United States Patent 12,397,048 (BUNYAVIRALES VACCINE) - sequence listing, part 12

SEQ ID NO: 13429 - RNA, 3447 nt, synthetic construct
  misc_feature 1..3447: note = derived and/or modified CDS sequence (opt5) from PUUV(CG17/Baskiria-2001)__AF442614.1__GP
  source 1..3447: mol_type = other RNA
atgggcgagctgagccccgtgtgcctctacctgcttctgcaggggctcctgctttgtaacaccggagccgctagaaatctgaacgaactcaagatggagtgccctcacacaatcggcctggggcaaggactggtcgttggctccgtggaactcccgtctctgcccattcaacaggtggagacgcttaaactggaaagctcctgtaatttcgacctccatacctctacagccgggcagcagagctttaccaagtggacatgggagatcaaaggagatctggcggagaacacccaggcttcctctaccagcttccagaccaagtccagcgaagtcaatcttcggggcctgtgcctcattcctacgctggtggttgagaccgccgcccgcatgagaaaaacaatcgcttgttatgacctgtcttgcaaccagaccgtgtgtcaacccacagtctacctcatgggccctattcagacctgcatcacgacaaagtcctgtctgcttagcctgggggatcagcggatccaggtgaattatgaaaagacctactgcgtttctggacaactcgtggagggcatttgttttaaccccatccacacaatggccctgtcccagcctagccatacctatgacattatgaccatgatggtccgctgcttccttgtgatcaaaaaggtgacatctggggattccatgaaaattgagaagaattttgaaacgctggtccagaaaaacggatgcaccgctaataacttccaaggctactatatctgtctcattgggagctcctctgagccgctgtacgttcccgccctggacgattacagaagcgcggaagtgctctcccggatggcctttgctcctcacggagaggaccatgatatcgaaaagaatgccgtgagcgctatgcgcatcgccggcaaggtcacaggcaaagcgccctctaccgagtccagcgacacagtgcaggggattgccttctctggaagccctctgtatacctccacgggcgttcttacatctaaggatgaccccgtgtacatctgggctccggggattatcatggagggaaaccacagcatttgcgagaaaaagaccctgcctctcacctggacaggctttatctccctgcccggggaaatcgagaaaaccacacagtgtacggtcttctgcacccttgccggacctggcgctgattgtgaagcctatagcgaaacaggcatttttaatatctcttcccccacatgcctgattaacagagtgcagcggttccgcggggccgagcaacagatcaagtttgtttgtcagagagtggacatggacattacagtctactgcaacggaatgaaaaaggtgatcctcaccaagacgctggtcatcggccagtgtatttataccttcacaagcatcttctctctgattcccggggtggctcactccctcgcggttgagctgtgcgtgcctggacttcatggctgggccaccatgctgctcctgctgacattttgtttcgggtgggtccttatcccgaccattacgatgatcctcctgaaaattctgatcgcttttgcctacctctgcagcaagtataatacagattccaaattccggatcctgattgaaaaggtgaaacgcgagtaccaaaagaccatgggctctatggtttgcgaagtgtgtcagtacgagtgcgaaacagccaaggagcttgagagccacagaaaatcctgttctatcggaagctgcccctattgtctgaacccttccgaagctaccaccagcgccctccaggcgcattttaaggtctgcaaactgacatctcggttccaggagaatctgcgcaagtcccttacggtgtacgaacccatgcaaggctgttatagaaccctcagcctgtttcggtacagatctcgcttctttgtggggctggtttggtgcgtcctcctggtgcttgagctgattgtgtgggctgcctccgccgagacacagaacctcaatgctggatggaccgacacagcccacggcagcgggatcattcctatgaaaaccgatctggaactggacttctctcttcccagctccgctagctatacgtaccggagacagctccagaacccggccaatgagcaagaaaagatcccttttcatctgcagctgtctaagcaggtcatccacgcggagattcaacacctcggacattggatggatgccacattcaacctgaaaaccgcttttcactgttatggctcctgcgaaaagtacgcctacccctggcagaccgctgggtgtttcatcgagaaagactatgagtacgaaacaggctggggatgcaatcctcccgattgccctggcgtggggaccggatgtacagcctgcggcgtttatcttgacaagctgaaaagcgtggggaaggtcttcaagattgtgtccctccgctacacgcggaaagtttgtatccagctgggaaccgagcagacatgcaagaccgtggattctaacgactgtctgattacaaccagcgtcaaagtgtgccttatcggcacgatctccaagtttcaaccctctgataccctcctgttcctggggccgctccagcagggcggactgatttttaaacagtggtgtacaaccacatgccaattcggcgaccctggggacatcatgagcacccccacaggaatgaagtgtcccgaacttaatggctcctttcgcaaaaagtgcgcgttcgccaccacgcctgtttgtcagtttgatgggaacacaatttctggatataagagaatgatcgctaccaaagacagcttccagtcctttaatgtgaccgagccgcatattagcacatctgccctggaatggatcgatcccgactccagcctccgggatcacatcaacgtcattgtgtctagagacctgtccttccaggatctgagcgagaccccttgccaaatcgaccttgctacggcctctattgatggcgcctgggggtccggcgtgggatttaatctggtctgcacagttagcctcaccgagtgttccgctttcctgacaagcatcaaggcgtgcgacgccgctatgtgttacggctctaccacagccaacctcgtgcgcgggcagaacaccattcacatcgtgggaaaaggcgggcatagcggatccaagtttatgtgctgtcacgatacgaaatgctctagcaccggcctggtcgccgctgcgccccatcttgaccacgtgacaggctataatcaggccgattccgacaagattttcgacgatggggctcctgaatgtggaatgtcttgctggttcaagaaaagcggcgagtggatcctgggggttctcaacggaaattggatggtggtcgccgtgctggttgtgctgcttatcctgtccattctcctgtttaccctctgttgcccccggagaccttcttaccgcaaggaacacaaaccctga

SEQ ID NO: 13430 - RNA, 3447 nt, synthetic construct
  misc_feature 1..3447: note = derived and/or modified CDS sequence (opt5) from PUUV(CG215/Omsk)__AF442615.1__GP
  source 1..3447: mol_type = other RNA
atgggcaagctgagccccgtgtgcctctacctgcttctgcagtgtctcctgcttggggacagaggagatgcccggaacctgaatgagctcaaaatggaatgccctcacaccatcggcctggggcaaggactggtcgttggctccgtggagctcccgcccgtgcctattcagcaggtcgaatctctgaaacttgagagctcctgtaacttcgacctgcatacatctacggctgggcagcaatcctttaccaaatggacatgggaaatcaagaatgatctcgccgagaacacccaggcgtcctctaccagcttccagacaaaatccagcgaggtgaatctgcgcggactttgcctgattcccacactcgttgtggaaaccgctgccagaacgcggaagaccatcgcctgttatgacctgacatgcaaccagaccgtctgtcaacctacagtgtacctgatgggccccattcagacctgcgttacgacaaagtcttgtctcctgggccttggggatcagcgcatccaggtgaattatgagaaaacctactgcgtctccggacaactggtggaaggcgtgtgttttaaccctatccacacaatggctctcagccagccgtctcatacctatgacgtcatgaccctgatggttagatgcttccttattatcaagaaagtgacatccggggatagcatgaagattgagaaaaattttgagacgctggtgcagaagaccggatgcacaggcaacaatttccaagggtactatatctgtctcattggatcttccagcgaacccctgtacgtccctaccctggacgattaccggtccgccgaggtgctctctcgcatggcttttgcgccccacggcgaagaccatgatatcgagaagaacgccgttagcacaatgagaattgccggcaaagtgaccgggcgggctccttccacggaagccagcgacacagtccagggaatcgctttctctggcagccccctgtataccagcaccggggtgcttacagccaaggatgacccggtttacatctgggcgcctggaattatcatggagggcaatcactctagctgcgacaaaaagaccctgcccctcacatggacggggtttatttccctgcctggagagatcgaaaagaccacacagtgtaccgtgttctgcacacttgccggccccggcgctgattgtgaggcctattctgaaaccgggatttttaacatcagctcccccacgtgcctgatcaatcgcgtccagagattccggggagctgagcaacagattaagtttgtgtgtcagcgcgtcgacatggatatcattgtgtactgcaacggcatcaaaaaggttattctcaccaagacactggtgatcgggcagtgtatctataccttcacaagcattttctctctgatccctggagtcgcccactccctcgccgtggaactgtgcgttccgggccttcatgggtggaccacgatgctgctcctgctgacattttgtttcggctgggtgcttattccctttatcaccatgattctcctgaaaatcctgattgctttcgcgtacctctgcagcaagtataacacagactctaaatttagaatcctggtcgagaaggtgaaaaaggagtaccaaaagaccatgggatccatggtgtgcgaagtttgtcagtacgagtgcgaaaccgccaaagagcttgaaagccaccggaagtcctgttctatcggcagctgcccttattgtctgaatccctccgaggctacaacgtctgccctccaggcccatttcaaagtctgcaagctgaccagccgctttcaggagaacctgagaaaatcccttacagtgtacgaacctatgcaagggtgttatcggaccctcagcctgttcagataccgctctaagtttttcgtgggactggtctggtgcctcctgcttgtgatggagctgattgtttgggctgcctccgcggaaacacagaatctcaacagcggctggaccgatacggctcacgggtctggaatcattcccatgaagacagacctggagctggatttttcccttccgagctctgccagctatacctaccggagacagctccagaatcctgccaacgagcaagaaaagatccccttccatctgcagatttccaaacaggtgatccacgctgagatccaacacctgggccattggatggacgccacctttaatctcaaaacagctttccactgttatgggagctgcgaaaagtacgcctacccttggcagaccgcgggctgtttcattgagaaagattatgaatacgagacaggatggggctgcaatccccctgactgccccggggtcggaacgggctgtaccgcctgcggggtgtatctggataaacttaagtctgttggaaaagtgtttaagatcgtctccctgaaatacacacgcaaggtgtgtattcagctcggcaccgagcagacatgcaaaaccgttgacagcaacgactgtctgatcacgacctccgtgaaggtctgcatgattgggacaatctctaaattccaaccgagcgataccctgctttttctcggccctctgcagcagggaggcctgatcttcaagcagtggtgtacaaccacatgccaatttggggaccccggagatattatgtccacccccacgggcatgaagtgtcctgaactcaacgggtctttccggaaaaagtgcgcttttgccacaaccccggtgtgtcagttcgacggaaataccatcagcggctataaaagaatgattgctacaaaggattcctttcagtctttcaacgtgaccgagccccatatcagcgcctccgcgctggaatggattgaccctgatagctctcttcgcgaccacatcaatgtcgttgtggggcgggatctgtcctttcaggacctcagcgagacgccctgccaagtggatctgatgacatctaccatcgacggcgcctggggatccggcgtcgggttcaacctggtgtgcacagttagccttaccgaatgttctccttttctgacatccattaaggcttgcgatagcgccatgtgttacggatccaccacggtgaatctcgtcagaggccagaacaccgtgcacatcgttgggaagggaggccatagcggctctaagttcatgtgctgtcacgacacaaaatgcagctccaccgggctggtggctgccgctccccatctcgaccgcgtcacaggatataaccaggccgattctgacaagattttcgatgacggcgcgcctgagtgtgggatgagctgctggtttaaaaagtccggagagtggatcctgggcgtgcttaatgggaactggatggttgtggccgtcctgattgctctcctgatcctgtctattcttatgttcaccctgtgttgcccccggagaccgagctaccgcaaagaacacaagccttga

SEQ ID NO: 13431 - RNA, 3447 nt, synthetic construct
  misc_feature 1..3447: note = derived and/or modified CDS sequence (opt5) from PUUV(CG222/Omsk)__AF442616.1__GP
  source 1..3447: mol_type = other RNA
atgggcaagctgagccccgtgtgcctctacctgcttctgcagtgtctcctgcttggggacagaggagatgcccggaacctgaatgagctcaaaatggaatgccctcacaccatcggcctggggcaaggactggtcgttggctccgtggagctcccgcccgtgcctattcagcaggtcgaatctctgaaacttgagagctcctgtaacttcgacctgcatacatctacggctgggcagcagagctttaccaaatggacatgggaaatcaagaatgatctcgccgagaacacccaagcgtcctctaccagcttccagacaaaatccagcgaggtgaatctgcgcggactttgcctgattcccacactcgttgtggaaaccgctgccagaacgcggaagaccatcgcctgttatgacctgacatgcaaccagaccgtctgtcaacctacagtgtacctgatgggccccattcagacctgcgttacgacaaagtcttgtctcctgggccttggggatcagcgcatccaggtgaattatgagaaaacctactgcgtctccggacaactggtggaaggcgtgtgttttaaccctatccacacaatggctctcagccagccgtctcatacctatgacgtcatgaccctgatggttagatgcttccttattatcaagaaagtgacatccggggatagcatgaagattgagaaaaattttgagacgctggtgcagaagaccggatgcacaggcaacaatttccaagggtactatatctgtctcattggatcttccagcgaacccctgtacgtccctaccctggacgattaccggtccgccgaggtgctctctcgcatggcttttgcgccccacggcgaagaccatgatatcgagaagaacgccgttagcacaatgagaattgccggcaaagtgaccgggcgggctccttccacggaagccagcgacacagtccagggaatcgctttctctggcagccccctgtatacctccaccggggtgcttacagccaaggatgacccggtttacatctgggcgcctggaattatcatggagggcaatcactctagctgcgacaaaaagaccctgcccctcacatggacggggtttatttccctgcctggagagatcgaaaagaccacacagtgtaccgtgttctgcacacttgccggcccccgcgctgattgtgaggcctattctgaaaccggcatttttaacatcagctcccccacgtgcctgatcaatagagtccagcggttccgcggggctgagcaacagattaagtttgtgtgtcagagagtcgacatggatatcattgtgtactgcaacggaatcaaaaaggttattctcaccaagacactggtgatcggccagtgtatctataccttcacaagcattttctctctgatccctggggtcgcccactccctcgccgtggaactgtgcgttccgggacttcatggctggaccacgatgctgctcctgctgacattttgtttcgggtgggtgcttattccctttatcaccatgattctcctgaaaatcctgattgctttcgcgtacctctgcagcaagtataacacagactctaaatttcggatcctggtcgagaaggtgaaaaaggagtaccaaaagaccatgggctccatggtgtgcgaagtttgtcagtacgagtgcgaaaccgccaaagagcttgaaagccaccgcaagtcctgttctatcggaagctgcccttattgtctgaatccctccgaggctacaacgtctgccctccaggcccatttcaaagtctgcaagctgaccagcagatttcaggagaacctgcggaaatcccttacagtgtacgaacctatgcaaggctgttatagaaccctcagcctgttccgctaccggtctaagtttttcgtggggctggtctggtgcctcctgcttgtgatggagctgattgtttgggctgcctccgcggaaacacagaatctcaacagcggatggaccgatacggctcacggctctgggatcattcccatgaagacagacctggagctggatttttcccttccgagctctgccagctatacctacagacgccagctccagaatcctgccaacgagcaagaaaagatccccttccatctgcagatttccaaacaggtgatccacgctgagatccaacacctgggacattggatggacgccacctttaatctcaaaacagctttccactgttatggcagctgcgaaaagtacgcctacccttggcagaccgcggggtgtttcattgagaaagattatgaatacgagacaggctggggatgcaatccccctgactgccccggcgtcgggacgggatgtaccgcctgcggcgtgtatctggataaacttaagtctgttgggaaagtgtttaagatcgtctccctgaaatacacacggaaggtgtgtattcagctcggaaccgagcagacatgcaaaaccgttgacagcaacgactgtctgatcacgacctccgtgaaggtctgcatgattggcacaatctctaaattccaaccgagcgataccctgctttttctcgggcctctgcagcagggcggactgatcttcaagcagtggtgtacaaccacatgccaatttggcgaccccggggatattatgtccacccccacgggaatgaagtgtcctgaactcaacggctctttcagaaagaagtgcgcttttgccacaaccccggtgtgtcagttcgacgggaataccatcagcggatataaacgcatgattgctacaaaggattcctttcagtctttcaacgtgaccgagccccatatcagcgcctccgcgctggaatggattgaccctgatagctctcttcgggaccacatcaatgtcgttgtgggcagagatctgtcctttcaggacctcagcgagacgccctgccaagtggatctgatgacatctaccatcgacggggcctggggctccggagtcggcttcaacctggtgtgcacagttagccttaccgaatgttctgcttttctgacatccattaaagcctgcgatagcgctatgtgttacgggtccaccacggtgaatctcgtccgcggacagaacaccgtgcacatcgttggcaaagggggacatagcggctctaagttcatgtgctgtcacgacacaaagtgcagctccaccggcctggtggccgccgctcctcccctcgaccgggtcacagggtataaccaggcggattctgacaagattttcgatgacggagcccctgagtgtggcatgagctgctggtttaaaaagtccggggagtggatcctgggagtgcttaatggcaactggatggttgtggctgtcctgattgccctcctgatcctgtctattcttatgttcaccctgtgttgccccagacgcccgagctaccggaaagaacataagccttga

SEQ ID NO: 13432 - RNA, 3447 nt, synthetic construct
  misc_feature 1..3447: note = derived and/or modified CDS sequence (opt5) from PUUV(CRF161)__AF367061.1__GP
  source 1..3447: mol_type = other RNA
atgggcaagctgagccccgtgtgcctctacctgcttctgcagtgtctcctgcttggggacagaggagatgcccggaacctgaatgagctcaaaatggaatgccctcacaccatcggcctggggcaaggactggtcgttggctccgtggagctcccgcccgtgcctattcagcaggtcgaatctctgaaacttgagagctcctgtaacttcgacctgcatacatctacggctgggcagcaatcctttaccaaatggacatgggaaatcaagaatgatctcgtggagaacacccaggcctcctctaccagcttccagacaaaatccagcgaggttaatctgcgcggactttgcctgattcccacactcgtggtcgaaaccgcggctagaacgcggaagaccatcgcctgttatgacctgacatgcaaccagaccgtgtgtcaacctacagtttacctgatgggccccattcagacctgcatcacgacaaagtcttgtctcctgggccttggggatcagcgcatccaggtgaattatgagaaaacctactgcgtctccggacaactggtggaaggcgtgtgttttaaccctattcacacaatggccctcagccagccgtctcatacctatgacgtcatgaccctgatggttagatgcttccttatcattaagaaagtgacatccggggatagcatgaagatcgagaaaaattttgagacgctggtgcagaagaccggatgcacaggcaacaatttccaagggtactatatttgtctcatcggatcttccagcgaacccctgtacgtccctaccctggacgattaccggtccgctgaggtgctctctcgcatggcctttgctccccacggcgaagaccatgatattgagaagaacgccgttagcacaatgagaatcgcgggcaaagtggccgggcgggctccttccaccgaagccagcgacacggtccagggaatcgctttctctggcagccccctgtatacaagcaccggggtgcttaccgccaaggatgacccggtttacatttgggcgcctggaatcattatggagggcaatcactctagctgcgacaaaaagacactgcccctcacctggacagggtttatctccctgcctggagagattcagaaaacgacccagtgtacagtgttctgcacccttgccggcccccgcgctgattgtcaagcctattctgaaacaggcatctttaacatcagctcccctacctgcctgattaatagagtccagcggttccgcggggctgagcagcagatcaagtttgtgtgtcaaagagtcgacatggatattatcgtgtactgcaacggaattaaaaaggttatcctcacgaagaccctggtgatcggccagtgtatttatacattcaccagcatcttctctctgattcccggggtcgcccactccctcgccgtggaactgtgcgttccgggacttcatggctggacaaccatgctgctcctgctgacgttttgtttcgggtgggtgcttatcccctttattacaatgatcctcctgaaaattctgatcgctttcgcgtacctctgcagcaagtataacaccgactctaaatttcggatcctggtcgagaaggtgaaaaaggaataccagaagacaatgggctccatggtgtgcgaggtttgtcagtacgagtgcgaaaccgccaaagagcttgaaagccaccgcaagtcctgttctattggaagctgcccttattgtctgaatccctccgaggctaccacatctgccctccaagcccatttcaaagtctgcaagctgacgagcagatttcaggaaaacctgcggaaatcccttaccgtgtacgagcctatgcagggctgttatagaacactcagcctgttccgctaccggtctaagtttttcgtggggctggtctggtgcctcctgcttgtgatggagctgatcgtttgggctgcctccgcggaaacccagaatctcaacagcggatggacagataccgctcacggctctgggattatccccatgaagacggacctggagctggatttttcccttccgagctctgccagctatacatacagacgccaactccagaatcctgccaacgaacaggagaaaattcccttccatctgcaaatctccaaacaggtgatccacgctgagattcagcacctgggacattggatggacgccacctttaatctcaagaccgctttccactgttatggcagctgcgaaaagtacgcctacccttggcagacagcggggtgtttcatcgagaaagattatgaatacgagaccggctggggatgcaatccccctgactgccccggcgtcgggacaggatgtacggcctgcggcgtgtatctggataaacttaagtctgttgggaaggtgtttaagattgtctccctgaaatacacccggaaggtgtgtatccaactcggaacagaacagacctgcaaaacagttgacagcaacgactgtctgattaccacgtccgtgaaggtctgcatgatcggcaccatctctaaattccagccgagcgatacactgcttattctcgggcctctgcagcaaggcggactgatctttaagcagtggtgtaccacaacctgccagttcggcgaccccggggatattatgtccacacccaccggaatgaagtgtcctgagctcaacggctcttttagaaagaagtgcgctttcgccacgacaccggtgtgtcagtttgacgggaataccatcagcggatataaacgcatgattgctaccaaggattccttccaatcttttaacgtgacagagccccatatcagcgcctccgcgctggaatggatcgaccctgatagctctcttcgggaccacattaatgtcgttgtgggcagagatctgtccttccaggacctcagcgagaccccctgccaggtggatctgatgacgtctacaatcgacggggcctggggctccggagtcggctttaacctggtgtgcaccgttagccttacagaatgttctgctttcctgacctccattaaagcctgcgatagcgctatgtgttacgggtccacaaccgccaatctcgtgaagggacaaaacacggtccacatggtgggcaaagggggacatagcggctctaagtttatgtgctgtcacgacaccaagtgcagctccacaggcctggttgccgctgcgcctcatctcgaccgcgtgaccgggtataaccaggccgattctgacaaaatcttcgatgacggagctcccgagtgtggcatgagctgctggttcaagaaatccggggaatggattctgggagtccttaatggcaactggatggtggttgccgtgctgatcgccctcctgattctgtctatccttatgtttacactgtgttgccctcggagacccagctaccgcaaggagcacaagccgtga

SEQ ID NO: 13433 - RNA, 3447 nt, synthetic construct
  misc_feature 1..3447: note = derived and/or modified CDS sequence (opt5) from PUUV(CRF308/Omsk)__AF442617.1__GP
  source 1..3447: mol_type = other RNA
atgggcaagctgagccccgtgtgcctctacctgcttctgcagtgtctcctgcttggggacagaggagatgcccggaacctgaatgagctcaaaatggaatgccctcacaccatcggcctggggcaaggactggtcgttggctccgtggagctcccgcccgtgcctattcagcaggtcgaatctctgaaacttgagagctcctgtaacttcgacctgcatacatctacggctgggcagcaatcctttaccaaatggacatgggaaatcaagaatgatctcgccgagaacacccaggcgtcctctaccagcttccagacaaaatccagcgaggtgaatctgcgcggactttgcctgattcccacactcgttgtggaaaccgctgccagaacgcggaagaccatcgcctgttatgacctgacatgcaaccagaccgtctgtcaacctacagtgtacctgatgggccccattcagacctgcatcacgacaaagtcttgtctcctgggccttggggatcagcgcatccaggttaattatgagaaaacctactgcgtgtccggacaactggtcgaaggcgtgtgttttaaccctattcacacaatggctctcagccagccgtctcatacctatgacgtgatgaccctgatggtcagatgcttccttatcattaagaaagttacatccggggatagcatgaagatcgagaaaaattttgagacgctggtgcagaagaccggatgcacaggcaacaatttccaagggtactatatttgtctcatcggatcttccagcgaacccctgtacgtgcctaccctggacgattaccggtccgccgaggtcctctctcgcatggcttttgcgccccacggcgaagaccatgatattgagaagaacgccgtgagcacaatgagaatcgccggcaaagttgctgggcgggccccttccaccgaagctagcgacacggtgcagggaatcgccttctctggcagccccctgtatacaagcaccggggtccttaccgcgaaggatgacccggtgtacatttgggcccctggaatcattatggagggcaatcactctagctgcgacaaaaagacactgcccctcacctggacagggtttatctccctgcctggagagattgaaaagacgacccagtgtacagttttctgcacccttgctggccccggcgccgattgtgaggcttattctgaaacagggatctttaacatcagctcccctacctgcctgattaatcgcgtgcagagattccggggagccgagcaacagatcaagtttgtctgtcagcgcgtggacatggatattatcgtctactgcaacggcattaaaaaggtgatcctcacgaagaccctggttatcgggcagtgtatttatacattcaccagcatcttctctctgattcccggaatcgcccactccctcgctgtggaactgtgcgtcccgggccttcatgggtggacaaccatgctgctcctgctgacgttttgtttcggctgggtgcttattccctttatcacaatgattctcctgaaaatcctgatcgcgttcgcctacctctgcagcaagtataacaccgactctaaatttcggattctggttgagaaggtgaaaaaggagtaccaaaagacaatgggatccatggtctgcgaagtgtgtcagtacgagtgcgaaaccgctaaagagcttgaaagccacagaaagtcctgttctatcggcagctgcccttattgtctgaatccctccgaggccaccacatctgccctccaggctcatttcaaagtgtgcaagctgacgagccgctttcaggagaacctgagaaaatcccttaccgtttacgaacctatgcaagggtgttatcggacactcagcctgttcagataccgctctaagtttttcgtcggactggtgtggtgcctcctgcttgtgatggagctgattgtctgggccgcgtccgctgaaacccagaatctcaacagcggctggacagataccgcccacgggtctggaatcattcccatgaagacggacctggagctggatttttcccttccgagctctgccagctatacataccggagacagctccagaatcctgctaacgagcaagaaaagatccccttccatctgcagatctccaaacaggtgattcacgccgagatccaacacctgggccattggatggacgctacctttaatctcaaaaccgccttccactgttatgggagctgcgaaaagtacgcgtacccttggcagacagccggctgtttcattgagaaagattatgaatacgagaccggatggggctgcaatccccctgactgccccggggttggaacaggctgtacggcttgcggggtgtatctggataaacttaagtctgtcggaaaagtgtttaagatcgtttccctgaaatacacccgcaaggtgtgtattcagctcggcacagagcagacctgcaaaacagtcgacagcaacgactgtctgatcaccacgtccgtgaaggtttgcatgatcgggaccatttctaaattccaaccgagcgatacactgctttttctcggccctctgcagcagggaggcctgatcttcaagcagtggtgtaccacaacctgccaatttggggaccccggagatattatgtccacacccaccggcatgaagtgtcctgaactcaacgggtctttccggaaaaagtgcgcctttgctacgacaccggtgtgtcagttcgacggaaataccatcagcggctataaaagaatgattgccaccaaggattcctttcagtctttcaacgtcacagagccccatatcagcgcgtccgccctggaatggatcgaccctgatagctctcttcgcgaccacattaatgtggtggtcgggcgggatctgtcctttcaggacctcagcgagaccccctgccaagttgatctgatgacgtctacaatcgacggcgcttggggatccggcgtggggttcaacctggtgtgcaccgtcagccttacagaatgttctgcctttctgacctccattaaggcttgcgatagcgccatgtgttacggatccacaaccgccaatctcgtgagaggccagaacacggttcacatcgtggggaagggaggccatagcggctctaagttcatgtgctgtcacgacaccaaatgcagctccacagggctggtcgctgcggcccctcatctcgaccgcgtgaccggatataaccaggctgattctgacaagattttcgatgacggcgcccccgagtgtgggatgagctgctggtttaaaaagtccggagagtggatcctgggcgttcttaatgggaactggatggtggtcgccgtgctgattgctctcctgatcctgtctatccttatgttcacactgtgttgccctcggagacccagctaccgcaaagaacacaagccgtga

SEQ ID NO: 13434 - RNA, 3447 nt, synthetic construct
  misc_feature 1..3447: note = derived and/or modified CDS sequence (opt5) from PUUV(Mu/07/1219)__KJ994777.1__GP
  source 1..3447: mol_type = other RNA
atggagaagatcattcccgtgtgcctgtacctccctttcctgtgtcttctgctctggagcagaggcgacacccggaacctgaatgaacttaaaatggagtgcccgcacacaatcgggctgggacagggcctcgtcattgggtccatcgaactgccccctgttcccctgattcaagtggagtctctcaagctggaaagctcctgtaactttgatcttcatacgtctaccagctcccagcaggccttcacaaaatggacctgggaggtgaagtctgacctggctgagaatacacaggccagctccaccagctttcaaacaaaatcttccgaagtcaacctccgcggactgtgccttgtgcctcccctggttatcgagaccgcggctagaacgcggaagaccatcgcctgtttcgatctcagctgcaatcagacaacctgtcagcctacagtgtttctgatgggcccgattcagacctgcatcacgacaaagtcttgtctgctcgggctgggagaccaacgcattcaggtcaactatgaaaagacctactgcgtgtccggccagcttatcgagggcatttgtttcaatcccgttcacacaatggccctgagccagccttctcatacctatgatatcgtgaccgtcatggtgagatgctttctcattgtgaagaaagtcacaacgggggactccatgaagatcgagaaatccttcgaaaccctggttcaaaagacaggatgcaccgataacggctttcaggggtactatgtgtgtcttatcggaagctctagcgagcccctgtacattcctacactcgacgattatcggtccgctgaagtgctgagccgcatggccttcgctccccacggcgaggaccatgatatcgaaaagaatgccatttctgcgatgagaatcgtcgggaaagtgaccggaaaggccccgtccacggagagctctgacacagttcagggcattgcttttagcggcaaccctctgtacacctccaccggggtgctcacagccaaagatgaccccgtctacgtgtgggctcctggaatcatgatggagggcaatcactctgtttgcgaaaagaaaaccctgccccttacatggacggggttcatccccctgcctggagagattgaaaagaccacacaatgtaccgtgttttgcacactcgccggcccgggggcggactgtgaggcctatagcgaaaccggaatcttcaacatttccagccccacgtgcctgatcaatcgggtccagcgcttcagaggcgctgagcagcagattaaatttatctgtcaacgggtggatatggacatcaccgtctactgcaacggccttaagaaggtgattctgacaaaaaccctcgttatcgggcagtgtatttatacattcacctctatcttttccctgattcctggagtggcccacagcctggctgtcgagctctgcgtgcccggcctgcatgggtgggccacgatgcttctgctcctgacattctgttttggatggatcctgattcctttctttgccatgatccttctcaaggttctgatcgctctggcgtacctctgctctaaatataataccgattccaagttcaaagtgctgattgaaaaggtcaagaaagagtaccagaagacaatgggcagcatggtgtgcgaagtgtgtcagtatgagtgcgaaaccgccaaagagcttgagtcccaccgcaagtcttgtcccatggggagctgcccgtactgtctgaaccctgctgaagccaccacatccgccctccaagctcattttaaagtttgcaagctgacgtctagattccaggacaacctgagaaagagccttggcgcctacgagcccaaacagggatgttatcgcaccctctccctgtttagataccggagcagattctttgtcggcttcatctggtgcctgctcctggtgcttgaactgattgtgtgggcggcttctgccgagacacagaatctcaactccgggtggaccgatacagcccacggaagcggcgtcatccctatgcgcaccgacctggagctggatttctctcttccctccagcgcttcttatacgtaccggagacaactccagaatcctgccaacgaacaggagaagattccctttcaccttcagatcagcaaacaagtgatccatgctgaaattcagcacctggggcattggatggacggaacattcaatctcaagaccgcctttcactgttatggctcctgcgagaaatacgcgtatccgtggcagaccgccgggtgtttcgttgaaaaggattacgagtacgagagcggctggggatgcaaccctgctgactgccccggcgtggggacaggatgtaccgcctgcggcgtctatctggataagctgaaatctgtggggaaggcttttaaaatcgtttccctgcgctacacacggaaggcctgtattcaactcggaacggaacagacctgcaaaaatgtggacagcaacgactgtctggtcacaacctccgtgaaggtttgcctgatcggcacagtgtctaaattccagcccagcgatacccttctctttctggggcctctggagcagggcggactcattttcaagcaatggtgtacgaccacatgccagtttggcgacccgggggatatcatgtccacccccgtcggaatgaagtgtcctgaactgtctggcagcttccggaaaaagtgcgcgtttgccacaacccccgtgtgtcagttcgacgggaatacaatctccggatataaacgcatgattgctaccaaggattcttttcagagcttcaacgtgacggagcctcatatctccgccagctctcttgaatggattgaccccgattccagcctgcgggaccacatcaatgtcattgttggcagagatctctctttccaagacctgtccgagacaccttgccaggtggatctgaccaccacaagcatcgacggggcttggggctctggagtgggctttaaccttatctgctccgtcagcctgaccgagtgttccacgttcctcacaagcattaaagcctgcgattctgccatgtgttacgggagcaccacagctaatctggtgcgcggacagaacaccgttcacatcgtgggcaaagggggacattccggctctaagtttatgtgctgtcacgacacaaaatgcagctccaccggcctcgtcgcggccgctccccatctggaccgggtgacggggtataatcaggccgattctgacaagattttcgatgacggagccccggaatgtggcatcagctgctggtttaccaaatccggggagtggattcttggagttctgaacggcaactggatggtggtcgctgtgctcgttgccctgttcatcctgtctatttttcttttcacactgtgttgccctagacgccccagctacgcgaaggaacacaaaccttga

SEQ ID NO: 13435 - RNA, 3447 nt, synthetic construct
  misc_feature 1..3447: note = derived and/or modified CDS sequence (opt5) from PUUV(Puu/Kazan)__Z84205.1__GP
  source 1..3447: mol_type = other RNA
atgggcaagctgagccccgtgtgcctctacctgcttctgcaggggctcctgcttttcaacaccggaacagccagaaatctgaacgagctcaaaatggaatgtcctcacacgatcggcctggggcaaggactggtcgttggctccgtggagctcccgcccgtgcctattcagcaggtcgaaaccctgaagctggagtctagctgcaattttgacctgcatacatccaccgctgggcagcaagccttcacaaaatggacctgggaaatcaagggagatctcgcggagaacacacaggcttctagcacctcctttcagacgaaatctagcgaggtgaatctgcggggcctttgtctgattcccaccctcgttatcgaaacagccgcccgcatgagaaagaccattgcttgctatgacctgtcctgtaaccagacagtgtgccaacctaccgtctacctgatgggccccatccagacgtgtatcacaaccaagagctgcctcctggggcttggagatcagcggattcaggtgaattatgagaaaacatactgtgtttctggccaactggtggaaggggtctgcttcaaccctatccacaccatggccctctcccagccgagccatacctatgacattgtgacaatgatggtgcgctgttttctggtcatcaagaaagttacgtctggagattccatgaagattgagaaaaatttcgagacccttgtgcagaagaacggctgcacagctaatagctttcaagggtactatatctgcctgattggatcttccagcgaacccctctacgtgcctaccctggacgattacagatccgccgaggtcctgtctcggatggcgttcgctccccacggcgaagaccatgatgtggagaagaacgccatcagcgccctccgcatcgctggcaaagttacagggaaggccccttccaccgaaagctctgacacggtgcagggagtcgcgttttccggcagccccctgtatacatctaccggggtgcttaccgccaaagatgacccggtttacatttgggctcctggaatcattatggagggcaatcacagcgtgtgtgagaagaaaacactgcccctcacctggacagggttcatctccctgcctggagaaattgagaagacgacccagtgcacagtcttttgtacccttgccggccccggcgctgattgcgaagcctattctgagacagggatcttcaacatcagctcccccacctgtctgattaatagagtgcagcggtttcgcggagccgaacaacagatcaaattcgtctgccagagagtggacatggacattacggtttactgtaacggcgtgaagaaggtcatcctcaccaaaacactggtgattgggcagtgcatctataccttcacaagcatcttttctctgattcctggagttgctcactccctcgcggtggagctgtgtgtcccgggccttcatgggtgggccaccatgctgctcctgctgacgttctgctttggctgggtgcttatccccacaattaccatgatcctcctgaagattctgatcgctttcgcctacctctgtagcaaatataacacagattctaagtttcggattctgatcgagaaagtgaagaaggaataccaaaagaccatgggatccatggtttgcgaggtctgccagtacgaatgtgagaccgccaaggaacttgagagccaccgcaaatcctgctctatcggcagctgtccttattgcctgaatccctccgaggctacaacgtctgccctccaggcgcatttcaaggtgtgtaaactgaccagccggattcaggaaaacctgagaaagtcccttacagtgtacgagcctatgcaagggtgctatcgcaccctcagcctgtttagataccggtctagattctttgtcggactggtgtggtgtgttctcctggtgcttgaactgatcgtctgggctgcctccgccgagacacagaatctcaacgctggctggaccgacacggcccacgggagcggaattatccccatgaagacagatctggagctggacttctctcttccgtccagcgcttcttatacctaccgccggcagctccagaatcctgccaacgaacaagagaatattccctttcaccttcagatcagcaaacaggtgatccatgcggaaattcaacacctgggccattggatggatgccaccttcaacctcaagacagcttttcactgctatgggtcctgtgagaaatacgcctacccttggcagaccgctggctgcttcgttgaaaaggactatgagtacgagacaggatggggctgtaatccccctgattgccccggggtgggaacgggctgcaccgcctgtggggcgtatctggacaaacttaagagcgtcggaaaggtgttcaaaatcgtttctctgagatacacacgcaaggtgtgcattcagctcggcaccgaacagacatgtaaaaccgtcgattccaacgactgcctgatcacgaccagcgtgaaggtgtgtctgattgggacaatctccaaatttcaaccgtctgatacccttctcttcctgggccctctgcagcagggaggcctcatctttaagcagtggtgcacaaccacatgtcaattcggggaccccggagacattatgagcacccccacgggcatgaaatgccctgatctgaatgggtcctttcggaagaagtgtgccttcgctacaaccccggtctgccagtttgacggaaacaccatctctggctataaaagaatgattgccacaaaggatagcttccagtcctttaatgttaccgagccccatatctctgctagcgcccttgaatggattgaccctgattccagcctgcgcgaccacatcaacgtgatcgtgtctcgggatctctccttccaggacctgagcgagacgccctgtcaaattgatctgtctacagcctccatcgacggggcttggggcagcggagtcggctttaatcttgtgtgcaccgtttctctgacagaatgctccgcgttcctcaccagcattaaagcctgtgatgctgccatgtgctacgggtccacaaccgccaacctggtgagaggacagaacacgatccacattgtcggcaaagggggacatagcggctctaaatttatgtgttgccacgacaccaagtgtagcacaaccggcctcgtggctgccgcgcctcatctggatcgcgttacagggtataatcaggctgactccgacaagatcttcgatgacggagcccccgagtgcggcatgtcttgttggttcaaaaagagcggggagtggattcttggagtgctgaacggcaattggatggtcgtggccgttctcatcgctctgctgatcctttccattctgctctttaccctgtgctgtcctcggagaccctcttaccgcaaagaacacaagccgtga

SEQ ID NO: 13436 - RNA, 3447 nt, synthetic construct
  misc_feature 1..3447: note = derived and/or modified CDS sequence (opt5) from PUUV(PUUV/Ardennes/Mg156/2011)__KT247603.1__GP
  source 1..3447: mol_type = other RNA
atgggcaagatcattcccgtgtgcctgtacctcctgttcctttgtctgctcctgtgggacagaggggatacccggaaccttaatgagctgaaaatggaatgccctcacacaatcggactcggccaggggctggtcattggaagcgttgagctgccgcccgtgcctctcacgcaagtggaatccctgaaacttgagtctagctgtaactttgacctgcatacctccacatctagccagcagtccttcaccaaatggacatgggaaatgaaggtcgatctcgccgagaatacccaggcttctagcacatcctttcaaaccaaaagctctgagatcaacctgcgcggcctttgcctggtgccccctctcgttattgaaacggccgcgagaacccggaagacaatcgcttgtttcgacctgtcctgcaatcagaccgcctgtcagcccacagtgtttctgatcgggcctattcagacctgcatcacgacaaagagctgtctcctgggacttggcgatcaacgcattcaggtcaactatgagaaaacctactgcgtgtctggccagctggttgaagggatctgtttcaatccggtgcacacaatggccctctcccagcccagccatacctatgacattgtcaccgtgatggtgagatgctttctgatcgtcaagaaagtttctacaggagattccatgaaacttgagaaatccttcgagacgctggtgcaaaagaccggctgcacagggaacggatttcagggctactatgtgtgtctcattgggtcctctagcgaacctctgtacatccccaccctggacgattatcggtccgctgaggtcctcagccgcatggccttcgctcctcacggagaagaccatgatatcgagaagaatgccatttctgcgatgagaatcgtgggcaaagttacaggcaaggccccctccaccgaaagctctgacacggtgcaggggattgcttttagcggaaacccgctgtacacatccaccggcgtccttaccgccaaagatgaccctatctacatttgggctcccgggatcatcatggagggaaatcactctgtgtgcgacaagaaaacactgcctctcacctggacaggcttcattcccctgcccggggagatcgaaaagacgacccaatgtacagtgttttgcacccttgccggacctggcgcggattgtgaggcctatagcgaaacaggcattttcaacatctccagcccgacctgcctgattaatcgggttcagcgcttcagaggggctgagcagcagatcaaatttatctgtcaacgggtcgacatggatattacggtgtactgcaacggactcaagaaggtcatcctgaccaaaacactggtgattggccagtgtatctataccttcacatctatttttagcctcatccccggggttgcccacagcctggctgtggaactttgcgtccctggactgcatggctgggccaccatgctcctgctgcttacgttctgttttgggtggattctcatccccttcttttctatgatcctgctgaagattctcatcgccttcgcttacctgtgctccaaatataatacagacagcaagtttaaaattcttatcgagaaggtgaagaaagagtaccagaagaccatgggctccatggtttgcgaagtgtgtcagtatgagtgcgaaacagcgaaagagctggaatctcaccgcaagagctgtcctatgggatcctgcccctactgtctcaacccggccgaggctaccacctctgccctgcaagcccatttcaaagtctgcaagctgacaagcagatttcaggataaccttcggaagtccctcggcgcttacgagcctaaacaggggtgttatcgcacgctgagcctgttcagataccggtctagatttttcgtgggattcatttggtgctttctcctggtgcttgaactgatcgtttgggccgcgtccgctgagacccagaatctcaacagcggctggacagacaccgcccacgggtctggaatcattcccatgcgcacagatctggaactggacttctcccttcctagctctgccagctatacctaccggagacaactccagaatcccgctaacgagcaggagaagatcccttttcatctgcagatttccaaacaagtcatccacgccgaaattcagcacctgggccattggatggatgggacgttcaatctcaagacagcttttcactgttatggcagctgcgagaaatacgcctatccctggcagaccgcgggatgtttcgtggaaaaggactacgagtacgaatctggctgggggtgcaacccgcctgattgccccggagtgggcaccgggtgtacagcctgcggagtctatctggacaaacttaagtccgtgggcaaggcttttaaaatcgttagcctgcgctacacccggaaggcctgtatccaactcgggacagagcagacgtgcaaatccgtggactctaatgattgtctggtcaccacaagcgtgaaggtttgcctgattggcaccgtgtccaaattccagccctctgacacacttctctttctgggacctctggagcagggcgggctcatcttcaagcaatggtgtaccacgacctgccagtttggagatccgggcgacattatgagcacacccgtcgggatgaagtgtcctgaactgtccggatctttcagaaagaagtgcgcttttgccaccacacccgtgtgtcagttcgatggcaacacccttagcgggtataaacgcatgatcgcgacaaaggactccttccagagctttaatgttaccgagcctcatatttctgcctccagcctggaatggatcgatcccgactcttccctccgggatcacatcaacgtgattgtcggcagagacctgagcttccaagatctgtctgagacgccttgccaggtggaccttgctacatccagcatcgatggagcctggggctccggggtgggatttaatctggtctgcagcgtttctctcaccgaatgtagcaccttcctgacatccattaaggcttgcgactctgccatgtgttacggcagcaccacggccaacctcctgcgcgggcagaatacagtgcacatcgtgggaaagggcggccattccgggtctaagtttatgtgctgtcacgacaccaaatgcagctccacaggacttgtcgctgcggctccccatctggatcgggtgaccggctataaccaggccgactctgataagattttcgacgatggggccccggagtgtggaatcagctgctggtttacaaaatccggcgagtggattctcggggttctgaatggaaactggatggtggtcgccgtgctggttgctcttttcatcctgagcatctttctcttcaccctgtgttgccctagacgcccctcttacgccaaggaacacaaaccttga

SEQ ID NO: 13437 - RNA, 3447 nt, synthetic construct
  misc_feature 1..3447: note = derived and/or modified CDS sequence (opt5) from PUUV(PUUV/Ardennes/Mg75/2011)__KT247602.1__GP
  source 1..3447: mol_type = other RNA
atgggcaagatcattcccgtgtgcctgtacctcctgttcctttgtctgctcctgtgggacagaggggatacccggaaccttaatgagctgaaaatggaatgccctcacacaatcggactcggccaggggctggtcattggaagcgttgagctgccgcccgtgcctctcacgcaagtggaatccctgaaacttgagtctagctgtaactttgacctgcatacctccacatctagccagcagtccttcaccaaatggacatgggaaatgaaggtcgatctcgccgagaatacccaggcttctagcacatcctttcaaaccaaaagctctgagatcaacctgcgcggcctttgcctggtgccccctctcgttattgaaacggccgcgagaacccggaagacaatcgcttgtttcgacctgtcctgcaatcagaccgcctgtcagcccacagtgtttctgatcgggcctattcagacctgcatcacgacaaagagctgtctcctgggacttggcgatcaacgcattcaggtcaactatgagaaaacctactgcgtgtctggccagctggttgaagggatctgtttcaatccggtgcacacaatggccctctcccagcccagccatacctatgacattgtcaccgtgatggtgagatgctttctgatcgtcaagaaagtttctacaggagattccatgaaacttgagaaatccttcgagacgctggtgcaaaagaccggctgcacagggaacggatttcagggctactatgtgtgtctcattgggtcctctagcgaacctctgtacatccccaccctggacgattatcggtccgctgaggtcctcagccgcatggccttcgctcctcacggagaagaccatgatatcgagaagaatgccatttctgcgatgagaatcgtgggcaaagttacaggcaaggccccctccaccgaaagctctgacacggtgcaggggattgcttttagcggaaacccgctgtacacatccaccggcgtccttaccgccaaagatgaccctatctacatttgggctcccgggatcatcatggagggaaatcactctgtgtgcgacaagaaaacactgcctctcacctggacaggcttcattcccctgcccggggagatcgaaaagacgacccaatgtacagtgttttgcacccttgccggacctggcgcggattgtgaggcctatagcgaaacaggcattttcaacatctccagcccgacctgcctgattaatcgggttcagcgcttcagaggggctgagcagcagatcaaatttatctgtcaacgggtcgacatggatattacggtgtactgcaacggactcaagaaggtcatcctgaccaaaacactggtgattggccagtgtatctataccttcacatctatttttagcctcatccccggggttgcccacagcctggctgtggaactttgcgtccctggactgcatggctgggccaccatgctcctgctgcttacgttctgttttgggtggattctcatccccttcttttctatgatcctgctgaagattctcatcgccttcgcttacctgtgctccaaatataatacagacagcaagtttaaaattcttatcgagaaggtgaagaaagagtaccagaagaccatgggctccatggtttgcgaagtgtgtcagtatgagtgcgaaacagcgaaagagctggaatctcaccgcaagagctgtcctatgggatcctgcccctactgtctcaacccggccgaggctaccacctctgccctgcaagcccatttcaaagtctgcaagctgacaagcagatttcaggataaccttcggaagtccctcggcgcttacgagcctaaacaggggtgttatcgcacgctgagcctgttcagataccggtctagatttttcgtgggattcatttggtgctttctcctggtgcttgaactgatcgtttgggccgcgtccgctgagacccagaatctcaacagcggctggacagacaccgcccacgggtctggaatcattcccatgcgcacagatctggaactggacttctcccttcctagctctgccagctatacctaccggagacaactccagaatcccgctaacgagcaggagaagatcccttttcatctgcagatttccaaacaagtcatccacgccgaaattcagcacctgggccattggatggatgggacgttcaatctcaagacagcttttcactgttatggcagctgcgagaaatacgcctatccctggcagaccgcgggatgtttcgtggaaaaggactacgagtacgaatctggctgggggtgcaacccgcctgattgccccggagtgggcaccgggtgtacagcctgcggagtctatctggacaaacttaagtccgtgggcaaggcttttaaaatcgttagcctgcgctacacccggaaggcctgtatccaactcgggacagagcagacgtgcaaatccgtggactctaatgattgtctggtcaccacaagcgtgaaggtttgcctgattggcaccgtgtccaaattccagccctctgacacacttctctttctgggacctctggagcagggcgggctcatcttcaagcaatggtgtaccacgacctgccattttggagatccgggcgacattatgagcacacccgtctccatgaagtgtcctgaactgtctgggagcttcagaaagaagtgcgcttttgccaccacacccgtgtgtcagttcgatggaaacaccctttccggctataaacgcatgatcgcgacaaaggacagcttccagtcttttaatgttaccgagcctcacatttccgccagctctctggaatggatcgatcccgactccagcctccgggatcacatcaacgtgattgtcgggagagacctgtctttccaggatctgtccgagacgccttgccaagtggaccttgctacaagctccatcgatggcgcctggggaagcggcgtggggtttaatctggtctgctctgttagcctcaccgaatgttccaccttcctgacatctattaaggcttgcgacagcgccatgtgttacggatccaccacggccaacctcctgcgcggccagaatacagtgcatatcgtggggaagggaggccactctggcagcaagtttatgtgctgtcatgacaccaaatgctcctctacagggcttgtcgctgcggctccccacctggatcgggtgaccggatataaccaggccgacagcgataagattttcgacgatggcgccccggagtgtgggatctcctgctggtttacaaaaagcggagagtggattctcggcgttctgaatgggaactggatggtggtcgccgtgctggttgctcttttcatcctgtctatctttctcttcaccctgtgttgccctagacgcccctcctacgccaaggaacacaaaccttga

SEQ ID NO: 13438 - RNA, 3447 nt, synthetic construct
  misc_feature 1..3447: note = derived and/or modified CDS sequence (opt5) from PUUV(PUUV/Jura/Mg2/2010)__KT247598.1__GP
  source 1..3447: mol_type = other RNA
atgggcaagatcattcccgtgtgcctgtacctcctgttcctttgtctgctcctgtggaacagaggggacacccggaatcttaacgagctgaaaatggaatgccctcacacaatcggactcggccaggggctggtcattggaagcgttgagctgccgcccgtgcctctcacgcaagtggaatccctgaaacttgagtctagctgtaattttgatctgcatacctccacatctagccagcagtccttcaccaagtggacatgggaaatgaagtctgacctcgccgagaacacccaggctagctccaccagctttcaaacaaaatcttccgagatcaatctgcgcggcctttgcctggtgccccctctcgtcattgaaacggccgcgagaacccggaagacaatcgcttgtttcgatctgagctgcaaccagaccgcctgtcagcccacagtttttctgatcgggcctattcagacctgcctcacgacaaagtcttgtctgcttggactgggcgaccaacgcatccaggtgaattatgagaaaacctactgcgtctccggccagctcgtggaaggggtttgtttcaacccgattcacacaatggccctgagccagccctctcatacctatgatatcgtgaccgtcatggtgagatgctttcttattgtgaagaaagtctccacaggagacagcatgaagatcgagaaatccttcgagacgctggttcaaaagaccggctgcacagggaatggatttcagggctactatgtgtgtctcattgggtctagctccgaacctctgtacatccccaccctggatgactatcggagcgctgaggtgctctctcgcatggccttcgctcctcacggagaagatcatgacatcgagaagaacgccatttccgcgatgagaatcgtcggcaaagtgacaggcaaggcccccagcaccgaatctagcgatacggttcaggggattgctttttccggaaatccgctgtacacatctaccggcgtgcttaccgccaaagacgatcctatctacatttgggctcccgggatcatcatggagggaaaccacagcgtctgcgagaagaaaacactgcctctcacctggacaggcttcattcccctgcccggggaaatcgagaagacgacccaatgtacagtgttttgcacccttgccggacctggcgcggactgtgaagcctattccgagacaggcattttcaatatcagctctccgacctgcctgattaaccgggttcagcgcttcagaggggctgaacagcagatcaaatttatctgtcaacgggtggacatggatattacggtctactgcaatggactcaagaaggtgatcctgaccaaaacactggtcattggccagtgtatctataccttcacatccatttttagcctcatccccggggtggcccactctctggctgttgagctttgcgtgcctggactgcatggctgggccaccatgctcctgctgcttacgttctgttttgggtggattctcatccccttcacagccatgctgctgctcaagatcctgattgcttttgcgtacctttgctccaaatataacaccgacagcaagttcaaaatcctgattgagaaggtcaagaaagaataccagaagacaatgggctccatggtgtgcgaggtttgtcagtatgaatgcgagaccgccaaagaactcgagtctcaccgcaagagctgtcctatgggatcctgcccctactgtctgaacccggctgaggccaccacatctgccctgcaagctcattttaaagtgtgcaaacttacgagcagattccaggataatctccggaagtccctgggcgcctacgaacctaagcaggggtgttatcgcaccctgagcctctttagataccggtctagattctttgtcggactggtgtggtgcttccttctggtgctcgagctgatcatttgggcggcttccgccgaaacacagaacctgaatagcggctggaccgacacagcccacgggtctggagttatccccatgcgcaccgatcttgagctcgacttctccctgcctagctctgctagctatacgtaccggagacaactgcagaaccccgccaatgagcaggaaaagatcccttttcacctccagatttccaaacaagtcatccatgctgagattcagcacctgggccattggatggatgggacattcaaccttaagaccgcctttcactgttatggcagctgcgaaaaatacgcgtatccctggcagaccgccggatgtttcgtggagaaggactacgaatacgagtctggctgggggtgcaatccgcctgattgccccggagtgggcacagggtgtaccgcttgcggagtctatctggacaagctcaaatccgtgggcaaggcctttcgcatcgttagcctgaaatacacacggaaggcttgtattcaactggggacggagcagacctgcaaatccgtggattctaacgactgtcttgtcacaaccagcgtgaaggtttgcctcatcggcacagtgtccaaattccagccctctgacaccctgctgtttctcggacctctggaacagggcgggcttatcttcaagcaatggtgtacgaccacatgccagtttggagatccgagagacattatgagcacccccgtcggcatgcgctgtcctgagctgtccgggtctttccggaagaaatgcgcctttgcgacaacccccgtgtgtcagttcgatggaaatacaatcagcggctataagagaatgattgccaccaaagactcctttcagagcttcaacgttacggaacctcatatctctgcttccagcctcgagtggattgatcccgactcttccctgcgcgatcacatcaatgtgatcgtcgggcgggacctgagcttccaagatctttctgaaacaccttgccaggtggacctgaccaccacatccattgatggcgcctggggaagcggcgtggggtttaacctcatctgctccgtcagcctgaccgagtgttctacgttcctcacaagcattaaggcttgcgactccgccatgtgttacggatctaccacagccaatctgatgagaggccagaacaccatccacattgttgggaaaggaggccatagcggctccaagtttatgtgctgtcacgatacaaagtgctctagcaccgggcttgtggctgcggctccccatctggaccgcgtgacgggatataatcaggccgactccgataaaatcttcgacgatggcgccccggagtgtgggatttcttgctggtttaccaagagcggagaatggatcctcggcgtcctgaacgggaactggatggtggttgccgtgctggtcgtgcttttcatcctgtccatttttctcttcacactgtgttgccctcggagacccagctacgctaaagagcacaagccttga

SEQ ID NO: 13439 - RNA, 3447 nt, synthetic construct
  misc_feature 1..3447: note = derived and/or modified CDS sequence (opt5) from PUUV(PUUV/Jura/Mg214/2010)__KT247599.1__GP
  source 1..3447: mol_type = other RNA
atgggcaagatcattcccgtgtgcctgtacctcctgttcctttgtctgctcctgtggaacagaggggacacccggaatcttaacgagctgaaaatggaatgccctcacacaatcggactcggccaggggctggtcattggaagcgttgagctgccgcccgtgcctctcacgcaagtggaatccctgaagctggagtctagctgtaattttgatctgcatacctccacatctagccagcagtccttcaccaaatggacatgggaaatgaagtctgacctcgccgagaacacccaggctagctccaccagctttcaaacaaaatcttccgagatcaatctgcgcggcctttgcctggtgccccctctcgtcattgaaacggccgcgagaacccggaagacaatcgcttgtttcgatctgagctgcaaccagaccgcctgtcagcccacagtttttctgatcgggcctattcagacctgcctcacgacaaagtcttgtctgcttggactgggcgaccaacgcatccaggtgaattatgagaaaacctactgcgtctccggccagctcgtggaaggggtttgtttcaacccgattcacacaatggccctgagccagccctctcatacctatgatatcgtgaccgtcatggtgagatgctttcttattgtgaagaaagtctccacaggagacagcatgaagatcgagaaatccttcgagacgctggttcaaaagaccggctgcacagggaatggatttcagggctactatgtgtgtctcattgggtctagctccgaacctctgtacatccccaccctggatgactatcggagcgctgaggtgctctctcgcatggccctggctcctcacggagaagatcatgacatcgagaagaacgccatttccgcgatgagaatcgtcggcaaagtgacaggcaaggcccccagcaccgaatctagcgatacggttcaggggattgctttctccggaaatccgctttacacatctaccggcgtgctgaccgccaaagacgatcctatctacatttgggctcccgggatcatcatggagggaaaccacagcgtctgcgagaagaaaacactccctctgacctggacaggctttattccccttcccggggaaatcgagaagacgacccaatgtacagtgttctgcaccctggccggacctggcgcggactgtgaagcctattccgagacaggcatttttaatatcagctctccgacctgcctcattaaccgggttcagcgcttcagaggggctgaacagcagatcaaattcatctgtcaacgggtggacatggatattacggtctactgcaatggactgaagaaggtgatcctgaccaaaacactcgtcattggccagtgtatctatacctttacatccattttcagcctgatccccggggtggcccactctcttgctgttgagctgtgcgtgcctggactccatggctgggccaccatgctgctgcttctcacgttttgtttcgggtggattctgatcccctttacagccatgctgctcctgaagatccttattgctttcgcgtacctgtgctccaaatataacaccgacagcaagtttaaaatcctcattgagaaggtcaagaaagaataccacaagtccatgggctctatggtgtgcgaggtttgtcagtatgaatgcgagacagccaaagaactggagagccatcgcaagtcctgtcctatgggatcttgcccctactgtctgaacccggctgaggccaccaccagcgcccttcaggctcacttcaaagtgtgcaagctcacatccagatttcaagataatctgcgcaagagcctgggcgcctacgaacctaaacaggggtgttatcggacgctctctctgttcagataccggtccagatttttcgtcggacttgtgtggtgctttctgctcgtgctggagctgatcatttgggcggctagcgccgaaacccagaaccttaattctggctggacagacaccgcccacgggtccggagttatccccatgcgcacagatctcgagctggacttcagcctgccttctagcgcttcctatacctaccggagacagctccaaaaccccgccaatgagcaggaaaagatccctttccatctgcagattagcaaacaggtcatccacgctgagattcaacatcttggccactggatggatgggacgtttaacctgaagacagccttccattgttatggctcttgcgaaaaatacgcgtatccctggcagaccgccggatgttttgtggagaaggactacgaatacgagtccggctgggggtgcaatccgcctgattgccccggagtgggcaccgggtgtacagcttgcggagtctatctcgacaagctgaaaagcgtgggcaaggccttccgcatcgtttccctgaaatacacccggaaggcttgtattcagcttgggacagagcaaacgtgcaaatctgtggatagcaacgactgtctcgtcaccacatccgtgaaggtttgcctgatcggcaccgtgtctaaatttcagcccagcgacacacttctcttcctgggacctcttgaacagggcgggctgatctttaagcagtggtgtaccacgacctgccaattcggagatccgggcgacattatgtccacacccgtcgggatgagatgtcctgagctctctggcagctttcgcaagaaatgcgccttcgcgaccacacccgtgtgtcagtttgatggaaataccatctccgggtataagcggatgattgccacaaaagacagcttccagtcttttaacgttaccgaacctcacatctccgctagctctctggagtggattgatcccgactccagcctgagagatcacatcaatgtgatcgtcggccgcgacctttctttccaggatctgtccgaaacgccttgccaagtggacctcacaaccaccagcattgatggagcctggggctccggggtgggattcaacctgatctgcagcgtctctctcacagagtgtagcacctttctgacgtccattaaggcttgcgactctgccatgtgttacggcagcacaaccgccaatcttatgcgggggcagaacacaatccatattgttggaaaaggcggccactccgggtctaagttcatgtgctgtcatgataccaagtgcagctccacaggactggtggctgcggctccccacctcgacagagtgaccggctataatcaggccgactctgataaaatctttgacgatggggccccggagtgtggaattagctgctggttcacgaagtccggcgaatggatcctgggggtcctgaacggaaactggatggtggttgccgtgcttgtcgtgctgtttatcctcagcattttcctgtttaccctctgttgccctcgccggccctcttacgctaaagagcacaagccttga

SEQ ID NO: 13440 - RNA, 3447 nt, synthetic construct
  misc_feature 1..3447: note = derived and/or modified CDS sequence (opt5) from PUUV(PUUV/Orleans/Mg23/2010)__KT247600.1__GP
  source 1..3447: mol_type = other RNA
atgggcaagatcattcccgtgtgcctgtacctcctgttcagatgtcttctgctctgggaccgggggaacgcccgcaatctgaacgagcttaaaatggaatgccctcacaccatcggactgggccaggggctcgtcattggaagcgttgagctgccgcccgtgcctctgacacaaatcgaatccctcaagctggagtctagctgtaattttgatcttcatacgtccacctctagccagcagtccttcacaaaatggacctgggaaattaagtctgacctggctgagaacacacaggccagctccaccagctttcaaacaaaatcttccgaggtgaatctcagaggcctgtgccttgtgccccctctggtcatcgaaaccgcggctcggacgcgcaagaccatcgcctgtttcgatctcagctgcaaccagacagcctgtcagcccaccgtttttctgattgggcctatccagacatgcattaccacgaagtcttgtctgctcggactgggcgaccaaagaatccaggtgaattatgagaaaacatactgcgtctccggccagcttattgaagggatctgtttcaacccggtgcacaccatggctctgagccagccctctcatacatatgatgttgtgaccgtcatggtgcggtgctttctcattgtgaagaaagtctccaccggagacagcatgaagatcgagaaatccttcgagacactggttcaaaagacgggctgcaccgggaatggatttcagggctactatgtgtgtcttatcgggtctagctccgaacctctgtacattcccacactcgatgactatcgcagcgccgaggtgctgtctagaatggctttcgcccctcacggagaagatcatgacatcgagaagaacgcgatttccgccatgcggatcgtcggcaaagtgaccggcaaggctcccagcacagaagcctctgataccgttcaggggattgcttttagcggaaatccgctgtacacgtccacaggcgtgctcaccgccaaagacgatcctatctacatctgggcgcccgggattatcatggagggaaaccactctgtctgcgagaagaaaaccctgcctcttacatggaccggcttcattcccctgcccggggaaatcgagaagacaacgcaatgtaccgtgttttgcacactcgccggacctggcgctgactgtgaagcctatagcgagaccggcattttcaatatctccagcccgacatgcctgatcaaccgcgttcagagattcagaggggctgaacagcagattaaatttatctgtcaacgcgtggacatggatattaccgtctactgcaatggacttaagaaggtgatcctgacgaaaaccttcattatcggccagtgtatttatacatttacctctatcttctccctcatccccggggtcgcccacagcctggccgtggagctgtgcgttcctggactccatggctgggctacaatgctgcttctgctcaccttttgtttcgggtgggtgctgattccctttttctctatgatcctgcttaagattctcatcgcgtttgcctacctgtgctccaaatataacacggacagcaagttccggattctgatcgagaaagtcaagcgggaataccagaagacaatgggctccatggtgtgcgaggtttgtcagtatgaatgcgagaccgctaaagaactcgagtctcaccgcaagagctgtcctatgggatcctgcccctactgtctgaacccggccgaggccacaacctctgcgcttcaagcccattttaaagtgtgcaagctgaccagcagattccaggataatctccggaaatccctgggcgcgtacgaacctaagcaggggtgttatagaacactgagcctttttcgctaccggtctagattcttcgtcggatttatctggtgcttcctcctggtgctggagctcattatctgggctgcctccgccgaaacgcagaacctgaatagcggctggaccgacacagctcacgggtctggagtgattcccatgcgcaccgatcttgagctggacttttccctccctagctctgccagctatacataccggagacaactgcagaaccccgctaatgagcaggaaaagatccctttccatctgcagatttccaaacaagttatccacgccgagatccagcaccttggccattggatggatgggacctttaacctcaagacggcgttccactgttatggcagctgcgaaaaatacgcctatccctggcagacagctggatgttttattgagaaggactacgaatacgagtctggctgggggtgcaatccgcctgattgccccggagtcggcaccgggtgtaccgcctgcggagtgtatctggacaaactgaagtccgtgggcaaggctttcaaaatcgtcagcctccgctacacacggaaggcctgtattcaactggggaccgagcagacatgcaaatccgtggattctaacgactgtcttgttacgaccagcgtgaaggtctgcctgatcggcacagtgtccaaatttcagccctctgacaccctcctgttcctgggacctcttgaacagggcgggctcatttttaagcaatggtgtacaaccacgtgccatttcggagatccgggcgacatcatgagcacccccgcggggatgaaatgtcctgagctgtccggatcttttacaaagaagtgcgccttcgctcccacccctgtttgtcagttcgatggcgacacaaccagcgggtataaaaagatgatcgccacaaaagattcctttcagagcttcaatgtgaccgaaccccacatttctgcttccagcctggagtggatcgaccctgatagatctctccgcgaccacattaacgtcatcgtgggccgggatctgtcctttcaggaccttagcgaaacgccctgccaagttgatctgacaaccacctctattgacggagcctggggctccggggtgggattcaatctcatctgcagcgtctccctgacagagtgtagcacctttctgacgtctattaaggcctgcgatagcgctatgtgttacggctccacaaccgcgaaccttctgagagggcagaatacagtgcatatcgtgggaaaaggcggccactctgggagcaagttcatgtgctgtcatgacaccaagtgctcctctacaggactcgtcgccgctgccccgcacctggaccgcgttaccggctataaccaggccgatagcgacaaaatctttgatgacggggctcctgagtgtggaatttcctgctggctcacgaagtctggcgaatggatcctgggggtgcttaatggaaactggatggtggtcgccgtgctggttgctctcttcatttttagcatcttcctgtttaccctgtgttgcccccggagaccttcctacgctaaagagcacaagccctga

SEQ ID NO: 13441 - RNA, 3447 nt, synthetic construct
  misc_feature 1..3447: note = derived and/or modified CDS sequence (opt5) from PUUV(PUUV/Orleans/Mg29/2010)__KT247601.1__GP
  source 1..3447: mol_type = other RNA
atgggcaagatcattcccgtgtgcctgtacctcctgttcagatgtcttctgctctgggaccgggggaacgcccgcaatctgaacgagcttaaaatggaatgccctcacaccatcggactgggccaggggctcgtcattggaagcgttgagctgccgcccgtgcctctgacacaaatcgaatccctcaagctggagtctagctgtaattttgatcttcatacgtccacctctagccagcagtccttcacaaaatggacctgggaaattaagtctgacctggctgagaacacacaggccagctccaccagctttcaaacaaaatcttccgaggtgaatctcagaggcctgtgccttgtgccccctctggtcatcgaaaccgcggctcggacgcgcaagaccatcgcctgtttcgatctcagctgcaaccagacagcctgtcagcccaccgtttttctgattgggcctatccagacatgcattaccacgaagtcttgtctgctcggactgggcgaccaaagaatccaggtgaattatgagaaaacatactgcgtctccggccagcttgtggaaggggtttgtttcaacccgattcacaccatggctctgagccagccctctcatacatatgatatcgtgaccgtcatggtgcggtgctttctcattgtgaagaaagtctccaccggagacagcatgaagatcgagaaatccttcgagacactggttcaaaagacgggctgcaccgggaatggatttcagggctactatgtgtgtcttatcgggtctagctccgaacctctgtacattcccacactcgatgactatcgcagcgccgaggtgctgtctagaatggctttcgcccctcacggagaagatcatgacatcgagaagaacgcgatttccgccatgcggatcgtcggcaaagtgaccggcaaggctcccagcacagaagcctctgataccgttcaggggattgcttttagcggaaatccgctgtacacgtccacaggcgtgctcaccgccaaagacgatcctatctacatctgggcgcccgggattatcatggagggaaaccactctgtctgcgagaagaaaaccctgcctcttacatggaccggcttcattcccctgcccggggaaatcgagaagacaacgcaatgtaccgtgttttgcacactcgccggacctggcgctgactgtgaagcctatagcgagaccggcattttcaatatctccagcccgacatgcctgatcaaccgcgttcagagattcagaggggctgaacagcagattaaatttatctgtcaacgcgtggacatggatattaccgtctactgcaatggacttaagaaggtgatcctgacgaaaaccttcattatcggccagtgtatttatacatttacctctatcttctccctcatccccggggtcgcccacagcctggccgtggagctgtgcgttcctggactccatggctgggctacaatgctgcttctgctcaccttttgtttcgggtgggtgctgattccctttttctctatgatcctgcttaagattctcatcgcgtttgcctacctgtgctccaaatataacacggacagcaagttccggattctgatcgagaaagtcaagcgggaataccagaagacaatgggctccatggtgtgcgaggtttgtcagtatgaatgcgagaccgctaaagaactcgagtctcaccgcaagagctgtcctatgggatcctgcccctactgtctgaacccggccgaggccacaacctctgcgcttcaagcccattttaaagtgtgcaagctgaccagcagattccaggataatctccggaaatccctgggcgcgtacgaacctaagcaggggtgttatagaacactgagcctttttcgctaccggtctagattcttcgtcggatttatctggtgcttcctcctggtgctggagctcattatctgggctgcctccgccgaaacgcagaacctgaatagcggctggaccgacacagctcacgggtctggagtgattcccatgcgcaccgatcttgagctggacttttccctccctagctctgccagctatacataccggagacaactgcagaaccccgctaatgagcaggaaaagatccctttccatctgcagatttccaaacaagttatccacgccgagatccagcaccttggccattggatggatgggacctttaacctcaagacggcgttccactgttatggcagctgcgaaaaatacgcctatccctggcagacagctggatgttttattgagaaggactacgaatacgagtctggctgggggtgcaatccgcctgattgccccggagtcggcaccgggtgtaccgcctgcggagtgtatctggacaaactgaagtccgtgggcaaggctttcaaaatcgtcagcctccgctacacacggaaggcctgtattcaactggggaccgagcagacatgcaaatccgtggattctaacgactgtcttgttacgaccagcgtgaaggtctgcctgatcggcacagtgtccaaatttcagccctctgacaccctcctgttcctgggacctcttgaacagggcgggctcatttttaagcaatggtgtacaaccacgtgccatttcggagatccgggcgacatcatgagcacccccgcggggatgaaatgtcctgagctgtccggatcttttagaaagaagtgcgccttcgctcccacacctgtttgtcacttcgatggcaaaaccatcagcgggtataagcgcatgattgccacaaaagactcctttcagagcttcaatgtgaccgaaccccacatctctgcttccagcctggagtggattgatcctgactcttccctccgggatcatatcaacgtcattgtgggcagagacctgagctttcaggatctttctgaaacaccctgccaggttgacctgaccacgacatccatcgatggagcctggggcagcggggtgggattcaatctcatttgctccgtcagcctgaccgagtgttctacctttctgacaagcatcaaggcctgcgactccgctatgtgttacggctctaccacggcgaaccttctgcgcgggcaaaatacagtgcacatcgtgggaaaaggcggccatagcgggtccaagttcatgtgctgtcacgataccaagtgctctagcacaggactcgtcgccgctgccccgcacctggaccgggttaccggctataaccaggccgactccgataaaatttttgacgatggggctcctgagtgtggaatctcttgctggctcacaaagagcggcgaatggattctgggggtgcttaatggaaactggatggtggtcgccgtgctggttgctctcttcatcttttccattttcctgtttaccctgtgttgccccagacggcctagctacgctaaagagcataagccctga

SEQ ID NO: 13442 - RNA, 3447 nt, synthetic construct
  misc_feature 1..3447: note = derived and/or modified CDS sequence (opt5) from PUUV(Vranica)__U14136.1__GP
  source 1..3447: mol_type = other RNA
atgggcaagctgagccccgtgtgcctctacctgttccttcagtgtctgctcctgtggaacagagggtccgcccggaatcttaacgagctgaaaatggaatgccctcacaccatcggactcggccaagggctggtcattggatctgttgagctgccgcccgtgcctatccaacaggtggaaagcctcaagctggagtcctcttgtaattttgaccttcatacaagcacggctacccagcaatccttcacaaaatggacctgggaaatgaaggatgacctggccgagaacacacaggcgtctagcacctcctttcagacaaaaagctctgaggtcaatctccgcggcctgtgccttattccccctctggtggttgaaaccgcttccagaacgcggaagaccatcgcctgtttcgatattagctgcaaccagacagtgtgtcaacccaccgtctatctcgtggggcctatccagacatgcatcaccacgaagtcttgtctgctgggactcggcgaccagcgcattcaggttaattacgagaaaacatattgcgtgtccggccaactgatcgaaggggtctgttttaacccggtgcacaccagagcccttagccagccctctcatacatacgatattgtgaccatgatggtccggtgcttcctggttgtgaagaaagtgacctccggagacagcatgaagatcgagaaaaattttgagacactcgtccagaagacggattgcaacgctaatggcttccaagggtattacatttgtctggtgggatcctctagcgaacctctttatgttcccaccctggacgattaccgctccgccgaggtgctcagcagaatggcttttgcccctcacggcgaagaccatgatgtcgagcggaacgcggtgtctgccctgcgcatcgttgggaaggtgacaggaaaagctccctccaccgaagccagcgacacagtccagggcattgctttctctggcagcccgctgtacacctccacgggggtgctcacagccaaggataatcctgtctatatctggtctcccggaatcattatggagggcaaccacagcgtgtgcgagaaaaagaccctgcctcttacctggacagggtttatccccctgcccggagaaattgagaaaacccctcagtgtacagttttctgcacgctcgcgggcccgggggccgactgtgaggcttactccgaaaccggaatctttaatattagctctcccacatgcctgcttaacagagtgcagcggttccgcggcgccgaacaacagatcaagttcgtctgtcagagagtggacatggatatcaccgtttattgcaacggcatgaaaaaggtgattctgacaaagaccctcgtcatcgggcagtgtatttacacgtttacctccatcttcagcctgattcctggaatcgctcactctctggccgtggagctctgcgtgcccggcctgcatgggtgggccacagttcttctgctcctgaccttttgtttcggatggatcctgattccttttatcgctatgattcttctcaaaatcctgattgcgttcgcctatctgtgctccaagtacaatacagacagcaaatttaagatcctcattgagaaagtcaagaaggaatatcagaaaaccatgggctccatggtgtgcgaggtgtgtcagtacgaatgcgagacggctaaggaactggagtctcaccggaaaagctgtcccatcgggtcctgcccgtactgtcttaacccttctgaggccacaaccagcgccctgcaggctcatttcaaggtctgcaaactcacatcccgctttcaggataatctgagaaagagcctggccgcgtatgaacccaagcaaggctgttaccggaccctttctctcttcagatatcgctcccggtttttcgtgggatttatctggtgcattctgctggttctcgagctggtgatctgggctgccagcgccgaaacccagaaccttaattctggctggacagacacggctcacgggtccggagtcgtgcctatgagaaccgatctggagctcgacttcagcctgccctctagcgcctcctacacatatcgccggcagctgcagaaccctgctaatgagcacgagaaaattcccttccatcttcaaatcagcaagcaggttattcacgccgaaatccagcatctcggccactggatggatgcgacctttaacctgaaaacagccttccattgttacgggctgtgcgaaaagtatgcttacccgtggcaaaccgccggatgctttttcgagaaagactacgaatttgagtctggctgggggtgtaatcctcccgattgccccggcatcggaacgggctgtacagcttgcggggtgtatctcgacaagctgaagtccgtcggaaaagtgttcaagattatcagccttagatacacccgcaaagcctgtattcagctgggcaccgagcagacatgcaagtccgttgattctaacgactgtctcgtgaccacaagcatcaaagtctgcctgattgggacggtgtccaagtttcagccttctgacaccctgcttttcctcggaccgctggaacaaggcgggctgatctttaaacagtggtgtacaaccacatgccagttcggcgatcccggagacatcatgagcaccctcacgggcatgaagtgtcctgagctgaatgggtcctttcggaagaaatgcgcgttcgccaccacacccgtgtgtcagtttgatggaaacaccatttctggctataagagaatgatggctacaaaagacagcttccaatccttcaatgtcaccgaacctcacatcagcacatctgcccttgagtggattgatcccgactccagcctgcgcgatcacatcaacgttgtggtgtctcgggacctctcctttcaggatctgagcgaaaccccttgccaggtcgacctgacgacatcttccattgatggggcttggggaagcggcgtggggttcaatcttgtttgcaccgtgtccctgaccgagtgtcccacatttctcaccagcatcaaggcctgcgactctgccatgtgttacggcagcacgacaaccaacctggtcagaggacagaacacagtgcatatcgttggcaaagggggacactccggctctaagttcatgtgctgtcatgataccaagtgcagctccacagggctcattgctgcggccccgcacctggaccgcgtgaccggatttaatcaagctgactctgataaaatcttcgacgatggcgcccctggctgtgggatgagctgctggtttaagaaatccggagagtggattcttggcgtcctgaacgggaattggctcgtggttgccgtgctgatcgctctgttcattctttctatctttctgttcacgctctgttgcccccggagacctacctatacaaaggaacacaaaccctga

SEQ ID NO: 13443 - RNA, 3447 nt, synthetic construct
  misc_feature 1..3447: note = derived and/or modified CDS sequence (opt5) from PUUV(CG1820/POR)__KT885051.1__GP
  source 1..3447: mol_type = other RNA
atgggcgagctgagccccgtgtgcctctacctgcttctgcaggggctcctgctttgtaacaccggagccgctagaaatctgaacgaactcaagatggagtgccctcacacaatccggctgggccaagggctggtcgttggatccgtggaactcccgtctctgcccattcaacaggtggagacgcttaaactggaaagctcctgtaatttcgacctccatacctctacagccggccagcagagctttaccaagtggacatgggagatcaaaggggatctggcggagaacacccaggcttcctctaccagcttccagaccaagtccagcgaagtcaatcttcgcggactgtgcctcattcctacgctggtggttgagaccgccgccagaatgcggaaaacaatcgcttgttatgacctgtcttgcaaccagaccgtgtgtcaacccacagtctacctcatgggccctattcagacctgcatcacgacaaagtcctgtctgcttagcctgggcgatcagcgcatccaggtgaattatgaaaagacctactgcgtttctgggcaactcgtggagggaatttgttttaaccccatccacacaatggccctgtcccagcctagccatacctatgacattatgaccatgatggtcagatgcttccttgtgatcaaaaaggtgacatctggcgattccatgaaaattgagaagaattttgaaacgctggtccagaaaaacgggtgcaccgctaataacttccaaggatactatatctgtctcattggcagctcctctgagccgctgtacgttcccgccctggacgattaccggagcgcggaagtgctctcccgcatggcctttgctcctcacggggaggaccatgatatcgaaaagaatgccgtgagcgctatgagaatcgccggaaaggtcacaggcaaagcgccctctaccgagtccagcgacacagtgcagggcattgccttctctgggagccctctgtatacctccacgggagttcttacatctaaggatgaccccgtgtacatctgggctccgggcattatcatggaggggaaccacagcatttgcgagaaaaagaccctgcctctcacctggacaggatttatctccctgcccggcgaaatcgagaaaaccacacagtgtacggtcttctgcacccttgccgggcctggagctgattgtgaagcctatagcgaaacaggcatttttaatatctcttcccccacatgcctgattaaccgggtgcagcgcttcagaggcagcgagcaacagatcaagtttgtttgtcagcgggtggacatggacattacagtctactgcaacgggatgaaaaaggtgatcctcaccaagacgctggtcatcggacagtgtatttataccttcacatctatcttctccctgattcccggcgtggcccacagcctcgctgttgagctgtgcgtgcctgggcttcatggatgggcgaccatgctgctcctgctgacattttgtttcggctgggtccttatcccgaccattacgatgatcctcctgaaaattctgatcgcctttgcttacctctgctccaagtataatacagattctaaattccgcatcctgattgaaaaggtgaaaagagagtaccaaaagaccatggggagcatggtttgcgaagtgtgtcagtacgagtgcgaaacagccaaggagcttgagtcccaccggaaatcttgtagcatcggctcctgcccctattgtctgaaccctagcgaagccaccacctctgctctccaggcccattttaaggtctgcaaactgacatcccgcttccaggagaatctgagaaagagccttacggtgtacgaacccatgcaaggatgttatcggaccctctctctgtttagataccgctcccggttctttgtgggcctggtttggtgcgtcctcctggtgcttgagctgattgtgtgggcggctagcgccgagacacagaacctcaatgccgggtggaccgacacagctcacggatctggcatcattcctatgaaaaccgatctggaactggacttcagccttccctccagcgcctcttatacgtacagacgccagctccagaacccggctaatgagcaagaaaagatcccttttcatctgcagctgtccaagcaggtcatccacgccgagattcaacacctcgggcattggatggatgcgacattcaacctgaaaaccgcctttcactgttatggaagctgcgaaaagtacgcttacccctggcagaccgccggctgtttcatcgagaaagactatgagtacgaaacagggtggggctgcaatcctcccgattgccctggagtgggcaccgggtgtacagcttgcggagtttatcttgacaagctgaaatccgtgggcaaggtcttcaagattgtgtctctccggtacacgagaaaagtttgtatccagctggggaccgagcagacatgcaagaccgtggatagcaacgactgtctgattacaacctccgtcaaagtgtgccttatcggaacgatctctaagtttcaacccagcgataccctcctgttcctgggcccgctccagcaagggggcctgatttttaaacagtggtgtacaaccacatgccagttcggagaccctggcgacatcatgtccacccccacagggatgaagtgtcccgaacttaatggatcttttcgcaaaaagtgcgccttcgcgaccacgcctgtttgtcagtttgatggcaacacaattagcgggtataagcggatgatcgccaccaaagactccttccagagctttaatgtgaccgagccgcatatttctacatccgctctggaatggatcgatcccgacagctctctcagagatcacatcaacgtcattgtgtcccgcgacctgagcttccaggatctgtctgagaccccttgccaaatcgaccttgccacggcttccattgatggagcctggggcagcggggtgggctttaatctggtctgcacagtttccctcaccgagtgtagcgccttcctgacatctatcaaggcttgcgacgcggccatgtgttacggaagcaccacagctaacctcgtgcggggccagaacaccattcacatcgtggggaaaggaggccattccgggtctaagtttatgtgctgtcacgatacgaaatgcagctccaccggactggtcgccgccgctccccatcttgacagagtgacaggctataatcaggccgattctgacaagattttcgacgatggcgcgcctgaatgtgggatgagctgctggttcaagaaatccggagagtggatcctgggcgttctcaacgggaattggatggtggtcgctgtgctggttgtgctgcttatcctgtctattctcctgtttaccctctgttgcccccgccggcctagctacagaaaggaacacaaaccctga

SEQ ID NO: 13444 - RNA, 3447 nt, synthetic construct
  misc_feature 1..3447: note = derived and/or modified CDS sequence (opt5) from PUUV(DTK/Ufa-97)__AB297666.2__GP
  source 1..3447: mol_type = other RNA
atgggcgagctgagccccgtgtgcctctacctgcttctgcaggggctcctgctttgtaacaccggagccgctagaaatctgaacgaactcaagatggagtgccctcacacagtccggctgggccaagggctggttgtgggatccgtggaactcccgtctctgcccatccagcaggtcgagacgcttaaactggaaagctcctgtaatttcgacctccatacctctacagccggccagcagagctttaccaagtggacatgggagattaaaggggatctggcggagaacacccaggcttcctctaccagcttccagaccaagtccagcgaagtgaatcttcgcggactgtgcctcatccctacgctggttgtggagaccgccgccagaatgcggaaaacaattgcttgttatgacctgtcttgcaaccagaccgtctgtcaacccacagtgtacctcatgggccctatccagacctgcattacgacaaagtcctgtctgcttagcctgggcgatcagcgcatccaggttaattatgaaaagacctactgcgtgtctgggcaactcgtcgagggaatctgttttaaccccattcacacaatggccctgtcccagcctagccatacctatgacatcatgaccatgatggtgagatgcttccttgtgattaaaaaggtcacatctggcgattccatgaaaatcgagaagaattttgaaacgctggttcagaaaaacgggtgcaccgctaataacttccaaggatactatatttgtctcatcggcagctcctctgagccgctgtacgtgcccgccctggacgattaccggagcgcggaagtgctctcccgcatggcctttgctcctcacggggaggaccatgatattgaaaagaatgccgtcagcgctatgagaatcgccggaaaggtgacaggcaaagcgccctctaccgagtccagcgacacagttcagggcatcgccttctctgggagccctctgtatacctccacgggagtgcttacatctaaggatgaccccgtctacatttgggctccgggcatcattatggaggggaaccacagcatctgcgaaaagaagaccctgcctctcacctggacaggatttatttccctgcccggcgagatcgagaaaaccacacagtgtacggtgttctgcacccttgccgggcctggagctgattgtgaagcctatagcgaaacaggcatctttaatatttcttcccccacatgcctgatcaaccgggttcagcgcttcagaggcagcgagcaacagattaagtttgtgtgtcagcgggtcgacatggacatcacagtgtactgcaacgggatgaaaaaggtcattctcaccaagacgctggtgatcggacagtgtatctataccttcacatctattttctccctgatccccggcgttgcccacagcctcgctgtggagctgtgcgtccctgggcttcatggatgggcgaccatgctgctcctgctgacattttgtttcggctgggtgcttattccgaccatcacgatgattctcctgaaaatcctgattgcctttgcttacctctgctccaagtataatacagattctaaattccgcatcctgatcgaaaaggttaaaagagagtaccaaaagaccatggggagcatggtgtgcgaagtctgtcagtacgagtgcgaaacagccaaggagcttgagtcccaccggaaatcttgtagcattggctcctgcccctattgtctgaaccctagcgaagccaccacctctgctctccaggcccattttaaggtgtgcaaactgacatcccgcttccaggagaatctgagaaagagccttacggtgtacgaacccatgcaaggatgttatcggaccctctctctgtttagataccgctcccggttctttgttggcctggtctggtgcgtgctcctggtgcttgagctgatcgtctgggcggctagcgccgagacacagaacctcaatgccgggtggaccgacacagctcacggatctggcattatccctatgaaaaccgatctggaactggacttcagccttccctccagcgcctcttatacgtacagacgccagctccagaacccggctaatgagcaagaaaagattccttttcatctgcagctgtccaaacaggtgatccacgccgagatccaacacctcgggcattggatggatgcgacattcaacctgaaaaccgcctttcactgttatggaagctgcgaaaagtacgcttacccctggcagaccgccggctgtttcattgagaaagactatgagtacgaaacagggtggggctgcaatcctcccgattgccctggagttggcaccgggtgtacagcttgcggagtgtatcttgacaagctgaaatccgtcggcaaggtgttcaagatcgtttctctccggtacacgagaaaagtgtgtattcagctggggaccgagcagacatgcaagaccgtcgatagcaacgactgtctgatcacaacctccgtgaaagtttgccttattggaacgatctctaagtttcaacccagcgataccctcctgttcctgggcccgctccagcaagggggcctgatctttaaacagtggtgtacaaccacatgccaattcggagaccctggcgacattatgtccacccccacagggatgaagtgtcccgaacttaatggatcttttcgcaaaaagtgcgccttcgcgaccacgcctgtgtgtcagtttgatggcaacacaatcagcgggtataagcggatgattgccaccaaagactccttccagagctttaatgtcaccgagccgcatatctctacatccgctctggaatggattgatcccgacagctctctcagagatcacatcaacgtgatcgtgtcccgcgacctgagcttccaggatctgtctgagaccccttgccaaattgaccttgccacggcttccatcgatggagcctggggcagcggggtcggctttaatctggtttgcacagtgtccctcaccgagtgtagcgccttcctgacatctattaaggcttgcgacgcggccatgtgttacggaagcaccacagctaacctcgtgcggggccagaacaccatccacattgtcgggaaaggaggccattccgggtctaagtttatgtgctgtcacgatacgaaatgcagctccaccggactggtggccgccgctccccatcttgacagagttacaggctataatcaggccgattctgacaagatcttcgacgatggcgcgcctgaatgtgggatgagctgctggttcaagaaatccggagagtggattctgggcgtgctcaacgggaattggatggtcgtggctgttctggtggtcctgcttatcctgtctatcctcctgtttaccctctgttgcccccgccggcctagctacagaaaggaacacaaaccctga

SEQ ID NO: 13445 - RNA, 3447 nt, synthetic construct
  misc_feature 1..3447: note = derived and/or modified CDS sequence (opt5) from PUUV(PUU/Cg-Erft)__AJ238778.1__GP
  source 1..3447: mol_type = other RNA
atgggcaagatcattcccgtgtgcctgtacctcctgttcctttgtctgctcctgtggaacagaggggacgcccggaatcttaacgagctgaaaatcgaatgccctcacaccattggactcggccaggggctggtcatcggaagcgttgagctgccgcccgtgcctctcacacaagtggaatccctgaagctggagtctagctgtaattttgatctgcatacgtccacctctagccagcagcccttcacaaaatggacctgggaaatgaagtccgacctcgctgagaacacacaggcctctagcacctcctttcaaacaaaaagctctgagattaatctgcgcggcctttgcctggtccctcccctcgtgatcgaaaccgcggctagaacgcggaagaccatcgcctgtttcgatctgtcctgcaaccagacagcctgtcagcctaccgtttttctgattgggccgatccagacatgcattaccacaaagagctgtctcctgggacttggcgaccaacgcatccaggtgaattatgagaaaacgtactgcgtctctggccagctggtggaaggggtttgtttcaaccccgtgcacaccatggctctctcccagcctagccatacatatgatattgtcaccgtgatggtgagatgctttctgatcgccaagaaagtctctaccggagactccatgaaacttgagaagtccttcgagacactggttcaaaagacgagctgcaccggcaatgggtttcagggatactatatttgtctcgtgggctctagctccgaacccctgtacatccctacactggatgactatcggagcgctgaggtgctctctcgcatggccttcgcgccccacggggaagatcatgacgtcgagaagaacgccatctccgctatgagaattatcggaaaagtgaccggcaaggccccgagcacagaatctagcgataccattcagggcgttgctttttccgggaatcctctgtacacgtctacaggagtgcttaccgccaaagacgatcccgtctacatctgggcgcctggcattatcatggaggggaaccacagcgtgtgcgacaagaaaaccctgcccctcacatggaccggattcatccccctgcctggcgagattgaaaagacaacgcaatgtaccgtgttttgcacacttgccgggccgggagctgactgtgaggcctattccgaaaccggcatcttcaatattagctctcccacatgcctgatcaaccgggttcagcgcttcagaggcgctgagcagcagattaaatttatctgtcaacgggtcgatatggacatcaccgtgtactgcaatgggctcaagaaggtcattctgacgaaaaccctgatcattggacagtgtatctatacattcacctccatttttagcctcatccctggcgtggcccactctctggccgttgaactttgcgtgcccgggctgcatggatgggctacaatgctcctgctgcttaccttctgttttggctggattctcatccctttcttttccatgatcctgctgaagattctcatcgcgttcgcctacctgtgcagcaaatataacacggattccaagtttaaaattcttatcgagaaggtcaagaaagagtaccagaagacaatggggtctatggtgtgcgaagtttgtcactatgagtgcgaaaccgctaaagagctggaaagccatcgcaagtcctgtcccatgggctcttgcccgtactgtctcaaccctgccgaggccacaaccagcgctctgcaggcccacttcaaagtgtgcaagctgacctccagatttcaagacaatcttagaaagagcctcggagcgtacgagcccaaacagggctgttatcgcacactgtctctgttcagataccggtccagatttttcgtcgggttcatttggtgcctcctgcttgtgctggaactcatcgtgtgggctgccagcgccgagacgcagaaccttaattctggatggaccgatacagctcacggctccgggatcattcctatgcgcaccgacctggaacttgattttagcctcccctctagcgcctcctatacataccggagacagctgcaaaaccctgctaatgagcaggagaagatccccttccatctgcagattagcaaacaggttatccacgccgaaattcaacatctcggacactggatggacggcacctttaacctgaagacggcgttccattgttatgggtcttgcgagaaatacgcctatccgtggcagacagctggctgttttatcgaaaaggattacgagtacgaatccggatggggctgcaatcctcccgactgccccggggtcggaaccggctgtaccgcctgcggggtgtatcttgataagctgaaaagcgtgggaaaggctttcaaaatcgtctccctccgctacacacggaaggcctgtattcagctgggcaccgagcaaacatgcaaatctgtggacagcaacgactgtctggttacgacctccgtgaaggtctgccttatcgggacagtgtctaaatttcagcctagcgataccctcctgttcctgggcccgctcgagcagggaggcctgatttttaagcagtggtgtacaaccacgtgccaattcggggaccccggagatatcatgtccacccctgttggcatgaagtgtcccgaacttaatgggtcttttcggaaaaagtgcgcgttcgccacaacccctgtgtgtcagtttgacggaaacacactgagcggctataaacgcatgattgctaccaaggattccttccagagcttcaatgtcacagagccccacatctctgcctccagcctcgaatggatcgaccctgattcttccctgcgggaccacattaacgtgatcgttgggagagatctgagctttcaggacctttctgagaccccctgccaagtggatctggctacgacatccattgacggcgcctggggaagcggcgtcgggttcaatctcgtgtgctccgtgagcctgaccgaatgttctacctttctcacaagcatcaaagcctgcgattccgctatgtgttacggatctaccacggcgaacctgcttcgcggccagaatacagtccatattgttgggaagggaggccacagcggctccaagttcatgtgctgtcatgacaccaaatgctctagcacagggctggtggccgctgccccgcacctcgaccgggtgaccggatataaccaggccgattccgacaagatctttgatgacggcgctcctgagtgtgggatttcttgctggttcacaaaaagcggagagtggatcctgggcgtcctgaacgggaattggatggtggttgccgtgcttgtcgcgctgtttatcctctccattttcctgtttaccctctgttgccccagacgccctagctacgctaaggaacacaaaccctga

SEQ ID NO: 13446 - RNA, 3447 nt, synthetic construct
  misc_feature 1..3447: note = derived and/or modified CDS sequence (opt5) from PUUV(PUUV/Konnevesi/Mg_M105A/2005)__JQ319173.1__GP
  source 1..3447: mol_type = other RNA
atgggcaagagctcccccgtgtgcctgtacctcatcctgcaggggcttctgctcattggagccgtcaacgctagaaatctgaacgagcttaaaatggaatgtcctcacaccatcggcctggggcaaggactcgttgtgggctctgtggagctgccgcccgtccctattcaacaggtggaaagcctgaagctcgagtcctcttgcaatttcgacctgcatacaagcacggccgggcagcaatcctttaccaaatggacatgggaaaccaagtctgatcttgcggagaacacacaggctagctccaccagcttccagacaaaatcttccgaggttaatctgcggggactctgtctgatccccacccttgtggtcgaaacggccgcccgcatgagaaagaccattgcttgctatgacctgagctgtaaccagacagtgtgccaacctaccgtttacctcatgggccccatccagacatgtctgaccacgaagtcttgcctgctcggcctgggggatcagcggatccaggtgaattatgagcgcacatactgtgtctccggacaacttgtggaaggcgtgtgctttaaccctattcacaccatggccctgagccagccgtctcatacatatgacatcgtcaccgttatggtgagatgtttcctcgtgattaaaaaggtcacctccggggatagcatgaaaatcgagaagaattttgagacactggtgcagaaaacgggatgcaccgctaactccttccaaggctactatatttgccttgttgggtctagctccgaacccctgtacgtgcctacactcgacgattaccggagcgccgaggtcctgtctcgcatggcgtttgctccccacggagaagaccatgatatcgagaagaatgccatttccgccctgagaatcgctggcaaggtgaccggcaaagcccctagcacagaatctagcgacaccgttcaggggatcgcgttctccggatctcccctctatacgagcacaggcgtgctgaccgccaaggatgacccggtctacatttgggctcctgggatcattatggagggaaaccactccgtgtgtgagaaaaagacccttcccctgacatggaccggctttatccctctccccggggaaattgagaaaacaacgcagtgcaccgtcttctgtacactggccggacccggcgctgattgcgaagcctatagcgagaccggcatctttaatatctcttcccctacatgtcttattaaccgggtgcagcgcttcagaggggccgaacaacagatcaagtttgtttgccagcgggtggacatggacattaccgtctactgtaatggagtgaaaaaggttatcctgacgaagaccctcgtgattggccagtgcatctatacattcaccagcatcttctctctgattccggggatcgctcactccctggcggtcgagctctgtgtgcccggactgcatggctgggccacagtgcttctgctcctgaccttttgcttcgggtgggttctgattcctacgatcacaatgattcttctcaaaatcctgattgcttttgcctacctgtgtagcaagtataacaccgattccaaattcaagatcctcgtcgagaaagtgaagaaggaataccagaaaacaatgggctctatggtgtgcgaggtctgccagtacgaatgtgagaccgccaaggaactggagagccaccgcaaatcctgctctatcggaagctgtccctattgccttaacccttccgaggctacccccagcgccctgcaggcgcattttaaggtgtgtaaactcacatctagattccaggaaaatctgaagaagtccctgacgatgtacgagccgatgcaaggctgctatcggacccttagcctctttcgctacagatctcggttctttgttgggctggtgtggtgtatgctgctcgtcctggaacttattgtgtgggctgcctccgccgagacacagaacctgaatgctggatggaccgacacagcccacggcagcgggatcattcctatgaaagctgatctcgagctggacttctctctgcccagctccgccagctatacctacagacgccagcttcagaaccctgcgaatgaacaagagaagatcccctttcacctccagatttctaaacaggttatccatgccgaaatccaacacctgggacattggatggatgctacgttcaacctgaagacagcctttcactgctatggctcctgtgagaaatacgcttacccttggcagaccgccgggtgcttcgtggaaaaggactatgagtacgagaccggctggggatgtaatcccccggattgccctggcgtcgggacaggatgcaccgcgtgtggcgtgtatctcgacaagctgaaaagcgttgggaaggtgttcaaaattgtctcccttcggtacacaagaaaggtgtgcatccagctgggaacggaacagacctgtaaaacagtggattctaacgactgcctcattaccacaagcgtcaaggtttgtctgatcggcaccatttccaaatttcaaccctctgatacgctgcttttcctcgggcccctgcagcagggcggactgatctttaagcagtggtgcaccacaacctgtcaattcggcgaccctggggacatcatgagcacaccgaccggaatgaagtgccccgagctcaatggctcctttcgcaaaaagtgtgccttcgctacaacccctgtgtgccagtttgatgggaacacgatttctggatataaacggatgatcgccacaaaggacagcttccagtcctttaatgtgaccgaaccccatattagcacctctgctctggagtggatcgatcctgactccagccttagagatcacattaacgtcatcgtgtctcgcgacctgtccttccaggatctcagcgaaacaccctgtcaaatcgacctgaccgcctctgccattgatggcgcttgggggtccggcgttggatttaatctggtgtgcacgatcagccttacagagtgctccaccttcctgacaagcattaaagcgtgtgacgccgctatgtgctacggctctaccacaaccaacctcgtccgggggcagaatacgatccacgtggttggaaagggcgggcatagcggatccaagtttatgtgttgccacgataccaaatgttctagcacaggcctggtggccgccgctcctcatctcaacagagtcaccggcttcaaccaggccgactccgataagattttcgacgacggggcgcccgagtgcggagtgtcttgttggtttaaaaagagcggcgaatgggttctgggggtgcttaatggaaactggatggtcgtggctgtgctgatcgccctcctgattctgtccatcttcctttttgccctgtgctgtccgcgccggccttcttataaaaaggagcacaagccctga

SEQ ID NO: 13447 - RNA, 3447 nt, synthetic construct
  misc_feature 1..3447: note = derived and/or modified CDS sequence (opt5) from PUUV(PUUV/Konnevesi/Mg_M114B/2005)__JQ319175.1__GP
  source 1..3447: mol_type = other RNA
atgggcaagagctcccccgtgtgcctgtacctcatcctgcaggggcttctgctctttggagccgtcaacgctagaaatctgaacgagcttaaaatggaatgtcctcacaccattggcctggggcaaggactcgttgtgggctctgtggagctgccgcccgtccctatccaacaggtggaaagcctgaagctcgagtcctcttgcaattttgacctgcatacaagcacggccgggcagcaatccttcaccaaatggacatgggaaattaagaacgatcttgcggagaatacccaggcttctagcacatcctttcagaccaaaagctctgaggttaacctgcggggactctgtctgatccccacacttgtggtcgaaaccgccgcccgcatgagaaagacgattgcttgctatgacctgtcctgtaatcagaccgtgtgccaacctacagtttacctcatgggccccatccagacctgtctgacaaccaagagctgcctgctcggcctgggggatcagcggatccaggtgaactatgagcgcacgtactgtgtctctggacaacttgtggaaggcgtgtgcttcaatcctattcacacaatggccctgtcccagccgagccatacctatgacatcgtcacaattatggttagatgttttctcgtgatcaaaaaggtgacctctggggataacatgaaaattgagaagaatttcgagaccctggtccagaaaacaggatgcacggctaactcctttcaaggctactatatctgccttgtggggagctcctctgaacccctgtacgttcctaccctcgacgattaccggagcgccgaggtgctgtcccgcatggcgttcgctccccacggagaagaccatgatattgagaagaatgccatcagcgccctgagaatcgctggcaaggtcacaggcaaagccccttctaccgaatccagcgacacagtgcaggggattgcgttttctggaagccccctctatacctccacgggcgttctgacagccaaggatgacccggtgtacatctgggctcctgggattatcatggagggaaaccactctgtctgtgagaaaaagacccttcccctgacctggacaggcttcattcctctccccggggaaatcgagaaaaccacacagtgcacggtgttttgtaccctggccggacccggcgctgattgcgaagcctatagcgagacaggcatcttcaatatttccagccctacctgtcttatcaaccgggtccagcgctttagaggggccgaacaacagattaagttcgtgtgccagcgggttgacatggacatcacagtgtactgtaacggagtcaaaaaggtgattctgaccaagacgctcgttatcggccagtgcatctataccttcacatctattttctccctgatcccggggattgctcacagcctggcggtggagctctgtgtccccggactgcatggctgggccaccgtgcttctgctcctgacattctgctttgggtgggtgctgatccctaccattacgatgatccttctcaaaattctgatcgctttcgcctacctgtgttctaagtataatacagattccaaatttaagatcctcgttgagaaagtcaagaaggaataccagaaaaccatgggcagcatggtgtgcgaggtgtgccagtacgaatgtgagacagccaaggaactggagtcccaccgcaaatcttgcagcattggatcctgtccctattgccttaacccttctgaggctacccccagcgccctgcaggcgcatttcaaggtctgtaaactcacctccagatttcaggaaaatctgaaaaagagcctgacaatgtacgagccgatgcaaggctgctatcggacgctttctctcttccgctacagatcccggtttttcgtggggctggtttggtgtatgctgctcgtgctggaacttatcgtctgggctgccagcgccgagacccagaacctgaatgctggatggacagacaccgcccacggctctgggattatccctatgaaggctgatctcgagctggacttttccctgcccagctctgccagctatacatacagacgccagcttcagaaccctgcgaatgaacaagagaagattcccttccacctccagatctccaaacaggtgatccatgccgaaattcaacacctgggacattggatggatgctacctttaacctgaagacggccttccactgctatggcagctgtgagaaatacgcttacccttggcagacagccgggtgcttcgttgaaaaggactatgagtacgagaccggctggggatgtaatcccccggattgccctggcgtggggaccggatgcacagcgtgtggcgtctatctcgacaagctgaaatctgtggggaaggtttttaaaatcgtgtcccttcggtacaccagaaaggtctgcattcagctgggaacagaacagacgtgtaaaaccgtggatagcaacgactgcctcatcacaacctccgtgaaggtctgtctgattggcacaatctctaaattccaacccagcgataccctgctttttctcgggcccctgcagcagggcggactgatcttcaagcagtggtgcacgaccacatgtcaatttggcgaccctggggacattatgtccaccccgacaggaatgaagtgccccgagctcaatggctctttccgcaaaaagtgtgcctttgctaccacacctgtttgccagttcgatgggaacaccatcagcggatataaacggatgattgccacgaaggactcctttcagtctttcaatgtgacagaaccccatatcagcacctccgctctggagtggattgatcctgacagctctcttagagatcacatcaacgtgatcgtctcccgcgacctgagctttcaggatctctctgaaaccccctgtcaaattgacctgatcgcctccgccattgatggcgcttgggggagcggcgtgggattcaatctggtttgcacagtgtctcttaccgagtgctccacgtttctgacaagcatcaaagcgtgtgacgccgctatgtgctacggctccaccacaattaacctcatccgggggcagaacaccattcacgtcgtgggaaagggcgggcatagcggatctaagttcatgtgttgccacgatacaaaatgtagctccaccggcctggttgccgccgctcctcatctcgacagagtgacgggcttcaatcaggccgattctgacaagatctttgacgatggggcgcccgagtgcggagtcagctgttggttcaaaaagtccggcgaatgggtgctgggggttcttaacggaaattggatggtggtcgctgtgctgatcgccctcctgattctgtctatctttcttttcgccctgtgctgtccgcgccggcctagctataaaaaggagcacaagccctga

SEQ ID NO: 13448 - RNA, 3447 nt, synthetic construct
  misc_feature 1..3447: note = derived and/or modified CDS sequence (opt5) from PUUV(PUUV/Konnevesi/Mg_M78B/2005)__JQ319174.1__GP
  source 1..3447: mol_type = other RNA
atgggcaagagctcccccgtgtgcctgtacctcatcctgcaggggcttctgctgttcggagccgtcaacgctagaaatctgaacgagcttaaaatggaatgtcctcacaccattggcctggggcaaggactcgttgtgggctctgtggagctgccgcccgtccctatccaacaggtggaaagcctgaagctcgagtcctcttgcaattttgacctgcatacaagcacggccgggcagcagtccttcaccaaatggacatgggaaattaagaacgatcttgcggagaatacccaggcttctagcacatcctttcagaccaaaagctctgaggttaacctgcggggactctgtctgatccccacacttgtggtcgaaaccgccgcccgcatgagaaagacgattgcttgctatgacctgtcctgtaatcagaccgtgtgccaacctacagtttacctcatgggccccatccagacctgtctgacaaccaagagctgcctgctcggcctgggggatcagcggatccaggtgaactatgagcgcacgtactgtgtctctggacaacttgtggaaggcgtgtgcttcaatcctattcacacaatggccctgtcccagccgagccatacctatgacatcgtcacaattatggttagatgttttctcgtgatcaaaaaggtgacctctggggataacatgaaaattgagaagaatttcgagaccctggtccagaaaacaggatgcacggctaacggctttcaagggtactatatctgccttgtgggatccagctccgaacccctgtacgttcctaccctcgacgattaccggtctgccgaggtgctgagccgcatggcgttcgctccccacggcgaagaccatgatattgagaagaatgccatctccgccctgagaatcgctggcaaggtcacagggaaagcccctagcaccgaatcttccgacacagtgcagggaattgcgtttagcggctctcccctctataccagcacgggggttctgacagccaaggatgacccggtgtacatctgggctcctggaattatcatggagggcaaccactccgtctgtgagaaaaagacccttcccctgacctggacagggttcattcctctccccggagaaatcgagaaaaccacacagtgcacggtgttttgtaccctggccggccccggcgctgattgcgaagcctattctgagacagggatcttcaatattagctcccctacctgtcttatcaaccgggtccagcgctttagaggagccaagcaacagattaaattcgtgtgccagcgggttgacatggacatcacagtgtactgtaacggcgtcaagaaggtgattctgaccaaaacgctcgttatcgggcagtgcatctataccttcacaagcatcttttctctgattccgggaattgctcactccctggcggtggaactctgtgtccccggcctgcatgggtgggccaccgtgcttctgctcctgacattctgctttggctgggtgctgatccctaccattacgatgatccttctcaagattctgatcgctttcgcctacctgtgtagcaaatataatacagattctaagtttaaaatcctcgttgagaaggtcaagaaagagtaccaaaagaccatgggatccatggtgtgcgaagtgtgccagtacgagtgtgaaacagccaaagagctggaaagccaccgcaagtcctgctctattggcagctgtccctattgccttaacccttccgaggctaccccctctgccctgcaggcgcatttcaaagtctgtaagctcaccagcagatttcaggagaatctgaagaaatccctgacaatgtacgaaccgatgcaagggtgctatcggacgcttagcctcttccgctacagatctcggtttttcgtgggactggtttggtgtatgctgctcgtgctggagcttatcgtctgggctgcctccgccgaaacccagaacctgaatgctggctggacagacaccgcccacgggagcggaattatccctatgaaggctgatctcgagctggacttttctctgccctccagcgcctcttatacatacagacgccagcttcagaaccctgcgaatgagcaagaaaagattcccttccacctccagatcagcaaacaggtgatccatgccgagattcaacacctgggccattggatggatgctacctttaacctgaaaacggccttccactgctatgggtcctgtgaaaagtacgcttacccttggcagacagccggctgcttcgttgagaaggactatgaatacgagaccggatggggctgtaatcccccggattgccctggggtgggaaccggctgcacagcgtgtggggtctatctcgacaaactcaagagcgtgggaaaagtttttaagatcgtgtctcttcggtacaccagaaaagtctgcattcagctgggcacagagcagacgtgtaagaccgtggattccaacgactgcctcatcacaaccagcgtgaaagtctgtctgattgggacaatctccaagttccaaccctctgataccctgctttttctcggccccctgcagcagggaggcctgatcttcaagcagtggtgcacgaccacatgtcaatttggggaccctggagacattatgagcaccccgacaggcatgaaatgccccgaactcaatgggtccttccgcaagaaatgtgcctttgctaccacacctgtttgccagttcgatggaaacaccatctctggctataagcggatgattgccacgaaagacagctttcagtccttcaatgtgacagagccccatatctctaccagcgctctggaatggattgatcctgactccagccttagagatcacatcaacgtgatcgtctctcgcgacctgtcctttcaggatctcagcgagaccccctgtcaaattgacatgacagcctctgccatcgatggggcttggggctccggagtgggcttcaatctggtttgcaccgtgagcctgacggaatgctctacatttcttacctccattaaggcgtgtgacgccgctatgtgctacgggagcacaaccacaaacctggtccggggacagaacaccatccacgtggttggcaaagggggacattccggcagcaagttcatgtgttgccacgatacgaagtgttctagcaaaggcctcgtggccgccgctcctcatctggacagagtcaccgggttcaatcaggccgattccgacaagatttttgacgatggagcgcccgagtgcggcgtgtcttgttggttcaaaaagagcggggagtgggttctcggagtgctgaacggcaattggatggtcgtggctgtgcttatcgccctgctcattctgtccatctttctgttcgccctttgctgtccgcgccggccttcttataagaaagaacacaagccctga

SEQ ID NO: 13449 - RNA, 3447 nt, synthetic construct
  misc_feature 1..3447: note = derived and/or modified CDS sequence (opt5) from PUUV(PUUV/Konnevesi/Mg_O78A/2005)__JQ319172.1__GP
  source 1..3447: mol_type = other RNA
atgggcaagagctcccccgtgtgcctgtacctcatcctgcaggggcttctcctgttcggagccgtcaacgctagaaatctgaacgagcttaaaatggaatgtcctcacaccattggcctggggcaaggactcgttgtgggctctgtggagctgccgcccgtccctatccaacaggtggaaagcctgaagctcgagtcctcttgcaattttgacctgcatacaagcacggccgggcagcaatccttcaccaaatggacatgggaaattaagtctgatcttgcggagaacacccaggctagctccacatcttttcagaccaaatcttccgaggttaatctgcggggactctgtctgatccccacacttgtggtcgaaaccgccgcccgcatgagaaagacgattgcttgctatgacctgagctgtaaccagaccgtgtgccaacctacagtttacctcatgggccccatccagacctgtctgacaaccaagtcttgcctgctcggcctgggggatcagcggatccaggtgaattatgagcgcacgtactgtgtctccggacaacttgtggaaggcgtgtgcttcaaccctattcacacaatggccctgagccagccgtctcatacctatgacatcgtcacaattatggttagatgttttctcgtgatcaaaaaggtgacctccggggatagcatgaaaattgagaagaatttcgagaccctggtccagaaaacaggatgcacggctaactcctttcaaggctactatatctgccttgtggggtctagctccgaacccctgtacgttcctaccctcgacgattaccggagcgccgaggtgctgtctcgcatggcgttcgctccccacggagaagaccatgatattgagaagaatgccatctccgccctgagaatcgctggcaaggtcacaggcaaagcccctagcaccgaatctagcgacacagtgcaggggattgcgttttccggatctcccctctataccagcacgggcgttctgacagccaaggatgacccggtgtacatctgggctcctgggattatcatggagggaaaccactccgtctgtgagaaaaagacccttcccctgacctggacaggcttcattcctctccccggggaaatcgagaaaaccacacagtgcacggtgttttgtaccctggccggacccggcgctgattgcgaagcctatagcgagacaggcatcttcaatatttcttcccctacctgtcttatcaaccgggtccagcgctttagaggggccgaacaacagattaagttcgtgtgccagcgggttgacatggacatcacagtgtactgtaatggagtcaaaaaggtgattctgaccaagacgctcgttatcggccagtgcatctataccttcacaagcatttttagcctgatcccggggattgctcactccctggcggtggagctctgtgtccccggactgcatggctgggccaccgtgcttctgctcctgacattctgctttgggtgggtgctgatccctaccattacgatgatccttctcaaaattctgatcgctttcgcctacctgtgtagcaagtataacacagattccaaatttaagatcctcgttgagaaagtcaagaaggaataccagaaaaccatgggctctatggtgtgcgaggtgtgccagtacgaatgtgagacagccaaggaactggagagccaccgcaaatcctgctctattggaagctgtccctattgccttaacccttccgaggctacccccagcgccctgcaggcgcatttcaaggtctgtaaactcacctctagatttcaggaaaatctgaagaagtccctgacaatgtacgagccgatgcaaggctgctatcggacgcttagcctcttccgctacagatctcggtttttcgtggggctggtttggtgtatgctgctcgtgctggaacttatcgtctgggctgcctccgccgagacccagaacctgaatgctggatggacagacaccgcccacggcagcgggattatccctatgaaagctgatctcgagctggacttttctctgcccagctccgccagctatacatacagacgccagcttcagaaccctgcgaatgaacaagagaagattcccttccacctccagatctctaaacaggtgatccatgccgaaattcaacacctgggacattggatggatgctacctttaacctgaagacggccttccactgctatggctcctgtgagaaatacgcttacccttggcagacagccgggtgcttcgttgaaaaggactatgagtacgagaccggctggggatgtaatcccccggattgccctggcgtggggaccggatgcacagcgtgtggcgtctatctcgacaagctgaaaagcgtggggaaggtttttaaaatcgtgtcccttcggtacaccagaaaggtctgcattcagctgggaacagaacagacgtgtaaaaccgtggattctaacgactgcctcatcacaaccagcgtgaaggtctgtctgattggcacaatctccaaattccaaccctctgataccctgctttttctcgggcccctgcagcagggcggactgatcttcaagcagtggtgcacgaccacatgtcaatttggcgaccctggggacattatgagcaccccgacaggaatgaagtgccccgagctcaatggctccttccgcaaaaagtgtgcctttgctaccacacctgtttgccagttcgatgggaacaccatctctggatataaacggatgattgccacgaaggacagctttcagtccttcaatgtgacagaaccccatatcagcacctctgctctggagtggattgatcctgactccagccttagagatcacatcaacgtgatcgtctctcgcgacctgtcctttcaggatctcagcgaaaccccctgtcaaattgacctgacagcctctgccatcgatggcgcttgggggtccggcgtgggattcaatctggtttgcaccattagccttacggagtgctccacatttctgaccagcatcaaagcgtgtgacgccgctatgtgctacggctctacaaccacaaacctcgtgcgggggcagaataccattcacgtcgtgggaaagggcgggcatagcggatccaagttcatgtgttgccacgatacgaaatgttctagcaccggcctggttgccgccgctcctcatctcaacagagtgacaggcttcaaccaggccgactccgataagatctttgacgacggggcgcccgagtgcggagtctcttgttggttcaaaaagagcggcgaatgggtgctgggggttcttaatggaaactggatggtggtcgctgtgctgattgccctcctgatcctgtccatctttcttttcgccctgtgctgtccgcgccggccttcttataaaaaggagcacaagccctga

SEQ ID NO: 13450 - RNA, 3447 nt, synthetic construct
  misc_feature 1..3447: note = derived and/or modified CDS sequence (opt5) from PUUV(PUUV/Pieksamaki/human_kidney/2008)__JN831951.1__GP
  source 1..3447: mol_type = other RNA
atgggcaagagctcccccgtgtgcctgtacctcatcctgcaggggcttctcctgttcggagccgtcaacgctagaaatctgaacgagcttaaaatggaatgtcctcacaccattggcctggggcaaggactcgttgtgggctctgtggagctgccgcccgtccctatccaacaggtggaaagcctgaagctcgagtcctcttgcaattttgacctgcatacaagcacggccgggcagcaatccttcaccaaatggacatgggaaattaagtctgatcttgcggagaacacccaggctagctccacatcctttcagaccaaatcttccgaggttaatctgcggggactctgtctgatccccacacttgtggtcgaaaccgccgcccgcatgagaaagacgattgcttgctatgacctgagctgtaaccagaccgtgtgccaacctacagtttacctcatgggccccatccagacctgtctgacaaccaagtcttgcctgctcggcctgggggatcagcggatccaggtgaattatgagcgcacgtactgtgtctccggacaacttgtggaaggcgtgtgcttcaaccctattcacacaatggccctgagccagccgtctcatacctatgacgtcgttacaatcatggtgagatgttttctcgtgattaaaaaggtcacctccggggatagcatgaaaatcgagaagaatttcgagaccctggtgcagaaaacaggatgcacggctaacaattttcaaggctactatatttgccttgttgggtcctctagcgaacccctgtacgtgcctaccctcgacgattaccggtccgccgaggtcctgagccgcatggcgttcgctccccacggagaagaccatgatatcgagaagaacgccatttctgccctgagaatcgctggcaaggtgacaggcaaagccccttccaccgaaagctctgacacagttcaggggatcgcgtttagcggaagccccctctatacctctacgggcgtgctgacagccaaggatgacccggtctacatttgggctcctgggatcattatggagggaaatcacagcgtgtgtgagaaaaagacccttcccctgacctggacaggcttcatccctctccccggggaaattgagaaaaccacacagtgcacggtcttttgtaccctggccggacccggcgctgattgcgaagcctattccgagacaggcatcttcaacatcagctctcctacctgtcttattaatcgggtgcagcgctttagaggggccgaacaacagatcaagttcgtttgccagcgggtggacatggacattacagtctactgtaacggagtgaaaaaggttatcctgaccaagacgctcgtgattggccagtgcatctataccttcacatccatctttagcctgattccggggatcgctcactctctggcggtcgagctctgtgtgcccggactgcatggctgggccaccgtgcttctgctcctgacattctgctttgggtgggttctgattcctaccatcacgatgattcttctcaaaatcctgattgctttcgcctacctgtgttccaagtataacacagatagcaaatttaagatcctcgtcgagaaagtgaagaaggaataccagaaaaccatgggctccatggtgtgcgaggtctgccagtacgaatgtgagacagccaaggaactggagtctcaccgcaaaagctgctccatcggatcttgtccctattgccttaatcctagcgaggctaccccctccgccctgcaggcgcatttcaaggtgtgtaaactcaccagcagatttcaggaaaacctgaagaagtctctgacaatgtacgagccgatgcaaggctgctatcggacgctttccctcttccgctacagaagccggtttttcgttgggctggtgtggtgtatgctgctcgtcctggaacttattgtgtgggctgcctctgccgagacccagaatctgaacgctggatggacagacaccgcccacggctccgggatcattcctatgaaagctgatctcgagctggactttagcctgccctctagcgcctcctatacatacagacgccagcttcagaatcctgcgaacgaacaagagaagatccccttccacctccagattagcaaacaggttatccatgccgaaatccaacacctgggacattggatggatgctacctttaatctgaagacggccttccactgctatggctcttgtgagaaatacgcttacccttggcagacagccgggtgcttcgtggaaaaggactatgagtacgagaccggctggggatgtaatcccccggattgccctggcgtcgggaccggatgcacagcgtgtggcgtgtatctcgacaagctgaaatccgttgggaaggtgtttaaaattgtcagccttcggtacaccagaaaggtgtgcatccagctgggaacagaacagacgtgtaaaaccgtggattccaacgactgcctcattacaacctctgtcaaggtttgtctgatcggcacaattagcaaattccaaccctccgataccctgctttttctcgggcccctgcagcagggcggactgatcttcaagcagtggtgcacgaccacatgtcaatttggcgaccctggggacatcatgtctaccccgacaggaatgaagtgccccgagctcaacggcagcttccgcaaaaagtgtgcctttgctaccacacctgtgtgccagttcgatgggaataccatttccggatataaacggatgatcgccacgaaggactcttttcagagcttcaacgtgacagaaccccatatttccaccagcgctctggagtggatcgatcctgactcttcccttagagatcacattaatgtcatcgtgagccgcgacctgtcttttcaggatctctccgaaaccccctgtcaaatcgacctgacagccagcgccattgatggcgcttgggggtctggcgttggattcaacctggtgtgcaccatctcccttacggagtgcagcacatttctgacctccattaaagcgtgtgacgccgctatgtgctacggcagcacaaccacaaatctcgtccgggggcagaacaccatccacgtggttggaaagggcgggcattctggaagcaagttcatgtgttgccacgatacgaaatgttcctctaccggcctggtggccgccgctcctcatctcgacagagtcacaggcttcaaccaggccgatagcgacaagatttttgacgatggggcgcccgagtgcggagtgtcctgttggttccgcaaatctggcgaatgggttctgggggtgcttaatggaaactggatggtcgtggctgtgctgatcgccctcctgattctgagcatctttcttttcgccctgtgctgtccgcggagaccttcctataagaaagagcacaagccctga

SEQ ID NO: 13451 - RNA, 3447 nt, synthetic construct
  misc_feature 1..3447: note = derived and/or modified CDS sequence (opt5) from PUUV(Samara_49/CG/2005)__AB433850.2__GP
  source 1..3447: mol_type = other RNA
atgggcaagctgagccccgtgtgcctctacctgcttctgcaggggctcctgctttgtaaaaccggaacagccagaaacctgaatgagctcaagatggaatgccctcacacgatcggcctggggcaaggactggtcgttggctccgtggagctcccgcccgtgcctattcagcaggtcgaaaccctgaaacttgagtctagctgtaacttcgacctgcatacatccaccgctgggcagcaagcctttacaaagtggacctgggaaatcaaaggagatctcgcggagaatacacaggcttctagcacctccttccagacgaagtctagcgaggtgaacctgcggggcctttgcctgattcccaccctcgttatcgaaacagccgcccgcatgagaaagaccattgcttgttatgacctgtcctgcaatcagacagtgtgtcaacctaccgtctacctgatgggccccatccagacgtgcatcacaaccaaaagctgtctcctggggcttggagatcagcggattcaggtgaactatgagaagacatactgcgtttctggccaactggtggaaggggtctgttttaatcctatccacaccatggccctctcccagccgagccatacctatgacattgtgacaatgatggtgcgctgcttcctggtcatcaaaaaggttacgtctggagattccatgaaaattgagaagaactttgagacccttgtgcagaagaatggctgcacagctaacagcttccaagggtactatatctgtctgattggatcttccagcgaacccctctacgtgcctaccctggacgattacagatccgccgaggtcctgtctcggatggcgtttgctccccacggcgaagaccatgatgtggagaaaaatgccatcagcgccctccgcatcgctggcaaggttacagggaaagccccttccaccgaaagctctgacacggtgcagggaattgcgttctccggcagccccctgtatacatctaccggggtccttaccgccaaggatgacccggtgtacatctgggctcctggaattatcatggagggcaaccacagcgtttgcgagaaaaagacactgcccctcacctggacagggtttatttccctgcctggagaaatcgagaaaacgacccagtgtacagtgttctgcacccttgccggccccggcgctgattgtgaagcctattctgagacagggatctttaatattagctcccctacctgcctgatcaacagagtccagcggttccgcggagccgaacaacagattaagtttgtgtgtcagagagtcgacatggacatcacggtgtactgcaatggcgttaagaaagtgattctcaccaagacactggtcatcgggcagtgtatctataccttcacaagcattttctctctgatccccggagtggctcactccctcgcggttgagctgtgcgtgccgggccttcatgggtgggccaccatgctgctcctgctgacgttttgtttcggctgggtccttattcccacaatcaccatgattctcctgaaaatcctgattgcttttgcctacctctgcagcaagtataacacagattctaaattccggatcctgatcgagaaggtgaagcgcgaataccaaaagaccatgggatccatggtgtgcgaggtttgtcagtacgaatgcgagaccgccaaggaacttgagagccacaaaaagtcctgttctattggcagctgcccttattgtctgaacccctccgaggctacaacgtctgccctccaggcgcattttaaagtctgcaagctgaccagcagattccaggaaaatctgcggaagtcccttacagtgtacgagcctatgcaagggtgttatcgcaccctcagcctgtttagataccggtctagattctttgtgggactggtctggtgcgtgctcctggttcttgaactgatcgtgtgggctgcctccgccgagacacagaacctcaatgctggctggaccgacacggcccacgggagcggaattatccccatgaaaacagatctggagctggacttctctcttccgtccagcgcttcttatacctaccgccggcagctccagaaccctgccaatgaacaagagaacattccctttcatctgcagatcagcaagcaggtcatccacgcggaaattcaacacctgggccattggatggatgccaccttcaatctcaaaacagcttttcactgttatgggtcctgcgagaagtacgcctacccttggcagaccgctggctgtttcgtggaaaaagactatgagtacgagacaggatggggctgcaatccccctgattgccccggggttggaacgggctgtaccgcctgcggggcgtatctggacaaacttaagagcgtgggaaaagtcttcaagatcgtgtctctgagatacacacgcaaagtttgtattcagctcggcaccgaacagacatgcaagaccgtggattccaacgactgtctgatcacgaccagcgtcaaagtgtgcctgattgggacaatctccaagtttcaaccgtctgatacccttctcttcctgggccctctgcagcagggaggcctcatctttaaacagtggtgtacaaccacatgccaattcggggaccccggagacattatgagcacccccacgggcatgaagtgtcctgatctgaacgggtcctttcggaagaaatgcgccttcgctacaaccccggtgtgtcagtttgacggaaataccatctctggctataagagaatgattgccacaaaagatagcttccagtcctttaacgtcaccgagccccatatctctgctagcgcccttgaatggattgaccctgattccagcctgcgcgaccacatcaatgttatcgtgtctcgggatctctccttccaggacctgagcgagacgccctgccaaattgatctgtctacagcctccatcgacggggcttggggcagcggagtgggctttaaccttgtctgcaccgtgtctctgacagaatgttccgcgttcctcaccagcattaaggcctgcgatgctgccatgtgttacgggtccacaaccgccaatctgatcagaggacagaacacgattcacatcgttggcaaagggggacatagcggctctaagtttatgtgctgtcacgacaccaagtgcagcacaaccggcctcgtggctgccgcgcctcatctggatcgcgtcacagggtataaccaggctgactccgacaaaattttcgatgacggagcccccgagtgtggcatgtcttgctggttcaagaaaagcggggagtggatccttggagtgctgaatggcaactggatggttgtggccgtcctcatcgctctgctggtgctttccattctgctctttaccctgtgttgccctcggagaccctcttaccgcaaggaacacaaaccgtga

SEQ ID NO: 13452 - RNA, 3447 nt, synthetic construct
  misc_feature 1..3447: note = derived and/or modified CDS sequence (opt5) from PUUV(Samara_94/CG/2005)__AB433852.2__GP
  source 1..3447: mol_type = other RNA
atgggcaagctgagccccgtgtgcctctacctgcttctgcaggggctcctgctttgtaacaccggaacagccagaaatctgaacgagctcaaaatcgaatgccctcacacgattggcctggggcaaggactggtcgttggctccgtggagctcccgcccgtgcctatccagcaggtcgaaaccctgaaacttgagtctagctgtaatttcgacctgcatacatccaccgctgggcagcaagcctttacaaaatggacctgggaaattaagggagatctcgcggagaacacacaggcttctagcacctccttccagacgaaatctagcgaggtgaatctgcggggcctttgcctgatccccaccctcgttattgaaacagccgcccgcatgagaaagaccatcgcttgttatgacctgtcctgcaaccagacagtgtgtcaacctaccgtctacctgatgggccccatccagacgtgcattacaaccaagagctgtctcctggggcttggagatcagcggatccaggtgaattatgagaaaacatactgcgtttctggccaactggtggaaggggtctgttttaaccctattcacaccatggccctctcccagccgagccatacctatgacatcgtgacaatgatggtgcgctgcttcctgattatcaagaaagtcacgtctggagattccatgaagattgagaaaaattttgagacccttgttcagaagaacgactgcacagctaatagcttccaaggctactatatctgttttatcgggtcttccagcgaacccctgtacgtgcctaccctcgatgactacagatccgccgaggtgctgtctcggatggcgttcgctccccacggagaagatcatgacgtcgagaagaacgccattagcgccctgcgcatcgctggcaaagtgacaggcaaggccccttccaccgaaagctctgatacggttcaggggattgcgttttccggaagccccctctatacatctaccggcgtgctggccgctaaagacgatccggtctacatctgggcccctgggattatcatggagggaaatcacagcatctgcgagaagaaaacccttcccctgacatggaccggcttcatttccctccctggggaaatcgagaagacaacgcagtgtaccgtgttttgcacactggctggacccggcgccgactgtgaagcctattctgagaccggcattttcaacatcagctcccccacatgccttattaatagagttcagcggtttcgcggggctgaacaacagatcaaattcgtgtgtcagagagtcgacatggatatcaccgtgtactgcaacggagtcaagaaggtgattctgacgaaaaccctcgttatcggccagtgtatttatacattcaccagcatcttttctctgattcctggggtggcgcactccctggccgtcgagctctgcgtgccgggactgcatggctgggctacaatgcttctgctcctgaccttctgttttgggtgggttctgatccccacgattacaatgatccttctcaagatcctgattgccttcgcctacctgtgcagcaaatataacaccgactctaagtttcggatcctcattgagaaagtgaagaaggaataccaaaagacaatgggctccatggtctgcgaggtgtgtcagtacgaatgcgagaccgctaaggaactggagagccaccgcaaatcctgttctatcggaagctgcccttattgtcttaatccctccgaggccaccacatctgcgctgcaggctcatttcaaggtgtgcaaactcacgagcagatttcaggaaaacctgcggaagtccctgaccgtttacgagcctatgcaaggctgttatcgcacacttagcctcttcagataccggtctagatttttcgtcgggctggtgtggtgcgtgctgctcgtcctggaacttattgtgtgggccgcctccgctgagacccagaatctgaacgccggatggacagataccgctcacggcagcgggatcatccccatgaagacggacctcgagctggatttttctctgccgtccagcgcctcttatacataccgccggcagcttcagaatcctgcgaacgaacaagagaatattcccttccacctccagatcagcaaacaggttattcatgccgaaatccaacacctgggacattggatggacgctacctttaacctgaagaccgccttccactgttatggctcctgcgagaaatacgcttacccttggcagacagccgggtgtttcgtggaaaaggattatgagtacgagaccggctggggatgcaatccccctgactgccccggcgtcgggacaggatgtacggcgtgcggcgcctatctcgataaacttaagagcgtggggaaggtttttaaaattgtgtctctgagatacacccgcaaggtctgtatccagctgggaacagaacagacctgcaaaacagtggactccaacgattgtctcatcaccacgagcgttaaggtgtgcctgattggcaccatctccaaattccaaccgtctgacacactgctttttctcgggcctctgcagcagggcggactgattttcaagcagtggtgtaccacaacctgccaatttggcgaccccggggatatcatgagcacacccaccggaatgaaatgtcctgacctcaatggctccttccggaagaagtgcgcttttgccacgacaccggtctgtcagttcgatgggaacaccatttctggatataaaagaatgatcgctaccaaggacagctttcagtccttcaatgtgacagagccccatatctctgccagcgccctggaatggattgatcctgactccagccttcgcgatcacatcaacgtgattgtctctcgggacctgtcctttcaggatctcagcgagaccccctgccaaatcgacctgtctacgacatccattgatggcgcttgggggagcggcgttggattcaatctggtgtgcaccgtgtctcttacagaatgttccgcgtttctgaccagcatcaaagcctgcgacgctgccatgtgttacggctccacaaccgccaacctcattagagggcagaacacgatccacatcgtcggaaagggcgggcatagcggatctaaattcatgtgctgtcacgataccaagtgcagcacaaccggcctggtggctgccgcgcctcatctcgaccgcgttacaggctataatcaggctgactccgataagattttcgacgatggggcccccgagtgtggaatgtcttgctggtttaaaaagagcggcgagtggatcctgggggtgcttaacggaaattggatggtcgtggccgttctgattgctctcctggtgctgtccatccttctgttcaccctctgttgccctcggagaccctcttaccgcaaagaacacaagccgtga

SEQ ID NO: 13453 - RNA, 3447 nt, synthetic construct
  misc_feature 1..3447: note = derived and/or modified CDS sequence (opt5) from PUUV(Sotkamo)__NC_005223.1__GP
  source 1..3447: mol_type = other RNA
atgggcaagagctcccccgtgtgcctgtacctcatcctgcaggggcttcttctcttcgacaccgtcaacgccaaaaatctgaacgagcttaagatggaatgtcctcacacaattggactgggccaagggctcgttgtgggatctgtggagctgccgcccgtccctatccagcagattgaaagcctgaaactcgagtcctcttgcaattttgatctgcatacgagcaccgctggccagcaatccttcacaaagtggacctgggaaacaaaaggggaccttgccgagaacacccaggcgtctagcacatcctttcagaccaagagctctgaggtgaatctgagaggactctgtctgatccccacgcttgttgtggaaaccgctgcccggatgcgcaagacaattgcctgctatgatctgtcctgtaaccagaccgtctgccaacctacagtgtacctcatgggccccatccagacctgtctgacgacaaaaagctgcctgctcggcctgggggaccagagaatccaggttaattatgagcggacctactgtgtgtctggacaacttgtcgaaggcgtgtgcttcaaccctattcacacaatggctctgtcccagccgagccatacctatgatatcgtgaccattatggtccgctgttttctcgttatcaagaaagtgacatctggggactccatgaagattgagaaaaatttcgagacgctggtgcagaagaccggatgcacagccaacggctttcaagggtactatatctgccttattggaagctcctctgaacccctgtacgtccctaccctcgatgactacagaagcgctgaggtgctgtcccggatggccttcgcgccccacggcgaagatcatgacatcgagaagaatgccgttagcgctctgcgcatcgccggcaaagtgacagggaaggctccttctaccgaatccagcgatacggtccagggaattgccttttctggcagccccctctatacatccaccggggtgctgaccgcgaaagacgatccggtttacgtgtgggcccctggaatcattatggagggcaaccactctgtctgtgagaagaaaacacttcccctgacctggacagggttcatccctctccccggagaaattgagaagacgacccagtgcacagtgttttgtaccctggctggccccggcgccgactgcgaagcctatagcgagacagggatcttcaatatctccagccctacctgtcttattaacagagtccagcggtttcgcggagccgaacaacagatcaaattcgtgtgccagagagttgacatggatattacggtgtactgtaatggcgtcaagaaggtgatcctgaccaaaacactcgttattgggcagtgcatctataccttcacatctatcttttccatgattccgggaatcgcccacagcctggctgtggagctgtgtgtccccggcctccatgggtgggcgaccgtgctgcttctgctcacgttctgctttggctgggtgctgattcctacaatcaccatgattctgcttaagatcctcattgccttcgcttacctgtgttctaaatataacacagactccaagtttcggatcctggttgagaaagtcaagaaggaataccaaaagaccatgggaagcatggtgtgcgaggtgtgccagtacgaatgtgagaccgccaaggaactcgagtcccaccgcaaatcttgcagcatcggctcctgtccctattgcctgaacccttctgaggccacacccagcgctctgcaggcccatttcaaggtctgtaaactgacgtccagatttcaggaaaatctcaaaaagagcctgaccatgtacgagccgatgcaagggtgctatcggacactgtctcttttccgctacagatcccggtttttcgtgggactcgtttggtgtatgctgctggtgctcgaactgattgtctgggcggctagcgccgagacccagaaccttaatgatggctggacagacaccgcccacgggtctggaatcattcctatgaaagctgatctggagctcgacttttccctgcccagctctgccagctatacgtacagacgccagctgcagaaccctgctaatgaacaagagaagatccccttccaccttcagatttccaaacaggtgatccatgccgaaatccaacacctcggccattggatggatgcgacatttaacctgaagaccgccttccactgctatgggagctgtgagaaatacgcttacccttggcagaccgccggctgcttcgttgaaaaggactatgagtacgagacaggatggggctgtaatcccccggattgccctggggtgggaaccggctgcacagcttgtggggtctatctggacaagctcaaatctgtgggaaaggtttttaaaattgtgtccctgcggtacacgagaaaggtctgcatccagcttggcaccgggcagacatgtaaaaccgtggatagcaacgactgcctgattacaacctccgtgaaggtctgtctcatcggcacgatttctaaattccaacccagcgacaccctgctgtttcttggacccctccagcagggcgggctgatcttcaagcagtggtgcacaaccacatgtcaatttggagatcctggcgacatcatgtccaccccgacagggatgaagtgccccgaactgaatggatctttccgcaaaaagtgtgcctttgcgaccacgcctgtttgccagttcgatggcaacacaattagcgggtataaacggatggtggccaccaaggactcctttcagtctttcaatgtgaccgagccccatatcagcacatccgctctcgaatggattgatctggacagctctcttagagatcacatcaacgtcattgtgtcccgcgacctgagctttcaggatctctctgagaccccttgtcaagttgacctgacgacatccgccaccgatggcgcttggggaagcggcgtggggttcaatctggtctgcacagtgtctcttaccgaatgctccgcctttctgacaagcatcaaagcctgtcacgctgcgatgtgctacggatccaccacgaccaacctcgttcggggccagaatacaatccatgtggtcgggaagggaggccacagcggctctaagttcatgtgttgccatgacaccaaatgtagctccacagggctggtggccgctgctccccacctcgatagagttaccggattcaaccaggccgactctgacaagatttttgatgacggcgctcctgagtgcgggatgagctgttggttcaaaaagctgggagagtgggtgcttggcgtcctgaacgggaattggatggtggtggccgtcctcatcgcgctgctgattctttccatctttctgttcgctctctgctgtccccgccggccgtcttataaaaaggatcacaagccttga

SEQ ID NO: 13454 - RNA, 3447 nt, synthetic construct
  misc_feature 1..3447: note = derived and/or modified CDS sequence (opt5) from PUUV(2009)__HE801634.1__GP
  source 1..3447: mol_type = other RNA
atgggcaagagctcccccgtgtgcctgtacctcatcctgcaggggcttctcctgttcgacaccgtcaacgccagaaatctgaacgagcttaaaatggaatgtcctcacacaattggactgggccaagggctcgttgtgggatctgtggagctgccgcccgtccctatccagcagattgaaagcctgaagctcgagtcctcttgcaattttgatctgcatacgagcaccgctggccagcaatccttcacaaaatggacctgggaaacaaagggggaccttgccgagaacacccaggcgtctagcacatcctttcagaccaaaagctctgaggtgaatctgcggggactctgtctgatccccacgcttgttgtggaaaccgctgcccgcatgagaaagacaattgcctgctatgatctgtcctgtaaccagaccgtctgccaacctacagtgtacctcatgggccccatccagacctgtctgacgacaaagagctgcctgctcggcctgggggaccagcggatccaggttaattatgagcgcacctactgtgtgtctggacaacttgtcgaaggcgtgtgcttcaaccctattcacacaatggctctgtcccagccgagccatacctatgatatcgtgaccattatggtcagatgttttctcgttatcaaaaaggtgacatctggggactccatgaaaattgagaagaatttcgagacgctggtgcagaaaaccggatgcacagccaacggctttcaagggtactatatctgccttattggaagctcctctgaacccctgtacgtccctaccctcgatgactaccggagcgctgaggtgctgtcccgcatggccttcgcgccccacggcgaagatcatgacatcgagaagaatgccgttagcgctctgagaatcgccggcaaggtgacagggaaagctccttctaccgaatccagcgatacggtccagggaattgccttttctggcagccccctctatacatccaccggggtgctgaccgcgaaggacgatccggtttacgtgtgggcccctggaatcattatggagggcaaccactctgtctgtgagaaaaagacacttcccctgacctggacagggttcatccctctccccggagaaattgagaaaacgacccagtgcacagtgttttgtaccctggctggccccggcgccgactgcgaggcttatagcgaaacagggatcttcaatatctccagccctacctgtcttattaaccgggtccagcgctttagaggagccgaacaacagatcaagttcgtgtgccagcgggttgacatggatattacggtgtactgtaatggcgtcaaaaaggtgatcctgaccaagacactcgttattgggcagtgcatctataccttcacatctatcttttccctgattccgggaatcgcccacagcctggctgtggagctctgtgtccccggcctgcatgggtgggcgaccgtgcttctgctcctgacgttctgctttggctgggtgctgattcctacaatcaccatgattcttctcaaaatcctgattgccttcgcttacctgtgttctaagtataacacagactccaaatttaagatcctcgttgagaaagtcaagaaggaataccaaaagaccatgggaagcatggtgtgcgaggtgtgccagtacgaatgtgagaccgccaaggaactggagtcccaccgcaaatcttgcagcatcggctcctgtccctattgccttaacccttctgaggccacacccagcgctctgcaggcccatttcaaggtctgtaaactcacgtccagatttcaggaaaatctgaaaaagagcctgaccatgtacgagccgatgcaagggtgctatcggacactttctctcttccgctacagatcccggtttttcgtgggactggtttggtgtatgctgctcgtgctggaacttattgtctgggcggctagcgccgagacccagaacctgaatgccggctggacagataccgctcacgggtctggaatcattcctatgaaagccgacctcgagctggatttttccctgcccagctctgctagctatacgtacagacgccagcttcagaaccctgccaatgaacaagagaagatccccttccacctccagatttccaaacaggtgatccatgcggaaatccaacacctgggccattggatggacgccacatttaacctgaagaccgctttccactgctatgggagctgtgagaaatacgcctacccttggcagaccgctggctgcttcgttgaaaaggattatgagtacgagacaggatggggctgtaatcccccggactgccctggggtgggaaccggctgcacagcctgtggggtctatctcgataagctgaaatctgtgggaaaggtttttaaaattgtgtcccttcggtacacgagaaaggtctgcatccagctgggcaccgaacagacatgtaaaaccgtggacagcaacgattgcctcattacaacctccgtgaaggtctgtctgatcgggacgatttctaaattccaacccagcgacaccctgctttttctcggccccctgcagcagggaggcctgatcttcaagcagtggtgcacaaccacatgtcaatttggggaccctggagatatcatgtccaccccgacaggcatgaagtgccccgagctcaatgggtctttccgcaaaaagtgtgcgtttgccaccacgcctgtttgccagttcgacggaaacacaattagcggctataaacggatggtggctaccaaggattcctttcagtctttcaatgtgaccgaaccccatatcagcacatccgccctggagtggattgaccctgatagctctcttagagaccacatcaacgtcattgtgtcccgcgatctgagctttcaggacctctctgaaaccccctgtcaagttgatctgacgacatccgctatcgacggggcctggggcagcggagtgggcttcaatctggtctgcaccgtgtctcttacagagtgctccgcctttctgaccagcatcaaggcttgtgatgcggccatgtgctacgggtccacaaccacgaacctcgttcggggacagaataccattcacgtggtcggcaaagggggacatagcggctctaagttcatgtgttgccacgacacaaaatgtagctccaccggcctggtggctgccgcccctcatctcgatagagttacagggttcaaccaggctgactctgacaagatctttgatgacggagcccccgagtgcggcatgagctgttggttcaaaaagctgggggaatgggtgcttggagtcctgaacggcaattggatggtggtggcggtcctcattgctctgctgatcctttccatttttctgttcgccctctgctgtccgcgccggccttcttataaaaaggagcacaagccctga

SEQ ID NO: 13455 - RNA, 3447 nt, synthetic construct
  misc_feature 1..3447: note = derived and/or modified CDS sequence (opt5) from PUUV(Umea/hu)__AY526218.1__GP
  source 1..3447: mol_type = other RNA
atgggcaagctgagccccgtgtgcctctacctgttccttcagtgtctgctcctgtggtccagagggtctgcccggaaccttaatgagctgaaaatggaatgccctcacaccatcggactcggccaagggctggtcattggaagcgttgagctgccgcccgtgcctgtgcagcaggtcgaatccctcaagctggagtctagctgtaactttgaccttcatacatccacggctacccagcaatctttcacaaaatggacctgggaaatgaaggatgacctggccgagaatacacaggcgagctccaccagctttcagacaaaatcttccgaggtgaacctccgcggcctgtgccttattccccctctggttgtggaaaccgctagcagaacgcggaagaccatcgcctgtttcgatatctcttgcaatcagacagtctgtcaacccaccgtgtatctcgttgggcctattcagacatgcatcaccacgaagtcctgtctgctgggactcggcgaccagcgcatccaggtgaactacgagaaaacatattgcgtcagcggccaactggtggaaggggtgtgttttaatccggtccacaccatggttctttctcagccctcccatacatacgatattgtgaccatgatggtgagatgcttcctggtcgtgaagaaagttaccagcggagactccatgaagatcgagaaaaacctcgagacactggtgcagaagacggattgcaatgccaacggctttcaagggtattacatttgtcttgtcggatctagctccgaacctctgtatgtgcccaccctcgacgattaccggagcgctgaggttctgtctcgcatggccttcgctcctcacggcgaagaccatgatatcgagagaaatgccgtgtccgcgctgcggattgtcgggaaggtgacaggaaaagcccccagcaccgaagcctctgacacaatccagggcattgcctttagcggctccccgctctacacctctacgggggtcctgacagctaaggataaccctgtgtatgtttggagccccggaatcatcatggagggcaatcactccgtgtgcgagaaaaagacccttcctctgacctggacagggttcattcccctccccggagaaatcggcaaaaccagccagtgtacagtcttttgcacgctggccgggcctggagcggactgtgaggcctactctgaaaccggcattttcaacatctccagcccgacatgccttattaatcgcgctcagagatttcggggcgccgagcaacagatcaagttcgtgtgtcagcgcgttgacatggatatcaccgtgtattgcaacgggatgaaaaaggtcattctgacaaagaccctcgtgatcggacagtgtatttacacgttcacctctatcttttccctgattcccggcatcgctcacagcctggccgtggaactctgcgttcctgggctgcatggatgggccacagtccttctgctcctgaccttctgttttggctggatcctgattcccttcatcgctatgatttcccttaaaatcctcattgcgtttgcctatctgtgctctaagtacaacacagacagcaaattcaagatcctgattgagaaagtgaagaaggagtatcaaaagaccatggggtccatggtgtgcgaagtctgtcagtacgagtgcgaaacggctaaggagctcgaatctcacagaaaaagctgtcctatcggctcctgcccctactgtctgaatccgagcgaggccacaacctctgcccttcaggctcattttaaggtgtgcaaactgacatcccgggttcaggataacctccgcaagagcctggccgcgtatgagcctaagcaaggatgttacagaaccctgtctcttttccggtatagatcccgctttttcgtgggctttatctggtgcattctcctggtcctggaactcatcatttgggctgccagcgccgagacccagaatctgaactctgggtggacagacacggctcacggaagcggcatcattcccatgcggaccgatcttgaactggacttctccctccctagctctgcctcctacacatatagacgccagctgcagaatcccgctaacgagcacgagaaaatcccttttcatctgcaaatcagcaaacaggtgattcacgccgaaatccagcatcttgggcactggatggatgcgaccttcaatctcaaaacagccttccattgttacggatcctgcgagaagtatgcttacccctggcaaaccgccggctgctttttcgaaaaagactacgagtttgaatctagctgggggtgtaacccgcctgattgccccggcgttggaacgggctgtacagcttgcggggtgtatctggacaagctgaagtccgtcggaaaagtgttcaagattatctctctccggtacaccagaaaagcctgtattcagctgggcaccgagcagacatgcaagagcgttgattccaatgactgtcttgtgaccacatctgtcaaagtgtgcctgatcgggacggtgagcaagtttcagccctccgacaccctcctgttcctgggacctcttgagcaaggcgggctcatctttaaacagtggtgtacaaccacatgccagttcggcgatccgggagacattatgagcacccccacgggcatgaagtgtcctgaactgaacgggtcttttcgcaagaaatgcgcgttcgccaccacacccgtctgtcagtttgatggaaataccatctccggctataagcggatgattgctacaaaagacagcttccaatcttttaacgttaccgatcctcacatctccacaagcgccctggagtggattgaccccgattcttccctcagagaccacatcaatgtggtggtcagccgcgatctgtccttccaggaccttagcgaaaccccttgccaggtggatctgacgacatctagcatcgacggggcttggggatccggcgttgggttcaacctcgtgtgcaccgtctctctgaccgagtgtagcacatttctgacctccattaaggcctgcgattctgccatgtgttacggcagcacgacaatcaatcttatgcggggacagaacaccgtgcatattgttggcaaagggggacactccggctctaagttcatgtgctgtcatgacacaaagtgcagctccaccgggctggtggctgcggctccccacctcgacagagtcacaggatttaaccaagctgatagcgacaaaatcttcgatgacggcgccccggaatgtggcatgtcttgctggtttaagaaatccggggagtggattctgggagtgctcaatggcaactggctggttgtggccgtccttgtggctctgttcatcctcagcatttttctgttcaccctgtgttgccctcgccggcccatctatgccaaggagcacaaaccttga

SEQ ID NO: 13456 - RNA, 3447 nt, synthetic construct
  misc_feature 1..3447: note = derived and/or modified CDS sequence (opt5) from PUUV(P360)__L08755.1__GP
  source 1..3447: mol_type = other RNA
atgggcgagctgagccccgtgtgcctctgtctgcttctgcaggggctcctgctttgcaacaccggagccgctagaaatctgaacgaactcaagatggagtgtcctcacacaatccggctgggccaagggctggtcgttggatccgtggaactcccgtctctgcccattcaacaggtggagacgcttaaactggaaagctcctgcaatttcgacctccatacctctacagccggccagcagagctttaccaagtggacatgggagatcaaaggggatctggcggagaacacccaggcttcctctaccagcttccagacaaagtccagcgaagtcaatcttcgcggactgtgtctcattcctacgctggtggttgagaccgccgccagaatgcggaaaacaatcgcttgctacgacctgtcttgtaaccagaccgtgtgccaacccacagtctatctcatgggccctattcagacctgtatcacgacaaagtcctgcctgcttagcctgggcgatcagcgcatccaggtgaattacgaaaagacctattgtgtttctgggcaactcgtggagggaatttgctttaaccccatccacacaatggccctgtcccagcctagccatacctacgacattatgaccatgatggtcagatgcttccttgtgatcaaaaaggtgacatctggcgattccatgaaaattgagaagaattttgaaacgctggtccagaaaaacgggtgtaccgctaataacttccaaggatattacatctgcctcattggcagctcctctgagccgctgtatgttcccgccctggacgattaccggagcgcggaagtgctctcccgcatggcctttgctcctcacggggaggaccatgatatcgaaaagaatgccgtgagcgctatgagaatcgccggaaaggtcacaggcaaagcgccctctaccgagtccagcgacacagtgcagggcattgccttctctgggagccctctgtacacctccacgggagttcttacatctaaggatgaccccgtgtatatctgggctccgggcattatcatggaggggaaccacagcatttgtgagaaaaagaccctgcctctcacctggacaggatttatctccctgcccggcgaaatcgagaaaaccacacagtgcacggtcttctgtacccttgccgggcctggagctgattgcgaagcctacagcgaaacaggcatttttaatatctcttcccccacctgtctgattaaccgggtgcagcgcttcagaggcagcgagcaacagatcaagtttgtttgccagcgggtggacatggacattacagtctattgtaacgggatgaaaaaggtgatcctcaccaagacgctggtcatcggacagtgcatttacaccttcacatctatcttctccctgattcccggcgtggcccacagcctcgctgttgagctgtgtgtgcctgggcttcatggatgggcgaccatgctgctcctgctgacattttgcttcggctgggtccttatcccgaccattacgatgatcctcctgaaaattctgatcgcctttgcttatctctgctccaagtacaatacagattctaaattccgcatcctgattgaaaaggtgaaaagagagtatcaaaagaccatggggagcatggtttgtgaagtgtgccagtacgagtgtgaaacagccaaggagcttgagtcccaccggaaatcttgcagcatcggctcctgtccctactgcctgaaccctagcgaagccaccacctctgctctccaggcccattttaaggtctgtaaactgacatcccgcttccaggagaatctgagaaagagccttacggtgtatgaacccatgcaaggatgctaccggaccctctctctgtttagatatcgctcccggttctttgtgggcctggtttggtgtgtcctcctggtgcttgagctgattgtgtgggcggctagcgccgagacacagaacctcaatgccgggtggaccgacacagctcacggatctggcatcattcctatgaaaaccgatctggaactggacttcagccttccctccagcgcctcttacacgtatagacgccagctccagaacccggctaatgagcaagaaaagatcccttttcatctgcagctgtccaagcaggtcatccacgccgagattcaacacctcgggcattggatggatgcgacattcaacctgaaaaccgcctttcactgctacggaagctgtgaaaagtatgcttacccctggcagaccgccggctgcttcatcgagaaagactacgagtatgaaacagggtggggctgcaatcctcccgattgtcctggagtgggcaccgggtgcacagcttgtggagtttaccttgacaagctgaaatccgtgggcaaggtcttcaagattgtgtctctccggtatacgagaaaagtttgcatccagctggggaccgagcagacatgtaagaccgtggatagcaacgactgcctgattacaacctccgtcaaagtgtgtcttatcggaacgatctctaagtttcaacccagcgataccctcctgttcctgggcccgctccagcaagggggcctgatttttaaacagtggtgcacaaccacatgtcagttcggagaccctggcgacatcatgtccacccccacagggatgaagtgccccgaacttaatggatcttttcgcaaaaagtgtgccttcgcgaccacgcctgtttgccagtttgatggcaacacaattagcgggtacaagcggatgatcgccaccaaagactccttccagagctttaatgtgaccgagccgcatatttctacatccgctctggaatggatcgatcccgacagctctctcagagatcacatcaacgtcattgtgtcccgcgacctgagcttccaggatctgtctgagaccccttgccaaatcgaccttgccacggcttccattgatggagcctggggcagcggggtgggctttaatctggtctgtacagtttccctcaccgagtgcagcgccttcctgacatctatcaaggcttgtgacgcggccatgtgctatggaagcaccacagctaacctcgtgcggggccagaacaccattcacatcgtggggaaaggaggccattccgggtctaagtttatgtgttgccacgatacgaaatgtagctccaccggactggtcgccgccgctccccatcttgacagagtgacaggctacaatcaggccgattctgacaagattttcgacgatggcgcgcctgaatgcgggatgagctgttggttcaagaaatccggagagtggatcctgggcgttctcaacgggaattggatggtggtcgctgtgctggttgtgctgcttatcctgtctattctcctgtttaccctctgctgtccccgccggcctagctatagaaaggaacacaaaccctga

SEQ ID NO: 13457 - RNA, 3447 nt, synthetic construct
  misc_feature 1..3447: note = derived and/or modified CDS sequence (opt5) from MUV(11-1)__JX028272.1__GP
  source 1..3447: mol_type = other RNA
atgggcaagatcagccccgtgtacctgtatctcctgttccaggggcttctgctctggagagacggactggcccggaaccttaatgagctgaaaatggaatgccctcacaccattggcctcgggcaaggactggtcatcggctccgttgagctgccgcccgtgcctctccgccaggtggaatctctgaaacttgagagctcctgtaactttgatctgcatacatctacggctacccagcagagcttcacaaaatggatttgggaatccaagaatgacctcaccgattctacacaagccagctccaccagctaccagacaaaatctaccgaggtcaacctgaaggggctttgcctggtgcccacgctcgttatcgagaccgcggctagaacacggaagaccattgcctgttttgacctgtcctgcaatcagacagtgtgtcagcctaccgtctatctgatcggacccatccaaacgtgcattacaaccaaaagctgtctcatcggcctgggcgatcagcgcattcaggtgaactacgaaaagacatattgcgtttctgggcagcttgtggagggagtctgtttcaatcctatccacaccatggccctgtcccaaccgagccatacctacgacgtggtgacaatgatggtcagatgctttctcgttgtgaaaaaggtgacgtctggcgattccatgaaaattgaaaagaacttcgagaccctggtccagaagacagggtgtagcaataacaattttcagggatattacgtgtgccttatcggctcctctagcgagcccctgtacgttcctaccctcgacgattatcggtccgctgaaattctgagccgcatggccttcgctccccacggggaggaccatgatatcgaaagaaacgccatctctgcgatgcggattgtgggaaaagtcacaggcaaggccccttccagcgagtctagcgacaccgtgcaaggcgttgctttttccgggaatcccctgtacacgtctacaggagtgctcaccagcaaagatgacccggtctatgtgtgggcccctggcatcattatggaagggaaccactccgtctgcgacaagaaaaccctgccccttacatggaccggatacatccctctgcccggcgagattgagaagacaacgcagtgtaccgtgttctgcacactcgctgggcccggagccgattgtgaagcgtatagcgagaccggcatctttaatatctcttcccctacatgcctgattaaccgcgttcagagattccggggcgccgaacagcaaatcaaatttgtgtgtcagcgcgtcgacatggatattaccgtgtactgcaacgggatcaagaaggttattcttacgaaaaccctggtgatcggacagtgtatctatacattcaccagcattttctctctcatgccgggcgtcgctcactccctggccgtggagctgtgcgtgcccgggctccatggatgggctacaatgctgcttctgctcaccttttgtttcggctggatcctgattcctacgatcacactgattcttctcaagatcctgctggcctttgcctacgtttgcagcaaatacaataccgactccaagttcaaaattctcatcgaaaaggtcaagcaggagtatcaaaagacaatggggtctatggtgtgtgaggtgtgccagcacgaatgcgagaccgctaaggaactggagagccataaaaagtcctgtcccatcggctcttgcccttactgtcttaaccccgcggaagccaccacaagcgctctgcaggcccactttaaagtctgcaagctcacgtccagattccaggagaatctgcgcaagagcctgaccgtgtatgagccgaaacaaggatgttaccggacactttctctctttagatatcggtccagatgcttcgttggcctgatttggtgtatcctgctcaccctggaacttattgtgtgggccgctagcgccgagacactgaacctcaatcctgggtggaccgatacggcgcacggatctggcatcgtccccatgaagacagacctggaactggatttttcccttcctagctctgctagctacacctatcgccggtccctccagaaccccgccaatgagcaggaacaggtgcctttccatctgcaaattgaaaaacaggttatccacgccgagatccagcatctggggcactggatggacgctacctttaacctcaagacagccttccattgctacggagcttgtgaaaaatacgcctatccctggcaaaccgcgggctgctttgtggagaaggatttcgagttcgagaatgggtggggctgtaacccgcctgactgccccggagtcggcacagggtgcacggcctgtggagcttacctggataaacttaagagcgtgggcaaggtttttaaaattgtgtctctgagatatacccgcaaggcctgcatccagctcgggacagagcagacctgtaaaaatgtcgactccaacgactgcctggtgacaaccagcgtgaaggtctgtctgattggaacgatctccaaattccagccctctgatacccttctctttctgggccctctggaacaagggggcattatcttcaagcagtggtgcacaaccacatgtcagtttggagacccgggcgatatcatgagcacccccattgggatgaagtgccctgagctcaatggatccttccggaaaaagtgttcttttgctacaacccccgtttgccagttcgacggcaacacgatcagcgggtacaaaagaatgattgccacaaaggattcctttcaatctttcaatgtgaccgaacctcacatcagcgcgtccgccctggagtggattgaccccgatagctctcttcgcgaccacatcaacgtggtcgtgggacgggatctgccttttcaggacctctccgaaaccccctgtcagatcgatctgagcacatcttccattgacggcgcttgggggagcggcgttggattcaacctggtgtgctctgtctcccttaccgagtgctttacgttcctgaatagcatcaaagcctgtgatacagctatgtgctatggctccaccacagccaacctcgtgagagggcagaataccgttcatgtggtcggaaagggcgggcacagcggatctaagttcatgtgttgccatgacacaaaatgtagcaacaccggcctgctcgccgctgcgccgcacctggaccgcgtgacgggctacaatcaagccgattccgacaaggtttttgatgacggggctcctgagtgcggaatgacctgttggttcaaaaagtctggcgaatggattatgggggtgcttagcggaaactggatggtcgtggccgtgctgatcacactcctggtcctgtccatttttcttttcgccctgtgctgtccccggagagctgcctataaaaaggagcacaagccttga

SEQ ID NO: 13458 - RNA, 3447 nt, synthetic construct
  misc_feature 1..3447: note = derived and/or modified CDS sequence (opt5) from MUV(11-4)__JX046483.1__GP
  source 1..3447: mol_type = other RNA
atgggcaagatcagccccgtgtacctgtgcctcctgcttcaggggctgctcctgtggagagacggacttgcccggaacctgaatgagctcaaaatggaatgtcctcacaccattggcctggggcaaggactggtcatcggctccgttgagctcccgcccgtgcctctgcgccaggtggaatctcttaagctggagagctcctgcaacttcgatctccatacatctacggctacccagcagagctttacaaaatggatttgggaatccaagaatgacctgaccgattctacacaagccagctccaccagctatcagacaaaatctaccgaggtcaaccttaaggggctgtgtctcgtgcccacgctggttatcgagaccgcggctagaacacggaagaccattgcctgcttcgacctgtcctgtaatcagacagtgtgccagcctaccgtctacctcatcggacccatccaaacgtgtattacaaccaaaagctgcctgatcggccttggcgatcagcgcattcaggtgaactatgaaaagacatactgtgtttctgggcagctggtggagggagtctgctttaatcctatccacaccatggccctctcccaaccgagccatacctatgacgtggtgacaatgatggtcagatgtttcctggttgtgaaaaaggtgacgtctggcgattccatgaaaattgaaaagaactttgagacccttgtccagaagacagggtgcagcaataacaatttccagggatactatgtgtgcctgatcggctcctctagcgagcccctctacgttcctaccctggacgattaccggtccgctgaaattctgagccgcatggcctttgctccccacggggaggaccatgatatcgaaagaaacgccatctctgcgatgcggattgtgggaaaagtcacaggcaaggccccttccagcgagtctagcgacaccgtgcaaggcatcgctttctccgggaatcccctctatacgtctacaggagttctgaccagcaaagatgacccggtgtacgtctgggcccctggcattatcatggaagggaaccactccgtgtgtgacaagaaaacccttcccctgacatggaccggatatattcctctccccggcgagatcgagaagacaacgcagtgcaccgtcttttgtacactggctgggcccggagccgattgcgaagcgtacagcgagaccggcatcttcaatatttcttcccctacatgtcttatcaaccgcgtgcagagatttcggggcgccgaacagcaaattaaattcgtttgccagcgcgtggacatggatatcaccgtctattgtaacgggattaagaaggtgatcctgacgaaaaccctcgttatcggacagtgcatttacacatttaccagcatcttctctctgatgccgggcgtggctcactccctggccgtcgagctctgtgtgcccgggctgcatggatgggctacaatgcttctgctcctgaccttctgctttggctggattctgatccctacgattacacttatcctcctgaagattctgctcgccttcgcctatgtgtgtagcaaatacaataccgactccaagtttaaaatcctgatcgaaaaggttaagcaggagtaccaaaagacaatggggtctatggtctgcgaggtgtgccagcacgaatgtgagaccgctaaggaacttgagagccataaaaagtcctgccccattggctcttgtccttattgcctgaaccccgcggaagccaccacaagcgctctccaggcccacttcaaagtgtgtaagctgacgtccagatttcaggagaatctgcggaaaagccttaccgtctacgagccgaaacaaggatgctatcgcacactctctctgttcagataccggtccagatgttttgtgggcctgatctggtgcattctcctgacccttgaactgatcgtttgggccgctagcgccgagacactcaacctgaatcctgggtggaccgatacggcgcacggatctggcattgtgcccatgcgcacagacctggaacttgatttctccctccctagctctgctagctatacctaccggagatccctgcagaaccccgccaatgagcaggagcagatcccttttcatctgcaaatcgaaaagcaggtcattcacgccgagatccagcatctcgggcactggatggacgctaccttcaacctgaaaacagcctttcattgttatggagcttgcgaaaagtacgcctacccctggcaaaccgcgggctgtttcgtggagaaagattttgagttcgaaaatgggtggggctgcaacccgcctgactgccccggagttggcacagggtgtacggcctgcggagcttatcttgataagctcaagagcgtgggcaaagtcttcaagattgtgtctctgcgctacacccggaaagcctgtatccagctggggacagagcagacctgcaagaatgttgactccaacgactgtctggtgacaaccagcgtcaaagtgtgccttattggaacgatctccaagtttcagccctctgataccctcctgttcctgggccctctcgaacaagggggcatcatttttaaacagtggtgtacaaccacatgccagttcggagacccgggcgatatcatgagcacccccattgggatgaagtgtcctgagctgaatggatcctttagaaagaaatgctctttcgctacaacccccgtgtgtcagtttgacggcaacacgatcagcgggtataagcgcatgattgccacaaaagattccttccaatcttttaatgtcaccgaacctcacatcagcgcgtccgcccttgagtggatcgaccccgatagctctctgcgggaccacattaacgttgtggtgggaagagatctccctttccaggacctgtccgaaaccccctgccagatcgatctgagcacatcttccattgacggcgcttgggggagcggcgtcggatttaaccttgtgtgctctgtttccctgaccgagtgtagcacgttcctcacatccatcaaggcctgcgataccgctatgtgttacggcagcacaaccgccaatctggtgcgcgggcagaacacagtccatgtggttggaaaaggcgggcactctggaagcaagtttgtgtgctgtcatgacaccaagtgctccaatacgggcctcctggccgctgcgccgcaccttgaccgggtcaccggctataaccaagccgattctgacaaagtgttcgatgacggggctcctgagtgtggaatgacatgctggttcaagaaaagcggcgaatggattatgggggttctgtccggaaattggatggtggtcgccgtgctcatcaccctgctggtgctttctatttttctgttcgccctctgttgccccagacgcgctgcctacaagaaagagcacaagccttga

SEQ ID NO: 13459 - RNA, 3447 nt, synthetic construct
  misc_feature 1..3447: note = derived and/or modified CDS sequence (opt5) from MUV(11-5)__JX046486.1__GP
  source 1..3447: mol_type = other RNA
atgggcaagatcagccccgtgtacctgtgcctcctgcttcaggggctgctcctgtggagagacggacttgcccggaacctgaatgagctcaaaatggaatgtcctcacaccattggcctggggcaaggactggtcatcggctccgttgagctcccgcccgtgcctctgcgccaggtggaatctcttaagctggagagctcctgcaacttcgatctccatacatctacggctacccagcagagctttacaaaatggatttgggaatccaagaatgacctgaccgattctacacaagccagctccaccagctatcagacaaaatctaccgaggtcaaccttaaggggctgtgtctcgtgcccacgctggttatcgagaccgcggctagaacacggaagaccattgcctgcttcgacctgtcctgtaatcagacagtgtgccagcctaccgtctacctcatcggacccatccaaacgtgtattacaaccaaaagctgcctgatcggccttggcgatcagcgcattcaggtgaactatgaaaagacatactgtgtttctgggcagctggtggagggagtctgctttaatcctatccacaccatggccctctcccaaccgagccatacctatgacgtggtgacaatgatggtcagatgtttcctggttgtgaaaaaggtgacgtctggcgattccatgaaaattgaaaagaactttgagacccttgtccagaagacagggtgcagcaataacaatttccagggatactatgtgtgcctgatcggctcctctagcgagcccctctacgttcctaccctggacgattaccggtccgctgaaattctgagccgcatggcctttgctccccacggggaggaccatgatatcgaaagaaacgccatctctgcgatgcggattgtgggaaaagtcacaggcaaggccccttccagcgagtctagcgacaccgtgcaaggcatcgctttctccgggaatcccctctatacgtctacaggagttctgaccagcaaagatgacccggtgtacgtctgggcccctggcattatcatggaagggaaccactccgtgtgtgacaagaaaacccttcccctgacatggaccggatatattcctctccccggcgagatcgagaagacaacgcagtgcaccgtcttttgtacactggctgggcccggagccgattgcgaagcgtacagcgagaccggcatcttcaatatttcttcccctacatgtcttatcaaccgcgtgcagagatttcggggcgccgaacagcaaattaaattcgtttgccagcgcgtggacatggatatcaccgtctattgtaacgggattaagaaggtgatcctgacgaaaaccctcgttatcggacagtgcatttacacatttaccagcatcttctctctgatgccgggcgtggctcactccctggccgtcgagctctgtgtgcccgggctgcatggatgggctacaatgcttctgctcctgaccttctgctttggctggattctgatccctacgattacacttatcctcctgaagattctgctcgccttcgcctatgtgtgtagcaaatacaataccgactccaagtttaaaatcctgatcgaaaaggttaagcaggagtaccaaaagacaatggggtctatggtctgcgaggtgtgccagcacgaatgtgagaccgctaaggaacttgagagccataaaaagtcctgccccattggctcttgtccttattgcctgaaccccgcggaagccaccacaagcgctctccaggcccacttcaaagtgtgtaagctgacgtccagatttcaggagaatctgcgcaagagccttaccgtctacgagccgaaacaaggatgctatcggacactctctctgttcagataccggtccagatgttttgtgggcctgatctggtgcattctcctgacccttgaactggttgtgtgggccgctagcgccgagacactcaacctgaatcctgggtggaccgatacggcgcacggatctggcatcgtccccatgcgcacagacctggaacttgatttctccctccctagctctgctagctatacctaccggagatccctgcagaaccccgccaatgagcaggagcagattccttttcatctgcaaatcgaaaaacaggtgatccacgccgagattcagcatctcgggcactggatggacgctaccttcaacctgaaaacagcctttcattgttatggagcttgcgaaaagtacgcctacccctggcaaaccgcgggctgtttcgttgagaaagattttgagttcgaaaatgggtggggctgcaacccgcctgactgccccggagtgggcacagggtgtacggcctgcggagcttatcttgataagctcaagagcgtcggcaaagtgttcaagatcgtttctctgcgctacacccggaaagcctgtattcagctggggacagagcagacctgcaagaatgtggactccaacgactgtctggtcacaaccagcgtgaaagtgtgccttatcggaacgatttccaagtttcagccctctgataccctcctgttcctgggccctctcgaacaagggggcatcatctttaaacagtggtgtacaaccacatgccagttcggagacccgggcgatattatgagcacccccatcgggatgaagtgtcctgagctgaatggatcctttagaaagaaatgctctttcgctacaacccccgtctgtcagtttgacggcaacacgattagcgggtataagcgcatgatcgccacaaaagattccttccaatcttttaatgttaccgaacctcacattagcgcgtccgcccttgagtggatcgaccccgatagctctctgcgggaccacatcaacgtggtggtcggaagagatctccctttccaggacctgtccgaaaccccctgccagattgatctgagcacatcttccatcgacggcgcttgggggagcggcgtgggatttaaccttgtttgctctgtgtccctgaccgagtgtagcacgttcctcacatccattaaggcctgcgataccgctatgtgttacggcagcacaaccgccaatctggtccgcgggcagaacacagtgcatgttgtgggaaaaggcgggcactctggaagcaagtttgtctgctgtcatgacaccaagtgctccaatacgggcctcctggccgctgcgccgcaccttgaccgggtgaccggctataaccaagccgattctgacaaagttttcgatgacggggctcctgagtgtggaatgacatgctggttcaagaaaagcggcgaatggatcatgggggtgctgtccggaaattggatggtcgtggccgtgctcattaccctgctggtcctttctatctttctgttcgccctctgttgccccagacgcgctgcctacaagaaagagcacaagccttga

SEQ ID NO: 13460 - RNA, 3408 nt, synthetic construct
  misc_feature 1..3408: note = derived and/or modified CDS sequence (opt5) from SANGV(SA14)__NC_034516.1__GP
  source 1..3408: mol_type = other RNA
atgatcatgtggggcctgctcctgcttgccgctattaccttcccctgccagagcctgaagaacgtgtacgacatgaaaatcgagtgtcctcactccgtcaattttggggaatctagcgttatgggaaaggtgcaactcccgtccctgtctattacagaggccgaacagcttgtgcccgagagctcctgcaacatggataatcatcagtctctgagcgtcctccagaaagcgacgaagaccacatggagaaagaaggctgaccactccaacgccggcaaggatagctatgaactgatcacctctgagattcaattcaaaggggtgtgttccctgacacataagatgatcgaggaaagccaccggctccgcagatctgttatctgctacgacctgtcctgtaataccacacattgcaaacctaccctttatatggtggtccccgtgcacagctgtaacatgatgaagtcttgcctgattggactcggcccttaccggatccaggttgtgtatgagcgcacgtactgtaccgtcggggtgctgaatgaaggaaaatgctttgtgcccgatcagtccgtcgccaacattgttaagaatggcatcttcgacattgtgagcgtgcagatcatttgtttcttcatcagaatcaagggctccacatataaaattcttgagaccgtcaagacagctatgaacgggaaatgcaatggaaccgatgacaaggtgcaaggctactacatctgcctgctcgggggaaactctggccctatttatgttccgagcgggacggattttcgggccatggaggctctggccaatatgctgcgcgcgccccacggagaagaccatgatctccctggcgaggaactggcctcctacagcatcgctggcacaattgaggggaaaatcccccacaccgcctcttcccagaaccttgaatttacagcttatagcggaatcccttcttacagctccttttctgtgcataccctgacccaggacggccagctcagctattcccccgggctgttcccgaatcttaaccaaagcgattgtaagaaaaacgccctgcctctcatttgggagggaacaatcgagctgcccggctactatgaagcgattcacccttgcaatgtcttttgtgtgttctctgggcccggagcctcctgcgaggcttttagcgaaggcggcatcttcaacattacgtctcccacctgtctggtttccaagcagaatagattccgggccgctgagcagcaaatcacatttgtgtgccagcgcgtcgacatggacatcattatctactgtaacgggcagagaaaggtgattctcaccaaaacactggtcatcggacagtgcatttacagcatcacctcccttttctctctgctccctagcgtggcccactccattgccatcgaactgtgtgttccgggctttcatgggtgggctacggcggcccttctgacaaccttctgctttggatggctcctgatcccctctattacctatatcgtgctgctcattctgaagttcatcgctgccatttttcacaatacaacccaagagaacaaattcaaggccatccttcggaaaatcaaggaggaatttgagaagacaaaaggcagcatggtctgtgatatttgcaagtacgaatgcgagacggggaaagaactgaaggctcataatctctcctgtaaccagagccagtgcccttattgtttcacccactgcgagatgacagagtctgcctttcaggcgcattacaaagtgtgtcaagctacccaccgcttcagagaagacctgaagaagacaatcacgccccagaccatttcccctggctgctatcggaccctgaatctttttcgctacaaaagcagatgttatatcctcacagtttggctgtgcctgctcattctggagtctatcgcctgggccgcttccgccagcgaaacctctcttaaccccctgtggacagataatgctcacggagtgggcagcgtcccgatgcataccgacctcgagctggatttctccctgccttctagctccaagtacacgtacaaacggaaacttacaagccccaccaaccctgagcaggccgtgtccctccacatcgaaattgagtctcaggggatcgcggccgacgtgcatagcctgggacactggtatgatgctagactgaatctcaaaacatccttccactgttacggcgcctgcaccaagtatcaatacccctggcataccgctaagtgtcactttgaacatgacttccagtatgagaactcttgggggtgcaatcctcccgattgcccgggagttggcacagggtgtacggcctgcggcctgtaccttgaccagctgaaacctgtcggaagcgcgtataagctcattaccgtgcgctactcccggaaagtgtgtgtccagtttggcgaagagaacctgtgcaagacaatcgatatgaacgactgtttcatgtctagacacgtgaaagtttgcattatcgggaccgtgagcaagttttcccaaggagacacactggtcttccttggccccctcgaagggggaggcctgatctttaaagattggtgtaccagcacgtgccagtacggggaccccggcgatattatgtctcctcgcgaccggggattctcctgtccggaatttcccggcagcttcagaaagaagtgcaattttgccacaacccctgtgtgtgagtattctgggaacatggtttccggatacaaaaaggtgatggctaccatcgatagcttccagtcttttaatacatccctgattcatttcaccgaggagcgcatcgaatggaaagaccccgatggcatgctccgggaccacctgaacattcttgtcacaaaggatatcgacttcgagaatctgggggagaacccttgcaaagtgggactccaaacgagctccattgaaggcgcctgggggagcggcgttggatttaccctggtgtgccaggtctctctgatcgattgtgctagattccttacaagcatcaaggcctgcgacatggccatttgttatggcgctcagtccgtgtctctcgtgcgcgggcagaataccgtcaagatcacaggaaaaggcgggcacagcggatcctcttttaagtgctgtcatgaggttgattgcagctccaccggcctgcaagcgtctgctccccacctggacaaagtgaacggcattagcgaacaggagaatgacaaggtgtacgatgacggggcccctcagtgtggagtctcctgctggttcgtgaaaagcggcgaatggatctctgggattctccatggaaactgggttgtggtcgtggttctggtgatccttctgctcttttccctgatcctgcttagcattctgtgtcccgtccggaagcacaagagatcttga

SEQ ID NO: 13461 - RNA, 3408 nt, synthetic construct; identical to SEQ ID NO: 13460
  misc_feature 1..3408: note = derived and/or modified CDS sequence (opt5) from SANGV(SA14)__NC_034516.1__GP
  source 1..3408: mol_type = other RNA

SEQ ID NO: 13462 - RNA, 3402 nt, synthetic construct
  misc_feature 1..3402: note = derived and/or modified CDS sequence (opt5) from SEOV(L99)__AF288298.1__GP
  source 1..3402: mol_type = other RNA
atgtggagcctgctcctgcttgccgctctggtgggccaggggttcgccctcaagaacgtctttgacatgagaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaaactgaccaaggtcgtgtggcggaaaaaggctaatcaagaactcgccaaccagaatagctttgaggttgtggagtccgaagtcagcttcaaagggctgtgcatgcttaagcaccgcatggtggaggaatcttatagaaaccggcgctccgttatctgttacgacctggcctgcaatagcacattttgtaagcctaccgtgtatatgattgtccccatccatgcttgcaacatgatgaaatcttgtctcattggactgggcccttacagaatccaggtggtgtatgagcggacatactgcaccacagggatccttaccgagggaaagtgtttcgtccccgataaagccgttgtgtccgctctgaagcgcggcatgtatgccattgcgagcatcgaaacgatttgctttttcatccacaaaaagggcaatacctacaagattgtgacagccatcacctctgctatggggtccaaatgtaacaatacagacaccaaggtccagggatactatatttgcatcatcggcgggaacagcgcccctgtgtacgctccggccggagaggattttagagcgatggaagttttctccggcattatcacgtctccccatggggaggaccacgatctccctggagaagagattgccacatatcaaatcagcggccagattgaggctaaaatcccccacaccgtgtccagcaagtctctgaaactgatcgcctttgctggcattccttcctacagctctacaagcatcctcgccgcctccgaagacgggcggttcatcttttctcccggactgttcccgaatcttaaccagagcgtctgcgataacaatgctctgcctctcatttggcgcggcctgattgaccttaccgggtattacgaggcggtgcatccctgtaacgttttctgcgtgctgtccggacctggcgccagctgtgaggctttttctgaagggggaatcttcaatatcacctcccccatgtgcctcgtcagcaagcagaacagatttcgggccgccgaacaacagatttctttcatctgtcagcgcgtggatatggacattatcgtctattgcaatggccagaaaaagacaattctgacgaagaccctggtgatcggccaatgtatttacacaatcacctccctctttagcctgcttcccggggttgctcactccatcgccattgagctgtgcgtgcctggattccatggctgggcgacagctgccctcctgatcaccttttgtttcgggtgggtccttattccggcctgcacgctggctatcctcctggtgctgaaatttttcgccaacattctccacacatctaatcaggagaacagatttaaggctatcctgcggaaaatcaaggaagagttcgagaaaaccaagggaagcatggtttgtgaaatttgcaagtacgaatgcgagacccttaaagagctgaaggcccacaatctctcctgtgtgcagggcgaatgcccctattgttttacacattgcgagcctaccgaaacagcgatccaagcccactacaaagtctgtcaggctacgcatcgcttcagagaggatctgaagaaaaccgtgacacccaagaacattgggcctggctgctatcggaccctgaatcttttcagatacaagtctcgctgttatatcctcacaatgtggaccctgctgctcattatcgagagcatcctgtgggccgcttccgccgcggaaattccccttgtgccgctgtggacggacaacgcccacggagttggcagcgtccctatgcataccgacctcgagctggatttttctctgccctccagctctaaatacgcttataagcggcaccttacaaatcctgtgaacgaccagcagtccgtgagcctccacatcgaaattgagtctcaagggatcggagccgatgtccatcacctgggccattggtacgacgctagactgaatctcaaaaccagcttccactgctacggggcctgtacaaagtatcagtacccctggcacaccgccaaatgccattttgaaaaggattatgagtacgagaactcctgggcttgtaaccctcccgactgcccgggagtgggcacggggtgcacagcgtgtggcctgtatcttgatcagctgaagcctgttggaaccgccttcaaaattatcagcgtgcgctactctcggaaggtctgcgtgcagtttggcgaagagtatctctgtaaaacaatcgacatgaatgattgcttcgttaccagacacgctaagatttgtatcattgggaccgtgtccaaatttagccaaggagacacactgctgttccttggccccatggaagggggaggcatcatttttaagcattggtgcacgtccacctgtcacttcggggatcccggcgacgtcatgggacctaaagacaagccgttttcttgccccgagttccctggccagtttcgcaagaaatgtaacttcgccacaacccccatctgcgaatacgatgggaatattatcagcggatacaagaaagtgctcgccacaatcgactccttccagtcttttaacaccagcaatattcatttcacggatgagcggatcgagtggagagaccctgatggcatgctgcgcgaccacattaacatcgttatttccaaggatatcgactttgaaaatctggctgagtctccctgtaaagtggggctccaggccgcgaacatcgaaggagcttggggcagcggggtcggcttcacactgacctgccaagtgtcccttaccgagtgccctacatttctgaccagcattaaggcctgtgatatggccatctgctatggagctgaatctgtgacactctcccggggccagaatacggtcagaattaccgggaagggaggccacagcgggtcttccttcaaatgttgccatggaaaggagtgtagctctacaggcctgcaggcctccgcgccccacctggacaaagttaacggcatcagcgagcttgaaaatgagaaggtgtacgatgacggggctccggaatgcggagtgacctgttggtttaaaaagtccggcgagtgggtcatggggattatcaacggaaattgggtggttctcatcgtgctgtgcgtcctgctcctgttcagccttattctgctctctatcctgtgtcctgtgcgcaagcataaaaagagctga

SEQ ID NO: 13463 - RNA, 3402 nt, synthetic construct
  misc_feature 1..3402: note = derived and/or modified CDS sequence (opt5) from SEOV(Rn10-134)__JF693883.2__GP
  source 1..3402: mol_type = other RNA
atgtggagcctgctcctgcttgccgctctggtgggccaggggttcgccctcaagaacgtctttgacatgagaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaaactgaccaaggtcatctggcggaaaaaggctaatcaagaaagcgccaaccaaaattcctttgaggtggttgagagcgaagtgtctttcaaagggctctgcatgctgaagcaccgcatggtcgaggaatcctatagaaaccggcgcagcgtgatttgttacgaccttgcctgcaattctacattttgtaagcctaccgtttatatgatcgtgcccattcatgcttgcaacatgatgaaatcctgtctgatcggactcggcccttacagaatccaggtcgtgtatgagcggacatactgcaccacagggattctgaccgagggaaagtgtttcgtgcccgataaagccgtcgttagcgctcttaagcgcggcatgtatgccatcgcgtctattgaaacgatctgctttttcattcaccagaaaggcaatacctacaagatcgtgacagccattacctccgctatggggagcaagtgtaacaatacagacaccaaagtgcagggatactatatctgcatcattggcgggaactccgcccctgtctacgctccggccggagaggattttagagcgatggaagtgttctctggcatcattacgagcccccatggggaggaccacgatctgcctggagaagagatcgccacatatcagatttccggccagatcgaggctaagatcccccacaccgttagctctaaaaatctcaagctgacagcctttgctggcattccttcctacagctctaccagcatcctggccgcctccgaagacgggcggttcatcttttctcccggactcttcccgaacctgaaccagagcgtgtgcgataataacgcgcttcctctgatttggcgcggcctcattgacctgaccgggtattacgaggctgtccatccctgtaatgtgttctgcgttctttccggacctggcgccagctgtgaggctttttctgaagggggaatcttcaacatcacatcccccatgtgcctggtgagcaaacaaaatagatttcgggccgccgaacagcagatttctttcgtctgtcaacgcgtggatatggacatcattgtctattgcaacggccagaagaaaacgatcctcaccaagacactggtgattggccagtgtatctacaccattacatccctgtttagcctcctgcccggggttgctcactccatcgccatcgagctttgcgtgcctggattccatggctgggcgaccgctgccctgctcattacgttttgtttcgggtgggtcctgatcccggcctgcacacttgctattctgctcgtgctgaagtttttcgccaatatcctgcacacctctaaccaggagaatagatttaaagctattctccggaagatcaaagaagagttcgaaaagaccaaaggaagcatggtttgtgagatctgcaagtacgaatgcgagacactgaaggagcttaaagcccacaacctgtcctgtgtgcaaggcgaatgcccctattgttttacccattgcgagcctacagaaacggcgattcaggcccactacaaggtctgtcaggctacccatcgcttcagagaggatctcaaaaagacagtgacaccccagaatatcgggcctggctgctatcggaccctgaacctgttcagatacaaatctcgctgttatattcttaccatgtggacgctcctgctgatcattgagagcatcctctgggccgcttccgccgtggaaatccccctggttccgctttggaccgacaatgcgcacggagtcggcagcgtgcctatgcatacagacctggagctcgatttttctctgccctccagctctcggtacacctataagagacacctgacaaaccctgtgaatgaccaacagtccgtcagccttcacattgaaatcgagtctcaggggattggagccgatgtgcatcacctcggccattggtacgacgctcgcctgaacctgaagaccagcttccactgctacggggcctgtacgaaatatcagtacccctggcacacagctaagtgccattttgaaaaagattatgagtacgagaactcctgggcctgtaatcctcccgactgcccgggagttggcaccgggtgcacagcctgtggcctctatctggatcaacttaagcctgtgggaaccgctttcaaaatcattagcgtccggtactctagaaaggtgtgcgttcagtttggcgaagagtatctgtgtaagaccatcgacatgaacgattgcttcgtgacacgccacgcgaaaatctgtattatcgggacggtctccaagtttagccagggagacaccctcctgttcctgggccccatggaagggggaggcattatctttaaacattggtgcacatccacctgtcacttcggggatcccggcgacgtgatgggacctaaggacaaaccgtttatttgccccgagttccctggccagtttcggaagaaatgtaatttcgccacaacccccgtttgcgaatacgatgggaacatcatttctggatacaagaaggtgcttgctacgatcgacagcttccaatcctttaatacatctaacatccatttcaccgatgagagaattgagtggcgcgaccctgatggcatgctccgggaccacatcaatattgtcatcagcaaagatattgactttgaaaacctggccgagaatccctgtaaggtggggctgcaggccgctaacatcgaaggagcctggggctccggggtgggcttcaccctcacatgccaggtctctctgaccgagtgccctacatttcttacgagcatcaaagcgtgtgatatggctatttgctatggagccgaatccgttaccctgagcagaggccaaaatacagtgaagatcaccgggaaaggaggccactctgggtccagcttcaagtgttgccatggaaaggagtgttctctcacaggcctgcaggcctccgctccccacctggacaaagtgaacggcattagcgagcttgaaaatgagaaggtctacgatgacggggccccggaatgcggaatcacctgttggtttaaaaagtctggcgagtgggtgatggggattatcaacggaaattgggttgtgctcatcgtcctgtgcgtgctgctcctgttctcccttattctgctcagcatcctgtgtcctgttcgcaaacataagaagtcctga

SEQ ID NO: 13464 - RNA, 3402 nt, synthetic construct
  misc_feature 1..3402: note = derived and/or modified CDS sequence (opt5) from SEOV(Gou3-e5)__AF288650.1__GP
  source 1..3402: mol_type = other RNA
atgtggggcctgctcctgcttgccgctctggtggggcagggactcgccctgaagaacgtcttcgacatgaaaatccaatgcccccacagcgttaattttggcgagacctccgtgtctgggtacacagaacttcctccgctgcccctccaggaggcggaacagctggtgcctgagagctcctgtaacatggataatcatcagtctctgagcacgattaacaagctcaccaaagtcatctggagaaagaaagctaatcaagaatccgcctctcagaacagcttcgaggtggttgagaatgaagtgtcctttaagggactgtgcatgcttaagcaccggatggtcgaggaaagctatcgcaacagacggtctgtgatttgttacgacctggcctgcaatacaaccttctgtaaacccacagtttatatgatcgtgcctattcatgcttgcaacatgatgaagtcctgtctcatcggcctggggccctaccgcatccaggtcatttatgagagaacctactgcacaaccggaatccttacggagggcaaatgttttgtgcctgataaggccgtggtcagcgctctgaaacggggcatgtatgccattgcgtctatcgaaaccatttgcttctttgttcaccagaaggggaatacatacaagatcgtgtccgccattaccagcgctatgggatctaaatgtaacaatacagactccaaggtgcaaggctactatatctgcatcattgggggaaacagcgccccggtctacgctcccgccggcgaggatttccgcgcgatggaagtgttttccgggatcattacctctcctcatggagaggaccacgatctccccggcgaagagatcgccacgtatcagattagcggccagatcgaggctaaaatccctcacacagtttccagcaagaatctgaaactgaccgccttcgctgggattccctcttactccagcacatctatcctcgccgccagcgaagacggaagatttattttctccccgggcctgtttcctaaccttaaccagtctgtgtgcgataataacgctctgcccctcatctggcgggggctgattgaccttaccggatattacgaggcgatccatccttgtaatgtcttctgcgtgctgagcggccccggggcctcctgtgaggctttcagcgaaggaggcatctttaacattacctctcccatgtgcctcgtttccaagcaaaatcgcttcagagccgccgaacagcagatcagctttatttgtcaacgggtggatatggacatcgtcgtgtattgcaacggccagaaaaagacaattctgacgaagaccctggtcatcgggcagtgtatttacacaatcacctctctcttctccctgcttcctggagtggctcacagcatcgccattgagctgtgcgttccgggctttcatgggtgggcgacagctgccctcctggtgaccttctgttttggatgggtccttatccccgcctgcacgctggctgtgctcctgttcctgaaatttttcgccaatattctccacacatccaaccaggagaatcgctttaaggctatcctgagaaaaattaaggaagagttcgagaaaaccaagggctctatggtttgtgaaatctgcaagtacgaatgcgagacccttaaagagctgaaggcccacaacctcagctgtgtgcaaggggaatgcccttattgttttacacattgcgagcccaccgaaacagcgatccaggcccactacaaagtctgtcaggctacgcatcggttccgcgaggatctgaagaaaaccgtgacacctcagaatattggccccggatgctatagaaccctgaaccttttccggtacaagtccagatgttatatcctcacaatgtggattctgctgctcgtgatcgagtctattctgtgggccgctagcgccgcggaaatcccgcttgttcctctgtggaccgacaatgcccacggcgtcgggtccgtgcccatgcatacggacctcgagctggattttagcctgccttcttccagcaagtacacctataaacgccaccttacaaaccccgtgaatgaccaacagtctgtctccctccacatcgaaattgagagccagggaatcggcgctgatgtgcatcacctggggcattggtacgacgcccggctgaacctcaagacctctttccactgctacggagcttgtacaaaatatcagtacccttggcacaccgccaagtgccattttgaaaaagattatgagtacgagaacagctgggcctgtaatcccccggactgccctggcgttgggacgggctgcacaggatgtggcctgtatcttgatcaactgaagcccgtggggaccgctttcaagattatctccgtcagatacagccgcaaagtgtgcgttcagtttggagaagagtatctctgtaagacaattgacatgaacgattgcttcgtgacccggcacgcgaaaatctgtatcattggcaccgtctctaagttttcccagggggacacactgctgttccttggacccatggaaggcgggggcatcatttttaaacattggtgcacgagcacctgtcacttcggagatcctggcgacgtgatggggccgaaggacaaaccctttatctgccctgagttccccggacagtttagaaagaagtgtaatttcgccacaacccctgtttgcgaatacgatggcaacgtgatttccgggtaccgcaaagtcctcgctacaatcgactctttccagagctttaatacctccaacgtgcatttcacggatgagcggattgagtggaaggaccccgatggaatgctgagagaccacatcaatatcgtgatttctaaagatatcgactttgaaaacctggccgagaatccttgtaaggtcggcctccaagccgctaacattgaaggggcctggggcagcggagttggcttcacactgacctgccaggtgtcccttaccgagtgccccacatttctgacctctatcaaagcgtgtgatatggctatttgctatggggccgaaagcgtgacactctcccgcggacaaaatacgatcaagatcaccggccggggcggacacagcgggtcttccttcaagtgttgccatggcaaagagtgtagcgccaacgggctgcaggcttctgccccgcacctggacaaggtcaatggaatttccgagcttgaaaacgagaaagtgtacgatgacggcgcgcctgaatgcgggatcacatgttggtttaagaaaagcggagagtgggttatgggcattatcaatgggaactgggtggtcctcattgtgctgtgcgttctgctcctgttctctcttatcctgctctccatcctgtgtcccgtgagaaagcataagaaaagctga

SEQ ID NO: 13465 - RNA, 3402 nt, synthetic construct
  misc_feature 1..3402: note = derived and/or modified CDS sequence (opt5) from SEOV(China)__EU163437.1__GP
  source 1..3402: mol_type = other RNA
atgtggagcctgctcctgcttgccgctctggtgggccaggggttcgccctcaagaacgtctttgacatgagaatccaatgcccccactccgttaaattcggagagacctctgtgagcggctacacagaactgcctccgctttccctgcaggaggcggaacagctcgtgcccgagtctagctgtaatatggataaccatcagtccctgtctacgattaataagctgaccaaagtcatctggcggaagaaagctaaccaagaaagcgccaatcagaactcctttgagattctcgagagcgaagtgtctttcaaggggctgtgcatgcttaagcaccgcatggttgaggaatcctatagaaatcggcgcagcgtgatctgttacgacctggcctgcaactctacattttgtaaacctaccgtctatatgattgtgcccatccatgcttgcaatatcatgaagtcctgtctcattggactgggcccttacagaatccaggttgtgtatgagcggacatactgcaccacagggattcttaccgagggaaaatgtttcgtccccgataaggccgtggtgagcgctctgaaacgcggcatgtatgccatcgcgtctattgaaacgatctgctttttcattcaccagaagggcaacaagtacaaaatcgtcaccgccatcacatccgctatggggagcaagtgtaataacaccgacacaaaagttcaaggatactatatttgcatcattggcggaaattccgcccctgtgtacgctccggccggggaggattttagagcgatggaagtgttctctggcatcattaccagcccccatggggaggaccacgatctccctggagaagagatcgccacgtatcagatctccggccagattgaggctaagatcccccacacagtcagctctcagaacctgaaactgaccgcctttgctggcattccttcctacagctctacaagcatcctcgccgcctccgaagacgggcggttcatcttttctcccggactgttcccgaatcttaaccaaagcgtgtgcgataacaatgctctgcctctcatctggcgcggcctgatcgaccttaccgggtattacgaggcggttcatccctgtaacgtgttctgcgtcctgtccggacctggcgccagctgtgaagccttttctgaagggggaattttcaatatcacctcccccatgtgcctcgtgagcaagcagaacagatttcgggccgccgaacagcaaatttctttcatctgtcagcgcgttgatatggacattatcgtgtattgcaatggccagaaaaagacaattctgacgaagaccctggtcatcggccagtgtatctacacaattacctccctctttagcctgcttcccggggtggctcactccatcgccattgagctgtgcgtccctggattccatggctgggcgacagctgccctcctgatcaccttttgtttcgggtgggtgcttattccggcctgcacgctggctatcctcctggttctgaaatttttcgccaacatcctccaaacatctaatcaggagaacagatttaaggctattctgcggaaaatcaaggaagagttcgagaaaaccaagggaagcatggtgtgtgagatttgcaagtacgaatgcgagacccttaaagagctgaaggcccacaatctctcctgtgtccagggcgaatgcccctattgttttacacactgcgagcctaccgaaacagcgatccaggcccattacaaagtgtgtcaagctacgcaccgcttcagagaggatctgaagaaaaccgttacaccccagaacattgggcctggctgctatcggaccctgaatcttttcagatacaagtctcgctgttatatcctcacaatgtggaccctgctgctcatcattgagagcatcctgtgggccgcttccgccgcggaaattccccttgtgccgctgtggacggacaacgcccatggagtcggcagcgtgcctatgcacaccgacctcgagctggatttttctctgccctccagctctaagtacacatataaacggcatcttaccaatcctgtgaacgaccagcagtccgttagcctccacatcgaaattgagtctcaagggatcggagctgatgtccaccatctgggccactgctacgacgccagactgaatctcaagaccagcttccattgttacggggcttgcacaaaatatcagtacccctggcacacggccaagtgtcactttgaaaaagattatgagtacgagaactcctgggcctgcaaccctcccgactgcccgggagtgggcacagggtgtaccgcttgcggcctgtatcttgatcagctgaagcctgtgggaacagcgttcaagatcattagcgtccgctactctcggaaagtgtgtgttcagtttggcgaagagtatctctgcaagaccatcgacatgaatgattgtttcgtgaccagacatgccaaaatttgcatcattgggacagtctccaagtttagccaaggagacacgctgctgttccttggccccatggaagggggaggcatcatttttaaacactggtgtacctccacatgccatttcggggatcccggcgacgtgatgggacctaaggacaaaccgtttatctgtcccgagttccctggccagtttcgcaagaagtgcaacttcgctaccacacccgtttgtgaatacgatgggaatatcatttctggatacaaaaaggtgctcgccaccatcgacagcttccagtcctttaaccggtcttatattcacttcacggatgagagaatcgagtggcgcgaccctgatggcatgctgcgggaccatattaatatcgtcatcagcaaagatattgactttgaaaacctggccgagaatccctgcaaggtggggctccaagctgccaacatcgaaggagcgtggggcctgggggttggcttcacacttacctgccaggtgtccctgaccgagtgtcctacatttctcacctctattaaggcttgcgatatggccatctgttacggagccgaaagcgtcacactgtccagaggccagaatacggtgaaaattaccgggaagggaggccacagcgggtcttccttcaaatgctgtcacggaaaggagtgcagctctacaggcctgcaggcttccgctccccatcttgacaaagtgaacggcatcagcgagctcgaaaatgagaaggtctatgatgacggggcgccggaatgtggaattacctgctggtttaaaaagtctggcgagtgggttatggggattatcaacggaaattgggtggtgctgattgtcctgtgtgtgctcctgcttttctccctgatcctcctgagcattctgtgccctgttcgcaagcacaaaaagtcctga

SEQ ID NO: 13466 - RNA, 3402 nt, synthetic construct
  misc_feature 1..3402: note = derived and/or modified CDS sequence (opt5) from SEOV(DPRK08)__JX853576.1__GP
  source 1..3402: mol_type = other RNA
atgtggagcctgctcctgcttgccgctctggtgggccaggggttcgccctcaagaacgtctttgacatgagaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaaactgaccaaggtcatctggcggaaaaaggctaatcaagaaagcgccaaccaaaattcctttgaggtggttgagagcgaagtgtctttcaaagggctctgcatgctgaagcaccgcatggtcgaggaatcctatagaaaccggcgcagcgtgatttgttacgaccttgcctgcaattctacattttgtaagcctaccgtttatatgatcgtgcccattcatgcttgcaacatgatgaaatcctgtctgatcggactcggcccttacagaatccaggtcgtgtatgagcggacatactgcaccacagggattctgaccgagggaaagtgtttcgtgcccgataaagccgtcgttagcgctcttaagcgcggcatgtatgccatcgcgtctattgaaacgatctgctttttcattcaccagaaaggcaatacctacaagatcgtgacagccattacctccgctatggggagcaagtgtaacaatacagacaccaaagtgcagggatactatatctgcatcattggcgggaactccgcccctgtctacgctccggccggagaggattttagagcgatggaagtgttctctggcatcattacgagcccccatggggaggaccacgatctgcctggagaagagatcgccacatatcagatttccggccagatcgaggctaagatcccccacaccgttagctctaaaaatctcaagctgacagcctttgctggcattccttcctacagctctaccagcatcctggccgcctccgaagacgggcggttcatcttttctcccggactcttcccgaacctgaaccagagcgtgtgcgataataacgcccttcctctgatttggcgcggcctcattgacctgaccgggtattacgaggcggtccatccctgtaatgtgttctgcgttctttccggacctggcgccagctgtgaggctttttctgaagggggaatcttcaacatcacatcccccatgtgcctggtgagcaaacaaaatagatttcgggccgccgaacagcagatttctttcgtctgtcaacgcgtggatatggacatcattgtctattgcaacggccagaagaaaacgatcctcaccaagacactggtgattggccagtgtatctacaccattacatccctgtttagcctcctgcccggggttgctcactccatcgccatcgagctttgcgtgcctggattccatggctgggcgaccgctgccctgctcattacgttttgtttcgggtgggtcctgatcccggcctgcacacttgctattctgctcgtgctgaagtttttcgccaatatcctgcacacctctaaccaggagaatagatttaaagctattctccggaagatcaaagaagagttcgaaaagaccaaaggaagcatggtttgtgagatctgcaagtacgaatgcgagacactgaaggagcttaaagcccacaacctgtcctgtgtgcaaggcgaatgcccctattgttttacccattgcgagcctacagaaacggcgattcaggcccactacaaggtctgtcaggctacccatcgcttcagagaggatctcaaaaagacagtgacaccccagaatatcgggcctggctgctatcggaccctgaacctgttcagatacaaatctcgctgttatattcttaccatgtggacgctcctgctgatcattgagagcatcctctgggccgcttccgccgcggaaatccccctggtgccgatttggaccgacaatgcccacggagttggcagcgtccctatgcatacagaccttgagctggatttttctctcccctccagctctaagtacacctataagcggcacctgacaaaccctgtgaatgaccaacagtccgtgagcctgcacatcgaaattgagtctcaggggatcggagctgatgtccatcaccttggccattggtacgacgccagactcaacctgaaaaccagcttccactgctacggggcttgtacgaagtatcagtacccctggcacacagccaaatgccattttgaaaaggattatgagtacgagaactcctgggcctgtaatcctcccgactgcccgggagtgggcaccgggtgcacagcttgtggcctgtatctcgatcaactgaaacctgttggaaccgcgttcaagattatcagcgtgcgctactctcggaaggtctgcatgcagtttggcgaagagtatctttgtaaaaccatcgacatgaacgattgcttcgtgacaagacacgccaagatttgtatcattgggacggtttccaaatttagccagggagacaccctcctgttcctgggccccatggaagggggaggcatcatttttaagcattggtgcacatccacctgtcacttcggggatcccggcgacgtgatgggacctaaagacaagccgtttatctgccccgagttccctggccagtttcgcaaaaagtgtaatttcgctacaacccccgtctgcgaatacgatgggaacattatctctggatacaagaaagtgctggccacgatcgacagcttccaatcctttaatacatctaacattcatttcaccgatgagcggatcgagtggagagaccctgatggcatgcttcgcgaccacattaatatcgttattagcaaggatatcgactttgaaaacctcgccgagaatccctgtaaagtggggctgcaggctgccaacatcgaaggagcgtggggctccggggtcggcttcaccctgacatgccaggtgtctctcaccgagtgccctacatttctgacgagcattaaggcttgtgatatggccatctgctatggagccgaatccgtgacccttagccggggccaaaatacagtcaaaattaccgggaagggaggccactctgggtccagcttcaagtgttgccatggaaaagagtgttcttccacaggcctgcaggctagcgctccccacctcgacaaggttaacggcatctctgagctggaaaatgagaaagtgtacgatgacggggcgccggaatgcggagtgacctgttggtttaagaaatccggcgagtgggtcatggggattatcaacggaaattgggtggttctgatcgtgctttgcgtcctcctgctgttcagcctcattctgctttccatcctgtgtcctgtgagaaagcataagaaaagctga

SEQ ID NO: 13467 - RNA, 3402 nt, synthetic construct
  misc_feature 1..3402: note = derived and/or modified CDS sequence (opt5) from SEOV(Fj372/2013)__KP645197.1__GP
  source 1..3402: mol_type = other RNA
atgtggagcctgctcctgcttgccgctctggtgggccccgggttcgccctcaagaacgtctttgacatgagaatccagtgccctcactccgttaatttcggagagacctctgtgagcggctacacagaactgccgcccctttccctgcaagaggcggaacagctcgtgcctgagtctagctgtaacatggataatcatcagtccctgtctacgattaacaaactgaccaaggtcatctggcagaaaaaggctaatcaagaaagcgccaaccaaaattcctttgaggtggttgagagcgaagtgtctttcaaagggctctgcatgctgaagcaccggatggtcgaggaatcctatcgcaacagacggagcgtgatttgttacgaccttgcctgcaattctacattttgtaagcccaccgtttatatgatcgtgcctattcatgcttgcaacatgatgaaatcctgtctgatcggactcggcccctaccgcatccaggtcgtgtatgagagaacatactgcaccacagggattctgaccgagggaaagtgtttcgtgcctgataaagccgtcgttagcgctcttaagcggggcatgtatgccatcgcgtctattgaaacgatctgctttttcattcaccagaaaggcaatacctacaagatcgtgacagccattacctccgctatggggagcaagtgtaacaatacagacaccaaagtgcagggatactatatctgcatcattggcgggaactccgccccggtctacgctcccgccggagaggattttcgcgcgatggaagtgttctctggcatcattacgagccctcatggggaggaccacgatctgcccggagaagagatcgccacatatcagatttccggccagatcgaggctaagatccctcacaccgttagctctaaaaatctcaagctgacagcctttgctggcattccctcctacagctctaccagcatcctggccgcctccgaagacgggagattcatcttttctccgggactcttccctaacctgaaccagagcgtgtgcgataataacgctctgcccctgatttggcggggcctcattgacctgaccgggtattacgaggcggtccatccttgtaatgtgttctgcgttctttccggacccggcgccagctgtgaggctttttctgaagggggaatcttcaacatcacatcccccatgtgcctggtgagcaaacaaaatcgctttagagccgccgaacagcagatttctttcgtctgtcaacgggtggatatggacatcattgtctattgcaacggccagaagaaaacgatcctcaccaagacactggtgattggccagtgtatctacaccattacatccctgtttagcctcctgcctggggttgctcactccatcgccatcgagctttgcgtgccgggattccatggctgggcgaccgctgccctgctcattacgttttgtttcgggtgggtcctgatccccgcctgcacacttgctattctgctcgtgctgaagtttttcgccaatatcctgcacacctctaaccaggagaatcgctttaaagctattctcagaaagatcaaagaagagttcgaaaagaccaaaggaagcatggtttgtgagatctgcaagtacgaatgcgagacactgaaggagcttaaagcccacaacctgtcctgtgtgcaaggcgaatgcccttattgttttacccattgcgagcccacagaaacggcgattcaggcccactacaaggtctgtcaggctacccatcggttccgcgaggatctcaaaaagacagtgacccctcagaatatcgggcccggctgctatagaacactgaacctgttccggtacaaatctagatgttatattcttaccatgtggacgctcctgctgatcattgagagcatcctctgggccgcttccgccgcggaaatcccgctggtgcctctttggaccgacaatgcccacggagttggcagcgtccccatgcatacagacctggagctcgatttttctctgccttccagctctaagtacacctataagcgccacctgacaaaccccgtgaatgaccaacagtccgtgagccttcacattgaaatcgagtctcaggggattggagctgatgtccatcacctcggccattggtacgacgcccggctgaacctgaaaaccagcttccactgctacggggcttgtacgaagtatcagtacccttggcacacagccaaatgccattttgaaaaggattatgagtacgagaactcctgggcctgtaatcccccggactgccctggagtgggcaccgggtgcacagcttgtggcctctatctggatcaacttaaacccgttggaaccgcgttcaagatcattagcgtgagatactctcgcaaggtctgcgtgcagtttggcgaagagtatctgtgtaaaaccatcgacatgaacgattgcttcgttacacggcacgccaagatctgtattatcgggacggtgtccaaatttagccagggagacaccctcctgttcctgggccccatggaagggggaggcattatctttaagcattggtgcacatccacctgtcacttcggggatcctggcgacgtcatgggaccgaaagacaagccctttatttgccctgagttccccggccagtttcgcaaaaagtgtaatttcgctacaacccctgtgtgcgaatacgatgggaacatcatttctggatacaagaaagttcttgccacgatcgacagcttccaatcctttaatacatctaacatccatttcaccgatgagagaattgagtggcgggaccccgatggcatgctcagagaccacatcaatattgtgatcagcaaggatattgactttgaaaacctggccgagaatccttgtaaagtcgggctgcaggctgccaacatcgaaggagcgtggggctccggggtgggcttcaccctcacatgccaggtgtctctgaccgagtgccccacatttcttacgagcatcaaggcttgtgatatggccatttgctatggagccgaatccgtcaccctgagccgcggccaaaatacagttaaaatcaccgggaagggaggccactctgggtccagcttcaagtgttgccatggaaaagagtgttcttccacaggcctccaggctagcgccccgcacctggacaaggtgaacggcatttctgagctggaaaatgagaaagtgtacgatgacggggcgcctgaatgcggaatcacctgttggtttaagaaatccggcgagtgggtcatggggattatcaacggaaattgggtggttcttatcgtgctctgcgtcctgcttctcttcagcctgattcttctgtccatcctctgtcccgtgcggaagcataagaaaagctga

SEQ ID NO: 13468 - RNA, 3402 nt, synthetic construct
  misc_feature 1..3402: note = derived and/or modified CDS sequence (opt5) from SEOV(HeB38)__JN377554.1__GP
  source 1..3402: mol_type = other RNA
atgtggagcctgctcctgcttgccgctctggtgggccaggggttcgccctcaagaacgtctttgacatgagaatccaatgcccccactccgttaaattcggagagacctctgtgagcggctacacagaactgcctccgctttccctgcaggaggcggaacagctcgtgcccgagtctagctgtaatatggataaccatcagtccctgtctacgattaataagctgaccaaagtcatctggcaaaagaaagctaaccaggaaagcgccaatcagaactcctttgaggtggccgagagcgaagtttctttcaaggggctctgcatgctgaagcaccggatggtggaggaatcctatcgcaatagacggagcgtcatttgttacgaccttgcttgcaactctacattttgtaaacctaccgtgtatatgatcgttcccattcatgcctgcaatatgatgaagtcctgtctgatcggactcggcccttaccgcatccaggtggtctatgagagaacatactgcaccacagggattctgaccgagggaaaatgtttcgtgcccgataaggctgtggtcagcgcccttaaacggggcatgtatgcgatcgcctctattgaaacgatctgctttttcattcaccaaaagggcaacacctacaagatcgttacagctattacctccgccatggggagcaaatgtaataacacagacaccaaggtgcagggatactatatctgcatcattggcggaaattccgctcctgtgtacgccccgtctggggaggattttcgcgcgatggaagtcttcagcggcatcattatgagcccccatggggaggaccacgatctgcctggagaagagatcgccacgtatcagattagcggccagatcgaggctaaaatcccccacacagtgtcttccaagaacctcaaactgaccgcctttgctggcattcctagctactctagcacatccatcctggccgcctctgaagacgggagattcatttttagccccggactcttcccgaatctgaaccaatccgtttgcgataacaatgcccttcctctgatctggcggggcctcattgacctgaccgggtattacgaggcggtgcatccctgtaacgtcttctgcgtgcttagcggacctggcgcctcttgtgaggctttttccgaagggggaatcttcaatatcaccagccccatgtgcctggtttctaagcagaaccgctttagagccgccgaacagcaaatttccttcgtgtgtcagcgggtcgatatggacatcattgtgtattgcaatggccagaaaaagacaatcctcacgaagaccctggtcattggccagtgtatctacacaattaccagcctgttttccctcctgcccggggtggctcactctatcgccatcgagctttgcgttcctggattccatggctgggcgacagctgccctgctcattaccttttgtttcgggtgggtgctgatcccggcctgcacgcttgctattctgctcgtcctgaaatttttcgccaacatcctgcacacaagcaatcaagagaaccgctttaaggctattctcagaaaaatcaaggaagagttcgagaaaaccaagggatccatggtgtgtgaaatctgcaagtacgaatgcgagaccctgaaagagcttaaggcccacaatctgtcttgtgttcagggcgaatgcccctattgttttacacattgcgagcctaccgaaacagcgattcaggcccactacaaagtgtgtcaggctacgcatcggttccgcgaggatctcaagaaaaccgtcacaccccaaaacatcgggcctggctgctatagaaccctgaatctgttccggtacaagagcagatgttatattcttacaatgtggaccctcctgctgatcattgagtccatcctctgggccgctagcgccgcggaaatccccctggtgccgctttggacggacaacgcccacggagtgggctctgttcctatgcataccgacctggagctcgatttttccctgccctcctcttccaagtacacatataaacgccacctgaccaatcctgtcaacgaccagcagagcgtgtctcttcacattgaaatcgagagccaggggattggagctgatgtgcatcacctcggccattggtacgacgcccggctgaatctgaagacatccttccactgctacggggcttgtaccaaatatcaatacccctggcacacggccaagtgccattttgaaaaagattatgagtacgagaacagctgggcctgtaaccctcccgactgcccgggagtcggcacagggtgcaccgcttgtggcctctatctggatcagcttaagcctgtgggaacagcgttcaagatcatttctgttagatactcccgcaaagtgtgcgtccagtttggcgaagagtatctgtgtaagaccatcgacatgaatgattgcttcgtgacccggcacgccaaaatctgtattatcgggacagttagcaagttttcccagggagacacgctcctgttcctgggccccatggaagggggaggcattatctttaaacattggtgcacctctacatgtcacttcggggatcccggcgacgtgatgggacctaaggacaaaccgtttatttgccccgagttccctggccaatttagaaagaagtgtaacttcgctaccacacccgtctgcgaatacgatgggaatatcattagcggatacaaaaaggtgcttgccaccatcgactccttccagtcttttaacacgagcaatatccatttcacagatgagcgcattgagtggcgggaccctgatggcatgctcagagaccacatcaacattgttatctccaaagatattgactttgaaaatctggccgagaacccctgtaaggtggggctgcaggctgccaatatcgaaggagcgtggggctctggggtcggcttcaccctgacctgccaagtgagcctcacagagtgccctacctttcttacatccatcaaggcttgtgatatggccatttgctatggagccgaaagcgtgacgctgctccgcggccagaacaccgtcaaaatcacagggaagggaggccactctgggtccagcttcaaatgttgccatggaaaggagtgttcttccaccggcctgcaggctagcgctccccacctggacaaagttaatggcatttctgagcttgaaaacgagaaggtgtacgatgacggggcgccggaatgcggaatcacatgttggtttaaaaagtccggcgagtgggtgatggggattatcaatggaaactgggtcgtgctcatcgttctgtgcgtgctgctcctgttcagccttattctgctctccatcctgtgtcctgtccggaagcataaaaagagctga

SEQ ID NO: 13469 - RNA, 3402 nt, synthetic construct
  misc_feature 1..3402: note = derived and/or modified CDS sequence (opt5) from SEOV(JiangxiXinjianRn-07-2011)__KP859513.1__GP
  source 1..3402: mol_type = other RNA
atgtggagcctgctcctgcttgccgctctggtgggccagtgcttcgccctcaagaacgtctttgacatgagaatccaatgtccccactccgttaatttcggggagacctctgtgagcggatacacagaactgcctccgctttccctgcaggaggcggaacagctcgtgcccgagtctagctgcaacatggataatcatcagtccctgtctacgattaacaaactgaccaaggtcatctggcggaaaaaggctaatcaagaaagcgccaaccaaaattcctttgaggtggttgagagcgaagtgtctttcaaaggcctctgtatgctgaagcaccgcatggtcgaggaatcctatagaaaccggcgcagcgtgatttgctacgaccttgcctgtaattctacattttgcaagcctaccgtttatatgatcgtgcccattcatgcttgtaacatgatgaaatcctgcctgatcgggctcggaccttacagaatccaggtcgtgtatgagcggacatactgtaccacaggcattctgaccgaggggaagtgcttcgtgcccgataaagccgtcgttagcgctcttaagcgcggaatgtatgccatcgcgtctattgaaacgatctgctttttcattcaccagaaaggcaatacctacaagatcgtgacagccattacctccgctatgggcagcaagtgcaacaatacagacaccaaagtgcaggggtactatatctgcatcattggaggcaactccgcccctgtctacgctccggccggggaggattttagagcgatggaagtgttctctggaatcattacgagcccccatggcgaggaccacgatctgcctggggaagagatcgccacatatcagatttccggacagatcgaggctaagatcccccacaccgttagctctaaaaatctcaagctgacagcctttgctggcattccttcctacagctctaccagcatcctggccgcctccgaagacggccggttcatcttttctcccggactcttcccgaacctgaaccagagcgtgtgtgataataacgcccttcctctgatctggcgcgggctcattgacctgaccggctattacgaggcggtccatccctgcaatgtgttctgtgttctttccgggcctggagccagctgcgaggctttttctgaaggcgggatcttcaacatcacatcccccatgtgtctggtgagcaaacaaaatagatttcgggccgccgaacagcagatttctttcgtctgccaacgcgtggatatggacatcattgtctattgtaacggacagaagaaaacgatcctcaccaagacactggtgattggccagtgcatctacaccattacatccctgtttagcctcctgcccggcgttgctcactccatcgccatcgagctttgtgtgcctgggttccatggatgggcgaccgctgccctgctcattacgttttgcttcggctgggtcctgatcccggcctgtacacttgctattctgctcgtgctgaagtttttcgccaatatcctgcacacctctaaccaggagaatagatttaaagctattctccggaagatcaaagaagagttcgaaaagaccaaagggagcatggtttgcgagatctgcaagtacgaatgtgagacactgaaggagcttaaagcccacaacctgtcctgcgtgcaaggagaatgtccctattgctttacccattgtgagcctacagaaacggcgattcaggcccactacaaggtctgccaggctacccatcgcttcagagaggatctcaaaaagacagtgacaccccagaatatcggccctgggtgttatcggaccctgaacctgttcagatacaaatctcgctgctatattcttaccatgtggacgctcctgctgatcattgagagcatcctctgggccgcttccgccgcggaaatccccctggtgccgctttggaccgacaatgcccacggcgttggaagcgtccctatgcatacagacctggagctcgatttttctctgccctccagctctaagtacacctataagcggcacctgacaaaccctgtgaatgaccaacagtccgtgagccttcacattgaaatcgagtctcagggcattggggctgatgtccatcacctcggacattggtacgacgccagactgaacctgaaaaccagcttccactgttacggcgcttgcacgaagtatcagtacccctggcacacagccaaatgtcattttgaaaaggattatgagtacgagaactcctgggcctgcaatcctcccgactgcccgggggtgggaaccggctgtacagcttgcgggctctatctggatcaacttaaacctgttggcaccgcgttcaagatcattagcgtgcgctactctcggaaggtctgtgtgcagtttggagaagagtatttctgcaaaaccatcgacatgaacgattgttttgttacaagacacgccaagatctgcattatcggcacggtgtccaaattcagccagggggacaccctgctctttctgggacccatggaaggcgggggaattatcttcaagcattggtgtacatctacctgccactttggcgatcccggggacgtcatgggccctaaagacaagccgttcatttgtcccgagtttcctggacagttccgcaaaaagtgcaatttcgctacaacccccgtgtgtgaatacgatggcaacatcatttccgggtacaagaaagttctggccacgatcgacagctttcaatccttcaatacatctaacatccattttaccgatgagcggattgagtggagagaccctgatggaatgcttcgcgaccacatcaatattgtgatcagcaaggatattgacttcgaaaacctcgccgagaatccctgcaaagtcggcctgcaggctgccaacatcgaaggggcgtggggatccggcgtggggtttaccctgacatgccaggtgtctctcaccgagtgtcctacattcctgacgagcatcaaggcttgcgatatggccatttgttatggcgccgaatccgtcacccttagccggggacaaaatacagttaaaatcaccggcaaagggggacactctggctccagctttaagtgctgtcatgggaaggagtgttcttccacaggactgcaggctagcgctccccacctcgacaaggtgaacggcatttctgagctggaaaatgagaaagtgtacgatgacggcgcgccggaatgtgggattacctgctggttcaagaaatccggagagtgggtcatgggcattatcaacgggaattgggtggttctgatcgtgctttgtgtcctcctgctgtttagcctcattctgctttccatcctgtgccctgtgagaaagcataagaaaagctga

SEQ ID NO: 13470 - RNA, 3402 nt, synthetic construct
  misc_feature 1..3402: note = derived and/or modified CDS sequence (opt5) from SEOV(LYON/Rn/FRA/2013/LYO852)__KF387724.1__GP
  source 1..3402: mol_type = other RNA
atgtggagcctgctcctgcttgccgctctggccggccaggggttcgcgctcaagaacgtgtttgacatgagaatccaatgcccccactccgtcaatttcggagagacctctgttagcggctacacagaactgcctccgctttccctgcaggaggctgaacagctcgtgcccgagtctagctgtaacatggataatcatcagtccctgtctacgattaacaaactgaccaaggtgatctggcggaaaaaggccaatcaagaaagcgcctcccagaacagctttgaggtcgtggagtctgaagtttccttcaaagggctctgcatgctgcgccacagaatggtggaggaaagctataagaatcggcgctctgtcatttgttacgaccttgcttgcaactccacattttgtaagcctaccgtgtatatgatcgttcccattcatgcctgcaatatgatgaaaagctgtctgatcggactcggcccttacagaatccaggtggtctatgagcggacatactgcaccacagggattctgaccgagggaaagtgtttcgtgcccgataaagctgtggtctctgcccttaagcgcggcatgtatgcgatcgcctccattgaaacgatctgctttttcattcaccagaaaggcaacacctacaagatcgttacagctattaccagcgccatggggtccaagtgtaataacacagacaccaaagtgcaaggatactatatctgcatcattggcggaaattctgctcctgtgtacgccccggcgggggaggattttagagccatggaagtcttcagcggcatcattacgagcccccatggggaggaccacgatctgcctggagaagagatcgctacatatcagattagcggccagatcgaggccaagatcccccacaccgtgtcttccaaaaacctcaagctgacagcttttgccggcattcctagctactctagcacctccatcctggccgcttctgaagacgggcggttcatttttagccccggactcttcccgaatctgaaccagtccgtttgcgataacaatgcgcttcctctgatctggcgcggcctcattgacctgaccgggtattacgaggccgtgcatccctgtaacgtcttctgcgtgcttagcggacctggcgcttcttgtgaagccttttccgaagggggaatcttcaatatcacaagccccatgtgcctggtttctaaacaaaacagatttcgggccgctgagcagcagatttccttcgtgtgtcaacgcgtcgatatggacatcattgtgtattgcaatggccagaagaaaacgatcctcaccaagacactggtcattggccagtgtatctacaccattacaagcctgttttccctcctgcccggggtggcccactctatcgcgatcgagctttgcgttcctggattccatggctgggctaccgccgccctgctcattacgttttgtttcgggtgggtgctgatcccggcttgcacacttgccattctgctcgtcctgaagtttttcgctaacatcctgcacaccagcaatcaggagaacagatttaaagccattctccggaagatcaaagaagagttcgaaaagaccaaaggatccatggtgtgtgagatctgcaagtacgaatgcgagacactgaaggagcttaaagcgcacaatctgtcttgtgttcaaggcgaatgcccctattgttttacccattgcgagcctacagaaacggccattcaggctcactacaaggtgtgtcaggccacccatcgcttcagagaggatctcaaaaagacagtcacaccccagaacatcgggcctggctgctatcggaccctgaatctgttcagatacaaaagccgctgttatattcttaccatgtggacgctcctgctgatcattgagtccatcctctgggctgccagcgcggccgaaatccccctggtgccgctttggaccgacaacgctcacggagtgggctctgttcctatgcatacagacctggagctcgatttttccctgccctcctcttccaagtacacctataagcggcacctgacaaatcctgtcaacgaccaacagagcgtgtctcttcacattgaaatcgagagccaggggattggagccgatgtgcatcacctcggccattggtacgacgctagactgaatctgaaaacctccttccactgctacggggcctgtacgaagtatcagtacccctggcacacagccaaatgccattttgaaaaggattatgagtacgagaacagctgggcttgtaaccctcccgactgcccgggagtcggcaccgggtgcacagcgtgtggcctctatctggatcaacttaaacctgtgggaaccgccttcaagatcatttctgttcgctactcccggaaggtgtgcgtccagtttggcgaagagtatctgtgtaaaaccatcgacatgaatgattgcttcgtgacaagacacgctaagatctgtattatcgggacggttagcaaattttcccagggagacaccctcctgttcctgggccccatggaagggggaggcattatctttaagcattggtgcacatctacctgtcacttcggggatcccggcgacgtgatgggacctaaagacaagccgtttatttgccccgagttccctggccagtttcgcaaaaagtgtaacttcgccacaacccccgtctgcgaatacgatgggaatatcattagcggatacaagaaagtgcttgccacgatcgactccttccaatcttttaacacaagcaatatccatttcaccgatgagcggattgagtggagagaccctgatggcatgctccgcgaccacatcaacattatcatttccaaggatatcgactttgaaaatctggctgagaacccctgtaaagttgggctgcaggccgcgaatatcgaaggagcttggggctctggggtgggcttcaccctcacatgccaggtcagcctgaccgagtgccctacatttcttacgtccattaaggcctgtgatatggccatctgctatggagctgaaagcgtgaccctgtctcggggccaaaacacagtgaaaattaccgggaagggaggccactccgggagctctttcaagtgttgccatggaaaagagtgttccctcacaggcctgcaggccagcgcgccccacctggacaaggtcaatggcatctctgagcttgaaaacgagaaagtttacgatgacggggctccggaatgcggaattacctgttggtttaagaaatccggcgagtgggtgatggggatcatcaatggaaactgggtggtcctcattgtgctgtgcgttttcctgctctttagcctgatccttctgtccattctctgtcctgtgagaaagcataagaaaagctga

SEQ ID NO: 13471 - RNA, 3402 nt, synthetic construct
  misc_feature 1..3402: note = derived and/or modified CDS sequence (opt5) from SEOV(Seoul-Baxter/NYC-D1_M)__KJ950863.1__GP
  source 1..3402: mol_type = other RNA
atgtggagcctgctcctgcttgccgctctggtgggccaggggttcgccctcaagaacgtctttgacatgaaaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaagctgaccaaagtcatctggagaaagaaagctaatcaagaaagcgccaaccaaaattcctttgaggtggccgagagcgaagtttctttcaaggggctctgcatgctgaagcaccggatggtggaggaatcctatcgcaacagacggagcgtcatttgttacgaccttgcttgcaattctacattttgtaaacctaccgtgtatatgatcgttcccattcatgcctgcaacatgatgaagtcctgtctgatcggactcggcccttaccgcatccaggtggtctatgagagaacatactgcaccacagggattctgaccgagggaaaatgtttcgtgcccgataaggctgtggtcagcgcccttaaacggggcatgtatgcgatcgcctctattgaaacgatctgctttttcattcaccagaagggcaatacctacaagatcgttacagctattacctccgccatggggagcaaatgtaacgacacagataccaaggtgcagggatactatatctgcatcattggcggaaattccgctcctgtgtacgccccggcgggggaggactttcgcgccatggaagtcttctctggcatcattacgagcccccatggggaggatcacgacctgcctggagaagagatcgctacatatcagatttccggccagatcgaggccaaaatcccccacaccgtgagctctaagaacctcaaactgacagcttttgccggcattccttcctacagctctaccagcatcctggccgcttccgaagatgggagattcatcttttctcccggactcttcccgaatctgaaccagagcgtttgcgacaacaatgcgcttcctctggtgtggcggggcctcattgatctgaccgggtattacgaggccgtccatccctgtaacgtgttctgcgttctttccggacctggcgctagctgtgaagccttttctgaagggggaattttcaatatcacatcccccatgtgcctggtgagcaagcaaaaccgctttagagccgctgaacagcagatctctttcgtctgtcaacgggtggacatggatattatcgtctattgcaatggccagaaaaagacgattctcaccaagacactggtgatcggccagtgtatttacaccatcacatccctgtttagcctcctgcccggggttgcccactccattgcgatcgagctttgcgtgcctggattccatggctgggctaccgccgccctgctcatcacgttttgtttcgggtgggtcctgattccggcttgcacacttgccatcctgctcgtgctgaaatttttcgctaacattctgcacacctctaatcaggagaaccgctttaaggccatcctcagaaaaattaaggaagagttcgagaaaaccaagggaagcatggtttgtgagatctgcaagtacgaatgcgagacactgaaagagcttaaggcgcacaatctgtcctgtgtgcaaggcgaatgcccctattgttttacccattgcgagcctacagaaacggccatccaggctcactacaaagtctgtcaggccacccatcggttccgcgaggacctcaagaaaacagtgacaccccagaacattgggcctggctgctatagaaccctgaatctgttccggtacaagtctagatgttatatccttaccatgtggacgctcctgctgattatcgagagcattctctgggctgcctccgcggccgaaatccccctggtgccgctttggaccgacaacgctcacggagttggcagcgtccctatgcatacagatctggagctcgacttttctctgccctccagctctaagtacacctataaacgccacctgacaaatcctgtgaacgatcaacagtccgtgagccttcacatcgaaattgagtctcaggggatcggagccgacgtccatcacctcggccattggtacgatgctcggctgaatctgaagaccagcttccactgctacggggcctgtacgaaatatcagtacccctggcacacagccaagtgccattttgaaaaagactatgagtacgagaactcctgggcttgtaaccctcccgattgcccgggagtgggcaccgggtgcacagcgtgtggcctctatctggaccaacttaagcctgttggaaccgccttcaagattatcagcgtgagatactctcgcaaagtctgcctgcagtttggcgaagagtatctctgtaagaccattgatatgaatgactgcttcgtgacacggcacgttaaaatctgtatcattgggacggtgtccaagtttagccagggagataccctgctgttccttggccccatggaagggggaggcatcatttttaaacattggtgcacatccacctgtcacttcggggaccccggcgacgtcatgggacctaaggataaaccgtttatctgccccgagttccctggccagtttagaaagaagtgtaacttcgctacaacccccgtgtgcgaatacgacgggaatattatctctggatacaaaaaggttctcgccacgattgatagcttccaatcctttaacacatctaatatccatttcaccgacgagcgcatcgagtggcgggatcctgacggcatgctgagagatcacattaacatcgtgattagcaaagacatcgattttgaaaatctggccgagaacccctgtaaggtcgggctccaggctgccaatattgaaggagcgtggggctccggggtgggcttcaccctgacatgccaggtgtctcttaccgagtgccctacatttctgacgagcatcaaagcctgtgacatggccatctgctatggagccgaatccgtcaccctcagccgcggccaaaacacagttaagattaccgggaagggaggccactctgggtccagcttcaaatgttgccatggaaaggagtgttcttccacaggcctgcaggctagcgctccccacctggataaagtgaatggcatctctgagcttgaaaacgagaaggtgtacgacgatggggcgccggaatgcggaattacctgttggtttaaaaagtccggcgagtgggtcatggggatcattaatggaaactgggtggttctcatcgtgctgtgcgtcctgctcctgttcagccttatcctgctctccattctgtgtcctgtgcggaagcataaaaagagctga

SEQ ID NO: 13472 - RNA, 3402 nt, synthetic construct
  misc_feature 1..3402: note = derived and/or modified CDS sequence (opt5) from SEOV(Singapore/06(RN41))__GQ274942.1__GP
  source 1..3402: mol_type = other RNA
atgtggagcctgctcctgcttgccgctctggccggccaggggttcgcgctcaagaacgtgtttgacatgagaatccaatgcccccactccgtcaatttcggagagacctctgttagcggctacacagaactgcctccgctttccctgcaggaggctgaacagctcgtgcccgagtctagctgtaacatggataatcatcagtccctgtctacgattaacaaactgaccaaggtgatctggcggaaaaaggccaatcaagaaagcgcctcccagaacagctttgaggtcgtggagtctgaaatttccttcaaagggctctgcatgctgaagcaccgcatggttgaggaaagctatagaaatcggcgctctgtgatctgttacgaccttgcttgcaactccacattttgtaagcctaccgtctatatgattgtgcccatccatgcctgcaatatgatgaaaagctgtctgatcggactcggcccttaccggattcaggttgtgtatgagagaacatactgcaccacagggatcctgaccgagggaaagtgtttcgtccccgataaagctgtggtgtctgcccttaagcgcggcatgtatgcgattgcctccatcgaaacgatttgctttttcatccaccagaaaggcaacacctacaagattgtcacagctatcaccagcgccatggggtccaagtgtaataacacagacaccaaagttcaaggatactatatctgcattatcggcggaaattctgctcctgtgtacgccccggcgggggaggattttagagccatggaagtgttcagcggcattatcacgagcccccatggggaggaccacgatctgcctggagaagagattgctacatatcagatcagcggccagatcgaggccaagattccccacaccgtctcttccaaaaacctcaagctgacagcttttgccggcatccctagctactctagcacctccattctggccgcttctgaagacgggcggttcatctttagccccggactcttcccgaatctgaaccagtccgtgtgcgataacaatgcgcttcctctgatttggcgcggcctcatcgacctgaccgggtattacgaggccgttcatccctgtaacgtgttctgcgtccttagcggacctggcgcttcttgtgaagccttttccgaagggggaatcttcaatattacaagccccatgtgcctggtgtctaaacaaaacagatttcgggccgctgagcagcagatctccttcgtttgtcaacgcgtggatatggacattatcgtctattgcaatggccagaagaaaacgattctcaccaagacactggtgatcggccagtgtatttacaccatcacaagcctgttttccctcctgcccggggtcgcccactctatcgcgattgagctttgcgtgcctggattccatggctgggctaccgccgccctgctcatcacgttttgtttcgggtgggttctgattccggcttgcacacttgccatcctgctcgtgctgaagtttttcgctaacattctgcacaccagcaatcaggagaacagatttaaagccatcctccggaagatcaaagaagagttcgaaaagaccaaaggatccatggtctgtgagatttgcaagtacgaatgcgagacactgaaggagcttaaagcgcacaatctgtcttgtgtgcaaggcgaatgcccctattgttttacccattgcgagcctacagaaacggccatccaggctcactacaaggtttgtcaggccacccatcgcttcagagaggatctcaaaaagacagtgacaccccagaacattgggcctggctgctatcggaccctgaatctgttcagatacaaaagccgctgttatatccttaccatgtggacgctcctgctgattatcgagtccatcctctgggctgccagcgcggccgaaattcccctggtcccgctttggaccgacaacgctcacggagtgggctctgtgcctatgcatacagacctggagctcgatttttccctgccctcctcttccaagtacacctataagcggcacctgacaaatcctgttaacgaccaacagagcgtctctcttcacatcgaaattgagagccaggggatcggagccgatgtgcatcacctcggccattggtacgacgctagactgaatctgaaaacctccttccactgctacggggcctgtacgaagtatcagtacccctggcacacagccaaatgccattttgaaaaggattatgagtacgagaacagctgggcttgtaaccctcccgactgcccgggagtgggcaccgggtgcacagcgtgtggcctctatctggatcaacttaaacctgtcggaaccgccttcaagattatctctgtgcgctactcccggaaggtttgcgtgcagtttggcgaagagtatctgtgtaaaaccatcgacatgaatgattgcttcgtcacaagacacgctaagatttgtatcattgggacggtgagcaaattttcccagggagacaccctcctgttcctgggccccatggaagggggaggcatcatttttaagcattggtgcacatctacctgtcacttcggggatcccggcgacgttatgggacctaaagacaagccgtttatctgccccgagttccctggccagtttcgcaaaaagtgtaacttcgccacaacccccgtgtgcgaatacgatgggaatattatcagcggatacaagaaagtccttgccacgatcgactccttccaatcttttaacacaagcaatattcatttcaccgatgagcggatcgagtggagagaccctgatggcatgctccgcgaccacattaacatcgtgatttccaaggatatcgactttgaaaatctggctgagaacccctgtaaagttgggctgcaggccgcgaatatcgaaggagcttggggctctggggtgggcttcaccctcacatgccaggtcagcctgaccgagtgccctacatttcttacgtccattaaggcctgtgatatggccatctgctatggagctgaaagcgtgaccctgtctcggggccaaaacacagtgaaaattaccgggaagggaggccactccgggagctctttcaagtgttgccatggaaaagagtgttccagcacaggcctccaggcctctgcgccccacctggacaaggtcaatggcatctccgagctggaaaacgagaaagtttacgatgacggggctccggaatgcggaattacctgttggtttaagaaaagcggcgagtgggtgatggggatcatcaatggaaactgggtggtccttattgtgctctgcgttctgctcctgttctccctgatccttctgagcattctctgtcctgtgagaaagcataagaaatcttga

SEQ ID NO: 13473 - RNA, 3402 nt, synthetic construct
  misc_feature 1..3402: note = derived and/or modified CDS sequence (opt5) from SEOV(11CSG)__AB618131.1__GP
  source 1..3402: mol_type = other RNA
atgtggagcctgctcctgcttgccgctctggccggccaggggttcgcgctcaagaacgtgtttgacatgagaatccaatgcccccactccgtcaatttcggagagacctctgttagcggctacacagaactgcctccgctttccctgcaggaggctgaacagctcgtgcccgagtctagctgtaacatggataatcatcagtccctgtctacgattaacaaactgaccaaggtgatctggcggaaaaaggccaatcaagaaagcgcctcccagaacagctttgaggtcgtggagtctgaagtttccttcaaagggctctgcatgctgaagcaccgcatggtggaggaaagctatagaaatcggcgctctgtcatttgttacgaccttgcttgcaactccacattttgtaagcctaccgtgtatatgatcgttcccattcatgcctgcaatatgatgaaaagctgtctgatcggactcggcccttacagaatccaggtggtctatgagcggacatactgcaccacagggattctgaccgagggaaagtgtttcgtgcccgataaagctgtggtctctgcccttaagcgcggcatgtatgcgatcgcctccattgaaacgatctgctttttcgttcaccagaaaggcaacacctacaagattgtgacagctatcaccagcgccatggggtccaagtgtaataacacagacaccaaagtgcaaggatactatatttgcatcatcggcggaaattctgctcctgtctacgccccggcgggggaggattttagagccatggaagtgttcagcggcattatcacgagcccccatggggaggaccacgatctgcctggagaagagattgctacatatcagatcagcggccagattgaggccaagtttccccacaccgtttcttccaaaaacctcaagctgacagctttcgccggcatccctagctactctagcacctccatcctggccgcttctgaagacgggcggtttattttcagccccggactcttcccgaatctgaaccagtccgtgtgcgataacaatgcgcttcctctgatctggcgcggcctcattgacctgaccgggtattacgaggccgtccatccctgtaacgtgttttgcgttcttagcggacctggcgcttcttgtgaagccttctccgaagggggaatctttaatattacaagccccatgtgcctggtgtctaaacaaaacagattccgggccgctgagcagcagatctcctttgtctgtcaacgcgtggatatggacatcattgtctattgcaatggccagaagaaaacgatcctcaccaagacactggtgattggccagtgtatctacaccattacaagcctgttctccctcctgcccggggttgcccactctatcgcgattgagctttgcgtgcctggatttcatggctgggctaccgccgccctgctcatcacgttctgttttgggtgggtcctgatcccggcttgcacacttgccattctgctcgtgctgaagttctttgctaacatcctgcacaccagcaatcaggagaacagattcaaagccattctccggaagatcaaagaagagtttgaaaagaccaaaggatccatggtttgtgagatttgcaagtacgaatgcgagacactgaaggagcttaaagcgcacaatctgtcttgtgtgcaaggcgaatgcccctattgtttcacccattgcgagcctacagaaacggccatccaggctcactacaaggtctgtcaggccacccatcgcttcagagaggatctcaaaaagacagtgacaccccagaacatcgggcctggctgctatcggaccctgaatctgtttagatacaaaagccgctgttatattcttaccatgtggacgctcctgctgatcattgagtccatcctctgggctgccagcgcggccgaaattcccctggtgccgctttggaccgacaacgctcacggagttggctctgtccctatgcatacagacctggagctcgatttctccctgccctcctcttccaagtacacctataagcggcacctgacaaatcctgtgaacgaccaacagagcgtgtctcttcacatcgaaatcgagagccaggggattggagccgatgtccatcacctcggccattggtacgacgctagactgaatctgaaaacctcctttcactgctacggggcctgtacgaagtatcagtacccctggcacacagccaaatgccatttcgaaaaggattatgagtacgagaacagctgggcttgtaaccctcccgactgcccgggagtgggcaccgggtgcacagcgtgtggcctctatctggatcaacttaaacctgttggaaccgcctttaagatcatttctgtgcgctactcccggaaggtctgcgtgcagttcggcgaagagtatctgtgtaaaaccatcgacatgaatgattgctttgttacaagacacgctaagatttgtatcatcgggacggtgagcaaattctcccagggagacaccctcctgtttctgggccccatggaagggggaggcattatcttcaagcattggtgcacatctacctgtcactttggggatcccggcgacgtcatgggacctaaagacaagccgttcatttgccccgagtttcctggccagttccgcaaaaagtgtaacttcgccacaacccccgtgtgcgaatacgatgggaatacgatcagcggatacaagaaagttcttgccacaattgactcctttcaatctttcaacaccagcaatatccattttaccgatgagcggattgagtggagagaccctgatggcatgctccgcgaccacatcaacatcgtgatttccaaggatatcgacttcgaaaatctggctgagaacccctgtaaagtcgggctgcaggccgcgaatattgaaggagcttggggctctggggtgggctttacactgacctgccaggtgagcctcacagagtgccctacgttccttacctccatcaaggcctgtgatatggccatttgctatggagctgaaagcgtcacactgtctcggggccaaaacaccgttaaaatcacagggaagggaggccactccgggagctcttttaagtgttgccatggaaaagagtgttccagcaccggcctccaggcctctgcgccccacctggacaaggtgaatggcatctccgagctggaaaacgagaaagtgtacgatgacggggctccggaatgcggaattacgtgttggttcaagaaaagcggcgagtgggtcatggggatcattaatggaaactggatcgtgcttattgttctctgcgtgctgctgctcttttccctgatccttctgagcatcctctgtcctgtcagaaagcataagaaatcttga

SEQ ID NO: 13474 - RNA, 3402 nt, synthetic construct
  misc_feature 1..3402: note = derived and/or modified CDS sequence (opt5) from SEOV(5CSG)__AB618130.1__GP
  source 1..3402: mol_type = other RNA
atgtggagcctgctcctgcttgccgctctggccggccaggggttcgcgctcaagaacgtgtttgacatgagaatccaatgcccccactccgtcaatttcggagagacctctgttagcggctacacagaactgcctccgctttccctgcaggaggctgaacagctcgtgcccgagtctagctgtaacatggataatcatcagtccctgtctacgattaacaaactgaccaaggtgatctggcggaaaaaggccaatcaagaaagcgcctcccagaacagctttgaggtcgtggagtctgaagtttccttcaaagggctctgcatgctgaagcaccgcatggtggaggaaagctatagaaatcggcgctctgtcatttgttacgaccttgcttgcaactccacattttgtaagcctaccgtgtatatgatcgttcccattcatgcctgcaatatgatgaaaagctgtctgatcggactcggcccttacagaatccaggtggtctatgagcggacatactgcaccacagggattctgaccgagggaaagtgtttcgtgcccgataaagctgtggtctctgcccttaagcgcggcatgtatgcgatcgcctccattgaaacgatctgctttttcattcaccagaaaggcaacacctacaagatcgttacagctattaccagcgccatggggtccaagtgtaataacacagacaccaaagtgcaaggatactatatctgcatcattggcggaaattctgctcctgtgtacgccccggcgggggaggattttagagccatggaagtcttcagcggcatcattacgagcccccatggggaggaccacgatctgcctggagaagagatcgctacatatcagattagcggccagatcgaggccaagatcccccacaccgtgtcttccaaaaacctcaagctgacagcttttgccggcattcctagctactctagcacctccatcctggccgcttctgaagacgggcggttcatttttagccccggactcttcccgaatctgaaccagtccgtttgcgataacaatgcgcttcctctgatctggcgcggcctcattgacctgaccgggtattacgaggccatccatccctgtaacgtgttctgcgtccttagcggacctggcgcttcttgtgaagccttttccgaagggggaatcttcaatattacaagccccatgtgcctggtgtctaaacaaaacagatttcgggccgctgagcagcagatctccttcgtttgtcaacgcgtggatatggacattatcgtctattgcaatggccagaagaaaacgattctcaccaagacactggtgatcggccagtgtatttacaccatcacaagcctgttttccctcctgcccggggtcgcccactctatcgcgattgagctttgcgtgcctggattccatggctgggctaccgccgccctgctcatcacgttttgtttcgggtgggttctgattccggcttgcacacttgccatcctgctcgtgctgaagtttttcgctaacattctgcacaccagcaatcaggagaacagatttaaagccatcctccggaagatcaaagaagagttcgaaaagaccaaaggatccatggtctgtgagatttgcaagtacgaatgcgagacactgaaggagcttaaagcgcacaatctgtcttgtgtgcaaggcgaatgcccctattgttttacccattgcgagcctacagaaacggccatccaggctcactacaaggtttgtcaggccacccatcgcttcagagaggatctcaaaaagacagtgacaccccagaacattgggcctggctgctatcggaccctgaatctgttcagatacaaaagccgctgttatatccttaccatgtggacgctcctgctgattatcgagtccatcctctgggctgccagcgcggccgaaattcccctggtcccgctttggaccgacaacgctcacggagtgggctctgtgcctatgcatacagacctggagctcgatttttccctgccctcctcttccaagtacacctataagcggcacctgacaaatcctgttaacgaccaacagagcgtctctgtgcacatcgaaattgagagccaggggatcggagccgatgtgcatcaccttggccattggtacgacgctagactcaatctgaaaacctccttccactgctacggggcctgtacgaagtatcagtacccctggcacacagccaaatgccattttgaaaaggattatgagtacgagaacagctgggcttgtaaccctcccgactgcccgggagtcggcaccgggtgcacagcgtgtggcctgtatctcgatcaactgaaacctgtgggaaccgccttcaagattatctctgttcgctactcccggaaggtgtgcgtccagtttggcgaagagtatctttgtaaaaccatcgacatgaatgattgcttcgtgacaagacacgctaagatttgtatcattgggacggttagcaaattttcccagggagacaccctcctgttcctgggccccatggaagggggaggcatcatttttaagcattggtgcacatctacctgtcacttcggggatcccggcgacgtgatgggacctaaagacaagccgtttatctgccccgagttccctggccagtttcgcaaaaagtgtaacttcgccacaacccccgtctgcgaatacgatgggaatacgattagcggatacaagaaagtgctggccacaatcgactccttccaatcttttaacaccagcaatatccatttcaccgatgagcggattgagtggagagaccctgatggcatgcttcgcgaccacatcaacattgttatctccaaggatattgactttgaaaatctcgctgagaacccctgtaaagtggggctgcaggccgcgaatatcgaaggagcttggggctctggggtcggcttcacactgacctgccaggtgagcctcacagagtgccctacgtttctgacctccatcaaggcctgtgatatggccatttgctatggagctgaaagcgtgacactttctcggggccaaaacaccgtcaaaatcacagggaagggaggccactccgggagctctttcaagtgttgccatggaaaagagtgttccagcaccggcctgcaggcctctgcgccccacctcgacaaggttaatggcatttccgagctggaaaacgagaaagtgtacgatgacggggctccggaatgcggaatcacgtgttggtttaagaaaagcggcgagtgggtgatggggattatcaatggaaactgggtcgtgctgatcgttctttgcgtgctcctgctgttctccctcattctgcttagcatcctgtgtcctgtcagaaagcataagaaatcttga

SEQ ID NO: 13475 - RNA, 3402 nt, synthetic construct
  misc_feature 1..3402: note = derived and/or modified CDS sequence (opt5) from SEOV(80-39)__S47716.1__GP
  source 1..3402: mol_type = other RNA
atgtggagcctgctcctgcttgccgctctggtgggccaggggttcgccctcaagaacgtctttgacatgagaatccaatgcccccactccgttaaattcggagagacctctgtgagcggctacacagaactgcctccgctttccctgcaggaggcggaacagctcgtgcccgagtctagctgtaatatggataaccatcagtccctgtctacgattaataagctgaccaaagtcatctggcggaagaaagctaaccaagaaagcgccaatcagaactcctttgagctcatggagagcgaagtgtctttcaaggggctgtgcatgcttaagcaccgcatggttgaggaatcctatagaaatcggcgcagcgtgatttgttacgacctggcctgcaactctacattttgtaaacctaccgtctatatgatcgtgcccattcatgcttgcaatatgatgaagtcctgtctcatcggactgggcccttacagagttcaggtggtctatgagcggacatactgcaccacagggatccttaccgagggaaaatgtttcgtgcccgataaggccgtggtcagcgctctgaaacgcggcatgtatgccattgcgtctatcgaaacgatttgctttttcatccaccagaagggcaacacctacaagattgttacagccatcacctccgctatggggagcaaatgtaataacacagacaccaaggtgcaaggatactatatttgcatcatcggcggaaattccgcccctgtgtacgctccggccggggaggattttagagcgatggaagtcttctctggcattatcacgagcccccatggggaggaccacgatctccctggagaagagattgccacatatcagatctccggccagattgaggctaaaatcccccacaccgtgagctctaagaacctgaaactgacagcctttgctggcatcccttcctacagctctaccagcattctcaccgcctccgaagacgggcggttcatcttttctcccggactgttcccgaatcttaaccagagcgtttgcgataacaatgccctgcctctcatttggcgcggcctgatcgaccttacagggtattacgaggctgtgcatccctgtaacgtcttctgcgtgctgtccggacctggcgcgagctgtgaagccttttctgaagggggaattttcaatatcacgtcccccatgtgcctcgttagcaagcaaaacagatttcgggctgccgaacagcagatctctttcgtgtgtcaacgcgtcgatatggacattatcgtgtattgcaatggccagaaaaagaccattctgacaaagaccctggtcatcggccagtgtatttacacaatcacctccctctttagcctgcttcccggggtggcccactccattgctatcgagctgtgcgttcctggattccatggctgggccacggcggctctcctgatcacattttgtttcgggtgggtgcttattccggcctgcaccctggccatcctcctggtcctgaaatttttcgctaacattctccacacctctaatcaggagaacagatttaaggccatcctgcggaaaattaaggaagagttcgagaaaacaaagggaagcatggtgtgtgagatctgcaagtacgaatgcgagacccttaaagagctgaaggctcacaatctctcctgtgttcaaggcgaatgcccctattgttttacacattgcgagcctacggaaaccgccatccaggcgcactacaaagtgtgtcaggccacacatcgcttcagagaggatctgaagaaaaccgtcacaccccagaacattgggcctggctgctatcggaccctgaatcttttcagatacaagtctcgctgttatatcctcacgatgtggaccctgctgctcattatcgagagcattctgtgggctgcctccgctgccgaaatcccccttgtgccgctgtggacagacaacgcgcacggagtgggcagcgttcctatgcataccgacctcgagctggatttttctctgccctccagctctcggtacacatataagagacaccttaccaatcctgtcaacgaccaacagtccgtgagcctccacatcgaaattgagtctcaggggatcggagccgatgtgcatcacctgggccattggtacgacgctcgcctgaatctcaaaacgagcttccactgctacggggcctgtacaaagtatcagtacccctggcacaccgctaaatgccattttgaaaaggattatgagtacgagaactcctgggcctgtaaccctcccgactgcccgggagtcggcacagggtgcaccgcctgtggcctgtatcttgatcaactgaaacctgtgggaaccgctttcaagattatcagcgttcggtactctagaaaggtgtgcgtccagtttggcgaagagtatctctgtaaaacaattgacatgaatgattgcttcgtgacgcgccacgcgaagatctgtatcattgggaccgtttccaaatttagccagggagacacactgctgttccttggccccatggaagggggaggcatcatttttaagcattggtgcacctccacatgtcacttcggggatcccggcgacgtgatgggacctaaagacaagccgtttatctgccccgagttccctggccagtttcggaaaaagtgtaacttcgccaccacgcccgtctgcgaatacgatgggaatattatctctggatacaagaaagtgctcgctacaattgacagcttccaatcctttaacacctctaatatccatttcaccgatgagagaatcgagtggcgcgaccctgatggcatgctgcgggaccacattaacatcgttattagcaaggatatcgactttgaaaatctggccgagaacccctgtaaagtggggctccaggccgctaatattgaaggagcctggggctccggggtcggcttcacactgacctgccaggtgtctcttacagagtgccctacgtttctgaccagcatcagagcgtgtgatatggctatctgctatggagccgaatccgtgacactcagccgcggccaaaacaccgtcaagattacagggaaaggaggccactctgggtccagcttcaagtgttgccatggaaaggagtgttctctgaccggcctgcaggcctccgctccccaccttgacaaagttaatggcatcagcgagctcgaaaacgagaaggtgtacgatgacggggccccggaatgcggaattacgtgttggtttaaaaagtctggcgagtgggtgatggggatcattaatggaaactgggtcgtgctgatcgttctgtgcgtgctcctgcttttctccctgatcctcctgagcattctgtgtcctgtccggaaacataagaagtcctga

SEQ ID NO: 13476 - RNA, 3402 nt, synthetic construct
  misc_feature 1..3402: note = derived and/or modified CDS sequence (opt5) from SEOV(93HBQ3)__KM115585.1__GP
  source 1..3402: mol_type = other RNA
atgtggagcctgctcctgcttgccgctctggtgggccaggggttcgccctcaagaacgtctttgacatgagaatccaatgcccccactccgttaaattcggagagacctctgtgagcggctacacagaactgcctccgctttccctgcaggaggcggaacagctcgtgcccgagtctagctgtaatatggataaccatcagtccctgtctacgattaataagctgaccaaagtcatctggcaaaagaaagctaaccaggaaagcgccaatcagaactcctttgaggtggccgagagcgaagtttctttcaaggggctctgcatgctgaagcaccggatggtggaggaatcctatcgcaatagacggagcgtcatttgttacgaccttgcttgcaactctacattttgtaaacctaccgtgtatatgatcgttcccattcatgcctgcaatatgatgaagtcctgtctgatcggactcggcccttaccgcatccaggtggtctatgagagaacatactgcaccacagggattctgaccgagggaaaatgtttcgtgcccgataaggctgtggtcagcgcccttaaacggggcatgtatgcgatcgcctctattgaaacgatctgctttttcattcaccaaaagggcaacacctacaagatcgttacagctattacctccgccatggggagcaaatgtaataacacagacaccaaggtgcagggatactatatctgcatcattggcggaaattccgctcctgtgtacgccccgtctggggaggattttcgcgcgatggaagtcttcagcggcatcattatgagcccccatggggaggaccacgatctgcctggagaagagatcgccacgtatcagattagcggccagatcgaggctaaaatcccccacacagtgtcttccaagaacctcaaactgaccgcctttgctggcattcctagctactctagcacatccatcctggccgcctctgaagacgggagattcatttttagccccggactcttcccgaatctgaaccaatccgtttgcgataacaatgcccttcctctgatctggcggggcctcattgacctgaccgggtattacgaggcggtgcatccctgtaacgtcttctgcgtgcttagcggacctggcgcctcttgtgaggctttttccgaagggggaatcttcaatatcaccagccccatgtgcctggtttctaagcagaaccgctttagagccgccgaacagcaaatttccttcgtgtgtcagcgggtcgatatggacatcattgtgtattgcaatggccagaaaaagacaatcctcacgaagaccctggtcattggccagtgtatctacacaattaccagcctgttttccctcctgcccggggtggctcactctatcgccatcgagctttgcgttcctggattccatggctgggcgacagctgccctgctcattaccttttgtttcgggtgggtgctgatcccggcctgcacgcttgctattctgctcgtcctgaaatttttcgccaacatcctgcacacaagcaatcaagagaaccgctttaaggctattctcagaaaaatcaaggaagagttcgagaaaaccaagggatccatggtgtgtgaaatctgcaagtacgaatgcgagaccctgaaagagcttaaggcccacaatctgtcttgtgttcagggcgaatgcccctattgttttacacattgcgagcctaccgaaacagcgattcaggcccactacaaagtgtgtcaggctacgcatcggttccgcgaggatctcaagaaaaccgtcacaccccaaaacatcgggcctggctgctatagaaccctgaatctgttccggtacaagagcagatgttatattcttacaatgtggaccctcctgctgatcattgagtccatcctctgggccgctagcgccgcggaaatccccctggtgccgctttggacggacaacgcccacggagtgggctctgttcctatgcataccgacctggagctcgatttttccctgccctcctcttccaagtacacatataaacgccacctgaccaatcctgtcaacgaccagcagagcgtgtctcttcacattgaaatcgagagccaggggattggagctgatgtgcatcacctcggccattggtacgacgcccggctgaatctgaagacatccttccactgctacggggcttgtaccaaatatcaatacccctggcacacggccaagtgccattttgaaaaagattatgagtacgagaacagctgggcctgtaaccctcccgactgcccgggagtcggcacagggtgcaccgcttgtggcctctatctggatcagcttaagcctgtgggaacagcgctgaagatcatttctgttagatactcccgcaaagtgtgcgtccagttcggcgaagagtatctctgtaagaccatcgacatgaatgattgctttgtgacccggcacgccaaaatctgtattatcgggacagttagcaagttctcccagggagacacgctgctgtttcttggccccatggaagggggaggcattatcttcaaacattggtgcacctctacatgtcactttggggatcccggcgacgtgatgggacctaaggacaaaccgttcatttgccccgagtttcctggccaattcagaaagaagtgtaactttgctaccacacccgtctgcgaatacgatgggaatatcattagcggatacaaaaaggtgctcgccaccatcgactccttccagtctttcaacacgagcaatatccattttacagatgagcgcattgagtggcgggaccctgatggcatgctgagagaccacatcaacattgttatctccaaagatattgacttcgaaaatctggccgagaacccctgtaaggtggggctccaggctgccaatatcgaaggagcgtggggctctggggtcggctttaccctgacctgccaagtgagccttacagagtgccctaccttcctgacatccatcaaggcttgtgatatggccatttgctatggagccgaaagcgtgacgctcctgcgcggccagaacaccgtcaaaatcacagggaagggaggccactctgggtccagctttaaatgttgccatggaaaggagtgttcttccaccggcctgcaggctagcgctccccaccttgacaaagttaatggcatttctgagctcgaaaacgagaaggtgtacgatgacggggcgccggaatgcggaatcacatgttggttcaaaaagtccggcgagtgggtgatggggattatcaatggaaactgggtcgtgctgatcgttctgtgcgtgctcctgctttttagcctgattctcctgtccatcctgtgtcctgtccggaagcataaaaagagctga

SEQ ID NO: 13477 - RNA, 3402 nt, synthetic construct
  misc_feature 1..3402: note = derived and/or modified CDS sequence (opt5) from SEOV(93HBQ4)__KM115586.1__GP
  source 1..3402: mol_type = other RNA
atgtggagcctgctcctgcttgccgctctggtgggccaggggttcgccctcaagaacgtctttgacatgagaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaagctgaccaaggtcatctggcggaaaaaggctaatcaagaaagcgccaaccaaaattcctttgaggtggccgagagcgaagtttctttcaaagggctctgcatgctgaagcaccgcatggtggaggaatcctatagaaaccggcgcagcgtcatttgttacgaccttgcttgcaattctacattttgtaagcctaccgtgtatatgatcgttcccattcatgcctgcaacatgatgaaatcctgtctgatcggactcggcccttacagaatccaggtggtctatgagcggacatactgcaccacagggattctgaccgagggaaagtgtttcgtgcccgataaagctgtggtcagcgcccttaagcgcggcatgtatgcgatcgcctctattgaaacgatctgctttttcattcaccagaaaggcaatacctacaagatcgttacagctattacctccgccatggggagcaagtgtaacaatacagacaccaaagtgcaaggatactatatctgcatcattggcgggaactccgctcctgtgtacgccccgtctggagaggattttagagcgatggaagtcttcagcggcatcattatgagcccccatggggaggaccacgatctgcctggagaagagatcgccacgtatcagattagcggccagatcgaggctaagatcccccacacagtgtcttccaaaaatctcaagctgaccgcctttgctggcattcctagctactctagcacatccatcctggccgcctctggggacagccggttcatcttttcccccggactcttcccgaacctgaaccagagcgtttgcgataataacgcccttcctctgatttggcgcggcctcattgacctgaccgggtattacgaagcggtgcatccctgtaatgtcttctgcgtgctttctggacctggcgcctcctgtgaggcttttagcgaagggggaatcttcaacatcacctctcccatgtgcctggtttccaaacaaaatagatttcgggccgccgagcagcagattagcttcgtgtgtcaacgcgtcgatatggacatcattgtgtattgcaacggccagaagaaaacaatcctcacgaagaccctggtcattggccagtgtatctacacaattacctccctgttttctctcctgcccggggtggctcacagcatcgccatcgaactttgcgttcctggattccatggctgggcgacagctgccctgctcattaccttttgtttcgggtgggtgctgatcccggcctgcacgcttgctattctgctcgtcctgaagtttttcgccaatatcctgcacacatccaaccaggagaatagatttaaagctattctccggaagatcaaagaggagttcgagaagaccaaaggatctatggtgtgtgaaatctgcaagtacgagtgcgaaaccctgaaggagcttaaagcccacaacctgagctgtgttcaaggcgagtgcccctattgttttacacattgcgaacctaccgagacagcgattcaggcccactacaaggtgtgtcaggctacgcatcgcttcagagaagatctcaaaaagaccgtcacaccccagaatatcgggcctggctgctatcggaccctgaacctgttcagatacaaatcccgctgttatattcttacaatgtggaccctcctgctgatcattgagagcatcctctgggccgcttctgccgcggagatccccctggtgccgctttggacggacaatgcccacggagtgggctccgttcctatgcataccgacctggaactcgattttagcctgccctcttccagcaagtacacatataagcggcacctgaccaaccctgtcaatgaccaacagtctgtgagccttcacattgagatcgaatcccaggggattggagctgatgtgcatcacctcggccattggtacgacgccagactgaacctgaaaacatccttccactgctacggggcttgtaccaagtatcagtacccctggcacacggccaaatgccattttgagaaggattatgaatacgagaactcttgggcctgtaatcctcccgactgcccgggagtcggcacagggtgcaccgcttgtggcctctatctggatcaacttaaacctgtgggaacagcgttcaagatcatttccgttcgctacagccggaaggtgtgcgtccagtttggcgaggaatatctgtgtaaaaccatcgacatgaacgattgcttcgtgaccagacacgccaagatctgtattatcgggacagtttccaaattttctcagggagacacgctcctgttcctgggccccatggaagggggaggcattatctttaagcattggtgcaccagcacatgtcacttcggggatcccggcgacgtgatgggacctaaagacaagccgtttatttgccccgagttccctggccagtttcgcaaaaagtgtaatttcgctaccacacccgtctgcgaatacgatgggaacatcatttccggatacaagaaagtgcttgccaccatcgactctttccagagctttaatacgtccaacatccatttcacagatgaaaccattgagtggcgggaccctgatggcatgctcagagaccacatcaatattgttatctctaaggatattgactttgagaacctggccgaaaatccctgtaaagtggggctgcaggctgccaacatcgagggagcgtggggcagcggggtcggcttcaccctcacatgccaggtgtccctgaccgaatgccctacatttcttacgagcatcaaggcttgtgatatggccatttgctatggagccgagtctgtgaccctgtcccgcggccaaaatacagtcaaaatcaccgggaagggaggccacagcgggtcttccttcaagtgttgccatggaaaagaatgtagctctacaggcctccaggcttccgctccccacctggacaaggttaacggcattagcgagctggagaatgaacgggtgtacgatgacggggcgccggagtgcggaatcacctgttggtttaaaaagtccggcgaatgggtgatggggattatcaacggaaattgggtcgtgcttatcgttctctgcgtgctgctcctgttcagcctgattcttctgtctatcctctgtcctgtcagaaaacataaaaagagctga

SEQ ID NO: 13478 - RNA, 3402 nt, synthetic construct
  misc_feature 1..3402: note = derived and/or modified CDS sequence (opt5) from SEOV(B1)__AB457790.1__GP
  source 1..3402: mol_type = other RNA
atgtggagcctgctcctgcttgccgctctggtgggccaggggttcgccctcaagaacgtctttgacatgagaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaaactgaccaaggtcatctggcggaaaaaggctaatcaagaaagcgccaaccaaaattcctttgaggtggttgagagcgaagtgtctttcaaagggctctgcatgctgaagcaccgcatggtcgaggaatcctatagaaaccggcgcagcgtgatttgttacgaccttgcctgcaattctacattttgtaagcctaccgtttatatgatcgtgcccattcatgcttgcaacatgatgaaatcctgtctgatcggactcggcccttacagaatccaggtcgtgtatgagcggacatactgcaccacagggattctgaccgagggaaagtgtttcgtgcccgataaagccgtcgttagcgctcttaagcgcggcatgtatgccatcgcgtctattgaaacgatctgctttttcattcaccagaaaggcaatacctacaagatcgtgacagccattacctccgctatggggagcaagtgtaacaatacagacaccaaagtgcagggatactatatctgcatcattggcgggaactccgcccctgtctacgctccggccggagaggattttagagcgatggaagtgttctctggcatcattacgagcccccatggggaggaccacgatctgcctggagaagagatcgccacatatcagatttccggccagatcgaggctaagatcccccacaccgttagctctaaaaatctccggctgacagcctttgctggcattccttcctacagctctaccagcatcctggccgcctccgaagacgggcgcttcatcttttctcccggactcttcccgaacctgaaccagagcgtgtgcgataataacgcccttcctctgatttggagaggcctcattgacctgaccgggtattacgaggcggtccatccctgtaatgtgttctgcgttctttccggacctggcgccagctgtgaggctttttctgaagggggaatcttcaacatcacatcccccatgtgcctggtgagcaagcaaaatcggtttcgcgccgccgaacagcagatttctttcgtctgtcaaagagtggatatggacatcattgtctattgcaacggccagaaaaagacgatcctcaccaaaacactggtgattggccagtgtatctacaccattacatccctgtttagcctcctgcccggggttgctcactccatcgccatcgagctttgcgtgcctggattccatggctgggcgaccgctgccctgctcattacgttttgtttcgggtggatcctgattccggcctggacacttgctatcctgctcgtcctgaagtttttcgccaatattctgcacacctctaaccaggagaatcggtttaaggctatcctccgcaaaatcaaggaagagttcgagaaaaccaagggaagcatggtgtgcgaaatttgtaaatacgaatgcgagacactgaaggagcttaaggcccacaacctgtcctgcgttcaaggcgaatgtccctattgctttacccattgtgagcctacagaaacggcgatccaggcccactacaaaatttgccaggctacccatagattccgggaggatctcaagaaaacagtgacaccccagaatatcgggcctggctgttatagaaccctgaacctgttccgctacaagtctcggtgctatattcttaccatgtggacgctcctgctgatcatcgagagcattctctgggccgcttccgccgcggaaatccccctggtcccgctttggaccgacaatgcccacggagtgggcagcgtgcctatgcatacagacctggagctcgatttttctctgccctccagctctaaatacacctataagagacacctgacaaaccctgttaatgaccaacagtccgtcagccttcacattgaaatcgagtctcaggggattggagctgatgtgcatcacctcggccattggtacgacgcccgcctgaacctgaagaccagcttccactgttacggggcttgcacgaaatatcagtacccctggcacacagccaagtgtcattttgaaaaagattatgagtacgagaactcctgggcctgcaatcctcccgactgtccgggagtgggcaccgggtgcacagcttgcggcctctatctggatcaacttaagcctgtcggaaccgcgttcaaaatcatcagcgtgcggtactctagaaaggtttgtgtgcagtttggcgaagagtatctgtgcaagaccattgacatgaacgattgtttcgtcacacgccacgccaaaatctgcattatcgggacggtgtccaagtttagccagggagacaccctcctgttcctgggccccatggaagggggaggcattatctttaaacattggtgtacatctacctgccacttcggggatcccggcgacgttatgggacctaaggacaaaccgtttatttgtcccgagttccctggccagtttcggaagaaatgcaatttcgctacaacccccgtgtgtgaatacgatgggaacatcatctccggatacaagaaggtccttgccacgattgacagcttccaatcctttaatacatctaacatccatttcaccgatgagagaattgagtggcgcgaccctgatggcatgctccgggaccacatcaatattgtgatcagcaaagatatcgactttgaaaacctggccgagaatccctgcaaggttgggctgcaggctgccaacattgaaggagcgtggggctccggggtgggcttcaccctcacatgtcaggtctctctgaccgagtgccctacatttcttacgagcatcaaggcttgcgatatggccatttgttatggagccgaatccgtgaaactgagcagaggccaaaataccgtgaaaatcacagggaagggaggccactctgggtccagcttcaagtgctgtcatggaaaagagtgttcttccaccggcctccaggctagcgctccccacctggacaaggtcaacggcatttctgagctggaaaatgagaaagtttacgatgacggggcgccggaatgcggagtgacatgctggtttaagaaatccggcgagtgggtgatggggatcatcaacggaaattgggtcgtgcttattgttctctgtctgctgctcctgttcagccttatcctgctctccattctgtgccctgtgcgcaagcataagaaaagctga

SEQ ID NO: 13479 - RNA, 3402 nt, synthetic construct
  misc_feature 1..3402: note = derived and/or modified CDS sequence (opt5) from SEOV(B1)__AB457791.1__GP
  source 1..3402: mol_type = other RNA
atgtggagcctgctcctgcttgccgctctggtgggccaggggttcgccctcaagaacgtctttgacatgagaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaaactgaccaaggtcatctggcagaaaaaggctaatcaggaaagcgccaaccaaaattcctttgaggtggttgagagcgaagtgtctttcaaagggctctgcatgctgaagcaccggatggtcgaggaatcctatcgcaacagacggagcgtgatttgttacgaccttgcctgcaattctacattttgtaagcctaccgtttatatgatcgtgcccattcatgcttgcaacatgatgaaatcctgtctgatcggactcggcccttaccgcatccaggtcgcctatgagagaacatactgcaccacagggattctgaccgagggaaagtgtttcgtgcccgataaagctgtggtcagcgcccttaagcggggcatgtatgcgatcgcctctattgaaacgatctgctttttcattcaccaaaaaggcaatacctacaagatcgttacagctattacctccgccatggggagcaagtgtaacaatacagacaccaaagtgcagggatactatatctgcatcattggcgggaactccgctcctgtgtacgccccggcgggagaggattttcgcgccatggaagtcttctctggcatcattacgagcccccatggggaggaccacgatctgcctggagaagagatcgctacatatcagatttccggccagatcgaggccaagatcccccacaccgtgagctctaaaaatctcagactgacagcttttgccggcattccttcctacagctctaccagcatcctggccgcttccaaggacgggcggttcattttctctcccggactcttcccgaacctgaaccaaagcgtttgcgataataacgcgcttcctctgatctggcgcggcctcattgacctgaccgggtattacgaagccgtgcatccctgtaatgtcttctgcgtgctttccggacctggcgctagctgtgaggccttttctgaagggggaatcttcaacatcacatcccccatgtgcctggttagcaaacagaatagatttcgggccgctgagcagcaaatttctttcgtgtgtcagcgcgtcgatatggacatcattgtgtattgcaacggccagaagaaaacgatcctcaccaagacactggtcattggccagtgtatctacaccattacatccctgtttagcctcctgcccggggtggcccactccatcgcgatcgaactttgcgttcctggattccatggctgggctaccgccgccctgctcattacgttttgtttcgggtggatcctgattccggcttgcacacttgccatcctgctcgtgctgaagtttttcgctaatattctgcacacctctaaccaagagaatagatttaaagccatcctccggaagatcaaagaggaatttgagaagaccaaaggaagcatggtctgtgaaatttgcaagtacgagtgcgaaacactgaaggagcttaaagcgcacaacctgtcctgtgtgcagggcgagtgcccctattgttttacccattgcgaacctacagagacggccatccaggctcactacaagatttgtcaggccacccatcgcttcagagaagatctcaaaaagacagttacaccccaaaatatcgggcctggctgctatcggaccctgaacctgttcagatacaaatctcgctgttatattcttaccatgtggacgctcctgctgatcatcgagagcattctctgggctgcctccgcggccgagatccccctggtgccgctttggaccgacaatgctcacggagtcggcagcgtgcctatgcatacagacctggaactcgatttttctctgccctccagctctaagtacacctataagcggcacctgacaaaccctgtgaatgaccagcagtccgttagccttcacattgagatcgaatctcaggggattggagccgatgtccatcacctcggccattggtacgacgctagactgaacctgaaaaccagcttccactgctacggggcctgtacgaagtatcaatacccctggcacacagccaaatgccattttgagaaggattatgaatacgagaactcctgggcttgtaatcctcccgactgcccgggagtgggcaccgggtgcacagcgtgtggcctctatctggatcagcttaaacctgtgggaaccgccttcaagatcatcagcgtccgctactctcggaaggtgtgcgttcagtttggcgaggaatatctgtgtaaaaccattgacatgaacgattgcttcgtgacaagacacgctaagatctgtattatcgggacggtctccaaatttagccagggagacaccctcctgttcctgggccccatggaagggggaggcattatctttaagcattggtgcacatccacctgtcacttcggggatcccggcgacgtgatgggacctaaagacaagccgtttatttgccccgagttccctggccaatttcgcaaaaagtgtaatttcgccacaacccccgtttgcgagtacgatgggaacatcatctctggatacaagaaagtgcttgccacgattgacagcttccagtcctttaatacatctaacatccatttcaccgatgaacggattgagtggagagaccctgatggcatgctccgcgaccacatcaatattgtcatcagcaaggatatcgactttgagaacctggctgaaaatccctgtaaagtggggctgcaggccgcgaacattgagggagcttggggctccggggttggcttcaccctcacatgccaagtgtctctgaccgaatgccctacatttcttacgagcatcaaggcctgtgatatggccatttgctatggagctgagtccgtcaccctgagccggggccagaatacagtgaaaatcaccgggaagggaggccactctgggtccagcttcaagtgttgccatggaaaagaatgttcttccacaggcctccaggccagcgcgccccacctggacaaggtgaacggcatttctgagctggagaatgaaaaagtctacgatgacggggctccggagtgcggagttacctgttggtttaagaaatccggcgaatgggtgatggggatcatcaacggaaattgggtggtccttattgtgctctgcctgctgctcctgttcagccttatcctgctctccattctgtgtcctatcagaaagcataagaaaagctga

SEQ ID NO: 13480 - RNA, 3402 nt, synthetic construct
  misc_feature 1..3402: note = derived and/or modified CDS sequence (opt5) from SEOV(B1)__AB457792.1__GP
  source 1..3402: mol_type = other RNA
atgtggagcctgctcctgatggccgctcttgtgggccaggggttcgccctgaagaacgtctttgacatgagaatccaatgcccccactccgttaatttcggagagacctctgtgagcggctacacagaactccctccgctgtcccttcaggaggcggaacagctggtgcccgagtctagctgtaacatggataatcatcagtccctctctacgattaacaaactgaccaaggtcatctggcagaaaaaggctaatcaggaaagcgccaaccaaaattcctttgaggtggttgagagcgaagtgtctttcaaagggctgtgcatgctcaagcaccggatggtcgaggaatcctatcgcaacagacggagcgtgatttgttacgacctggcctgcaattctacattttgtaagcctaccgtttatatgatcgtgcccattcatgcttgcaacatgatgaaatcctgtcttatcggactgggcccttaccgcatccaggtcgcctatgagagaacatactgcaccacagggattctcaccgagggaaagtgtttcgtgcccgataaagctgtggtcagcgccctgaagcggggcatgtatgcgatcgcctctattgaaacgatctgctttttcattcaccaaaaaggcaatacctacaagatcgttacagctattacctccgccatggggagcaagtgtaacaatacagacaccaaagtgcagggatactatatctgcatcattggcgggaactccgctcctgtgtacgccccggcgggagaggattttcgcgccatggaagtcttctctggcatcattacgagcccccatggggaggaccacgatcttcctggagaagagatcgctacatatcagatttccggccagatcgaggccaagatcccccacaccgtgagctctaaaaatctgagactcacagcttttgccggcattccttcctacagctctaccagcatcctggccgcttccaaggacgggcggttcattttctctcccggactgttcccgaacctcaaccaaagcgtttgcgataataacgcgctgcctcttatctggcgcggcctgattgacctcaccgggtattacgaagccgtgcatccctgtaatgtcttctgcgtgctgtccggacctggcgctagctgtgaggccttttctgaagggggaatcttcaacatcacatcccccatgtgccttgttagcaaacagaatagatttcgggccgctgagcagcaaatttctttcgtgtgtcagcgcgtcgatatggacatcattgtgtattgcaacggccagaagaaaacgatcctgaccaagacactcgtcattggccagtgtatctacaccattacatccctgtttagcctgctccccggggtggcccactccatcgcgatcgaactgtgcgttcctggattccatggctgggctaccgccgcccttctgattacgttttgtttcgggtggatcctcattccggcttgcacactggccatccttctggtgctcaagtttttcgctaatattctgcacacctctaaccaagagaatagatttaaagccatcctgcggaagatcaaagaggaatttgagaagaccaaaggaagcatggtctgtgaaatttgcaagtacgagtgcgaaacactcaaggagctgaaagcgcacaacctttcctgtgtgcagggcgagtgcccctattgttttacccattgcgaacctacagagacggccatccaggctcactacaagatttgtcaggccacccatcgcttcagagaagatctgaaaaagacagttacaccccaaaatatcgggcctggctgctatcggaccctcaacctgttcagatacaaatctcgctgttatattctgaccatgtggacgcttctcctgatcatcgagagcattctgtgggctgcctccgcggccgagatccccctcgtgccgctgtggaccgacaatgctcacggagtcggcagcgtgcctatgcatacagaccttgaactggatttttctctcccctccagctctaagtacacctataagcggcacctgacaaaccctgtgaatgaccagcagtccgttagcctgcacattgagatcgaatctcaggggattggagccgatgtccatcaccttggccattggtacgacgctagactcaacctgaaaaccagcttccactgctacggggcctgtacgaagtatcaatacccctggcacacagccaaatgccattttgagaaggattatgaatacgagaactcctgggcttgtaatcctcccgactgcccgggagtgggcaccgggtgcacagcgtgtggcctgtatctcgatcagctgaaacctgtgggaaccgccttcaagatcatcagcgtccgctactctcggaaggtgtgcgttcagtttggcgaggaatatctttgtaaaaccattgacatgaacgattgcttcgtgacaagacacgctaagatctgtattatcgggacggtctccaaatttagccagggagacaccctcctgttcctgggccccatggaagggggaggcattatctttaagcattggtgcacatccacctgtcacttcggggatcccggcgacgtgatgggacctaaagacaagccgtttatttgccccgagttccctggccaatttcgcaaaaagtgtaatttcgccacaacccccgtttgcgagtacgatgggaacatcatctctggatacaagaaagtgctggccacgattgacagcttccagtcctttaatacatctaacatccatttcaccgatgaacggattgagtggagagaccctgatggcatgcttcgcgaccacatcaatattgtcatcagcaaggatatcgactttgagaacctcgctgaaaatccctgtaaagtggggctgcaggccgcgaacattgagggagcttggggctccggggttggcttcaccctgacatgccaagtgtctctcaccgaatgccctacatttctgacgagcatcaaggcctgtgatatggccatttgctatggagctgagtccgtcacccttagccggggccagaatacagtgaaaatcaccgggaagggaggccactctgggtccagcttcaagtgttgccatggaaaagaatgttcttccacaggcctgcaggccagcgcgccccacctcgacaaggtgaacggcatttctgagctggagaatgaaaaagtctacgatgacggggctccggagtgcggagttacctgttggtttaagaaatccggcgaatgggtgatggggatcatcaacggaaattgggtggtcctgattgtgctttgcctcctgctcctgttcagcctgatccttctgtccattctctgtcctatcagaaagcataagaaaagctga

SEQ ID NO: 13481 - RNA, 3402 nt, synthetic construct
  misc_feature 1..3402: note = derived and/or modified CDS sequence (opt5) from SEOV(B1)__AB457793.1__GP
  source 1..3402: mol_type = other RNA
atgtggagcctgctcctgcttgccgctctggtgggccaggggttcgccctcaagaacgtctttgacatgagaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaaactgaccaaggtcatctggcagaaaaaggctaatcaggaaagcgccaaccaaaattcctttgaggtggttgagagcgaagtgtctttcaaagggctctgcatgctgaagcaccggatggtcgaggaatcctatcgcaacagacggagcgtgatttgttacgaccttgcctgcaattctacattttgtaagcctaccgtttatatgatcgtgcccattcatgcttgcaacatgatgaaatcctgtctgatcggactcggcccttaccgcatccaggtcgcctatgagagaacatactgcaccacagggattctgaccgagggaaagtgtttcgtgcccgataaagctgtggtcagcgcccttaagcggggcatgtatgcgatcgcctctattgaaacgatctgctttttcattcaccaaaaaggcaatacctacaagatcgttacagctattacctccgccatggggagcaagtgtaacaatacagacaccaaagtgcagggatactatatctgcatcattggcgggaactccgctcctgtgtacgccccggcgggagaggattttcgcgccatggaagtcttctctggcatcattacgagcccccatggggaggaccacgatctgcctggagaagagatcgctacatatcagatttccggccagatcgaggccaagatcccccacaccgtgagctctaaaaatctcagactgacagcttttgccggcattccttcctacagctctaccagcatcctggccgcttccaaggacgggcatttcatcttttctcccggactcttcccgaacctgaaccaaagcgtttgcgataataacgcgcttcctctgatttggcggggcctcattgacctgaccgggtattacgaagccgtgcacccctgtaatgtcttctgcgtgctttccggacctggcgctagctgtgaggccttttctgaagggggaatcttcaacatcacatcccccatgtgcctggttagcaaacagaatcgctttagagccgctgagcagcaaatttctttcgtgtgtcagcgggtcgatatggacatcattgtgtattgcaacggccagaagaaaacgatcctcaccaagacactggtcattggccagtgtatctacaccattacatccctgtttagcctcctgcccggggtggcccattccatcgcgatcgaactttgcgttcctggattccacggctgggctaccgccgccctgctcattacgttttgtttcgggtggatcctgattccggcttgcacacttgccatcctgctcgtgctgaagtttttcgctaatattctgcacacctctaaccaagagaatcgctttaaagccatcctcagaaagatcaaagaggagttcgagaagaccaaaggaagcatggtctgtgaaatttgcaagtacgagtgcgaaacactgaaggagcttaaagcgcataacctgtcctgtgtgcagggcgagtgcccctattgttttacccactgcgaacctacagagacggccatccaggctcattacaagatttgtcaggccacccaccggttccgcgaagatctcaaaaagacagttacaccccaaaatatcgggcctggctgctatagaaccctgaacctgttccggtacaaatctagatgttatattcttaccatgtggacgctcctgctgatcatcgagagcattctctgggctgcctccgcggccgagatccccctggtgccgctttggaccgacaatgctcatggagtcggcagcgtgcctatgcacacagacctggaactcgatttttctctgccctccagctctaagtacacctataagcgccacctgacaaaccctgtgaatgaccagcagtccgttagccttcatattgagatcgaatctcaggggattggagccgatgtccaccatctcggccactggtacgacgctcggctgaacctgaaaaccagcttccactgctacggggcctgtacgaagtatcaatacccctggcatacagccaaatgccactttgagaaggattatgaatacgagaactcctgggcttgtaatcctcccgactgcccgggagtgggcaccgggtgcacagcgtgtggcctctatctggatcagcttaaacctgtgggaaccgccttcaagatcatcagcgtcagatactctcgcaaggtgtgcgttcagtttggcgaggaatatctgtgtaaaaccattgacatgaacgattgcttcgtgacacggcatgctaagatctgtattatcgggacggtctccaaatttagccagggagacaccctcctgttcctgggccccatggaagggggaggcattatctttaagcactggtgcacatccacctgtcatttcggggatcccggcgacgtgatgggacctaaagacaagccgtttatttgccccgagttccctggccaatttcgcaaaaagtgtaatttcgccacaacccccgtttgcgaatacgatgggaacatcatctctggatacaagaaagtgcttgccacgattgacagcttccagtcctttaatacatctaacatccacttcaccgatgaaagaattgagtggcgggaccctgatggcatgctcagagaccacatcaatattgtcatcagcaaggatatcgactttgagaacctggctgaaaatccctgtaaagtggggctgcaggccgcgaacattgagggagcttggggctccggggttggcttcaccctcacatgccaagtgtctctgaccgaatgccctacatttcttacgagcatcaaggcctgtgatatggccatttgctatggagctgagtccgtcaccctgagccgcggccagaatacagtgaaaatcaccgggaagggaggccattctgggtccagcttcaagtgttgccacggaaaagaatgttcttccacaggcctccaggccagcgcgccccatctggacaaggtgaacggcatttctgagctggagaatgaaaaagtctacgatgacggggctccggagtgcggagttacctgttggtttaagaaatccggcgaatgggtgatggggatcatcaacggaaattgggtggtccttattgtgctctgcctgctgctcctgttcagccttatcctgctctccattctgtgtcctatccggaagcacaagaaaagctga

SEQ ID NO: 13482 - RNA, 3402 nt, synthetic construct
  misc_feature 1..3402: note = derived and/or modified CDS sequence (opt5) from SEOV(B1)__AB457794.1__GP
  source 1..3402: mol_type = other RNA
atgtggagcctgctcctgatggccgctcttgtgggccaggggttcgccctgaagaacgtctttgacatgagaatccaatgcccccactccgttaatttcggagagacctctgtgagcggctacacagaactccctccgctgtcccttcaggaggcggaacagctggtgcccgagtctagctgtaacatggataatcatcagtccctctctacgattaacaaactgaccaaggtcatctggcagaaaaaggctaatcaggaaagcgccaaccaaaattcctttgaggtggttgagagcgaagtgtctttcaaagggctgtgcatgctcaagcaccggatggtcgaggaatcctatcgcaacagacggagcgtgatttgttacgacctggcctgcaattctacattttgtaagcctaccgtttatatgatcgtgcccattcatgcttgcaacatgatgaaatcctgtcttatcggactgggcccttaccgcatccaggtcgcctatgagagaacatactgcaccacagggattctcaccgagggaaagtgtttcgtgcccgataaagctgtggtcagcgccctgaagcggggcatgtatgcgatcgcctctattgaaacgatctgctttttcattcaccaaaaaggcaatacctacaagatcgttacagctattacctccgccatggggagcaagtgtaacaatacagacaccaaagtgcagggatactatatctgcatcattggcgggaactccgctcctgtgtacgccccggcgggagaggattttcgcgccatggaagtcttctctggcatcattacgagcccccatggggaggaccacgatcttcctggagaagagatcgctacatatcagatttccggccagatcgaggccaagatcccccacaccgtgagctctaaaaatctgagactcacagcttttgccggcattccttcctacagctctaccagcatcctggccgcttccaaggacgggcatttcatcttttctcccggactgttcccgaacctcaaccaaagcgtttgcgataataacgcgctgcctcttatttggcggggcctgattgacctcaccgggtattacgaagccgtgcacccctgtaatgtcttctgcgtgctgtccggacctggcgctagctgtgaggccttttctgaagggggaatcttcaacatcacatcccccatgtgccttgttagcaaacagaatcgctttagagccgctgagcagcaaatttctttcgtgtgtcagcgggtcgatatggacatcattgtgtattgcaacggccagaagaaaacgatcctgaccaagacactcgtcattggccagtgtatctacaccattacatccctgtttagcctgctccccggggtggcccattccatcgcgatcgaactgtgcgttcctggattccacggctgggctaccgccgcccttctgattacgttttgtttcgggtggatcctcattccggcttgcacactggccatccttctggtgctcaagtttttcgctaatattctgcacacctctaaccaagagaatcgctttaaagccatcctgagaaagatcaaagaggagttcgagaagaccaaaggaagcatggtctgtgaaatttgcaagtacgagtgcgaaacactcaaggagctgaaagcgcataacctttcctgtgtgcagggcgagtgcccctattgttttacccactgcgaacctacagagacggccatccaggctcattacaagatttgtcaggccacccaccggttccgcgaagatctgaaaaagacagttacaccccaaaatatcgggcctggctgctatagaaccctcaacctgttccggtacaaatctagatgttatattctgaccatgtggacgcttctcctgatcatcgagagcattctgtgggctgcctccgcggccgagatccccctcgtgccgctgtggaccgacaatgctcatggagtcggcagcgtgcctatgcacacagaccttgaactggatttttctctcccctccagctctaagtacacctataagcgccacctgacaaaccctgtgaatgaccagcagtccgttagcctgcatattgagatcgaatctcaggggattggagccgatgtccaccatcttggccactggtacgacgctcggctcaacctgaaaaccagcttccactgctacggggcctgtacgaagtatcaatacccctggcatacagccaaatgccactttgagaaggattatgaatacgagaactcctgggcttgtaatcctcccgactgcccgggagtgggcaccgggtgcacagcgtgtggcctgtatctcgatcagctgaaacctgtgggaaccgccttcaagatcatcagcgtcagatactctcgcaaggtgtgcgttcagtttggcgaggaatatctttgtaaaaccattgacatgaacgattgcttcgtgacacggcatgctaagatctgtattatcgggacggtctccaaatttagccagggagacaccctcctgttcctgggccccatggaagggggaggcattatctttaagcactggtgcacatccacctgtcatttcggggatcccggcgacgtgatgggacctaaagacaagccgtttatttgccccgagttccctggccaatttcgcaaaaagtgtaatttcgccacaacccccgtttgcgaatacgatgggaacatcatctctggatacaagaaagtgctggccacgattgacagcttccagtcctttaatacatctaacatccacttcaccgatgaaagaattgagtggcgggaccctgatggcatgcttagagaccacatcaatattgtcatcagcaaggatatcgactttgagaacctcgctgaaaatccctgtaaagtggggctgcaggccgcgaacattgagggagcttggggctccggggttggcttcaccctgacatgccaagtgtctctcaccgaatgccctacatttctgacgagcatcaaggcctgtgatatggccatttgctatggagctgagtccgtcacccttagccgcggccagaatacagtgaaaatcaccgggaagggaggccattctgggtccagcttcaagtgttgccacggaaaagaatgttcttccacaggcctgcaggccagcgcgccccatctcgacaaggtgaacggcatttctgagctggagaatgaaaaagtctacgatgacggggctccggagtgcggagttacctgttggtttaagaaatccggcgaatgggtgatggggatcatcaacggaaattgggtggtcctgattgtgctttgcctcctgctcctgttcagcctgatccttctgtccattctctgtcctatccggaagcacaagaaaagctga

SEQ ID NO: 13483 - RNA, 3402 nt, synthetic construct
  misc_feature 1..3402: note = derived and/or modified CDS sequence (opt5) from SEOV(B-1)__X53861.1__GP
  source 1..3402: mol_type = other RNA
atgtggagcctgctcctgcttgccgctctggtgggccaggggttcgccctcaagaacgtctttgacatgagaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaaactgaccaaggtcatctggcggaaaaaggctaatcaagaaagcgccaaccaaaattcctttgaggtggttgagagcgaagtgtctttcaaagggctctgcatgctgaagcaccgcatggtcgaggaatcctatagaaaccggcgcagcgtgatttactatgaccttgccggaaattctacattttgtaagcctaccgtttacatgatcgtgcccattcatgcttgcaacatgatgaaatcctgtctgatcggcctcgggccttatagaatccaggtcgtgtacgagcggacatattgcaccacagggattctgaccgagggcaagtgtttcgtgcccgataaagccgtcgttagcgctcttaagcgcggcatgtacgccatcgcgtctattgaaacgatctgctttttcattcaccagaaatggaataagtacaagatcgtgaccgccattacatccgctatggggagcaaatgtaacaataccgacacaaaggtgcagggatattacatctgcatcattggcgggaactccgcccctgtctatgctccggccggagaggattttagagcgatggaagtgttctctggcatcattaccagcccccatggggaggaccacgatctgcctggagaagagatcgccacgtaccacatttccggccagatcgaggctaaaatcccccatacagttagctctaagaatctccggctggccgcttttgccggcattccttcctatagctctaccagcatcctggccgcttccgaagacgggcgcttcatttttagccccggactcttcccgaacctgaaccagagcgtgtgtgataataacgcgcttcctctgatctggagaggcctcattgacctgacagggtactatgaggccgtccacccctgcaatgtgttctgcgttctttccggacctggcgctagctgtgaagccttttctgaagggggaatcttcaacatcacctcccccatgtgcctggtgagcaaacagaatcggtttcgcgccgctgaacaacagatttctttcgtctgtcagagagtggatatggacatcattgtctactgcaacggccaaaagaaaaccatcctcacaaagacgctggtgattggccagtgtatctacaccattacatccctgtttagcctcctgcccggggttgcccattccatcgcgatcgagctttgcgtgcctggattccacggctgggctaccgccgccctgctcattacattttgtttcgggtgggtcctgatcccggcttgcacccttgccattctgctcgtgctgaagtttttcgctaatatcctgcacacgtctaaccaggagaatcggtttaaagccattctccgcaagatcaaagaagagttcgaaaagagaaaaggaagcatggtttgtgagatctgcaagtatgaatgtgagacactgaaggagcttaaagcgcataacctgtcctgcgtgcagggcgaatgcccctactgttttacccactgcgagcctaccgaaacagccattcaagctcattataaggtctgtcaggccacccaccggttcagagaggatctcaaaaagacagtgacgccccagaatatcgggcctggctgctaccgcaccctgaacctgttccggtataaatctagatgttacattcttacaatgtggaccctcctgctgatcattgagagcatcctctgggctgcctccgcggccgaaatccccctggtgccgctttggacagacaatgctcatggagttggcagcgtccctatgcacaccgacctggagctcgatttttctctgccctccagctctaagtatacgtacaagcgccacctgaccaaccctgtgaatgaccagcaatccgtgagccttcatattgaaatcgagtctcaggggattggagccgatgtccaccatctcggccactggtacgacgctcggctgaacctgaaaacatctttccactgctatggggcctgtaccaagtaccagtatccctggcatacagccaaatgccactttgaaaaggattacgagtatgagaactcctgggcttgtaatcctcccgactgcccgggagtgggcaccgggtgtacggcgtgcggcctctacctggatcagcttaaacctgttggaacagccttcaagatcattagcgtgagatattctcgcaaggtctgcgtgcaatttggcgaggagcatctgtgtaaaaccatcgacatgaacgattgcttcgttacacggcacgctaagatctgtattatcgggaccgtgtccaaatttagccagggagacaccctcctgttcctgggccccatggaagggggaggcattatctttaagcattggtgcacatccacgtgtcacttcggggatcccagagacgtcatgggccctaaagacaagccgtttatttgccccgagttccctggacagtttcgcaaaaagtgtaatttcgccaccacacccgtgtgcgaatacgatggcaacatcatttctgggtacaagaaagttcttgccaccatcgacagcttccagtcctttaatacatctaacatccacttcaccgatgagcggattgagtggagagaccctgatggaatgctccgcgaccatatcaatattgtgatcagcaaggatattgactttgaaaacctggctgagaatccctgtaaagtcggcctgcaagccgcgaacatcgaaggggcttggggatccggcgtggggttcacgctcacatgccaggtgtctctgaccgagtgtcctacctttcttacaagcatcaaggcctgcgatatggccatttgctatggcgctgaatccgtcaccctgagccggggacagaatacagttaaaatcacgggcaagggaggacactctggctccagcttcaagtgttgccatgggaaagagtgttcttccaccggactccaagccagcgcgccccacctggacaaggtgaacggcatttctgagctggaaaatgagaaagtgtacgatgacggcgctccggaatgcggggtcacatgttggtttaagaaatccggagagtgggtgatgggcatcattaacgggaattgggttgtgcttatcgtcctctgcgtgctgctcctgttcagcctgatccttctgtccattctctgtcctgttagaaagcataagaaaagctga

SEQ ID NO: 13484 - RNA, 3402 nt, synthetic construct
  misc_feature 1..3402: note = derived and/or modified CDS sequence (opt5) from SEOV(BjHD01)__DQ133505.1__GP
  source 1..3402: mol_type = other RNA
atgtggagcctcctgttcctggccgctcttgtgggccaggggtttgccctgaagaacgtcttcgacatgagaatccaatgcccccactccgttaattttggagagacctctgtgagcggctacacagaactccctccgctgtcccttcaggaggcggaacagctggtgcccgagtctagctgtaacatggataatcatcagtccctctctacgattaacaagctgaccaaggtcatctggcggaaaaaggctaatcaagaaagcgccaaccaaaattccttcgaggtggttgagagcgaagtgtcttttaaagggctgtgcatgctcaagcaccgcatggtcgaggaatcctatagaaaccggcgcagcgtgatttgttacgacctggcctgcaattctacattctgtaagcctaccgtttatatgatcgtgcccattcatgcttgcaacatgatgaaatcctgtcttatcggactgggcccttacagaatccaggtcgtgtatgagcggacatactgcaccacagggattctcaccgagggaaagtgttttgtgcccgataaagccgtcgttagcgctctgaagcgcggcatgtatgccatcgcgtctattgaaacgatctgcttctttattcaccagaaaggcaatacctacaagatcgtgacagccattacctccgctatggggagcaagtgtaacaatacagacaccaaagtgcagggatactatatctgcatcattggcgggaactccgcccctgtctacgctccggccggagaggatttcagagcgatggaagtgttttctggcatcattacgagcccccatggggaggaccacgatcttcctggagaagaggttgccacatatcagatctccggccagattgaggctaagatcccccacaccgtgagctctaaaaatctgaagctcacagccttcgctggcatcccttcctacagctctaccagcattctggccgcctccgaagacgggcggtttatcttctctcccggactgttcccgaacctcaaccagagcgtctgcgataataacgctctgcctcttatttggcgcggcctgatcgacctcaccgggtattacgaggcggtgcatccctgtaatgtgttttgcgttctgtccggacctggcgccagctgtgaggctttctctgaagggggaatttttaacatcacatcccccatgtgccttgtcagcaaacaaaatagattccgggccgccgaacagcagatctcttttgtgtgtcaacgcgtcgatatggacattatcgtgtattgcaacggccagaagaaaacgattctgaccaagacactcgttatcggccagtgtatttacaccatcacatccctgttcagcctgctccccggggtggctcactccattgccatcgagctgtgcgtccctggatttcatggctgggcgaccgctgcccttctgatcacgttctgttttgggtgggtgctcattccggcctgcacactggctatccttctggttctcaagttctttgccaatattctgcacacctctaaccaggagaatagattcaaagctatcctgcggaagattaaagaagagtttgaaaagaccaaaggaagcatggtgtgtgagatctgcaagtacgaatgcgagacactcaaggagctgaaagcccacaacctttcctgtgtccaaggcgaatgcccctattgtttcacccattgcgagcctacagaaacggcgatccaggcccactacaaggtgtgtcaggctacccatcgcttcagagaggatctgaaaaagacagtgacaccccagaatattgggcctggctgctatcggaccctcaacctgtttagatacaaatctcgctgttatatcctgaccatgtggacgcttctcctgattatcgagagcattctgtgggccgcttccgccgcggaaatccccctcgttccgctgtggaccgacaatgcccacggagtcggcagcgtgcctatgcatacagaccttgagctggatttctctctcccctccagctctaagtacacctataagcggcacctgacaaaccctgtgaatgaccaacagtccgtcagcctgcacatcgaaattgagtctcaggggatcggagctgatgtgcatcaccttggccattggtacgacgccagactcaacctgaaaaccagctttcactgctacggggcttgtacgaagtatcagtacccctggcacacagccaaatgccatttcgaaaaggattatgagtacgagaactcctgggcctgtaatcctcccgactgcccgggagttggcaccgggtgcacagcttgtggcctgtatctcgatcaactgaaacctgtgggaaccgcgtttaagattatcagcgtccgctactctcggaaggtgtgcgttcagttcggcgaagagtatctttgtaaaaccattgacatgaacgattgctttgtgacaagacacgccaagatctgtatcattgggacggtctccaaattcagccagggagacaccctgctctttctgggccccatggaagggggaggcatcattttcaagcattggtgcacatccacctgtcactttggggatcccggcgacgtgatgggacctaaagacaagccgttcatctgccccgagtttcctggccagttccgcaaaaagtgtaatttcgctacaacccccgtttgcgaatacgatgggaacattatctctggatacaagaaagtgctggccacgattgacagctttcaatccttcaatacatctaacatccattttaccgatgagcggatcgagtggagagaccctgatggcatgcttcgcgaccacattaatatcgtcattagcaaggatatcgacttcgaaaacctcgccgagaatccctgtaaagtggggctgcaggctgccaacattgaaggagcgtggggctccggggtgggctttaccctgacatgccaggtctctctcaccgagtgccctacattcctgacgagcatcaaggcttgtgatatggccatctgctatggagccgaatccgttacccttagccggggccaaaatacagtgaaaattaccgggaagggaggccactctgggtccagctttaagtgttgccatggagaggagtgttcttccacaggcctgcaggctagcgcgccccacctcgacaaagtgaacggcatctctgaactggagaatgaaaaggtctacgatgacggggccccggagtgcggagtgacctgttggttcaaaaagtccggcgagtgggttatggggattatcaacggaaattgggtggtcctgattgtgctttgcgttctcctgctgtttagcctcatcctgctttccatcctgtgtcctgtgagaaaacataaaaagagctga

SEQ ID NO: 13485 - RNA, 3402 nt, synthetic construct
  misc_feature 1..3402: note = derived and/or modified CDS sequence (opt5) from SEOV(Cherwell)__KM948593.1__GP
  source 1..3402: mol_type = other RNA
atgtggagcctgctcctgcttgccgctctggtgggccaagggtccgccctcaagaacgtcttcgacatgagaatccaatgcccccactctgttaattttggagagaccagcgtgtccggctacacagaactgcctccgctttctctgcaggaggcggaacagctcgtgcccgagagctcctgtaacatggataatcatcagtctctgagcacgattaacaaactgaccaaggtcatctggcggaaaaaggctaatcaagaatccgccaaccagaatagcttcgaggtggttgagtctgaagtgtcctttaaagggctctgcatgctgaagcaccgcatggtcgaggaaagctatagaaaccggcgctctgtgatttgttacgaccttgcctgcaattccacattctgtaagcctaccgtttatatgatcgtgcccattcatgcttgcaacatgatgaaaagctgtctgatcggactcggcccttacagaatccaggtcgtgtatgagcggacatactgcaccacagggattctgaccgagggaaagtgttttgtgcccgataaagccgtcgtttctgctcttaagcgcggcatgtatgccatcgcgtccattgaaacgatctgcttctttattcaccagaaaggcaatacctacaagatcgtgacagccattaccagcgctatggggtccaagtgtaacaatacagacaccaaagtgcaaggatactatatctgcatcattggcgggaactctgcccctgtctacgctccggccggagaggatttcagagcgatggaagtgtttagcggcatcattacgagcccccatggggaggaccacgatctgcctggagaagagatcgccacatatcagattagcggccagatcgaggctaagatcccccacaccgtttcttccaaaaatctcaagctgacagccttcgctggcattcctagctactctagcacctccatcctggccgcctctgaagacgggcggtttattttcagccccggactctttccgaacctgaaccagtccgtgtgcgataataacgcgcttcctctgatctggcgcggcctcattgacctgaccgggtattacgaggctgtccatccctgtaatgtgttctgcgttcttagcggacctggcgcctcttgtgaggctttctccgaagggggaatctttaacatcacaagccccatgtgcctggtgtctaaacaaaatagattccgggccgccgaacagcagatttcctttgtctgtcaacgcgtggatatggacatcattgtctattgcaacggccagaagaaaacgatcctcaccaagacactggtgattggccagtgtatctacaccattacaagcctgttctccctcctgcccggggttgctcactctatcgccatcgagctttgcgtgcctggatttcatggctgggcgaccgctgccctgctcattacgttctgttttgggtgggtcctgatcccggcctgcacacttgctattctgctcgtgctgaagttctttgccaatatcctgcacaccagcaaccaggagaatagattcaaagctattctccggaagatcaaagaagagtttgaaaagaccaaaggatccatggtttgtgagatctgcaagtacgaatgcgagacactgaaggagcttaaagcccacaacctgtcttgtgtgcaaggcgaatgcccctattgtttcacccattgcgagcctacagaaacggcgattcaggcccactacaaggtctgtcaggctacccatcgctttagagaggatctcaaaaagacagtgacaccccctaatatcgggcccggctgctatcggaccctgaacctgttcagatacaaaagccgctgttatattcttaccatgtggacgctcctgctgatcattgagtccatcctctgggccgctagcgccgcggaaatcccgctggtgcctctttggaccgacaatgcccacggagttggctctgtccccatgcatacagacctggagctcgatttctccctgccttcctcttccaagtacacctataagcggcacctgacaaaccccgtgaatgaccagcaaagcgtgtctcttcacattgaaatcgagagccaggggattggagctgatgtccatcacctcggccattggtacgacgccagactgaacctgaaaacctcctttcactgctacggggcttgtacgaagtatcagtacccttggcacacagccaaatgccatttcgaaaaggattatgagtacgagaacagctgggcctgtaatcccccggactgccctggagtgggcaccgggtgcacagcttgtggcgtttatctcgatcagctgaaacccgtgggaaccgcgtttaagatcgtctctgtgcgctactcccggaaggtttgcgtgcaattcggcgaagagtatctttgtaaaaccattgacatgaacgattgctttgtcacaagacacgccaagatctgtatcattgggacggtgagcaaattctcccagggagacaccctgctctttctgggccccatggaagggggaggcatcattttcaagcattggtgcacatctacctgtcactttggggatcctggcgacgttatgggaccgaaagacaagcccttcatctgccctgagtttcccggccagttccgcaaaaagtgtaattttgctacaacccctgtgtgcgaatacgatgggaacattatcagcggatacaagaaagtcctggccacgattgactccttccagtctttcaatacaagcaacatccattttaccgatgagcggatcgagtggagagaccccgatggcatgcttcgcgaccacattaatatcgtgatttccaaggatatcgacttcgaaaacctcgccgagaatccttgtaaagtggggctgcaagctgccaacattgaaggagcgtggggctctggggtcggctttaccctgacatgccaggttagcctcaccgagtgccccacattcctgacgtccatcaaggcttgtgatatggccatctgctatggagccgaaagcgtgaccctttctcggggccagaatacagtgaaaattaccgggaagggaggccactccgggagctcttttaagtgttgccatggaaaagagtgttccagcacaggcctgcaggcttctgccccgcacctcgacaaggtcaacggcatctccgagctggaaaatgagaaagtgtacgatgacggggcgcctgaatgcggagttacctgttggttcaagaaaagctccgagtgggtgatgggcattatcaacgggaattgggtcgtgctgattgttctttgcgtgctcctgctgtttagcctcatcctgctttctatcctgtgtcccgtcagaaagcataagaaaagctga

SEQ ID NO: 13486 - RNA, 3402 nt, synthetic construct
  misc_feature 1..3402: note = derived and/or modified CDS sequence (opt5) from SEOV(HaixingRn40)__GU592924.1__GP
  source 1..3402: mol_type = other RNA
atgtggagcctcctgttcctggccgctcttgtgggccaggggtttgccctgaagaacgtcttcgacatgagaatccaatgcccccactccgttaattttggagagacctctgtgagcggctacacagaactccctccgctgtcccttcaggaggcggaacagctggtgcccgagtctagctgtaacatggataatcatcagtccctctctacgattaacaaactgaccaaggtcatctggcggaaaaaggctaatcaagaaagcgccaaccaaaattccttcgaggtggttgagagcgaagtgtcttttaaagggctgtgcatgctcaagcaccgcatggtcgaggaatcctatagaaaccggcgcagcgtgatttgttacgacctggcctgcaattctacattctgtaagcctaccgtttatatgatcgtgcccattcatgcttgcaacatgatgaaatcctgtcttatcggactgggcccttacagaatccaggtcgtgtatgagcggacatactgcaccacagggattctcaccgagggaaagtgttttgtgcccgataaagccgtcgttagcgctctgaagcgcggcatgtatgccatcgcgtctattgaaacgatctgcttctttattcaccagaaaggcaatacctacaagatcgtgacagccattacctccgctatggggagcaagtgtaacaatacagacaccaaagtgcagggatactatatctgcatcattggcgggaactccgcccctgtctacgctccggccggagaggatttcagagcgatggaagtgttttctggcatcattacgagcccccatggggaggaccacgatcttcctggagaagagatcgccacatatcagatttccggccagatcgaggctaagatcccccacaccgttagctctaaaaatctgaagctcacagccttcgctggcattccttcctacagctctaccagcatcctggccgcctccgaagacgggcggtttattttctctcccggactgttcccgaacctcaaccagagcgtgtgcgataataacgctctgcctcttatctggcgcggcctgattgacctcaccgggtattacgaggcggtccatccctgtaatgtgttttgcgttctgtccggacctggcgccagctgtgaggctttctctgaagggggaatctttaacatcacatcccccatgtgccttgtgagcaaacaaaatagattccgggccgccgaacagcagatttcttttgtctgtcaacgcgtggatatggacatcattgtctattgcaacggccagaagaaaacgatcctgaccagaacactcgtgattggccagtgtatctacaccattacatccctgttcagcctgctccccggggttgctcactccatcgccatcgagctgtgcgtgcctggatttcatggctgggcgaccgctgcccttctgattacgttctgttttgggtgggtcctcatcccggcctgcacactggctattcttctggtgctcaagttctttgccaatatcctgcacacctctaaccaggagaatcggttcaaggctattctgcgcaaaatcaaggaagagtttgaaaagaccaagggaagcatggtttgtgagatctgcaaatacgaatgcgagacactcaaggagctgaaggcccacaacctttcctgtgtgcaaggcgaatgcccctattgtttcacccattgcgagcctacagaaacggcgattcaggcccactacaaagtctgtcaggctacccatagattccgggaggatctgaagaaaacagtgacaccccagaatatcgggcctggctgctatagaaccctcaacctgtttcgctacaagtctcggtgttatattctgaccatgtggacgcttctcctgatcattgagagcatcctgtgggccgcttccgccgcggaaatccccctcgtgccgctgtggaccgacaatgcccacggagttggcagcgtccctatgcatacagaccttgagctggatttctctctcccctccagctctaaatacacctataagagacacctgacaaaccctgtgaatgaccaacagtccgtgagcctgcacattgaaatcgagtctcaggggattggagctgatgtccatcaccttggccattggtacgacgcccgcctcaacctgaagaccagctttcactgctacggggcttgtacgaaatatcagtacccctggcacacagccaagtgccatttcgaaaaagattatgagtacgagaactcctgggcctgtaatcctcccgactgcccgggagtgggcaccgggtgcacagcttgtggcctgtatctcgatcaactgaagcctgttggaaccgcgtttaaaatcattagcgtgcggtactctagaaaggtctgcgtgcagttcggcgaagagtatctttgtaagaccatcgacatgaacgattgctttgttacacgccacgccaaaatctgtattatcgggacggtgtccaagttcagccagggagacaccctgctctttctgggccccatggaagggggaggcattatcttcaaacattggtgcacatccacctgtcactttggggatcccggcgacgtcatgggacctaaggacaaaccgttcatttgccccgagtttcctggccagttccggaagaaatgtaatttcgctacaacccccgtgtgcgaatacgatgggaacatcatttctggatacaagaaggttctggccacgatcgacagctttcaatccttcaatacatctaacatccattttaccgatgagagaattgagtggcgcgaccctgatggcatgcttcgggaccacatcaatattgtgatcagcaaagatattgacttcgaaaacctcgggcagaatccctgtaaggtcggactgcaggccgctaacatcgagggcgcctgggggtccggcgtgggatttaccctgacatgccaagtgtctctcaccgaatgccctacattcctgacgagcatcaaagcgtgtgatatggctatttgctatggcgccgagtccgtcacccttagcagagggcagaatacagttaagatcaccggaaaaggcgggcactctggatccagctttaagtgttgccatggcaaggaatgttcttccacaggcctgcaggccagcgctccccacctcgacaaagtgaacgggatttctgatctggagaatgagaaggtgtacgacgatggagccccggaatgcggcgtcacctgttggttcaaaaagtccggggagtgggtgatgggaatcattaacggcaattgggttgtgctgatcgtcctttgcgtgctcctgctgtttagcctcatcctgctttccattctgtgtcctgttcgcaaacataaaaagagctga

SEQ ID NO: 13487 - RNA, 3402 nt, synthetic construct
  misc_feature 1..3402: note = derived and/or modified CDS sequence (opt5) from SEOV(HBQ17)__KM233655.1__GP
  source 1..3402: mol_type = other RNA
atgtggagcctgctctttgtggccgctctgatcggccaggggtttgcccttgagaacgcgttcgacatgcggattagatgcccccactccgtccattttggagaaacctctgttagcggctacacagagctgcctccgctctccctgcaagaagctgagcagcttgtgcccgaatctagctgtaatatggataaccaccagtccctgtctacgatcaataagctcaccaaagtgatttggcgcaagaaagccaaccaggagagcgccaatcaaaactccttcgaggtcgtggaaagcgctctgaagatcaaagggctgtgcatgctcaagcatagaatggttgaggaatcttatcggaatcgcagatccgtgatttgttacgacctggcctgcaacagcacattttgtaagcctaccgtctatatgatcgtgcccatccacgcttgcaatatgatgaaatcttgtcttattggactgggcccttaccggatccaggttgtgtatgagcgcacatactgcaccacagggattctcaccgagggaaagtgtttcgtccccgataaagccgtggtgtccgcgctgaagagaggcatgtatgccatcgctagcattgaaacgatctgctttttcattcatcagaaaggcaacacctacaagatcgtcacagccatcacctctgctatggggtccaagtgtaataacacagacaccaaagttcagggatactatatttgcatcattggcgggaatagcgcccctgtgtacgcgccggccggagaggattttcgggctatggaagtgttctccggcatcattacgtctccccacggggaggaccacgatcttcctggagaagagatcgccacatatcaaatcagcggccagattgaggctaagatcccccataccgtctccagcaaaaacctgaagctcacagcctttgccggcattccttcttactccagcacctctatcctggctgcgagcgaagacgggcgcttcattttctcccccggactgttcccgaatctcaaccagtctgtgtgcgataacaatgccctgcctcttatctggagaggcctgatcgacctcaccgggtattacgaggctgttcacccctgtaacgtgttctgcgtcctgagcggacctggcgcctcctgtgaagcctttagcgaagggggaattttcaatatcacatctcccatgtgccttgtgtccaaacagaaccggtttcgcgctgccgagcaacagattagcttcgtttgtcagagagtggatatggacatcattgtctattgcaatggccaaaagaaaacgatcctgaccaagacactcgtgattggccagtgtatctacaccatcacatctctgttttccctgctccccggggtcgcgcatagcattgctatcgagctgtgcgtgcctggattccacggctgggccaccgccgctctgctgattacgttttgtttcgggtgggttctcatcccggcctgcacactggctattcttctggtgctcaagtttttcgccaacatcctgcacacctccaatcaggagaaccggtttaaagcgatcctgcgcaagattaaagaagagttcgaaaagaccaaaggatctatggtctgtgagatctgcaagtacgaatgcgagacactcaaggagctgaaagcccataatcttagctgtgtgcagggcgaatgcccctattgttttacccactgcgagcctacagaaacggctattcaagcccattacaaggtttgtcaggctacccacagattccgggaggatctgaaaaagacagtgacaccccagaacatcgggcctggctgctatagaaccctcaatctgttccgctacaaatcccggtgttatattctgaccatgtggacgcttctcctgatcatcgagtctattctgtgggccgcgagcgccgctgaaatccccctcgtcccgctgtggaccgacaacgcccatggagtgggctccgtgcctatgcacacagaccttgagctggattttagcctcccctcttccagcaagtacacctataagagacacctgacaaatcctgttaacgaccagcaatctgtctccctgcatattgaaatcgagagccaggggattggagctgatgtgcaccatcttggccactggtacgacgcccgcctcaatctgaaaacctctttccactgctacggggcctgtacgaagtatcagtacccctggcatacagctaaatgccactttgaaaaggattatgagtacgagaacagctgggcgtgtaaccctcccgactgcccgggagtgggcaccgggtgcacagcctgtggcctgtatctcgatcagctgaaacctgtcggaaccgctttcaagatcatctccgtgcggtacagcagaaaggtttgcgtgcaatttggcgaagagtatctttgtaaaaccattgacatgaatgattgcttcgtcacacgccatgccaagatctgtattatcgggacggtgtctaaattttcccagggagacacccttctcttcctgggccccatggaagggggaggcattatctttaagcactggtgcacaagcacctgtcatttcggggatcccggcgacgttatgggacctaaagacaagccgtttatttgccccgagttccctggccagtttcggaaaaagtgtaacttcgccacaacccccgtgtgcgaatacgatgggaatatcatctccggatacaagaaagtcctggctacgattgactctttccagagctttaacacatccaatatccacttcaccgatgagagaattgagtggcgcgaccctgatggcatgcttcgggaccacatcaacattgtgatctctaaggatatcgactttgaaaatctcgccgagaacccctgtaaagttgggctgcaagcggctaatattgaaggagcctggggcagcggggtgggcttcaccctgacatgccaggtctccctcaccgagtgccctacatttctgacgtctatcaaggcctgtgatatggctatttgctatggagccgaaagcgtgaccctttccagaggccagaacacagtgaaaatcaccgggaagggaggccatagcgggtcttccttcaagtgttgccacggaaaagagtgtagctctacaggcctgcaagcgtccgctccccatctcgacaaggtcaatggcattagcgagctggaaaacgagaaagtttacgatgacggggccccggaatgcggagtgacctgttggtttaagaaatctggcgagtgggtgatggggatcatcaatggaaactgggtcgtgctgattgttctttgcgtgctcctgctgttctccctcatcctgcttagcattctgtgtcctgtccgcaagcacaagaaatcctga

SEQ ID NO: 13488 - RNA, 3402 nt, synthetic construct
  misc_feature 1..3402: note = derived and/or modified CDS sequence (opt5) from SEOV(HBQ20)__KM233656.1__GP
  source 1..3402: mol_type = other RNA
atgtggagcctgctctttctggccgctcttgtgggccaggggtttgccctgaagaacgtcttcgacatgagaatccaatgcccccactccgttaattttggagagacctctgtgagcggctacacagaactccctccgctgtcccttcaggaggcggaacagctggtgcccgagtctagctgtaacatggataatcatcagtccctctctacgattaacaaactgaccaaggtcatctggcggaaaaaggctaatcaagaaagcgccaaccaaaattccttcgaggtggttgagagcgaagtgtcttttaaagggctgtgcatgctcaagcaccgcatggtcgaggaatcctatagaaaccggcgcagcgtgatttgttacgacctggcctgcaattctacattctgtaagcctaccgtttatatgatcgtgcccattcatgcttgcaacatgatgaaatcctgtcttatcggactgggcccttacagaatccaggtcgtgtatgagcggacatactgcaccacagggattctcaccgagggaaagtgttttgtgcccgataaagccgtcgttagcgctctgaagcgcggcatgtatgccatcgcgtctattgaaacgatctgcttctttattcaccagaaaggcaatacctacaagatcgtgacagtgattacctccgccatggggagcaagtgtaacaatacagacaccaaagtccagggatactatatctgcatcattggcgggaactccgctcctgtgtacgccccggctggagaggatttcagagccatggaagttttctctggcatcattacgagcccccatggggaggaccacgatcttcctggagaagagatcgcgacatatcagatttccggccagatcgaggccaagatcccccacaccgtgagctctaaaaatctgaagctcacagctttcgccggcattccttcctacagctctaccagcatcctggctgcctccgaagacgggcggtttattttctctcccggactgttcccgaacctcaaccagagcgtctgcgataataacgccctgcctcttatctggcgcggcctgattgacctcaccgggtattacgaggctgtgcatccctgtaatgtgttttgcgttctgtccggacctggcgcgagctgtgaagccttctctgaagggggaatctttaacatcacatcccccatgtgccttgtcagcaaacaaaatagattccgggctgccgagcagcagatttcttttgtgtgtcaacgcgtcgatatggacatcattgtgtattgcaacggccagaagaaaacgatcctgaccaagacactcgttattggccagtgtatctacaccattacatccctgttcagcctgctccccggggtggcccactccatcgctatcgagctgtgcgtccctggatttcatggctgggccaccgcggcccttctgattacgttctgttttgggtgggtgctcatcccggcttgcacactggccattcttctggttctcaagttctttgctaatatcctgcacacctctaaccaggagaatagattcaaagccattctgcggaagatcaaagaagagtttgaaaagaccaaaggaagcatggtgtgtgagatctgcaagtacgaatgcgagacactcaaggagctgaaagctcacaacctttcctgtgtccaaggcgaatgcccctattgtttcacccattgcgagcctacagaaacggccattcaggcgcactacaaggtgtgtcaggccacccatcgcttcagagaggatctgaaaaagacagtgacaccccagaatatcgggcctggctgctatcggaccctcaacctgtttagatacaaatctcgctgttatattctgaccatgtggacgcttctcctgatcattgagagcatcctgtgggctgcctccgctgccgaaatccccctcgttccgctgtggaccgacaatgcgcacggagtcggcagcgtgcctatgcatacagaccttgagctggatttctctctcccctccagctctaagtacacctataagcggcacctgacaaaccctgtgaatgaccaacagtccgtcagcctgcacattgaaatcgagtctcaggggattggagccgatgtgcatcaccttggccattggtacgacgctagactcaacctgaaaaccagctttcactgctacggggcctgtacgaagtatcagtacccctggcacacagctaaatgccatttcgaaaaggattatgagtacgagaactcctgggcctgtaatcctcccgactgcccgggagttggcaccgggtgcacagcctgtggcctgtatctcgatcaactgaaacctgtgggaaccgcttttaagatcattagcgtccgctactctcggaaggtgtgcgttcagttcggcgaagagtatctttgtaaaaccatcgacatgaacgattgctttgtgacaagacacgcgaagatctgtattatcgggacggtctccaaattcagccagggagacaccctgctctttctgggccccatggaagggggaggcattatcttcaagcattggtgcacatccacctgtcactttggggatcccggcgacgtgatgggacctaaagacaagccgttcatttgccccgagtttcctggccagttccgcaaaaagtgtaatttcgccacaacccccgtttgcgaatacgatgggaacatcatttctggatacaagaaagtgctggctacgatcgacagctttcaatccttcaatacatctaacatccattttaccgatgagcggattgagtggagagaccctgatggcatgcttcgcgaccacatcaatattgtcatcagcaaggataccgacttcgaaaacctcgccgagaatccctgtaaagtggggctgcaggccgctaacattgaaggagcctggggctccggggtgggctttacactgacctgccaggtctctctcacagagtgccctacgttcctgaccagcatcaaggcgtgtgatatggctatctgctatggagccgaatccgttacacttagccggggccaaaataccgtgaaaattacagggaagggaggccactctgggtccagctttaagtgttgccatggaaaagagtgttcttccaccggcctgcaggccagcgctccccacctcgacaaggtgaacggcatctctgagctggaaaatgagaaagtctacgatgacggggccccggaatgcggagtgacgtgttggttcaagaaatccggcgagtgggttatggggattatcaacggaaattgggtggtcctgattgtgctttgcgttctcctgctgtttagcctcatcctgctttccatcctgtgtcctgtgagaaagcataagaaaagctga

SEQ ID NO: 13489 - RNA, 3402 nt, synthetic construct
  misc_feature 1..3402: note = derived and/or modified CDS sequence (opt5) from SEOV(HBQ43)__KM233657.1__GP
  source 1..3402: mol_type = other RNA
atgtggagcctgctgttcctggccgctcttgtgggccagggggtcgccctgaagaacgtttttgacatgagaatccaatgcccccactccgtgaatttcggagagacctctgtgagcggctacacagaactccctccgctgtcccttcaggaggcggaacagctggtccccgagtctagctgtaacatggataatcatcagtccctctctacgattaacaaactgaccaaggtgatctggcggaaaaaggctaatcaagaaagcgccaaccaaaattcctttgaggttgtggagagcgaagtctctttcaaagggctgtgcatgctcaagcaccgcatggtggaggaatcctatagaaaccggcgcagcgttatttgttacgacctggcctgcaattctacattttgtaagcctaccgtgtatatgatcgtccccattcatgcttgcaacatgatgaaatcctgtcttatcggactgggcccttacagaatccaggtggtgtatgagcggacatactgcaccacagggattctcaccgagggaaagtgtttcgtccccgataaagccgttgtgagcgctctgaagcgcggcatgtatgccatcgcgtctattgaaacgatctgctttttcattcaccagaaaggcaatacctacaagatcgtgacagccattacctccgctatggggagcaagtgtaacaatacagacaccaaagtccagggatactatatctgcatcattggcgggaactccgcccctgtgtacgctccggccggagaggattttagagcgatggaagttttctctggcatcattacgagcccccatggggaggaccacgatcttcctggagaagagatcgccacatatcagatttccggccagatcgaggctaagatcccccacaccgtgagctctaaaaatctgaagctcacagcctttgctggcattccttcctacagctctaccagcatcctggccgcctccgaagacgggcggttcatcttttctcccggactgttcccgaacctcaaccagagcgtctgcgataataacgctctgcctcttatttggcgcggcctgattgacctcaccgggtattacgaggcggtgcatccctgtaatgttttctgcgtgctgtccggacctggcgccagctgtgaggctttttctgaagggggaatcttcaacatcacatcccccatgtgccttgtcagcaaacaaaatagatttcgggccgccgaacagcagatttctttcgtgtgtcaacgcgtcgatatggacatcattgtgtattgcaacggccagaagaaaacgatcctgaccaagacactcgttattggccagtgtatctacaccattacatccctgtttagcctgctccccggggtggctcactccatcgccatcgagctgtgcgtccctggattccatggctgggcgaccgctgcccttctgattacgttttgtttcgggtgggtgctcatcccggcctgcacactggctattcttctggttctcaagtttttcgccaatatcctgcacacctctaaccaggagaatagatttaaagctattctgcggaagatcaaagaagagttcgaaaagaccaaaggaagcatggtgtgtgagatctgcaagtacgaatgcgagacactcaaggagctgaaagcccacaacctttcctgtgtccaaggcgaatgcccctattgttttacccattgcgagcctacagaaacggcgattcaggcccactacaaggtgtgtcaggctacccatcgcttcagagaggatctgaaaaagacagtgacaccccagaatatcgggcctggctgctatcggaccctcaacctgttcagatacaaatctcgctgttatattctgaccatgtggacgcttctcctgatcattgagagcatcctgtgggccgcttccgccgcggaaatccccctcgttccgctgtggaccgacaatgcccacggagtcggcagcgtgcctatgcatacagaccttgagctggatttttctctcccctccagctctaagtacacctataagcggcacctgacaaaccctgtgaatgaccaacagtccgtcagcctgcacattgaaatcgagtctcaggggattggagctgatgtgcatcaccttggccattggtacgacgccagactcaacctgaaaaccagcttccactgctacggggcttgtacgaagtatcagtacccctggcacacagccaaatgccattttgaaaaggattatgagtacgagaactcctgggcctgtaatcctcccgactgcccgggagttggcaccgggtgcacagcttgtggcctgtatctcgatcaactgaaacctgtgggaaccgcgttcaagatcattagcgtccgctactctcggaaggtgtgcgttcagtttggcgaagagtatctttgtaaaaccatcgacatgaacgattgcttcgtgacaagacacgccaagatctgtattatcgggacggtctccaaatttagccagggagacaccctcctcttcctgggccccatggaagggggaggcattatctttaagcattggtgcacatccacctgtcacttcggggatcccggcgacgtgatgggacctaaagacaagccgtttatttgccccgagttccctggccagtttcgcaaaaagtgtaatttcgctacaacccccgtttgcgaatacgatgggaacatcatttctggatacaagaaagtgctggccacgatcgacagcttccaatcctttaatacatctaacatccatttcaccgatgagcggattgagtggagagaccctgatggcatgcttcgcgaccacatcaatattgtcatcagcaaggatattgactttgaaaacctcgccgagaatccctgtaaagtggggctgcaggctgccaacatcgaaggagcgtggggctccggggtgggcttcaccctgacatgccaggtctctctcaccgagtgccctacatttctgacgagcatcaaggcttgtgatatggccatttgctatggagccgaatccgttacccttagccggggccaaaatacagtgaaaatcaccgggaagggaggccactctgggtccagcttcaagtgttgccatggaaaagagtgttcttccacaggcctgcaggctagcgcgccccacctcgacaaggtgaacggcttttctgagctggaaaatgagaaagtctacgatgacggggccccggaatgcggagtgacctgttggttcaagaaatccggcgagtgggttatggggattatcaacggaaattgggtggtcctgattgtgctttgcatcctcctgctgtttagcctcatcctgctttccattctgtgtcctgttagaaagcataagaaaagctga

SEQ ID NO: 13490 - RNA, 3402 nt, synthetic construct
  misc_feature 1..3402: note = derived and/or modified CDS sequence (opt5) from SEOV(HBQ5)__KM233653.1__GP
  source 1..3402: mol_type = other RNA
atgtggagcctcctgttcctggccgctcttgtgggccaggggtttgccctgaagaacgtcttcgacatgagaatccaatgcccccactccgttaattttggagagacctctgtgagcggctacacagaactccctccgctgtcccttcaggaggcggaacagctggtgcccgagtctagctgtaacatggataatcatcagtccctctctacgattaacaaactgaccaaggtcatctggcggaaaaaggctaatcaagaaagcgccaaccaaaattccttcgaggtggttgagagcgaagtgtcttttaaagggctgtgcatgctcaagcaccgcatggtcgaggaatcctatagaaaccggcgcagcgtgatttgttacgacctggcctgcaattctacattctgtaagcctaccgtttatatgatcgtgcccattcatgcttgcaacatgatgaaatcctgtcttatcggactgggcccttacagaatccaggtcgtgtatgagcggacatactgcaccacagggattctcaccgagggaaagtgttttgtgcccgataaagccgtcgttagcgctctgaagcgcggcatgtatgccatcgcgtctattgaaacgatctgcttctttattcaccagaaaggcaatacctacaagatcgtgacagccattacctccgctatggggagcaagtgtaacaatacagacaccaaagtgcagggatactatatctgcatcattggcgggaactccgcccctgtctacgctccggccggagaggatttcagagcgatggaagtgttttctggcatcattacgagcccccatggggaggaccacgatcttcctggagaagagatcgccacatatcagatttccggccagatcgaggctaagatcccccacaccgttagctctaaaaatctgaagctcacagccttcgctggcattccttcctacagctctaccagcatcctggccgcctccgaagacgggcggtttattttctctcccggactgttcccgaacctcaaccagagcgtgtgcgataataacgctctgcctcttatctggcgcggcctgattgacctcaccgggtattacgaggcggtccatccctgtaatgtgttttgcgttctgtccggacctggcgccagctgtgaggctttctctgaagggggaatctttaacatcacatcccccatgtgccttgtgagcaaacaaaatagattccgggccgccgaacagcagatttcttttgtctgtcaacgcgtggatatggacatcattgtctattgcaacggccagaagaaaacgatcctgaccaagacactcgtgattggccagtgtatctacaccattacatccctgttcagcctgctccccggggttgctcactccatcgccatcgagctgtgcgtgcctggatttcatggctgggcgaccgctgcccttctgattacgttctgttttgggtgggtcctcatcccggcctgcacactggctattcttctggtgctcaagttctttgccaatatcctgcacacctctaaccaggagaatagattcaaagctattctgcggaagatcaaagaagagtttgaaaagaccaaaggaagcatggtttgtgagatctgcaagtacgaatgcgagacactcaaggagctgaaagcccacaacctttcctgtgtgcaaggcgaatgcccctattgtttcacccattgcgagcctacagaaacggcgattcaggcccactacaaggtctgtcaggctacccatcgcttcagagaggatctgaaaaagacagtgacaccccagaatatcgggcctggctgctatcggaccctcaacctgtttagatacaaatctcgctgttatattctgaccatgtggacgcttctcctgatcattgagagcatcctgtgggccgcttccgccgcggaaatccccctcgtgccgctgtggaccgacaatgcccacggagttggcagcgtccctatgcatacagaccttgagctggatttctctctcccctccagctctaagtacacctataagcggcacctgacaaaccctgtgaatgaccaacagtccgtgagcctgcacattgaaatcgagtctcaggggattggagctgatgtccatcaccttggccattggtacgacgccagactcaacctgaaaaccagctttcactgctacggggcttgtacgaagtatcagtacccctggcacacagccaaatgccatttcgaaaaggattatgagtacgagaactcctgggcctgtaatcctcccgactgcccgggagtgggcaccgggtgcacagcttgtggcctgtatctcgatcaactgaaacctgttggaaccgcgtttaagatcattagcgtgcgctactctcggaaggtctgcgtgcagttcggcgaagagtatctttgtaaaaccatcgacatgaacgattgctttgttacaagacacgccaagatctgtattatcgggacggtgtccaaattcagccagggagacaccctgctctttctgggccccatggaagggggaggcattatcttcaagcattggtgcacatccacctgtcactttggggatcccggcgacgtcatgggacctaaagacaagccgttcatttgccccgagtttcctggccagttccgcaaaaagtgtaatttcgctacaacccccgtgtgcgaatacgatgggaacatcatttctggatacaagaaagttctggccacgatcgacagctttcaatccttcaatacatctaacatccattttaccgatgagcggattgagtggagagaccctgatggcatgcttcgcgaccacatcaatattgtgatcagcaaggatattgacttcgaaaacctcgccgagaatccctgtaaagtcgggctgcaggctgccaacatcgaaggagcgtggggctccggggtgggctttaccctgacatgccaggtgtctctcaccgagtgccctacattcctgacgagcatcaaggcttgtgatatggccatttgctatggagccgaatccgtcacccttagccggggccaaaatacagttaaaatcaccgggaagggaggccactctgggtccagctttaagtgttgccatggaaaagagtgttcttccacaggcctgcaggctagcgcgccccacctcgacaaggtgaacggcatttctgagctggaaaatgagaaagtgtacgatgacggggccccggaatgcggagtcacctgttggttcaagaaatccggcgagtgggtgatggggatcattaacggaaattgggttgtgctgatcgtcctttgcgtgctcctgctgtttagcctcatcctgctttccattctgtgtcctgttagaaagcataagaaaagctga

SEQ ID NO: 13491 - RNA, 3402 nt, synthetic construct
  misc_feature 1..3402: note = derived and/or modified CDS sequence (opt5) from SEOV(HBT14)__KM233658.1__GP
  source 1..3402: mol_type = other RNA
atgtggagcctcctgttcctggccgctcttgtgggccaggggtttgccctgaagaacgtcttcgacatgagaatccaatgcccccactccgttaattttggagagacctctgtgagcggctacacagggctccctccgctgtcccttcaggaagcggagcagctggtgcccgaatctagctgtaacatggataatcatcagtccctctctattatcaacaaactgacgaaggtcatttggcggaaaaaggctaatcaagagagcgccaaccagaatagcttcgaagtggttgagagcgaggtgtcttttaaaggactgtgcatgctcaagcaccgcatggtcgaagagtcctatagaaaccggcgcagcgtgatctgttacgacctggcctgcaattctaccttctgtaagcctacagtttatatgattgtgcccatccatgcttgcaacatgatgaaatcctgtcttatcggcctggggccttaccggattcaggtcgtgtatgaaagaacctactgcacaaccggaatcctcacagagggcaagtgttttgtgcccgataaagccgtcgttagcgctctgaagcgcggcatgtatgccattgcgtctatcgagaccatttgcttctttatccaccagaaagggaatacgtacaagattgtgaccgccatcacatccgctatgggaagcaagtgtaacaataccgacacaaaagtgcaaggctactatatctgcattatcgggggaaactccgcccctgtctacgctccggccggcgaagatttcagagcgatggaggtgttttctgggattatcaccagcccccatggagaagaccacgatcttcctggcgaggaaattgccacgtatcagatctccggccagatcgaggctaagattccccacacagttagctctaaaaatctgaagctcaccgccttcgctgggatcccttcctacagctctacaagcattctggccgcctccgaggacggacggtttatcttctctcccggcctgttcccgaacctcaaccagagcgtgtgcgataataacgctctgcctcttatttggcgcgggctgatcgacctcaccggatattacgaagcggtccatccctgtaatgtgttttgcgttctgtccggccctggggccagctgtgaggctttctctgaaggaggcatctttaacattacctcccccatgtgccttgtgagcaaacaaaatagattccgggccgccgagcagcagatctcttttgtctgtcaacgcgtggatatggacattatcgtctattgcaacggccagaagaaaacaattctgacgaagaccctcgtgatcgggcagtgtatttacacaatcacctccctgttcagcctgctccccggagttgctcactccatcgccattgaactgtgcgtgcctggctttcatgggtgggcgacagctgcccttctgatcaccttctgttttggatgggtcctcattccggcctgcacgctggctatccttctggtgctcaagttctttgccaatattctgcacacatctaaccaggagaatagattcaaagctatcctgcggaagatcaaagaggaatttgagaagaccaaaggcagcatggtttgtgaaatttgcaagtacgagtgcgaaaccctcaaggagctgaaagcccacaacctttcctgtgtgcaaggggagtgcccctattgtttcacacattgcgaacctaccgagacagcgatccaggcccactacaaggtctgtcaggctacgcatcgcttcagagaagatctgaaaaagaccgtgacaccccagaatattggccctggatgctatcggaccctcaacctgtttagatacaaatctcgctgttatatcctgacaatgtggacccttctcctgattatcgagagcatcctgtgggccgcttccgccgcggagattcccctcgtgccgctgtggacggacaatgcccacggcgttgggagcgtccctatgcataccgaccttgaactggatttctctctcccctccagctctaagtacacatataagcggcacctgaccaaccctgtgaatgaccaacagtccgtgagcctgcacatcgagattgaatctcagggaatcggcgctgatgtccatcaccttgggcattggtacgacgccagactcaacctgaaaacatcctttcactgctacggagcttgtaccaagtatcagtacccctggcacacggccaaatgccatttcgagaaggattatgaatacgagaactcctgggcctgtaatcctcccgactgcccgggcgtggggacaggctgcaccgcttgtggactgtatctcgatcaactgaaacctgttggcacagcgtttaagattatcagcgtgcgctactctcggaaggtctgcgtgcagttcggggaggaatatctttgtaaaaccatcgacatgaacgattgctttgttaccagacacgccaagatttgtatcattggaacagtgtccaaattcagccagggcgacacgctgctctttctggggcccatggagggaggcgggatcattttcaagcattggtgcacctccacatgtcactttggcgatcccggagacgtcatgggccctaaagacaagccgttcatctgccccgaatttcctgggcagttccgcaaaaagtgtaatttcgctaccacacccgtgtgcgagtacgatggaaacattatctctggctacaagaaagttctggccaccatcgacagctttcaatccttcaatacgtctaacattcattttacagatgaacggatcgagtggagagaccctgatgggatgcttcgcgaccacattaatatcgtgattagcaaggatatcgacttcgagaacctcgccgaaaatccctgtaaagtcggactgcaggctgccaacatcgagggcgcgtgggggtccggcgtgggatttaccctgacctgccaggtgtctctcacagaatgccctaccttcctgacaagcattaaggcttgtgatatggccatctgctatggcgccgagtccgtcacgcttagccgggggcaaaataccgttaaaattacaggaaagggcgggcactctggatccagctttaagtgttgccatggcaaagaatgttcttccaccggcctgcaggctagcgcgccccacctcgacaaggtgaacgggatctctgagctggagaatgaaaaagtgtacgatgacggagccccggagtgcggcgtcacatgttggttcaagaaatccggggaatgggtgatgggaattatcaacggcaattgggttgtgctgatcgtcctttgcgtgctcctgctgtttagcctcattctgctttccatcctgtgtcctgttagaaagcataagaaaagctga

SEQ ID NO: 13492 - RNA, 3402 nt, synthetic construct
  misc_feature 1..3402: note = derived and/or modified CDS sequence (opt5) from SEOV(HBT-3)__KM233661.1__GP
  source 1..3402: mol_type = other RNA
atgtggagccttctcttcctggccgctcttgtgggccaggggtttgccctgaagaacgtcttcgacatgagaatccaatgcccccactccgttaattttggagagacctctgtgagcggctacacagaactccctccgctgtcccttcaggaggcggaacagctggtgcccgagtctagctgtaacatggataatcatcagtccctctctacgattaacaaactgaccaaggtcatctggcggaaaaaggctaatcaagaaagcgccaaccaaaattccttcgaggtggttgagagcgaagtgtcttttaaagggctgtgcatgctcaagcaccgcatggtcgaggaatcctatagaaaccggcgcagcgtgatttgttacgacctgccttgcaattctacattctgtaagcccaccgtttatatgatcgtgcctattcatgcctgcaacatgatgaaatcctgtcttatcggactgggcccctacagaatccaggtcgtgtatgagcggacatactgcaccacagggattctcaccgagggaaagtgttttgtgcctgataaagctgtcgttagcgccctgaagcgcggcatgtatgctatcgcctctattgaaacgatctgcttctttattcaccagaaaggcaatacctacaagatcgtgacagcgattacctccgccatggggagcaagtgtaacaatacagacaccaaagtgcagggatactatatctgcatcattggcgggaactccgctccggtctacgcccccgctggagaggatttcagagccatggaagtgttttctggcatcattacgagccctcatggggaggaccacgatcttcccggagaagagatcgcgacatatcagatttccggccagatcgaggccaagatccctcacaccgttagctctaaaaatctgaagctcacagctttcgccggcattccctcctacagctctaccagcatcctggctgcctccgaagacgggcggtttattttctctccgggactgttccctaacctcaaccagagcgtgtgcgataataacgccctgccccttatctggcgcggcctgattgacctcaccgggtattacgaggctgtccatccttgtaatgtgttttgcgttctgtccggacccggcgcgagctgtgaagccttctctgaagggggaatctttaacatcacatcccccatgtgccttgtgagcaaacaaaatagattccgggctgccgagcagcagatttcttttgtctgtcaacgcgtggatatggacatcattgtctattgcaacggccagaagaaaacgatcctgaccaagacactcgtgattggccagtgtatctacaccattacatccctgttcagcctgctccctggggttgcccactccatcgctatcgagctgtgcgtgccgggatttcatggctgggccaccgcggctctgctgattacgttctgttttgggtgggtcctcatccccgcctgcacactggccattcttctggtgctcaagttctttgctaatatcctgcacacctctaaccaggagaatagattcaaagccattctgcggaagatcaaagaagagtttgaaaagaccaaaggaagcatggtttgtgagatctgcaagtacgaatgcgagacattcaaggagctcaaagctcacaacctgtcctgtgtgcaaggcgaatgcccttattgtttcacccattgcgagcccacagaaacggccattcaggcgcactacaaggtctgtcaggccacccatcgctttagagaggatcttaaaaagacagtgacccctcagaatatcgggcccggctgctatcggacactgaacctcttcagatacaaatctcgctgttatattctgaccatgtggacgctgcttctcatcattgagagcatcctgtgggctgcctccgctgccgaaatcccgctggtgcctctctggaccgacaatgcgcacggagttggcagcgtccccatgcatacagacctggagcttgatttttctctgccttccagctctaagtacacctataagcggcacctcacaaaccccgtgaatgaccaacagtccgtgagcctgcacattgaaatcgagtctcaggggattggagccgatgtccatcacctgggccattggtacgacgctagacttaacctcaaaaccagcttccactgctacggggcctgtacgaagtatcagtacccttggcacacagctaaatgccattttgaaaaggattatgagtacgagaactcctgggcctgtaatcccccggactgccctggagtgggcaccgggtgcacagcctgtggcctgtatctggatcaactcaaacccgttggaaccgctttcaagatcattagcgtgcgctactctcggaaggtctgcgtgcagtttggcgaagagtatctgtgtaaaaccatcgacatgaacgattgcttcgttacaagacacgcgaagatctgtattatcgggacggtgtccaaatttagccagggagacacccttctgttcctcggccccatggaagggggaggcattatctttaagcattggtgcacatccacctgtcacttcggggatcctggcgacgtcatgggaccgaaagacaagccctttatttgccctgagttccccggccagttccgcaaaaagtgtaattttgccacaacccctgtgtgcgaatacgatgggaacatcatttctggatacaagaaagttctggctacgatcgacagcttccaatcctttaatacatctaacatccatttcaccgatgagcggattgagtggagagaccccgatggcatgctgcgcgaccacatcaatattgtgatcagcaaggatattgactttgaaaaccttgccgagaatccttgtaaagtcgggctccaggccgctaacatcgaaggagcctggggctccggggtgggcttcaccctgacatgccaggtgtctctgaccgagtgccccacatttctcacgagcatcaaggcgtgtgatatggctatttgctatggagccgaatccgtcaccctgagccggggccaaaatacagttaaaatcaccgggaagggaggccactctgggtccagcttcaagtgttgccatggaaaagagtgttcttccacaggccttcaggccagcgctccgcacctggacaaggtgaacggcatttctgagctcgaaaatgagaaagtgtacgatgacggggcccctgaatgcggagtcacctgttggtttaagaaatccggcgagtgggtgatggggatcattaacggaaattgggttgtgctgatcgtcctgtgcgtgcttctcctgttcagcctgatcctcctgtccattctttgtcccgttagaaagcataagaaaagctga

SEQ ID NO: 13493 - RNA, 3402 nt, synthetic construct
  misc_feature 1..3402: note = derived and/or modified CDS sequence (opt5) from SEOV(HBT49)__KM233659.1__GP
  source 1..3402: mol_type = other RNA
atgtggagcctcctgttcctggccgctcttgtgggccaggggtttgccctgaagaacgtcttcgacatgagaatccaatgcccccactccgttaattttggagagacctctgtgagcggctacacagaactccctccgctgtcccttcaggaggcggaacagctggtgcccgagtctagctgtaacatggataatcatcagtccctctctacgattaacaaactgaccaaggtcatctggcggaaaaaggctaatcaagaaagcgccaaccaaaattccttcgaggtggttgagagcgaagtgtcttttaaagggctgtgcatgctcaagcaccgcatggtcgaggaatcctatagaaaccggcgcagcgtgatttgttacgacctggcctgcaattctacattctgtaagcctaccgtttatatgatcgtgcccattcatgcttgcaacatgatgaaatcctgtcttatcggactgggcccttacagaatccaggtcgtgtatgagcggacatactgcaccacagggattctcaccgagggaaagtgttttgtgcccgataaagccgtcgttagcgctctgaagcgcggcatgtatgccatcgcgtctattgaaacgatctgcttctttattcaccagaaaggcaatacctacaagatcgtgacagccattacctccgctatggggagcaagtgtaacaatacagacaccaaagtgcagggatactatatctgcatcattggcgggaactccgcccctgtctacgctccggccggagaggatttcagagcgatggaagtgttttctggcatcattacgagcccccatggggaggaccacgatcttcctggagaagagatcgccacatatcagatttccggccagatcgaggctaagatcccccacaccgttagctctaaaaatctgaagctcacagccttcgctggcattccttcctacagctctaccagcatcctggccgcctccgaagacgggcggtttattttctctcccggactgttcccgaacctcaaccagagcgtgtgcgataataacgctctgcctcttatctggcgcggcctgattgacctcaccgggtattacgaggcggtccatccctgtaatgtgttttgcgttctgtccggacctggcgccagctgtgaggctttctctgaagggggaatctttaacatcacatcccccatgtgccttgtgagcaaacaaaatagattccgggccgccgaacagcagatttcttttgtctgtcaacgcgtggatatggacatcattgtctattgcaacggccagaagaaaacgatcctgaccaagacactcgtgattggccagtgtatctacaccattacatccctgttcagcctgctccccggggttgctcactccatcgccatcgagctgtgcgtgcctggatttcatggctgggcgaccgctgcccttctgattacgttctgttttgggtgggtcctcatcccggcctgcacactggctattcttctggtgctcaagttctttgccaatatcctgcacacctctaaccaggagaatagattcaaagctattctgcggaagatcaaagaagagtttgaaaagaccaaaggaagcatggtttgtgagatctgcaagtacgaatgcgagacactcaaggagctgaaagcccacaacctttcctgtgtgcaaggcgaatgcccctattgtttcacccattgcgagcctacagaaacggcgattcaggcccactacaaggtctgtcaggctacccatcgcttcagagaggatctgaaaaagacagtgacaccccagaatatcgggcctggctgctatcggaccctcaacctgtttagatacaaatctcgctgttatattctgaccatgtggacgcttctcctgatcattgagagcatcctgtgggccgcttccgccgcggaaatccccctcgtgccgctgtggaccgacaatgcccacggagttggcagcgtccctatgcatacagaccttgagctggatttctctctcccctccagctctaagtacacctataagcggcacctgacaaaccctgtgaatgaccaacagtccgtgagcctgcacattgaaatcgagtctcaggggattggagctgatgtctaccatcttggccactggtacgacgccagactcaacctgaaaaccagctttcattgctatggggcttgtacgaagtaccagtatccctggcacacagccaaatgccacttcgaaaaggattacgagtatgagaactcctgggcctgtaatcctcccgactgcccgggagtgggcaccgggtgcacagcttgtggcctgtacctcgatcaactgaaacctgttggaaccgcgtttaagatcattagcgtgcgctattctcggaaggtctgcgtgcagttcggcgaagagtacctttgtaaaaccatcgacatgaacgattgctttgttacaagacatgccaagatctgtattatcgggacggtgtccaaattcagccagggagacaccctgctctttctgggccccatggaagggggaggcattatcttcaagcactggtgcacatccacctgtcattttggggatcccggcgacgtcatgggacctaaagacaagccgttcatttgccccgagtttcctggccagttccgcaaaaagtgtaatttcgctacaacccccgtgtgcgaatacgatgggaacatcatttctggatataagaaagttctggccacgatcgacagctttcaatccttcaatacatctaacatccactttaccgatgagcggattgagtggagagaccctgatggcatgcttcgcgaccatatcaatattgtgatcagcaaggatattgacttcgaaaacctcgccgagaatccctgtaaagtcgggctgcaggctgccaacatcgaaggagcgtggggctccggggtgggctttaccctgacatgccaggtgtctctcaccgagtgccctacattcctgacgagcatcaaggcttgtgatatggccatttgctacggagccgaatccgtcacccttagccggggccaaaatacagttaaaatcaccgggaagggaggccactctgggtccagctttaagtgttgccacggaaaagagtgttcttccacaggcctgcaggctagcgcgccccatctcgacaaggtgaacggcatttctgagctggaaaatgagaaagtgtatgatgacggggccccggaatgcggagtcacctgttggttcaagaaatccggcgagtgggtgatggggatcattaacggaaattgggttgtgctgatcgtcctttgcgtgctcctgctgtttagcctcatcctgctttccattctgtgtcctgttagaaagcacaagaaaagctga

SEQ ID NO: 13494 - RNA, 3402 nt, synthetic construct
  misc_feature 1..3402: note = derived and/or modified CDS sequence (opt5) from SEOV(HBT50)__KM233660.1__GP
  source 1..3402: mol_type = other RNA
atgtggagcctcctgttcctggccgctcttgtgggccaggggtttgccctgaagaacgtcttcgacatgagaatccaatgcccccactccgttaattttggagagacctctgtgagcggctacacagaactccctccgctgtcccttcaggaggcggaacagctggtgcccgagtctagctgtaacatggataatcatcagtccctctctacgattaacaaactgaccaaggtcatctggcggaaaaaggctaatcaagaaagcgccaaccaaaattccttcgaggtggttgagagcgaagtgtcttttaaagggctgtgcatgctcaagcaccgcatggtcgaggaatcctatagaaaccggcgcagcgtgatttgttacgacctggcctgcaattctacattctgtaagcctaccgtttatatgatcgtgcccattcatgcttgcaacatgatgaaatcctgtcttatcggactgggcccttacagaatccaggtcgtgtatgagcggacatactgcaccacagggattctcaccgagggaaagtgttttgtgcccgataaagccgtcgttagcgctctgaagcgcggcatgtatgccatcgcgtctattgaaacgatctgcttctttattcaccagaaaggcaatacctacaagatcgtgacagccattacctccgctatggggagcaagtgtaacaatacagacaccaaagtgcagggatactatatctgcatcattggcgggaactccgcccctgtctacgctccggccggagaggatttcagagcgatggaagtgttttctggcatcattacgagcccccatggggaggaccacgatcttcctggagaagagatcgccacatatcagatttccggccagatcgaggctaagatcccccacaccgttagctctaaaaatctgaagctcacagccttcgctggcattccttcctacagctctaccagcatcctggccgcctccgaagacgggcggtttattttctctcccggactgttcccgaacctcaaccagagcgtgtgcgataataacgctctgcctcttatctggcgcggcctgattgacctcaccgggtattacgaggcggtccatccctgtaatgtgttttgcgttctgtccggacctggcgccagctgtgaggctttctctgaagggggaatctttaacatcacatcccccatgtgccttgtgagcaaacaaaatagattccgggccgccgaacagcagatttcttttgtctgtcaacgcgtggatatggacatcattgtctattgcaacggccagaagaaaacgatcctgaccaagacactcgtgattggccagtgtatctacaccattacatccctgttcagcctgctccccggggttgctcactccatcgccatcgagctgtgcgtgcctggatttcatggctgggcgaccgctgcccttctgattacgttctgttttgggtgggtcctcatcccggcctgcacactggctattcttctggtgctcaagttctttgccaatatcctgcacacctctaaccaggagaatagattcaaagctattctgcggaagatcaaagaagagtttgaaaagaccaaaggaagcatggtttgtgagatctgcaagtacgaatgcgagacactcaaggagctgaaagcccacaacctttcctgtgtgcaaggcgaatgcccctattgtttcacccattgcgagcctacagaaacggcgattcaggcccactacaaggtctgtcaggctacccatcgcttcagagaggatctgaaaaagacagtgacaccccagaatatcgggcctggctgctatcggaccctcaacctgtttagatacaaatctcgctgttatattctgaccatgtggacgcttctcctgatcattgagagcatcctgtgggccgcttccgccgcggaaatccccctcgtgccgctgtggaccgacaatgcccacggagttggcagcgtccctatgcatacagaccttgagctggatttctctctcccctccagctctaagtacacctataagcggcacctgacaaaccctgtgaatgaccaacagtccgtgagcctgcacattgaaatcgagtctcaggggattggagctgatgtccatcaccttggccattggtacgacgccagactcaacctgaaaaccagctttcactgctacggggcttgtacgaagtatcagtacccctggcacacagccaaatgccatttcgaaaaggattatgagtacgagaactcctgggcctgtaatcctcccgactgcccgggagtgggcaccgggtgcacagcttgtggcctgtatctcgatcaactgaaacctgttggaaccgcgtttaagatcattagcgtgcgctactctcggaaggtctgcgtgcagttcggcgaagagtatctttgtaaaaccatcgacatgaacgattgctttgttacaagacacgccaagatctgtattatcgggacggtgtccaaattcagccagggagacaccctgctctttctgggccccatggaagggggaggcattatcttccgccattggtgcacatccacctgtcactttggggatcccggcgacgtcatgggacctaaggacaaaccgttcatttgccccgagtttcctggccagttccggaagaaatgtaatttcgctacaacccccgtgtgcgaatacgatgggaacatcatttctggatacaagaaggttctggccacgatcgacagctttcaatccttcaatacatctaacatccattttaccgatgagagaattgagtggcgcgaccctgatggcatgcttcgggaccacatcaatattgtgatcagcaaagatattgacttcgaaaacctcgccgagaatccctgtaaggtcgggctgcaggctgccaacatcgaaggagcgtggggctccggggtgggctttaccctgacatgccaggtgtctctcaccgagtgccctacattcctgacgagcatcaaggcttgtgatatggccatttgctatggagccgaatccgtcacccttagcagaggccaaaatacagttaagatcaccgggaaaggaggccactctgggtccagctttaagtgttgccatggaaaggagtgttcttccacaggcctgcaggctagcgcgccccacctcgacaaagtgaacggcatttctgagctggaaaatgagaaggtgtacgatgacggggccccggaatgcggagtcacctgttggttcaaaaagtccggcgagtgggtgatggggatcattaacggaaattgggttgtgctgatcgtcctttgcgtgctcctgctgtttagcctcatcctgctttccattctgtgtcctgttcgcaaacataaaaagagctga

SEQ ID NO: 13495 - RNA, 3402 nt, synthetic construct
  misc_feature 1..3402: note = derived and/or modified CDS sequence (opt5) from SEOV(HuludaoRn101)__GU592923.1__GP
  source 1..3402: mol_type = other RNA
atgtggagcctgctcctgcttgccgctctggtgggccaggggttcgccctcaagaacgtctttgacatgagaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaaactgaccaaggtcgtgtggcggaaaaaggctaatcaagaaagcgccaaccagaatagctttgaggttgtggagagcgaagtctctttcaaagggctctgcatgctgaagcaccgcatggtggaggaatcctatagaaaccggcgcagcgttatctgttacgaccttgcctgcaattctacattttgtaagcctaccgtgtatatgattgtccccatccatgcttgcaacatgatgaaatcctgtctgattggactcggcccttacagaatccaggtggtgtatgagcggacatactgcaccacagggatcctgaccgagggaaagtgtttcgtccccgataaagccgttgtgagcgctcttaagcgcggcatgtatgccattgcgtctatcgaaacgatttgctttttcatccaccagaaaggcaatacctacaagattgtgacagccatcacctccgctatggggagcaagtgtaacaatacagacaccaaagtccaaggatactatatttgcatcatcggcgggaactccgcccctgtgtacgctccggccggagaggattttagagcgatggaagttttctctggcattatcacgagcccccatggggaggaccacgatctgcctggagaagagattgccacatatcagatctccggccagattgaggctaagatcccccacaccgtgagctctaaaaatctcaagctgatcgcctttgctggcattccttcctacagctctacaagcatcctggccgcctccgaagactctcggttcatttttagccccgggctgttcccgaacctgaaccagtccgtctgcgataataacgcgcttcctctgatctggcgcggactcattgacctgaccggctattacgagaccgtgcatccctgtaatgttttctgcgtgcttagcgggcctggagcttcttgtgaagccttttccgagggcgggatcttcaacatcacaagccccatgtgcctggtctctaaacaaaatagatttcgggctgccgaacagcagatttccttcatctgtcaacgcgtggatatggacattatcgtctattgcaacggacagaagaaaacgattctcaccaagacactggtgatcggccagtgtatttacaccatcacaagcctgttttccctcctgcccggcgttgcccactctatcgctattgagctttgcgtgcctgggttccatggatgggccaccgcggctctgctcatcacgttttgtttcggctgggtcctgattccggcctgcacacttgccatcctgctcgtgctgaagtttttcgctaatattctgcacaccagcaaccaggagaatagatttaaagccatcctccggaagatcaaagaagagttcgaaaagaccaaagggtccatggtttgtgagatttgcaagtacgaatgcgagacactgaaggagcttaaagctcacaacctgtcttgtgtgcaaggagaatgcccctattgttttacccattgcgagcctacagaaacggccatccaggcgcactacaaggtctgtcaggccacccatcgcttcagagaggatctcaaaaagacagtgacaccccagaatattggccctgggtgctatcggaccctgaacctgttcagatacaaaagccgctgttatatccttaccatgtggacgctcctgctgattatcgagtccatcctctgggctgccagcgctgccgaaattcccctggtgccgctttggaccgacaatgcgcacggcgttggatctatccctatgcatacagacctggagctcgatttttccctgccctcctcttccaagtacacctataagcggcacctgacaaaccctgtcaatgaccaacagagcgtgtctcttcacattgaaatcgagagccagggcattggggccgatgtgcatcacctcggacattggtacgacgctagactgaacctgaaaacctccttccactgctacggcgcctgtacgaagtatcagtacccctggcacacagctaaatgccattttgaaaaggattatgagtacgagaacagctgggcctgtaatcctcccgactgcccgggggtcggaaccggctgcacagcctgtgggctctatctggatcaacttaaacctgtgggcaccgctttcaagatcatctctgttcgctactcccggaaggtgtgcgtccagtttggagaagagtatctgtgtaaaaccattgacatgaacgattgcttcgtgacaagacacgcgaagatctgtattatcggcacggttagcaaattttcccagggggacaccctcctgttcctgggacccatggaaggcgggggaattatctttaagcattggtgcacatctacctgtcacttcggcgatcccggggacgtgatgggccctaaagacaagccgtttatttgccccgagttccctggacagtttcgcaaaaagtgtaatttcgccacaacccccatctgcgaatacgatggcaacatcattagcgggtacaagaaagtccttgctacgatcgactccttccaatcttttaatacaagcaacattcatttcaccgatgagcggatcgagtggagagaccctgatggaatgctccgcgaccacattaatgtggttatctccaaggatatcgactttgaaaacctggccgagaatccctgtaaagtgggcctgcaggccgctaacattgaaggggcctggggatctggcgtcgggttcaccctcacatgccaggtgagcctgaccgagtgccctacatttcttacgtccatcaaggcgtgtgatatggctatttgctatggcgccgaaagcgtgaccctgtctcggggacaaaatacagtcagaatcaccggcaaagggggacactccggcagctctttcaagtgttgccatgggaaggagtgttccagcacaggactccaggcctctgctccccacctggacaaagttaacggcatttccgagctggaaaatgagaaggtgtacgatgacggcgccccggaatgcggggtgacctgttggtttaaaaagagcggagagtgggtcatgggcatcatcaacgggaattgggtggttcttattgtgctctgcgtcctgctcctcttctccctgatccttctgagcattctctgtcctgtgcgcaaacataagaagtcttga

SEQ ID NO: 13496 - RNA, 3402 nt, synthetic construct
  misc_feature 1..3402: note = derived and/or modified CDS sequence (opt5) from SEOV(Humber)__JX879768.1__GP
  source 1..3402: mol_type = other RNA
atgtggagcctgctcctgcttgccgctctggtgggccaggggttcgccctcaagaacgtctttgacatgagaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaaactgaccaaggtcatctggcggaaaaaggctaatcaagaaagcgccaaccaaaattcctttgaggtggttgagagcgaagtgtctttcaaagggctctgcatgctgaagcaccgcatggtcgaggaatcctatagaaaccggcgcagcgtgatttgttacgaccttgcctgcaattctacattttgtaagcctaccgtttatatgatcgtgcccattcatgcttgcaacatgatgaaatcctgtctgatcggactcggcccttacagaatccaggtcgtgtatgagcggacatactgcaccacagggattctgaccgagggaaagtgtttcgtgcccgataaagccgtcgttagcgctcttaagcgcggcatgtatgccatcgcgtctattgaaacgatctgctttttcgtgcaccagaaaggcaatacctacaagattgtgacagccatcacctccgctatggggagcaagtgtaacaatacagacaccaaagtccagggatactatatttgcatcatcggcgggaactccgcccctgtgtactctccggctggagaggattttagagccatggaagttttcagcggcattatcacgagcccccatggggaggaccacgatctgcctggagaagagattgcgacatatcagatcagcggccagattgaggccaagatcccccacaccgtgtcttccaaaaatctcaagctgacagcttttgccggcatccctagctactctagcacctccattctggctgcctctgaagacgggcggttcatctttagccccggactcttcccgaacctgaaccagtccgtctgcgataataacgcccttcctctgatttggcgcggcctcatcgacctgaccgggtattacgaggctgtgcatccctgtaatgttttctgcgtgcttagcggacctggcgcgtcttgtgaagccttttccgaagggggaattttcaacatcacaagccccatgtgcctggtctctaaacaaaatagatttcgggctgccgagcagcagatctccttcatttgtcaacgcgtggatatggacatcattgtctattgcaacggccagaagaaaacgatcctcaccaagacactggtgattggccagtgtatctacaccattacaagcctgttttccctcctgcccggggttgcccactctatcgctatcgagctttgcgtgcctggattccatggctgggccaccgcggctctgctcattacgttttgtttcgggtgggtcctgatcccggcctgcacacttgccgtgctgctcgttctgaagtttttcgctaatattctgcacaccagcaaccaggagaatagatttaaagccatcctccggaagattaaagaagagttcgaaaagaccaaaggatccatggtgtgtgagatctgcaagtacgaatgcgagacactgaaggagcttaaagctcacaacctgtcttgtatccaaggcgaatgcccctattgttttacccattgcgagcctacagaaacggccattcaggcgcactacaaggtctgtcaggccacccatcgcttcagagaggatctcaaaaagacagtgacaccccctaatatcgggcccggctgctatcggaccctgaacctgttcagatacaaaagccgctgttatattcttaccatgtggacgctcctgctgatcattgagtccatcctctgggctgccagcgctgccgaaatcccgctggtgcctctttggaccgacaatgcgcacggagttggctctgtccccatgcatacagacctggagctcgatttttccctgccttcctcttccaagtacacctataagcggcacctgacaaaccccgtgaatgaccagcaaagcgtgtctcttcacattgaaatcgagagccaggggattggagccgatgtccatcacctcggccattggtacgacgctagactgaacctgaaaacctccttccactgctacggggcctgtacgaagtatcagtacccttggcacacagctaaatgccattttgaaaaggattatgagtacgagaacagctgggcctgtaatcccccggactgccctggagtgggcaccgggtgcacagcctgtggcctctatctggatcagcttaaacccgttggaaccgctttcaagatcatttctgtgcgctactcccggaaggtctgcgtgcaatttggcgaagagtatctgtgtaaaaccatcgacatgaacgattgcttcgttacaagacacgcgaagatctgtattatcgggacggtgagcaaattttcccagggagacaccctcctgttcctgggccccatggaagggggaggcattatctttaagcattggtgcacatctacctgtcacttcggggatcctggcgacgtcatgggaccgaaagacaagccctttatttgccctgagttccccggccagtttcgcaaaaagtgtaatttcgccacaacccctgtgtgcgaatacgatgggaacatcattagcggatacaagaaagttcttgctacgatcgactccttccagtcttttaatacaagcaacatccatttcaccgatgagcggattgagtggagagaccccgatggcatgctccgcgaccacatcaatattatcatttccaaggatatcgactttgaaaacctggccgagaatccttgtaaagtggggctgcaagccgctaacatcgaaggagcctggggctctggggtcggcttcaccctcacatgccaggtgagcctgaccgagtgccccacatttcttacgtccattaaggcgtgtgatatggctatctgctatggagccgaaagcgtgaccctgtctcggggccagaatacagtcaaaattaccgggaagggaggccactccgggagctctttcaagtgttgccatggaaaagagtgttccagcaacggcctccaagcctctgctccgcacctggacaaggttaatggcatctccgagctggaaaacgagaaagtgtacgatgacggggcccctgaatgcggagtgacatgttggtttaagaaaagcggcgagtgggtcatggggattatcaatggaaactgggtggttcttatcgtgctctgcgtcctgctcctgttctccctgattcttctgagcatcctctgtcccgtgagaaagcataagaaatcttga

SEQ ID NO: 13497 - RNA, 3402 nt, synthetic construct
  misc_feature 1..3402: note = derived and/or modified CDS sequence (opt5) from SEOV(Humber)__KM948597.1__GP
  source 1..3402: mol_type = other RNA
atgtggagcctgctcctgcttgccgctctggtgggccaggggttcgccctcaagaacgtctttgacatgagaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaaactgaccaaggtcatctggcggaaaaaggctaatcaagaaagcgccaaccaaaattcctttgaggtggttgagagcgaagtgtctttcaaagggctctgcatgctgaagcaccgcatggtcgaggaatcctatagaaaccggcgcagcgtgatttgttacgaccttgcctgcaattctacattttgtaagcctaccgtttatatgatcgtgcccattcatgcttgcaacatgatgaaatcctgtctgatcggactcggcccttacagaatccaggtcgtgtatgagcggacatactgcaccacagggattctgaccgagggaaagtgtttcgtgcccgataaagccgtcgttagcgctcttaagcgcggcatgtatgccatcgcgtctattgaaacgatctgctttttcgtgcaccagaaaggcaatacctacaagattgtgacagccatcacctccgctatggggagcaagtgtaacaatacagacaccaaagtccagggatactatatttgcatcatcggcgggaactccgcccctgtgtactctccggctggagaggattttagagccatggaagttttcagcggcattatcacgagcccccatggggaggaccacgatctgcctggagaagagattgcgacatatcagatcagcggccagattgaggccaagatcccccacaccgtgtcttccaaaaatctcaagctgacagcttttgccggcatccctagctactctagcacctccattctggctgcctctgaagacgggcggttcatctttagccccggactcttcccgaacctgaaccagtccgtctgcgataataacgcccttcctctgatttggcgcggcctcatcgacctgaccgggtattacgaggctgtgcatccctgtaatgttttctgcgtgcttagcggacctggcgcgtcttgtgaagccttttccgaagggggaattttcaacatcacaagccccatgtgcctggtctctaaacaaaatagatttcgggctgccgagcagcagatctccttcatttgtcaacgcgtggatatggacatcattgtctattgcaacggccagaagaaaacgatcctcaccaagacactggtgattggccagtgtatctacaccattacaagcctgttttccctcctgcccggggttgcccactctatcgctatcgagctttgcgtgcctggattccatggctgggccaccgcggctctgctcattacgttttgtttcgggtgggtcctgatcccggcctgcacacttgccgtgctgctcgttctgaagtttttcgctaatattctgcacaccagcaaccaggagaatagatttaaagccatcctccggaagattaaagaagagttcgaaaagaccaaaggatccatggtgtgtgagatctgcaagtacgaatgcgagacactgaaggagcttaaagctcacaacctgtcttgtatccaaggcgaatgcccctattgttttacccattgcgagcctacagaaacggccattcaggcgcactacaaggtctgtcaggccacccatcgcttcagagaggatctcaaaaagacagtgacaccccctaatatcgggcccggctgctatcggaccctgaacctgttcagatacaaaagccgctgttatattcttaccatgtggacgctcctgctgatcattgagtccatcctctgggctgccagcgctgccgaaatcccgctggtgcctctttggaccgacaatgcgcacggagttggctctgtccccatgcatacagacctggagctcgatttttccctgccttcctcttccaagtacacctataagcggcacctgacaaaccccgtgaatgaccagcaaagcgtgtctcttcacattgaaatcgagagccaggggattggagccgatgtccatcacctcggccattggtacgacgctagactgaacctgaaaacctccttccactgctacggggcctgtacgaagtatcagtacccttggcacacagctaaatgccattttgaaaaggattatgagtacgagaacagctgggcctgtaatcccccggactgccctggagtgggcaccgggtgcacagcctgtggcctctatctggatcagcttaaacccgttggaaccgctttcaagatcatttctgtgcgctactcccggaaggtctgcgtgcaatttggcgaagagtatctgtgtaaaaccatcgacatgaacgattgcttcgttacaagacacgcgaagatctgtattatcgggacggtgagcaaattttcccagggagacaccctcctgttcctgggccccatggaagggggaggcattatctttaagcattggtgcacatctacctgtcacttcggggatcctggcgacgtcatgggaccgaaagacaagccctttatttgccctgagttccccggccagtttcgcaaaaagtgtaatttcgccacaacccctgtgtgcgaatacgatgggaacatcattagcggatacaagaaagttcttgctacgatcgactccttccagtcttttaatacaagcaacatccatttcaccgatgagcggattgagtggagagaccccgatggcatgctccgcgaccacatcaatattatcatttccaaggatatcgactttgaaaacctggccgagaatccttgtaaagtggggctgcaagccgctaacatcgaaggagcctggggctctggggtcggcttcaccctcacatgccaggtgagcctgaccgagtgccccacatttcttacgtccattaaggcgtgtgatatggctatctgctatggagccgaaagcgtgaccctgctccggggccagaatacagtcaaaattaccgggaagggaggccactctgggtccagcttcaagtgttgccatggaaaagagtgttcttccaacggcctgcaagccagcgctccgcacctggacaaggttaatggcatctctgagcttgaaaacgagaaagtgtacgatgacggggcccctgaatgcggagtgacatgttggtttaagaaatccggcgagtgggtcatggggattatcaatggaaactgggtggttctcatcgtgctgtgcgtcctgctcctgttcagccttattctgctctccatcctgtgtcccgtgagaaagcataagaaaagctga

SEQ ID NO: 13498 - RNA, 3402 nt, synthetic construct
  misc_feature 1..3402: note = derived and/or modified CDS sequence (opt5) from SEOV(K24-e7)__AF288652.1__GP
  source 1..3402: mol_type = other RNA
atgtggagcctgctcctgcttgccgctctggtgggccaggggttcgccctcaagaacgtctttgacatgagaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaaactgaccaaggtcgtgtggcggaaaaaggctaatcaagaaagcgccaaccaaaattcctttgaggttgtggagagcgaagtctctttcaaagggctctgcatgctgaagcaccgcatggtggaggaatcctatagaaaccggcgcagcgttatctgttacgaccttgcctgcaattctacattttgtaagcctaccgtgtatatgattgtccccatccatgcttgcaacatgatgaaatcctgtctgattggactcggcccttacagaatccaggtggtgtatgagcggacatactgcaccacagggatcctgaccgagggaaagtgtttcgtccccggcaaagccgttgtgagcgctcttaagcgcggcatgtatgccattgcgtctatcgaaacgatttgctttttcatccaccagaaagggaatacctacaagattgtgacagccatcacctccgctatgggaagcaagtgtaacaatacagataccaaagtccagggctactatatttgcatcatcgggggaaactccgcccctgtgtacgctccggccggcgaggactttagagcgatggaagttttctctgggattatcacgagcccccatggagaggatcacgacctgcctggcgaagagattgccacatatcagatctccggccagattgaggctaagatcccccacaccgtgagctctaaaaatctcaagctgatcgcctttgctgggattccttcctacagctctacaagcatcctggccgcctccgaagatggacggttcatttttagccccggcctcttcccgaacctgaaccagagcgtctgcgacaataacgctctgcctctgatctggcgcgggctcattgatctgaccggatattacgaggcggtgcatccctgtaatgttttcagagtgctttccggccctggggccagctgcgaagccttttctgagggaggcatcttcaacatcacctcccccatgtgtctggtcagcaaacaaaatcggtttcgcgccgccgaacagcagatttctttcatctgccaaagagtggacatggatattatcgtctattgtaacggccagaagaaaacaattctcacgaagaccctggtgatcgggcagtgcatttacacaatcacctccctgtttagcctcctgcccggagttgctcactccatcgccattgagctttgtgtgcctggcttccatgggtgggcgacagctgccctgctcatcaccttttgcttcggatgggtcctgattccggcctgtacgcttgctatcctgctcgtgctgaagtttttcgccaatattctgcacacatctaaccaggagaatcggtttaaagctatcctccgcaagatcaaagaagagttcgaaaagaccaaaggcagcatggtttgcgagatttgtaagtacgaatgcgagaccctgaaggagcttaaagcccacaacctgtcctgcgtgcaaggggaatgtccctattgctttacacattgtgagcctaccgaaacagcgatccaggcccactacaaggtctgccaggctacgcatagattccgggaggacctcaaaaagaccgtgacaccccagaatattggccctggatgttatagaaccctgaacctgttccgctacaaatctcggtgctatatccttacaatgtggaccctcctgctgattatcgagagcatcctctgggccgcttccgccgcggaaattcccctggtgccgctttggacggataatgcccacggcgttgggagcgtccctatgcataccgacctggagctcgacttttctctgccctccagctctaagtacacatataagagacacctgaccaaccctgtgaatgatcaacagtccgtgagccttcacatcgaaattgagtctcagggaatcggcgctgacgtccatcacctcgggcattggtacgatgcccgcctgaacctgaaaacatctttccactgttacggagcttgcaccaagtatcagtacccctggcacacggccaaatgtcattttgaaaaggactatgagtacgagaactcctgggcctgcaatcctcccgattgtccgggcgtggggacaggctgcaccgcttgcggactctatctggaccaacttaaacctgttggcacagcgttcaagattatcagcgtgcggtactctagaaaggtctgtatgcagtttggggaagagtatctgtgcaaaaccatcgatatgaacgactgtttcgtgacccgccacgccaagatttgcatcattggaacagtttccaaatttagccagggcgatacgctcctgttcctggggcccatggaaggaggcgggatcatttttaagcattggtgtacctccacatgccacttcggcgaccccggagatgtgatgggccctaaagacaagccgtttatctgtcccgagttccctgggcagtttcggaaaaagtgcaatttcgctaccacacccatttgtgaatacgacggaaacatcatctctggctacaagaaagtccttgccaccattgatagcttccaatcctttaatacgtctaacatccatttcacagacgagagaattgagtggcgcgatcctgacgggatgctccgggatcacatcaatattgtgatcagcaaggacatcgattttgaaaacctggccgagaatccctgcaaagttggactgcaggctgccaacattgaaggcgcgtgggggtccggcgtgggattcaccctcacctgtcaggtctctctgacagagtgccctacctttcttacaagcatcaaggcttgcgacatggccatttgttatggcgccgaatccgtgacgctgagcagagggcaaaataccgtgcgcatcacaggacggggcgggcactctggatccagcttcaaatgctgtcatggcaaggagtgttcttccaccggcctccaggctagcgctccccacctggataaggtcaacgggatttctgagctggaaaatgagaaagtttacgacgatggagcgccggaatgcggcgtgacatgctggtttaagaaatccggggagtgggtgatgggaatcatcaacggcaattgggtcgtgcttattgttctctgtgtgctgcttctcttcagcctgatccttctgtccattctctgccctgtcagaaagcataaaaagagctga

SEQ ID NO: 13499 - RNA, 3402 nt, synthetic construct
  misc_feature 1..3402: note = derived and/or modified CDS sequence (opt5) from SEOV(K24-v2)__AF288654.1__GP
  source 1..3402: mol_type = other RNA
atgtggagcctgctcctgcttgccgctctggtgggccaggggttcgccctcaagaacgtctttgacatgagaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaaactgaccaaggtcgtgtggcggaaaaaggctaatcaagaaagcgccaaccagaatagctttgaggttgtggagagcgaagtctctttcaaagggctctgcatgctgaagcaccgcatggtggaggaatcctatagaaaccggcgcagcgttatctgttacgaccttgcctgcaattctacattttgtaagcctaccgtgtatatgattgtccccatccatgcttgcaacatgatgaaatcctgtctgattggactcggcccttacagaatccaggtggtgtatgagcggacatactgcaccacagggatcctgaccgagggaaagtgtttcgtccccgatacggccgttgtgagcgctcttaaacgcggcatgtatgccattgcgtctatcgaaaccatttgctttttcatccaccagaagggcaatacatacaaaattgtgaccgccatcacatccgctatggggagcaagtgtaacaataccgacacgaaggtccaaggatactatatttgcatcatcggcgggaactccgcccctgtgtacgctccggccggagaggattttagagcgatggaagttttctctggcattatcacaagcccccatggggacgatcacgacctgcctggagaggaaattgccccctatcagatctccggccagattgaggctaaaatccctcacaccgtgagctctaagaatctcaaactgatcgcctttgctggcattccctcctacagctctacaagcatcctggccgcctccgaggatgggcggttcattttctctccgggactcttccctaacctgaaccagagcgtctgcgacaataacgcgcttcccctgatctggcgcggcctcattgatctgaccgggtattacgaagctgtgcatccttgtaatgttttctgcgtgctttccggacccggcgccagctgtgaggctttttctgaagggggaatcttcaacatcacctcccccatgtgcctggtcagcaagcaaaatagatttcgggccgccgagcagcagatttctttcatctgtcaacgcgtggacatggatattatcgtctattgcaacgaccagaaaaagacaattctcacgaaaaccctggtgatcggccagtgtatttacacaatcacctccctgtttagcctcctgcctggcgttgctcactccatcgccattgaactttgcgtgccggggttccatggatgggcgacagctgccctgctcatcaccttttgtttcggctgggtcctgattcccgcctgcacgcttgctatcctgctcgtgctgaagtttttcgccaatattctgcacacatctaaccaggagaatagatttaaggctatcctccggaaaatcaaggaggaatttgagaaaaccaaggggagcatggtttgtgaaatttgcaaatacgagtgcgaaaccctgaaggagcttaaggcccacaacctgtcctgtgtgcaaggagagtgcccttattgttttacacattgcgaacccaccgagacagcgatccaggcccactacaaagtctgtcaggctacgcatcgcttcagagaagacctcaagaaaaccgtgacacctcagaatattggccccgggtgctatcggaccctgaacctgttcagatacaagtctcgctgttatatccttacaatgtggaccctcctgctgattatcgagagcatcctctgggccgcttccgccgcggagattccgctggtgcctctttggacggataatgcccacggcgttggaagcgtccccatgcataccgacctggaactcgatttttctctgccttccagctctaaatacacatataagcggcacctgaccaaccccgtgaatgaccaacagtccgtgagccttcacatcgagattgaatctcagggcatcggggctgatgtccatcacctcggacattggtacggcgccagactgaacctgaagacatccttccactgctacggggcttgtaccaaatatcagtacccttggcacacggccaagtgccattttgagaaagactatgaatacgagaactcctgggcctgtaatcccccggattgccctggagtgggcacagggtgcaccgcttgtggcctctatctggaccaacttaagcccgttggaacagcgttcaaaattatcagcgtgcgctactctcggaaggtctgcatgcagtttggcgaggaatatctgtgtaagaccatcgatatgaacgactgcttcgtgaccagacacgccaaaatttgtatcattgggacagtttccaagtttagccagggagatacgctcctgttcctgggccccatggaagggggaggcatcatttttaaacattggtgcacctccacatgtcacttcggggaccctggcgacgtgatgggaccgaaggataaaccctttatctgccctgagttccccggccagtttcgcaagaaatgtaatttcgctaccacacctatttgcgagtacgacgggaacatcatctctggatacaagaaggtccttgccaccattgatagcttccaatcctttaatacgtctaacatccatttcacagacgaacggattgagtggagagatcccgacggcatgctccgcgatcacatcaatattgtgatcagcaaagacatcgattttgagaacctggccgaaaatccttgtaaggttgggctgcaggctgccaacattgagggagcgtggggctccggggtgggcttcaccctgacctgccaggtctctctgacagaatgccccacctttcttacaagcatcaaggcttgtgacatggccatttgctatggagccgagtccgtgacgctgagccggggccaaaataccgtgagaatcacagggaaaggaggccactctgggtccagcttcaaatgttgccatggaaaggaatgttcttccaccggcctccaggctagcgccccgcacctggataaggtcaacggcatttctgagctggagaatgaaaaagtttacgacgatggggcgcctgagtgcggagtgacatgttggtttaagaaatccggcgaatgggtgatggggatcatcaacggaaattgggtcgtgcttattgttctctgcgtgctgctcctcttcagcctgatccttctgtccattctctgtcccgtccgcaagcataaaaagagctga

SEQ ID NO: 13500 - RNA, 3402 nt, synthetic construct
  misc_feature 1..3402: note = derived and/or modified CDS sequence (opt5) from SEOV(KI-83-262)__D17592.1__GP
  source 1..3402: mol_type = other RNA
atgtggagcctgctcctgcttgccgctctggtgggccaggggttcgccctcaagaacgtctttgacatgagaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaaactgaccaaggtcatctggcggaaaaaggctaatcaagaaagcgccaaccaaaattcctttgaggtggttgagagcgaagtgtctttcaaagggctctgcatgctgaagcaccgcatggtcgaggaatcctatagaaaccggcgcagcgtgatttgttacgaccttgcctgcaattctacattttgtaagcctaccgtttatatgatcgtgcccattcatgcttgcaacatgatgaaatcctgtctgatcggactcggcccttacagaatccaggtcgtgtatgagcggacatactgcaccacagggattctgaccgagggaaagtgtttcgtgcccgataaagccgtcgttagcgctcttaagcgcggcatgtatgccatcgcgtctattgaaacgatctgctttttcattcaccagaaaggcaatacctacaagatcgtgacagccattacctccgctatggggagcaagtgtaacaatacagacaccaaagtgcagggatactatatctgcatcattggcgggaactccgcccctgtctacgctccggccggagaggattttagagcgatggaagtgttctctggcatcattacgagcccccatggggaggaccacgatctgcctggagaagagatcgccacatatcagatttccggccagatcgaggctaagatcccccacaccgttagctctaaaaatctcaagctgacagcctttgctggcattccttcctacagctctaccagcatcctggccgcctccgaagacgggcggttcatttttagccccggactcttcccgaacctgaaccagagcgtgtgcgataataacgcccttcctctgatctggcgcggcctcattgacctgaccgggtattacgaggcggtccatccctgtaatgtgttctgcgttctttccggacctggcgccagctgtgaggctttttctgaagggggaatcttcaacatcacatcccccatgtgcctggtgagcaaacaaaatagatttcgggccgccgaacagcagatttctttcgtctgtcaacgcgtggatatggacatcattgtctattgcaacggccagaagaaaacgatcctcaccaagacactggtgattggccagtgtatctacaccattacatccctgtttagcctcctgcccggggttgctcactccatcgccatcgagctttgcgtgcctggattccatggctgggcgaccgctgccctgctcattacgttttgtttcgggtgggtcctgatcccggcctgcacacttgctattctgctcgtgctgaagtttttcgccaatatcctgcacacctctaaccaggagaatagatttaaagctattctccggaagatcaaagaagagttcgaaaagaccaaaggaagcatggtttgtgagatctgcaagtacgaatgcgagacactgaaggagcttaaagcccacaacctgtcctgtgtgcaaggcgaatgcccctattgttttacccattgcgagcctacagaaacggcgattcaggcccactacaaggtctgtcaggctacccatcgcttcagagaggatctcaaaaagacagtgacaccccagaatatcgggcctggctgctatcggaccctgtctctgttcagatacaaaagccgctgttatattcttaccatgtggacgctcctgctgatcattgagtccatcctctgggccgctagcgccgcggaaatccccctggtgccgctttggaccgacaacgcccacggagttggctctgtccctatgcatacagacctggagctcgatttttccctgccctcttcttccaagtacacctataagcggcacctgacaaatcctgtgaacgaccaacagagcgtgtctcttcacattgaaatcgagagccaggggattggagctgatgtccatcacctcggccattggtacgacgccagactgaatctgaaaacctccttccactgctacggggcttgtacgaagtatcagtacccctggcacacagccaaatgccattttgaaaaggattatgagtacgagaacagctgggcctgtaaccctcccgactgcccgggagtgggcaccgggtgcacagcttgtggcctctatctggatcaacttaaacctgttggaaccgcgttcaagatcatttctgtgcgctactcccggaaggtctgcgtgcagtttggcgaagagtatctgtgtaaaaccatcgacatgaatgattgcttcgttacaagacacgccaagatctgtattatcgggacggtgagcaaattttcccagggagacaccctcctgttcctgggccccatggaagggggaggcattatctttaagcattggtgcacatctacctgtcacttcggggatcccggcgacgtcatgggacctaaagacaagccgtttatttgccccgagttccctggccagtttcgcaaaaagtgtaacttcgctacaacccccgtgtgcgaatacgatgggaatatcattagcggatacaagaaagttcttgccacgatcgactccttccaatcttttaacacaagcaatatccatttcaccgatgagcggattgagtggagagaccctgatggcatgctccgcgaccacatcaacattgtgatctccaaggatattgactttgaaaatctggccgagaacccctgtaaagtcgggctgcaggctgccaatatcgaaggagcgtggggctctggggtgggcttcaccctcacatgccaggtgagcctgaccgagtgccctacatttcttacgtccatcaaggcttgtgatatggccatttgctatggagccgaaagcgtcaccctgtctcggggccaaaacacagttaaaatcaccgggaagggaggccactccgggagctctttcaagtgttgccatggaaaagagtgttccagcacaggcctccaggcttctgctccccacctggacaaggtgaatggcatttccgagctggaaaacgagaaagtgtacgatgacggggcgccggaatgcggaatcacctgttggtttaagaaaagcggcgagtgggtcatggggattatcaatggaaactgggtggttcttatcgtgctctgcgtcctgctcctgttctccctgattcttctgagcatcctctgtcctgtgagaaagcataagaaatcttga

SEQ ID NO: 13501 - RNA, 3402 nt, synthetic construct
  misc_feature 1..3402: note = derived and/or modified CDS sequence (opt5) from SEOV(KI-85-1)__D17593.1__GP
  source 1..3402: mol_type = other RNA
atgtggagcctgctcctgcttgccgctctggtgggccaggggttcgccctcaagaacgtctttgacatgagaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaaactgaccaaggtcatctggcggaaaaaggctaatcaagaaagcgccaaccaaaattcctttgaggtggttgagagcgaagtgtctttcaaagggctctgcatgctgaagcaccgcatggtcgaggaatcctatagaaaccggcgcagcgtgatttgttacgaccttgcctgcaattctacattttgtaagcctaccgtttatatgatcgtgcccattcatgcttgcaacatgatgaaatcctgtctgatcggactcggcccttacagaatccaggtcgtgtatgagcggacatactgcaccacagggattctgaccgagggaaagtgtttcgtgcccgataaagccgtcgttagcgctcttaagcgcggcatgtatgccatcgcgtctattgaaacgatctgctttttcattcaccagaaaggcaatacctacaagatcgtgacagccattacctccgctatggggagcaagtgtaacaatacagacaccaaagtgcagggatactatatctgcatcattggcgggaactccgcccctgtctacgctccggccggagaggattttagagcgatggaagtgttctctggcatcattacgagcccccatggggaggaccacgatctgcctggagaagagatcgccacatatcagatttccggccagatcgaggctaagatcccccacaccgttagctctaaaaatctcaagctgacagcctttgctggcattccttcctacagctctaccagcatcctggccgcctccgaagacgggcggttcatcttttctcccggactcttcccgaacctgaaccagagcgtgtgcgataataacgcgcttcctctgatttggcgcggcctcattgacctgaccgggtattacgaggctgtccatccctgtaatgtgttctgcgttctttccggacctggcgccagctgtgaggctttttctgaagggggaatcttcaacatcacatcccccatgtgcctggtgagcaaacaaaatagatttcgggccgccgaacagcagatttctttcgtctgtcaacgcgtggatatggacatcattgtctattgcaacggccagaagaaaacgatcctcaccaagacactggtgattggccagtgtatctacaccattacatccctgtttagcctcctgcccggggttgctcactccatcgccatcgagctttgcgtgcctggattccatggctgggcgaccgctgccctgctcattacgttttgtttcgggtgggtcctgatcccggcctgcacacttgctattctgctcgtgctgaagtttttcgccaatatcctgcacacctctaaccaggagaatagatttaaagctattctccggaagatcaaagaagagttcgaaaagaccaaaggaagcatggtttgtgagatctgcaagtacgaatgcgagacactgaaggagcttaaagcccacaacctgtcctgtgtgcaaggcgaatgcccctattgttttacccattgcgagcctacagaaacggcgattcaggcccactacaaggtctgtcaggctacccatcgcttcagagaggatctcaaaaagacagtgacaccccagaatatcgggcctggctgctatcggaccctgaacctgttcagatacaaatctcgctgttatattcttaccatgtggacgctcctgctgatcattgagagcatcctctgggccgcttccgccgcggaaatccccctggtgccgctttggaccgacaatgcccacggagttggcagcgtccctatgcatacagacctggagctcgatttttctctgccctccagctctaagtacacctataagcggcacctgacaaaccctgtgaatgaccaacagtccgtgagccttcacattgaaatcgagtctcaggggattggagctgatgtccatcacctcggccattggtacgacgccagactgaacctgaaaaccagcttccactgctacggggcttgtgccaagtatcagtacccctggcacacggccaaatgccattttgaaaaggattatgagtacgagaactcctgggcttgtaatcctcccgactgcccgggagtgggcacagggtgcaccgcgtgtggcctctatctggatcaacttaaacctgttggaacagccttcaagatcattagcgtgcgctactctcggaaggtctgcgtgcagtttggcgaagagtatctgtgtaaaaccatcgacatgaacgattgcttcgttaccagacacgctaagatctgtattatcgggacagtgtccaaatttagccagggagacacgctcctgttcctgggccccatggaagggggaggcattatctttaagcattggtgcacctccacatgtcacttcggggatcccggcgacgtcatgggacctaaagacaagccgtttatttgccccgagttccctggccagtttcgcaaaaagtgtaatttcgccaccacacccgtgtgcgaatacgatgggaacatcatttctggatacaagaaagttcttgccaccatcgacagcttccaatcctttaatacgtctaacatccatttcacagatgagcggattgagtggagagaccctgatggcatgctccgcgaccacatcaatattgtgatcagcaaggatattgactttgaaaacctggctgagaatccctgtaaagtcgggctgcaggccgcgaacatcgaaggagcttggggctccggggtgggcttcaccctgacctgccaggtgtctctgacagagtgccctacctttcttacaagcatcaaggcctgtgatatggccatttgctatggagctgaatccgtcacgctgagccggggccaaaataccgttaaaatcacagggaagggaggccactctgggtccagcttcaagtgttgccatggaaaagagtgttcttccaccggcctccaggccagcgcgccccacctggacaaggtgaacggcatttctgagctggaaaatgagaaagtgtacgatgacggggctccggaatgcggaatcacatgttggtttaagaaatccggcgagtgggtcatggggattatcaacggaaattgggtggttcttatcgtgctctgcgtcctgctcctcttcagctttattctgctttccatcctgtgtcctgtgagaaagcataagaaaagctga

SEQ ID NO: 13502 - RNA, 3402 nt, synthetic construct
  misc_feature 1..3402: note = derived and/or modified CDS sequence (opt5) from SEOV(KI-88-15)__D17594.1__GP
  source 1..3402: mol_type = other RNA
atgtggagcctgctcctgcttgccgctctggtgggccaggggttcgccctcaagaacgtctttgacatgagaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaaactgaccaaggtcatctggcggaaaaaggctaatcaagaaagcgccaaccaaaattcctttgagattgtggagagcgaagtttctttcaaagggctctgcatgctgaagcaccgcatggtggaggaatcctatagaaaccggcgcagcgtcatctgttacgaccttgcctgcaattctacattttgtaagcctaccgtgtatatgattgttcccatccatgcttgcaacatgatgaaatcctgtctgatcggactcggcccttaccggattcaggtggtctatgagagaacatactgcaccacagggatcctgaccgagggaaagtgtttcgtgcccgataaagccgtggtcagcgctcttaagcgcggcatgtatgccattgcgtctatcgaaacgatttgctttttcatccaccagaaaggcaatacctacaagattgttacagccatcacctccgctatggggagcaagtgtaacaatacagacaccaaagtgcagggatactatatctgcattatcggcgggaactccgcccctgtgtacgctccggccggagaggattttagagcgatggaagtcttctctggcattatcacgagcccccatggggaggaccacgatctgcctggagaagagattgccacatatcagatctccggccagatcgaggctaagattccccacaccgtgagctctaaaaatctcaagctgacagcctttgctggcatcccttcctacagctctaccagcattctggccgcctccgaagacgggcggttcatcttttctcccggactcttcccgaacctgaaccagagcgtttgcgataataacgcccttcctctgatttggcgcggcctcatcgacctgaccgggtattacgaggcggtgcatccctgtaatgtcttctgcgtgctttccggacctggcgccagctgtgaggctttttctgaagggggaatcttcaacattacatcccccatgtgcctggttagcaaacaaaatagatttcgggccgccgaacagcagatctctttcgtgtgtcaacgcgtcgatatggacattatcgtgtattgcaacggccagaagaaaacgattctcaccaagacactggtcatcggccagtgtatttacaccatcacatccctgtttagcctcctgcccggggtggctcactccatcgccattgagctttgcgttcctggattccatggctgggcgaccgctgccctgctcatcacgttttgtttcgggtgggtgctgattccggcctgcacacttgctatcctgctcgtcctgaagtttttcgccaatattctgcacacctctaaccaggagaatagatttaaagctatcctccggaagatcaaagaagagttcgaaaagaccaaaggaagcatggtgtgtgagatttgcaagtacgaatgcgagacactgaaggagcttaaagcccacaacctgtcctgtgttcaaggcgaatgcccctattgttttacccattgcgagcctacagaaacggcgatccaggcccactacaaggtgtgtcaggctacccatcgcttcagagaggatctcaaaaagacagtcacaccccagaatattgggcctggctgctatcggaccctgaacctgttcagatacaaatctcgctgttatatccttaccatgtggacgctcctgctgattatcgagagcatcctctgggccgcttccgccgcggaaattcccctggtgccgctttggaccgacaatgcccacggagtgggcagcgttcctatgcatacagacctggagctcgatttttctctgccctccagctctaagtacacctataagcggcacctgacaaaccctgtcaatgaccaacagtccgtgagccttcacatcgaaattgagtctcaggggatcggagctgatgtgcatcacctcggccattggtacgacgccagactgaacctgaaaaccagcttccactgctacggggcttgtacgaagtatcagtacccctggcacacagccaaatgccattttgaaaaggattatgagtacgagaactcctgggcctgtaatcctcccgactgcccgggagtcggcaccgggtgcacagcttgtggcctctatctggatcaacttaaacctgtgggaaccgcgttcaagattatcagcgttcgctactctcggaaggtgtgcgtccagtttggcgaagagtatctgtgtaaaaccatcgacatgaacgattgcttcgtgacaagacacgccaagatttgtatcattgggacggtttccaaatttagccagggagacaccctcctgttcctgggccccatggaagggggaggcatcatttttaagcattggtgcacatccacctgtcacttcggggatcccggcgacgtgatgggacctaaagacaagccgtttatctgccccgagttccctggccagtttcgcaaaaagtgtaatttcgctacaacccccgtctgcgaatacgatgggaacattatctctggatacaagaaagtgcttgccacgatcgacagcttccaatcctttaatacatctaacattcatttcaccgatgagcggatcgagtggagagaccctgatggcatgctccgcgaccacattaatatcgttattagcaaggatatcgactttgaaaacctggccgagaatccctgtaaagtggggctgcaggctgccaacatcgaaggagcgtggggctccggggtcggcttcaccctcacatgccaggtgtctctgaccgagtgccctacatttcttacgagcattaaggcttgtgatatggccatctgctatggagccgaatccgtgaccctgagccggggccaaaatacagtcaaaattaccgggaagggaggccactctgggtccagcttcaagtgttgccatggaaaagagtgttcttccacaggcctccaggctagcgctccccacctggacaaggttaacggcatctctgagctgaaaaatgaaaaggtgtacgatgacggggcgccggagtgcggaattacctgttggtttaaaaagtccggcgaatgggtgatggggatcatcaacggaaattgggtcgtgcttattgttctctgcgtgctgctcctgttcagctttatcctgctttccattctgtgtcctgtcagaaagcataaaaagagctga

SEQ ID NO: 13503 - RNA, 3402 nt, synthetic construct
  misc_feature 1..3402: note = derived and/or modified CDS sequence (opt5) from SEOV(LongwanRn581)__GU592930.1__GP
  source 1..3402: mol_type = other RNA
atgtggagcctgctcctgcttgccgctctggtgggccaggggttcgccctcaagaacgtctttgacatgagaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaaactgaccaaggtcatctggcggaaaaaggctaatcaagaaagcgccaaccaaaattcctttgaggtggttgagagcgaagtgtctttcaaagggctctgcatgctgaagcaccgcatggtcgaggaatcctatagaaaccggcgcagcgtgatttgttacgaccttgcctgcaattctacattttgtaagcctaccgtttatatgatcgtgcccattcatgcttgcaacatgatgaaatcctgtctgatcggactcggcccttacagaatccaggtcgtgtatgagcggacatactgcaccacagggattctgaccgagggaaagtgtttcgtgcccgataaagccgtcgttagcgctcttaagcgcggcatgtatgccatcgcgtctattgaaacgatctgctttttcattcaccagaaaggcaatacctacaagatcgtgacagccattacctccgctatggggagcaagtgtaacaatacagacaccaaagtgcagggatactatatctgcatcattggcgggaactccgcccctgtctacgctccggccggagaggattttagagcgatggaagtgttctctggcatcattacgagcccccatggggaggaccacgatctgcctggagaagagatcgccacatatcagatttccggccagatcgaggctaagatcccccacaccgttagctctaaaaatctcaagctgacagcctttgctggcattccttcctacagctctaccagcatcctggccgcctccgaagacgggcggttcatcttttctcccggactcttcccgaacctgaaccagagcgtgtgcgataataacgcccttcctctgatttggcgcggcctcattgacctgaccgggtattacgaggcggtccatccctgtaatgtgttctgcgttctttccggacctggcgccagctgtgaggctttttctgaagggggaatcttcaacatcacatcccccatgtgcctggtgagcaaacaaaatagatttcgggccgccgaacagcagatttctttcgtctgtcaacgcgtggatatggacatcattgtctattgcaacggccagaagaaaacgatcctcaccaagacactggtgattggccagtgtatctacaccattacatccctgtttagcctcctgcccggggttgctcactccatcgccatcgagctttgcgtgcctggattccatggctgggcgaccgctgccctgctcattacgttttgtttcgggtgggtcctgatcccggcctgcacacttgctattctgctcgtgctgaagtttttcgccaatatcctgcacacctctaaccaggagaatagatttaaagctattctccggaagatcaaagaagagttcgaaaagaccaaaggaagcatggtttgtgagatctgcaagtacgaatgcgagacactgaaggagcttaaagcccacaacctgtcctgtgtgcaaggcgaatgcccctattgttttacccattgcgagcctacagaaacggcgattcaggcccactacaaggtctgtcaggctacccatcgcttcagagaggatctcaaaaagacagtgacaccccagaatatcgggcctggctgctatcggaccctgaacctgttcagatacaaatctcgctgttatattcttaccatgtggacgctcctgctgatcattgagagcatcctctgggccgcttccgccgcggaaatccccctggtgccgctttggaccgacaatgcccacggagttggcagcgtccctatgcatacagacctggagctcgatttttctctgccctccagctctaagtacacctataagcggcacctgacaaaccctgtgaatgaccaacagtccgtgagccttcacattgaaatcgagtctcaggggattggagctgatgtccatcacctcggccattggtacgacgccagactgaacctgaaaaccagcttccactgctacggggcttgtacgaagtatcagtacccctggcacacagccaaatgccattttgaaaaggattatgagtacgagaactcctgggcctgtaatcctcccgactgcccgggagtgggcaccgggtgcacagcttgtggcctctatctggatcaacttaaacctgttggaaccgcgttcaagatcattagcgtgcgctactctcggaaggtctgcgtgcagtttggcgaagagtatctgtgtaaaaccatcgacatgaacgattgcttcgttacaagacacgccaagatctgtattatcgggacggtgtccaaatttagccagggagacaccctcctgttcctgggccccatggaagggggaggcattatctttaagcattggtgcacatccacctgtcacttcggggatcccggcgacgtcatgggacctaaagacaagccgtttatttgccccgagttccctggccagtttcgcaaaaagtgtaatttcgctacaacccccgtgtgcgaatacgatgggaacatcatttctggatacaagaaagttcttgccacgatcgacagcttccaatcctttaatacatctaacatccatttcaccgatgagcggattgagtggagagaccctgatggcatgctccgcgaccacatcaatattgtgatcagcaaggatattgactttgaaaacctggccgagaatccctgtaaagtcgggctgcaggctgccaacatcgaaggagcgtggggctccggggtgggcttcaccctcacatgccaggtgtctctgaccgagtgccctacatttcttacgagcatcaaggcttgtgatatggccatttgctatggagccgaatccgtcaccctgagccggggccaaaatacagttaaaatcaccgggaagggaggccactctgggtccagcttcaagtgttgccatggaaaagagtgttcttccacaggcctccaggctaacgctccccacctggacaaggtgaatggcattagcgagctggaaaacgagaaagtgtacgatgacggggcgccggaatgcggagtcacctgttggtttaagaaatctggcgagtgggtgatggggatcattaatggaaactgggttgtgcttatcgtcctctgcgtgctgctcctgttctccctgatccttctgagcattctctgtcctgttagaaagcataagaaatcctga

SEQ ID NO: 13504 - RNA, 3402 nt, synthetic construct
  misc_feature 1..3402: note = derived and/or modified CDS sequence (opt5) from SEOV(RuianRn180)__GU592931.1__GP
  source 1..3402: mol_type = other RNA
atgtggagcctgctcatcgtggccgctctggtcggccaggggttcgcccttaagaacgtttttgacatgagaatccaatgcccccactccgtgaatttcggagagacctctgtgagcggctacacagaactgcctccgctctccctgcaggaggcggaacagcttgtccccgagtctagctgtaacatggataatcatcagtccctgtctacgattaacaaactcaccaaggtgatttggcggaaaaaggctaatcaagaaagcgccaaccaaaattcctttgaggttgtggagagcgaagtctctttcaaagggctgtgcatgctgaagcaccgcatggtggaggaatcctatagaaaccggcgcagcgttatctgttacgacctcgcctgcaattctacattttgtaagcctaccgtgtatatgattgtccccatccatgcttgcaacatgatgaaatcctgtctgatcggacttggcccttaccggattcaggtggtgtatgagagaacatactgcaccacagggatcctgaccgagggaaagtgtttcgtccccgataaagccgttgtgagcgctctcaagcgcggcatgtatgccattgcgtctatcgaaacgatttgctttttcatccaccagaaaggcaatacctacaagattgtgacagccatcacctccgctatggggagcaagtgtaacaatacagacaccaaagtccagggatactatatctgcattatcggcgggaactccgcccctgtgtacgctccggccggagaggattttagagcgatggaagttttctctggcattatcacgagcccccatggggaggaccacgatctgcctggagaagagattgccacatatcagatctccggccagatcgaggctaagattccccacaccgtgagctctaaaaatcttaagctgacagcctttgctggcatcccttcctacagctctaccagcattctcgccgcctccgaagacgggcggttcatcttttctcccggactgttcccgaacctgaaccagagcgtctgcgataataacgctctccctctgatttggcgcggccttatcgacctgaccgggtattacgaggcggtgcatccctgtaatgttttctgcgtgctctccggacctggcgccagctgtgaggctttttctgaagggggaatcttcaacattacatcccccatgtgcctggtcagcaaacaaaatagatttcgggccgccgaacagcagatctctttcatttgtcaacgcgtggatatggacatcattgtctattgcaacggccagaagaaaacgatccttaccaagacactggtgattggccagtgtatctacaccatcacatccctctttagcctgctgcccggggttgctcactccattgccatcgagctctgcgtgcctggattccatggctgggcgaccgctgccctgcttattacgttttgtttcgggtgggtcctgatcccggcctgcacactcgctattctgcttgtgctgaagtttttcgccaatatcctccacacctctaaccaggagaatagatttaaagctatcctgcggaagattaaagaagagttcgaaaagaccaaaggaagcatggtttgtgagatctgcaagtacgaatgcgagacactgaaggagctcaaagcccacaacctgtcctgtgtgcaaggcgaatgcccctattgttttacccattgcgagcctacagaaacggcgattcaggcccactacaaggtctgtcaggctacccatcgcttcagagaggatcttaaaaagacagtgacaccccagaatatcgggcctggctgctatcggaccctgaacctcttcagatacaaatctcgctgttatattctgaccatgtggacgctgcttctcatcatcgagagcattctgtgggccgcttccgccgcggaaatccccctggtgccgctctggaccgacaatgcccacggagttggcagcgtccctatgcatacagacctggagcttgatttttctctgccctccagctctaagtacacctataagcggcacctcacaaaccctgtgaatgaccaacagtccgtgagcctgcacattgaaatcgagtctcaggggattggagctgatgtccatcacctgggccattggtacgacgccagacttaacctcaaaaccagcttccactgctacggggcttgtacgaagtatcagtacccctggcacacagccaaatgccattttgaaaaggattatgagtacgagaactcctgggcctgtaatcctcccgactgcccgggagtgggcaccgggtgcacagcttgtggcctgtatctggatcaactcaaacctgttggaaccgcgttcaagatcatcagcgtgcgctactctcggaaggtctgcgtgcagtttggcgaagagtatctgtgtaaaaccattgacatgaacgattgcttcgttacaagacacgccaagatctgtattatcgggacggtgtccaaatttagccagggagacacccttctgttcctcggccccatggaagggggaggcattatctttaagcattggtgcacatccacctgtcacttcggggatcccggcgacgtcatgggacctaaagacaagccgtttatttgccccgagttccctggccagtttcgcaaaaagtgtaatttcgctacaacccccgtgtgcgaatacgatgggaacatcatctctggatacaagaaagttctggccacgattgacagcttccaatcctttaatacatctaacatccatttcaccgatgagcggattgagtggagagaccctgatggcatgctgcgcgaccacatcaatattgtgatcagcaaggatatcgactttgaaaaccttgccgagaatccctgtaaagtcgggctccaggctgccaacattgaaggagcgtggggctccggggtgggcttcaccctgacatgccaggtgtctctgaccgagtgccctacatttctcacgagcatcaaggcttgtgatatggccatttgctatggagccgaatccgtcaccctgagccggggccaaaatacagttaaaatcaccgggaagggaggccactctgggtccagcttcaagtgttgccatggaaaagagtgttcttccacaggccttcaggctagcgcgccccacctggacaaggtgaacggcatttctgagctcgaaaatgagaaagtgtacgatgacggggccccggaatgcggagtcacctgttggtttaagaaatccggcgagtgggtgatggggatcatcaacggaaattgggttgtgctgattgtcctgtgcgtgcttctcctgttcagcctgatcctcctgtccattctttgtcctgttagaaagcataagaaaagctga

SEQ ID NO: 13505 - RNA, 3402 nt, synthetic construct
  misc_feature 1..3402: note = derived and/or modified CDS sequence (opt5) from SEOV(ShuangyangRn470)__GU592925.1__GP
  source 1..3402: mol_type = other RNA
atgtggagccttctcttcctggccgctcttgtgggccaggggtttgccctgaagaacgtcttcgacatgagaatccaatgcccccactccgttaattttggagagacctctgtgagcggctacacagaactccctccgctgtcccttcaggagtctgaacagctggtgcccgagagctcctgtaacatggataatcatcagtctctcagcacgattaacaaactgaccaaggtcatctggcggaaaaaggcgaatcaagaatccgctaaccagaatagcttcgaggtggttgagtctgaagtgtcctttaaagggctgtgcatgctcaagcaccgcatggtcgaggaaagctatagaaaccggcgctctgtgatttgttacgacctggcctgcaattccacattctgtaagcctaccgtttatatgatcgtgcccattcatgcctgcaacatgatgaaaagctgtcttatcggactgggcccttacagaatccaggtcgtgtatgagcggacatactgcaccacagggattctcaccgagggaaagtgttttgtgcccgataaagctgtcgtttctgccctgaagcgcggcatgtatgctatcgcctccattgaaacgatctgcttctttattcaccagaaaggcaatacctacaagatcgtgacagcgattaccagcgccatggggtccaagtgtaacaatacagacaccaaagtgcaaggatactatatctgcatcattggcgggaactctgctcctgtctacgccccggctggagaggatttcagagccatggaagtgtttagcggcatcattacgagcccccatggggaggaccacgatcttcctggagaagagatcgcgacatatcagattagcggccagatcgaggccaagatcccccacaccgtttcttccaaaaatctgaagctcacagctttcgccggcattcctagctactctagcacctccatcctggctgcctctgaagacgggcggtttattttcagccccggactgttcccgaacctcaaccagtccgtgtgcaataacaatgccctgcctcttatctggcgcggcctgattgatctcaccgggtattacgaggctgtccatccctgtaacgtgttttgcgttctgagcggacctggcgcgtcttgtgaagccttctccgaagggggaatctttaatatcacaagccccatgtgccttgtgtctaaacaaaacagattccgggctgccgagcagcagatttcctttgtctgtcaacgcgtggacatggatatcattgtctattgcaatggccagaagaaaacgatcctgaccaagacactcgtgattggccagtgtatctacaccattacaagcctgttctccctgctccccggggttgcccactctatcgctatcgagctgtgcgtgcctggatttcatggctgggccaccgcggctctgctgattacgttctgttttgggtgggtcctcatcccggcctgcacactggccattcttctggtgctcaagttctttgctaacatcctgcacaccagcaatcaggagaacagattcaaagccattctgcggaagatcaaagaagagtttgaaaagaccaaaggatccatggtttgtgagatctgcaagtacgaatgcgagacactcaaggagctgaaagctcacaatctttcttgtgtgcaaggcgaatgcccctattgtttcacccattgcgagcctacagaaacggccattcaggcgcactacaaggtctgtcaggccacccatcgcttcagagaggacctgaaaaagacagtgacaccccagaacatcgggcctggctgctatcggaccctcaatctgtttagatacaaaagccgctgttatattctgaccatgtggacgcttctcctgatcgtggagtccattctgtgggctgccagcgctgccgaaatccccctcgttccgctgtggaccgataacgcgcacggagtcggctctgtgcctatgcatacagaccttgagctggacttctccctcccctcctcttccaagtacacctataagcggcacctgacaaatcctgtgaacgatcaacagagcgtctctctgcacatcgaaattgagagccaggggatcggagccgacgtgcatcaccttggccattggtacgatgctagactcaacctgaaaacctcctttcactgctacggggcctgtacgaagtatcagtacccctggcacacagctaaatgccatttcgaaaaggactatgagtacgagaatagctgggcctgtaaccctcccgattgcccgggagttggcaccgggtgcacagcctgtggcctgtatctcgaccaactgaaacctgtgggaaccgcttttaagattatctctgtccgctactcccggaaggtgtgcgttcagttcggcgaagagtatctttgtaaaaccattgatatgaatgactgctttgtgacaagacacgcgaagatctgtatcattgggacggtcagcaaattctcccagggagataccctgctctttctgggccccatggaagggggaggcatcattttcaagcattggtgcacatctacctgtcactttggggaccccggcgatgtgatgggacctaaagacaagccgttcatctgccccgagtttcctggccagttccgcaaaacatgtaacttcgccaccacgcccgtttgcgaatacgacgggaatattatcagcggatacaagaaggtgctggctacaattgattcctttcaatctttcaacaccagcaatatccattttaccgacgagcggatcgagtggagagatcctgacggcatgcttcgcgatcacattaacatcgtcatttccaaagacatcgatttcgaaaatctcgccgagaacccctgtaaggtggggctgcaggccgctaatattgaaggagcctggggctctggggtgggctttacactgacctgccaggtcagcctcacagagtgccctacgttcctgacctccatcaaagcgtgtgacatggctatctgctatggagccgaaagcgttacactttctcggggccaaaacaccgtgaagattacagggaaaggaggccactccgggagctcttttaagtgttgccatggaaaggagtgttccagcaccggcctgcaggcctctgctccccacctcgataaagtgaatggcatctccgagctggaaaacgagaaggtctacgacgatggggccccggaatgcggagtgacgtgttggttcaaaaagagcggcgagtgggttatggggattatcaatggaaactgggtggtcctgattgtgctttgcgttctcctgctgttttccctcatcctgcttagcatcctgtgtcctgtgagaaaacataagaagtcttga

SEQ ID NO: 13506 - RNA, 3402 nt, synthetic construct
  misc_feature 1..3402: note = derived and/or modified CDS sequence (opt5) from SEOV(WuhanMm13)__JQ665886.1__GP
  source 1..3402: mol_type = other RNA
atgtggagcctgctcctgcttgccgctctggtgggccaggggttcgccctcaagaacgtctttgacatgagaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaaactgaccaaggtcatctggcggaaaaaggctaatcaagaaagcgccaaccaaaattcctttgaggtgattgagagcgaagtttctttcaaagggctctgcatgctgaagcaccgcatggtggaggaatcctatagaaaccggcgcagcgtcatctgttacgaccttgcctgcaattctacattttgtaagcctaccgtgtatatgattgttcccatccatgcttgcaacatgatgaaatcctgtctgatcggactcggcccttaccggattcaggtggtctatgagagaacatactgcaccacagggatcctgaccgagggaaagtgtttcgtgcccgataaagccgtggtcagcgctcttaagcgcggcatgtatgccgttgcgtctattgaaacgatctgctttttcattcaccagaaaggcaatacctacaagatcgtgacagccattacctccgctatggggagcaagtgtaacaatacagacaccaaagtgcagggatactatatctgcatcattggcgggaactccgcccctgtctacgctccggccggagaggattttagagcgatggaagtgttctctggcatcattacgagcccccatggggaggaccacgatctgcctggagaagagatcgccacatatcagatttccggccagatcgaggctaagatcccccacaccgttagctctaaaaatctcaagctgacagcctttgctggcattccttcctacagctctaccagcatcctggccgcctccgaagacgggcggttcatcttttctcccggactcttcccgaacctgaaccagagcgtgtgcgataataacgcccttcctctgatttggcgcggcctcattgacctgaccgggtattacgaggcggtccatccctgtaatgtgttctgcgttctttccggacctggcgccagctgtgaggctttttctgaagggggaatcttcaacatcacatcccccatgtgcctggtgagcaaacaaaatagatttcgggccgccgaacagcagatttctttcgtctgtcaacgcgtggatatggacatcattgtctattgcaacggccagaagaaaacgatcctcaccaagacactggtgattggccagtgtatctacaccattacatccctgtttagcctcctgcccggggttgctcactccatcgccatcgagctttgcgtgcctggattccatggctgggcgaccgctgccctgctcacgacattttgtttcgggtgggtcctgattccggcctgcacccttgctatcctgctcgtgctgaagtttttcgccaatattctgcacacctctaaccaggagaatagatttaaagctatcctccggaagattaaagaagagttcgaaaagacaaaaggaagcatggtttgtgagatctgcaagtacgaatgcgagaccctgaaggagcttaaagcccacaacctgtcctgtgtgcaaggcgaatgcccctattgttttacacattgcgagcctacggaaaccgcgatccaggcccactacaaggtctgtcaggctacacatcgcttcagagaggatctcaaaaagaccgtgacaccccagaatattgggcctggctgctatcggaccctgaacctgttcagatacaaatctcgctgttatatccttacgatgtggaccattctcctgatcattgagagcatcctgtgggccgcttccgccgcggaaatccccctcgtgccgctgtggacagacaatgcccacggagttggcagcgtccctatgcataccgaccttgagctggatttttctctcccctccagctctaagtacacatataagcggcacctgaccaaccctgtgaatgaccaacagtccgtgagcctgcacattgaaatcgagtctcaggggattggagctgatgtccatcaccttggccattggtacgacgccagactcaacctgaaaacgagcttccactgctacggggcttgtacaaagtatcagtacccctggcacaccgccaaatgccattttgaaaaggattatgagtacgagaactcctgggcctgtaatcctcccgactgcccgggagtgggcacagggtgcaccgcttgtggcctgtatctcgatcaactgaaacctgttggaaccgcgttcaagatcattagcgtgcgctactctcggaaggtctgcgtgcagtttggcgaagagtatctttgtaaaacaatcgacatgaacgattgcttcgttacgagacacgccaagatctgtattatcgggaccgtgtccaaatttagccagggagacacactcctgttcctgggccccatggaagggggaggcattatctttaagcattggtgcacctccacatgtcacttcggggatcccggcgacgtcatgggacctaaagacaagccgtttatttgccccgagttccctggccagtttcgcaaaaagtgtaatttcgctaccacgcccgtgtgcgaatacgatgggaacatcatttctggatacaagaaagttctggccacaatcgacagcttccaatcctttaatacctctaacatccatttcaccgatgagcggattgagtggagagaccctgatggcatgcttcgcgaccacatcaatattgtgatcagcaaggatattgactttgaaaacctcgccgagaatccctgtaaagtcgggctgcaggctgccaacatcgaaggagcgtggggctccggggtgggcttcacactgacctgccaggtgtctctcacagagtgccctacgtttctgaccagcatcaaggcttgtgatatggccatttgctatggagccgaatccgtcacacttagccggggccaaaataccgttaaaatcacagggaagggaggccactctgggtccagcttcaagtgttgccatggaaaagagtgttcttccaccggcctgcaggctagcgctccccacctcgacaaggtgaacggcatttctgagctggaaaatgagaaagtgtacgatgacggggcgccggaatgcggaatcacgtgttggtttaagaaatccggcgagtgggtcatggggattatcaacggaaattgggtggttctgatcgctctttgcgtgctcctgctgttcagcctcattctgctttccatcctgtgtcctgtcagaaagcataagaaaagctga

SEQ ID NO: 13507 - RNA, 3402 nt, synthetic construct
  misc_feature 1..3402: note = derived and/or modified CDS sequence (opt5) from SEOV(WuhanMm24)__JQ665887.1__GP
  source 1..3402: mol_type = other RNA
atgtggagcctgctcctgcttgccgctctggtgggccaggggttcgccctcaagaacgtctttgacatgagaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaaactgaccaaggtcatctggcggaaaaaggctaatcaagaaagcgccaaccaaaattcctttgaggtgatggagagcgaagtttctttcaaagggctctgcatgctgaagcaccgcatggtggaggaatcctatagaaaccggcgcagcgtcatttgttacgaccttgcctgcaattctacattttgtaagcctaccgtgtatatgatcgttcccattcatgcttgcaacatgatgaaatcctgtctgatcggactcggcccttacagaatccaggtggtctatgagcggacatactgcaccacagggattctgaccgagggaaagtgtttcgtgcccgataaagccgtggtcagcgctcttaagcgcggcatgtatgccatcgcgtctattgaaacgatctgctttttcattcaccagaaaggcaatacctacaagatcgttacagccattacctccgctatggggagcaagtgtaacaatacagacaccaaagtgcagggatactatatctgcatcattggcgggaactccgcccctgtgtacgctccggccggagaggattttagagcgatggaagtcttctctggcatcattacgagcccccatggggaggaccacgatctgcctggagaagagatcgccacatatcagatttccggccagatcgaggctaagatcccccacaccgtgagctctaaaaatctcaagctgacagcctttgctggcattccttcctacagctctaccagcatcctggccgcctccgaagacgggcggttcatcttttctcccggactcttcccgaacctgaaccagagcgtttgcgataataacgcccttcctctgatttggcgcggcctcattgacctgaccgggtattacgaggcggtgcatccctgtaatgtcttctgcgtgctttccggacctggcgccagctgtgaggctttttctgaagggggaatcttcaacatcacatcccccatgtgcctggttagcaaacaaaatagatttcgggccgccgaacagcagatttctttcgtgtgtcaacgcgtcgatatggacatcattgtgtattgcaacggccagaagaaaacgatcctcaccaagacactggtcattggccagtgtatctacaccattacatccctgtttagcctcctgcccggggtggctcactccatcgccatcgagctttgcgttcctggattccatggctgggcgaccgctgccctgctcattacgttttgtttcgggtgggtgctgatcccggcctgcacacttgctattctgctcgtcctgaagtttttcgccaatatcctgcacacctctaaccaggagaatagatttaaagctattctccggaagatcaaagaagagttcgaaaagaccaaaggaagcatggtgtgtgagatctgcaagtacgaatgcgagacactgaaggagcttaaagcccacaacctgtcctgtgttcaaggcgaatgcccctattgttttacccattgcgagcctacagaaacggcgattcaggcccactacaaggtgtgtcaggctacccatcgcttcagagaggatctcaaaaagacagtcacaccccagaatatcgggcctggctgctatcggaccctgaacctgttcagatacaaatctcgctgttatattcttaccatgtggacgctcctgctgatcattgagagcatcctctgggccgcttccgccgcggaaatccccctggtgccgctttggaccgacaatgcccacggagtgggcagcgttcctatgcatacagacctggagctcgatttttctctgccctccagctctcggtacacctataagagacacctgacaaaccctgtcaatgaccaacagtccgtgagccttcacattgaaatcgagtctcaggggattggagctgatgtgcatcacctcggccattggtacgacgcccgcctgaacctgaagaccagcttccactgctacggggcttgtacgaaatatcagtacccctggcacacagccaagtgccattttgaaaaagattatgagtacgagaactcctgggcctgtaatcctcccgactgcccgggagtcggcaccgggtgcacagcttgtggcctctatctggatcaacttaagcctgtgggaaccgcgttcaaaatcattagcgttcggtactctagaaaggtgtgcgtccagtttggcgaagagtatctgtgtaagaccatcgacatgaacgattgcttcgtgacacgccacgccaaaatctgtattatcgggacggtttccaagtttagccagggagacaccctcctgttcctgggccccatggaagggggaggcattatctttaaacattggtgcacatccacctgtcacttcggggatcccggcgacgtgatgggacctaaggacaaaccgtttatttgccccgagttccctggccagtttcggaagaaatgtaatttcgctacatctcccgtctgcgaatacgatgggaacatcattagcggatacaagaaggtgcttgccaccatcgactccttccaatcttttaatacgagcaacatccatttcacagatgagagaattgagtggcgcgaccctgatggcatgctccgggaccacatcaatattgttatctccaaagatattgactttgaaaacctggccgagaatccctgtaaggtggggctgcaggctgccaacatcgaaggagcgtggggctctggggtcggcttcaccctgacctgccaggtgagcctcacagagtgccctacctttcttacatccatcaaggcttgtgatatggccatttgctatggagccgaaagcgtgacgctgtctagaggccaaaataccgtcaagatcacagggaaaggaggccactccgggagctctttcaagtgttgccatggaaaggagtgttccctcaccggcctgcaggctagcgctccccacctggacaaagttaacggcatttctgagcttgaaaatgagaaggtgtacgatgacggggcgccggaatgcggaatcacatgttggtttaaaaagtccggcgagtgggtgatggggattatcaacggaaattgggtcgtgctcatcgctctgtgcgttctgctcctgttcagccttattctgctctccatcctgtgtcctgtgcgcaaacataaaaagagctga

SEQ ID NO: 13508 - RNA, 3402 nt, synthetic construct
  misc_feature 1..3402: note = derived and/or modified CDS sequence (opt5) from SEOV(WuhanRf02)__JQ665888.1__GP
  source 1..3402: mol_type = other RNA
atgtggagcctgctcctgcttgccgctctggtgggccaggggttcgccctcaagaacgtctttgacatgagaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaaactgaccaaggtcatctggcggaaaaaggctaatcaagaaagcgccaaccagaactcctttgaggtgattgagagcgaagtttctttcaaagggctctgcatgctgaagcaccgcatggtggaggaatcctatagaaaccggcgcagcgtcatctgttacgaccttgcctgcaattctacattttgtaagcctaccgtgtatatgattgttcccatccatgcttgcaacatgatgaaatcctgtctgatcggactcggcccttaccggattcaggtggtctatgagagaacatactgcaccacagggatcctgaccgagggaaagtgtttcgtgcccgataaagccgtggtcagcgctcttaagcgcggcatgtatgccgttgcgtctattgaaacgatctgctttttcattcaccagaaaggcaatacctacaagatcgtgacagccattacctccgctatggggagcaagtgtaacaatacagacaccaaagtgcaaggatactatatctgcatcattggcgggaactccgcccctgtctacgctccggccggagaggattttagagcgatggaagtgttctctggcatcattacgagcccccatggggaggaccacgatctgcctggagaagagatcgccacatatcagatttccggccagatcgaggctaagatcccccacaccgttagctctaaaaatctcaagctgacagcctttgctggcattccttcctacagctctaccagcatcctggccgcctccgaagacgggcggttcatttttagccccggactcttcccgaacctgaaccagagcgtgtgcgataataacgctctgcctctgatctggcgcggcctcattgacctgaccgggtattacgaggcggtccatccctgtaatgtgttctgcgttctttccggacctggcgccagctgtgaggctttttctgagggcggaatcttcaacatcacatcccccatgtgcctggtgagcaaacaaaatagatttcgggccgccgaacagcgcatttctttcgtctgtcagagagtggatatggacatcattgtctattgcaacggccaaaagaaaacgatcctcaccaagacactggtgattggccagtgtatctacaccattacatccctgtttagcctcctgcccggggttgctcactccatcgccatcgagctttgcgtgcctggattccatggctgggcgaccgctgccctgctcacgacattttgtttcgggtgggtcctgattccggcctgcacccttgctatcctgctcgtgctgaagtttttcgccaatattctgcacacctctaaccaggagaatcggtttaaagctatcctccgcaagattaaagaagagttcgaaaagacaaaaggaagcgttgtgtgtgagatctgcaagtacgaatgcgagaccctgaaggagcttaaagcccacaacctgtcctgtgtccagggcgaatgcccctattgttttacacattgcgagcctacggaaaccgcgatccaagcccactacaaggtgtgtcaggctacacatagattccgggaggatctcaaaaagaccgtgacaccccagaatattgggcctggctgctatagaaccctgaacctgttccgctacaattctcggcccgacggacttacgatgtggaccctcctgctgatcattgagagcatcctctgggccgcttccgccgcggaaattccgctggttcctctttgggccgacaacgctcacggcgtcgggagcgtgcccatgcatacagatctggagctcgacttttctctgccttccagctctaaatatacctacaagagacacctgacaaatcccgtgaacgatcagcaatccgtcagccttcacatcgaaatcgagtctcagggaattggcgccgacgtgcatcacctcgggcattggtatgatgctcgcctgaacctgaagaccagcttccactgttacggagcctgcacgaaataccagtatccttggcacacagccaagtgtcattttgaaaaagactacgagtatgaaaattcctgggcttgcaatcccccggattgtcctggcgttgggaccggctgcacagcgtgcggactctacctggaccagcttaagcccgtgggcaccgccttcaaaatcattagcgtccggtattctagaaaggtgtgtgttcaatttggggaagagtacctgtgcaagaccatcgatatgaatgactgtttcgtgacacgccacgctaaaatttgcatcatcggaacggtccccaagttttcccagggcgataccctcctgttcctggggcctatggaaggaggcgggattatctttaaacattggtgtacatctacctgccacttcggcgacccgggagacgtgatgggccccaaggataaaccttttattcggcccgagttccctgggcagtttagaaagaaatgtaacttcgccacaacccccgtttgcggatatgacggcaatatcatttccgggtacaagaaggtgcttgccacgatcgattctttccagagctttaacacatccaatattcatttcaccgacgaacgcatcgagtggcgggatcctgacggaatgctcagagatcacatcaacattgtcatctctaaagacattgattttgagaatctggctgaaaacccctgtaaggtgggcctgcaagccgcgaatatcgagggggcttggggcagcggagtgggcttcaccctcacatgccaggtctccctgaccgaatgtccgacatttcttacgtctattaaagcctgcgacatggccatctgctacggggctgagagcgttaccctgtcccgcggacagaacacagtgaagatcaccggcaaagggggacacagcgggtcttccttcaagtgttgccatggcaaggaatgtagctctacagggctccaagcctccgcgcctcacctggataaagtgaatggaattagcgagctggagaacgaaaaggtctatgacgatggcgctcccgagtgcgggatcacctgttggtttaaaaagtctggagaatgggtgatgggcattatcaatgggaactgggttgtgcttattgccctctgcgtcctgcttctcttctccctgatccttctgagcatcctctgtcctgtgcggaaacataagaagtcctga

SEQ ID NO: 13509 - RNA, 3402 nt, synthetic construct
  misc_feature 1..3402: note = derived and/or modified CDS sequence (opt5) from SEOV(WuhanRf07)__JQ665889.1__GP
  source 1..3402: mol_type = other RNA
atgtggagcctgctcctgcttgccgctctggtgggccaggggttcgccctcaagaacgtctttgacatgagaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaaactgaccaaggtcatctggcggaaaaaggctaatcaagaaagcgccaaccaaaattcctttgaggtgattgagagcgaagtttctttcaaagggctctgcatgctgaagcaccgcatggtggaggaatcctatagaaaccggcgcagcgtcatctgttacgaccttgcctgcaattctacattttgtaagcctaccgtgtatatgattgttcccatccatgcttgcaacatgatgaaatcctgtctgatcggactcggcccttaccggattcaggtggtctatgagagaacatactgcaccacagggatcctgaccgagggaaagtgtttcgtgcccgataaagccgtggtcagcgctcttaagcgcggcatgtatgccgttgcgtctattgaaacgatctgctttttcattcaccagaaaggcaatacctacaagatcgtgacagccattacctccgctatggggagcaagtgtaacaatacagacaccaaagtgcagggatactatatctgcatcattggcgggaactccgcccctgtctacgctccggccggagaggattttagagcgatggaagtgttctctggcatcattacgagcccccatggggaggaccacgatctgcctggagaagagatcgccacatatcagatttccggccagatcgaggctaagatcccccacaccgttagctctaaaaatctcaagctgacagcctttgctggcattccttcctacagctctaccagcatcctggccgcctccgaagacgggcggttcatcttttctcccggactcttcccgaacctgaaccagagcgtgtgcgataataacgctctgcctctgatttggcgcggcctcattgacctgaccgggtattacgaggcggtccatccctgtaatgtgttctgcgttctttccggacctggcgccagctgtgaggctttttctgaagggggaatcttcaacatcacatcccccatgtgcctggtgagcaaacaaaatagatttcgggccgccgaacagcagatttctttcgtctgtcaacgcgtggatatggacatcattgtctattgcaacggccagaagaaaacgatcctcaccaagacactggtgattggccagtgtatctacaccattacatccctgtttagcctcctgcccggggttgctcactccatcgccatcgagctttgcgtgcctggattccatggctgggcgaccgctgccctgctcacgacattttgtttcgggtgggtcctgattccggcctgcacccttgctatcctgctcgtgctgaagtttttcgccaatattctgcacacctctaaccaggagaatagatttaaagctatcctccggaagattaaagaagagttcgaaaagacaaaaggaagcatggtttgtgagatctgcaagtacgaatgcgagaccctgaaggagcttaaagcccacaacctgtcctgtgtgcaaggcgaatgcccctattgttttacacattgcgagcctacggaaaccgcgatccaggcccactacaaggtctgtcaggctacacatcgcttcagagaggatctcaaaaagaccgtgacaccccagaatattgggcctggctgctatcggaccctgaacctgttcagatacaaatctcgcccctatatccttacgatgtggaccattctcctgatcattgagagcatcctgtgggccgcttccgccgcggaaatcccgctcgtgcctctgtggacagacaatgcccacggagttggcagcgtccccatgcataccgaccttgagctggatttttctctcccttccagctctaagtacacatataagcggcacctgaccaaccccgtgaatgaccaacagtccgtgagcctgcacattgaaatcgagtctcaggggattggagctgatgtccatcaccttggccattggtacgacgccagactcaacctgaaaacgagcttccactgttacggggcttgcacaaagtatcagtacccttggcacaccgccaaatgtcattttgaaaaggattatgagtacgagaactcctgggcctgcaatcccccggactgtcctggagtgggcacagggtgcaccgcttgcggcctgtatctcgatcaactgaaacccgttggaaccgcgttcaagatcattagcgtgcgctactctcggaaggtctgtgtgcagtttggcgaagagtatctttgcaaaacaatcgacatgaacgattgtttcgttacgagacacgccaagatctgcattatcgggaccgtgtccaaatttagccagggagacacacttctcttcctgggccccatggaagggggaggcattatctttaagcattggtgtacctccacatgccacttcggggatcctggcgacgtcatgggaccgaaagacaagccctttatttgtcctgagttccccggccagtttcgcaaaaagtgcaatttcgctaccacgcctgtgtgtgaatacgatgggaacatcatttctggatacaagaaagttctggccacaatcgacagcttccaatcctttaatacctctaacatccatttcaccgatgagcggattgagtggagagaccccgatggcatgcttcgcgaccacatcaatattgtgatcagcaaggatattgactttgaaaacctcgccgagaatccttgcaaagtcgggctgcaggctgccaacatcgaaggagcgtggggctccggggtgggcttcacactgacctgtcaggtgtctctcacagagtgccccacgtttctgaccagcatcaaggcttgcgatatggccatttgttatggagccgaatccgtcacacttagccggggccaaaataccgttaaaatcacagggaagggaggccactctgggtccagcttcaagtgctgtcatggaaaagagtgttcttccaccggcctgcaggctagcgccccgcacctcgacaaggtgaacggcatttctgagctggaaaatgagaaagtgtacgatgacggggcgcctgaatgcggaatcacgtgctggtttaagaaatccggcgagtgggtcatggggattatcaacggaaattgggtggttctgatcgctctttgtgtgctcctgctgttcagcctcattctgctttccatcctgtgccccgtcagaaagcataagaaaagctga

SEQ ID NO: 13510 - RNA, 3402 nt, synthetic construct
  misc_feature 1..3402: note = derived and/or modified CDS sequence (opt5) from SEOV(WuhanRf18)__JQ665893.1__GP
  source 1..3402: mol_type = other RNA
atgtggagcctgctcctgcttgccgctctggtgggccaggggttcgccctcaagaacgtctttgacatgagaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaaactgaccaaggtcatctggcggaaaaaggctaatcaagaaagcgccaaccaaaattcctttgaggtgattgagagcgaagtttctttcaaagggctctgcatgctgaagcaccgcatggtggaggaatcctatagaaaccggcgcagcgtcatctgttacgaccttgcctgcaattctacattttgtaagcctaccgtgtatatgattgttcccatccatgcttgcaacatgatgaaatcctgtctgatcggactcggcccttaccggattcaggtggtctatgagagaacatactgcaccacagggatcctgaccgagggaaagtgtttcgtgcccgataaagccgtggtcagcgctcttaagcgcggcatgtatgccgttgcgtctattgaaacgatctgctttttcattcaccagaaaggcaatacctacaagatcgtgacagccattacctccgctatggggagcaagtgtaacaatacagacaccaaagtgcagggatactatatctgcatcattggcgggaactccgcccctgtctacgctccggccggagaggattttagagcgatggaagtgttctctggcatcattacgagcccccatggggaggaccacgatctgcctggagaagagatcgccacatatcagatttccggccagatcgaggctaagatcccccacaccgttagctctaaaaatctcaagctgacagcctttgctggcattccttcctacagctctaccagcatcctggccgcctccgaagacgggcggttcatcttttctcccggactcttcccgaacctgaaccagagcgtgtgcgataataacgcccttcctctgatttggcgcggcctcattgacctgaccgggtattacgaggcggtccatccctgtaatgtgttctgcgttctttccggacctggcgccagctgtgaggctttttctgaagggggaatcttcaacatcacatcccccatgtgcctggtgagcaaacaaaatagatttcgggccgccgaacagcgcatttctttcgtctgtcagagagtggatatggacatcattgtctattgcaacggccaaaagaaaacgatcctcaccaagacactggtgattggccagtgtatctacaccattacatccctgtttagcctcctgcccggggttgctcactccatcgccatcgagctttgcgtgcctggattccatggctgggcgaccgctgccctgctcacgacattttgtttcgggtgggtcctgattccggcctgcacccttgctatcctgctcgtgctgaagtttttcgccaatattctgcacacctctaaccaggagaatcggtttaaagctatcctccgcaagattaaagaagagttcgaaaagacaaaaggaagcatggtttgtgagatctgcaagtacgaatgcgagaccctgaaggagcttaaagcccacaacctgtcctgtgtgcagggcgaatgcccctattgttttacacattgcgagcctacggaaaccgcgatccaagcccactacaaggtctgtcaggctacacatagattccgggaggatctcaaaaagaccgtgacaccccagaatattgggcctggctgctatagaaccctgaacctgttccgctacaaatctcggtgttatatccttacgatgtggaccattctcctgatcattgagagcatcctgtgggccgcttccgccgcggaaatccccctcgtgccgctgtggacagacaatgcccacggagttggcagcgtccctatgcataccgaccttgagctggatttttctctcccctccagctctaagtacacatataagagacacctgaccaaccctgtgaatgaccagcaatccgtgagcctgcacattgaaatcgagtctcaggggattggagctgatgtccatcaccttggccattggtacgacgcccgcctcaacctgaaaacgagcttccactgctacggggcttgtacaaagtatcagtacccctggcacaccgccaaatgccattttgaaaaggattatgagtacgagaactcctgggcctgtaatcctcccgactgcccgggagtgggcacagggtgcaccgcttgtggcctgtatctcgatcagctgaaacctgttggaaccgcgttcaagatcattagcgtgcggtactctagaaaggtctgcgtgcaatttggcgaagagtatctttgtaaaacaatcgacatgaacgattgcttcgttacgcgccacgccaagatctgtattatcgggaccgtgtccaaatttagccagggagacacactcctgttcctgggccccatggaagggggaggcattatctttaagcattggtgcacctccacatgtcacttcggggatcccggcgacgtcatgggacctaaagacaagccgtttatttgccccgagttccctggccagtttcggaaaaagtgtaatttcgctaccacgcccgtgtgcgaatacgatgggaacatcatttctggatacaagaaagttctggccacaatcgacagcttccagtcctttaatacctctaacatccatttcaccgatgagagaattgagtggcgcgaccctgatggcatgcttcgggaccacatcaatattgtgatcagcaaggatattgactttgaaaacctcgccgagaatccctgtaaagtcgggctgcaagctgccaacatcgaaggagcgtggggctccggggtgggcttcacactgacctgccaggtgtctctcacagagtgccctacgtttctgaccagcatcaaggcttgtgatatggccatttgctatggagccgaatccgtcacacttagcagaggccagaataccgttaaaatcacagggaagggaggccactctgggtccagcttcaagtgttgccatggaaaagagtgttcttccaccggcctgcaagctagcgctccccacctcgacaaggtgaacggcatttctgagctggaaaatgagaaagtgtacgatgacggggcgccggaatgcggaatcacgtgttggtttaagaaatccggcgagtgggtcatggggattatcaacggaaattgggtggttctgatcgctctttgcgtgctcctgctgttcagcctcattctgctttccatcctgtgtcctgtccgcaagcataagaaaagctga

SEQ ID NO: 13511 - RNA, 3402 nt, synthetic construct
  misc_feature 1..3402: note = derived and/or modified CDS sequence (opt5) from SEOV(WuhanRn10)__JQ665896.1__GP
  source 1..3402: mol_type = other RNA
atgtggagcctgctcctgcttgccgctctggtgggccaggggttcgccctcaagaacgtctttgacatgagaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaaactgaccaaggtcatctggcggaaaaaggctaatcaagaaagcgccaaccaaaattcctttgaggtgattgagagcgaagtttctttcaaagggctctgcatgctgaagcaccgcatggtggaggaatcctatagaaaccggcgcagcgtcatctgttacgaccttgcctgcaattctacattttgtaagcctaccgtgtatatgattgttcccatccatgcttgcaacatgatgaaatcctgtctgatcggactcggcccttaccggattcaggtggtctatgagagaacatactgcaccacagggatcctgaccgagggaaagtgtttcgtgcccgataaagccgtggtcagcgctcttaagcgcggcatgtatgccgttgcgtctattgaaacgatctgctttttcattcaccagaaaggcaatacctacaagatcgtgacagccattacctccgctatggggagcaagtgtaacaatacagacaccaaagtgcagggatactatatctgcatcattggcgggaactccgcccctgtctacgctccggccggagaggattttagagcgatggaagtgttctctggcatcattacgagcccccatggggaggaccacgatctgcctggagaagagatcgccacatatcagatttccggccagatcgaggctaagatcccccacaccgttagctctaaaaatctcaagctgacagcctttgctggcattccttcctacagctctaccagcatcctggccgcctccgaagacgggcggttcatcttttctcccggactcttcccgaacctgaaccagagcgtgtgcgataataacgcccttcctctgatttggcgcggcctcattgacctgaccgggtattacgaggcggtccatccctgtaatgtgttctgcgttctttccggacctggcgccagctgtgaggctttttctgaagggggaatcttcaacatcacatcccccatgtgcctggtgagcaaacaaaatagatttcgggccgccgaacagcagatttctttcgtctgtcaacgcgtggatatggacatcattgtctattgcaacggccagaagaaaacgatcctcaccaagacactggtgattggccagtgtatctacaccattacatccctgtttagcctcctgcccggggttgctcactccatcgccatcgagctttgcgtgcctggattccatggctgggcgaccgctgccctgctcacgacattttgtttcgggtgggtcctgattccggcctgcacccttgctatcctgctcgtgctgaagtttttcgccaatattctgcacacctctaaccaggagaatagatttaaagctatcctccggaagattaaagaagagttcgaaaagaacaaaggaagcgttgtgtgtgagatctgcaagtacgaatgcgagacactgaaggagcttaaagcccacaatctgtcctgtgtccaaggcgaatgcccctattgttttacccattgcgagcctacagaaacggcgatccaggcccactacaaggtgtgtcaggctacccatcgcttcagagaggatctcaaaaagacagtgacaccccagaacattgggcctggctgctatcggaccctgaatctgttcagatacaaatctcgctgttatatccttaccatgtggacgattctcctgatcattgagagcatcctgtgggccgcttccgccgcggaaatccccctcgttccgctgtggaccgacaacgcccacggagtcggcagcgtgcctatgcatacagaccttgagctggatttttctctcccctccagctctaagtacacctataagcggcacctgacaaatcctgtgaacgaccaacagtccgtcagcctgcacattgaaatcgagtctcaggggattggagctgatgtgcatcaccttggccattggtacgacgccagactcaacctgaaaaccagcttccactgctacggggcttgtacgaagtatcagtacccctggcacacagccaaatgccattttgaaaaggattatgagtacgaaaattcctgggcctgtaaccctcccgactgcccgggagttggcaccgggtgcacagcttgtggcctgtatctcgatcaactgaaacctgtgggaaccgcgttcaagatcattagcgtccgctactctcggaaggtgtgcgttcagtttggcgaggagtatctttgtaaaaccatcgacatgaatgattgcttcgtgacaagacacgccaagatctgtattatcgggacggtctccaaatttagccagggagacaccctcctgttcctgggccccatggaagggggaggcattatctttaagcattggtgcacatccacctgtcacttcggggatcccggcgacgtgatgggacctaaagacaagccgtttatttgccccgagttccctggccagtttcgcaaaaagtgtaacttcgctacaacccccgtttgcgaatacgatgggaatatcatttctggatacaagaaagtgctggccacgatcgacagcttccaatcctttaacacatctaatatccatttcaccgatgagcggattgagtggagagaccctgatggcatgcttcgcgaccacatcaacattgtcatcagcaaggatattgactttgaaaatctcgccgagaacccctgtaaagtggggctgcaggctgccaatatcgaaggagcgtggggctccggggtgggcttcaccctgacatgccaggtctctctcaccgagtgccctacatttctgacgagcatcaaggcttgtgatatggccatttgctatggagccgaatccgttacccttagccggggccaaaacacagtgaaaatcaccgggaagggaggccactctgggtccagcttcaagtgttgccatggaaaagagtgttcttccacaggcctgcaggctagcgctccccacctcgacaaggtgaatggcatttctgagctggaaaacgagaaagtctacgatgacggggcgccggaatgcggaatcacctgttggtttaagaaatccggcgagtgggtgatggggattatcaatggaaactgggttgtgctgatcgctctttgcgtcctcctgctgttcagcctcattctgctttccatcctgtgtcctgtgagaaagcataagaaaagctga

SEQ ID NO: 13512 - RNA, 3402 nt, synthetic construct
  misc_feature 1..3402: note = derived and/or modified CDS sequence (opt5) from SEOV(WuhanRn25)__JQ665897.1__GP
  source 1..3402: mol_type = other RNA
atgtggagcctgctcctgcttgccgctctggtgggccaggggttcgccctcaagaacgtctttgacatgagaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaaactgaccaaggtcatctggcggaaaaaggctaatcaagaaagcgccaaccaaaattcctttgaggtgattgagagcgaagtttctttcaaagggctctgcatgctgaagcaccgcatggtggaggaatcctatagaaaccggcgcagcgtcatctgttacgaccttgcctgcaattctacattttgtaagcctaccgtgtatatgattgttcccatccatgcttgcaacatgatgaaatcctgtctgatcggactcggcccttaccggattcaggtggtctatgagagaacatactgcaccacagggatcctgaccgagggaaagtgtttcgtgcccgataaagccgtggtcagcgctcttaagcgcggcatgtatgccgttgcgtctattgaaacgatctgctttttcattcaccagaaaggcaatacctacaagatcgtgacagccattacctccgctatggggagcaagtgtaacaatacagacaccaaagtgcagggatactatatctgcatcattggcgggaactccgcccctgtctacgctccggccggagaggattttagagcgatggaagtgttctctggcatcattacgagcccccatggggaggaccacgatctgcctggagaagagatcgccacatatcagatttccggccagatcgaggctaagatcccccacaccgttagctctaaaaatctcaagctgacagcctttgctggcattccttcctacagctctaccagcatcctggccgcctccgaagacgggcggttcatcttttctcccggactcttcccgaacctgaaccagagcgtgtgcgataataacgcccttcctctgatttggcgcggcctcattgacctgaccgggtattacgaggcggtccatccctgtaatgtgttctgcgttctttccggacctggcgccagctgtgaggctttttctgaagggggaatcttcaacatcacatcccccatgtgcctggtgagcaaacaaaatagatttcgggccgccgaacagcagatttctttcgtctgtcaacgcgtggatatggacatcattgtctattgcaacggccagaagaaaacgatcctcaccaagacactggtgattggccagtgtatctacaccattacatccctgtttagcctcctgcccggggttgctcactccatcgccatcgagctttgcgtgcctggattccatggctgggcgaccgctgccctgctcacgacattttgtttcgggtgggtcctgattccggcctgcacccttgctatcctgctcgtgctgaagtttttcgccaatattctgcacacctctaaccaggagaatagatttaaagctatcctccggaagattaaagaagagttcgaaaagaacaaaggaagcatggtttgtgagatctgcaagtacgaatgcgagacactgaaggagcttaaagcccacaatctgtcctgtgtgcaaggcgaatgcccctattgttttacccattgcgagcctacagaaacggcgatccaggcccactacaaggtctgtcaggctacccatcgcttcagagaggatctcaaaaagacagtgacaccccagaacattgggcctggctgctatcggaccctgaatctgttcagatacaaatctcgctgttatatccttaccatgtggacgattctcctgatcattgagagcatcctgtgggccgcttccgccgcggaaatccccctcgtgccgctgtggaccgacaacgcccacggagttggcagcgtccctatgcatacagaccttgagctggatttttctctcccctccagctctaagtacacctataagcggcacctgacaaatcctgtgaacgaccaacagtccgtgagcctgcacattgaaatcgagtctcaggggattggagctgatgtccatcaccttggccattggtacgacgccagactcaacctgaaaaccagcttccactgctacggggcttgtacgaagtatcagtacccctggcacacagccaaatgccattttgaaaaggattatgagtacgaaaattcctgggcctgtaaccctcccgactgcccgggagtgggcaccgggtgcacagcttgtggcctgtatctcgatcaactgaaacctgttggaaccgcgttcaagatcattagcgtgcgctactctcggaaggtctgcgtgcagtttggcgaggagtatctttgtaaaaccatcgacatgaatgattgcttcgttacaagacacgccaagatctgtattatcgggacggtgtccaaatttagccagggagacaccctcctgttcctgggccccatggaagggggaggcattatctttaagcattggtgcacatccacctgtcacttcggggatcccggcgacgtcatgggacctaaagacaagccgtttatttgccccgagttccctggccagtttcgcaaaaagtgtaacttcgctacaacccccgtgtgcgaatacgatgggaatatcatttctggatacaagaaagttctggccacgatcgacagcttccaatcctttaacacatctaatatccatttcaccgatgagcggattgagtggagagaccctgatggcatgcttcgcgaccacatcaacattgtgatcagcaaggatattgactttgaaaatctcgccgagaacccctgtaaagtcgggctgcaggctgccaatatcgaaggagcgtggggctccggggtgggcttcaccctgacatgccaggtgtctctcaccgagtgccctacatttctgacgagcatcaaggcttgtgatatggccatttgctatggagccgaatccgtcacccttagccggggccaaaacacagttaaaatcaccgggaagggaggccactctgggtccagcttcaagtgttgccatggaaaagagtgttcttccacaggcctgcaggctagcgctccccacctcgacaaggtgaatggcatttctgagctggaaaacgagaaagtgtacgatgacggggcgccggaatgcggaatcacctgttggtttaagaaatccggcgagtgggtcatggggattatcaatggaaactgggtggttctgatcgctctttgcgtgctcctgctgttcagcctcattctgctttccatcctgtgtcctgtcagaaagcataagaaaagctga

SEQ ID NO: 13513 - RNA, 3402 nt, synthetic construct
  misc_feature 1..3402: note = derived and/or modified CDS sequence (opt5) from SEOV(XiaotangshanRn7)__GU592929.1__GP
  source 1..3402: mol_type = other RNA
atgtggagcctcctgttcctggccgctcttgtgggccaggggtttgccctgaagaacgtcttcgacatgagaatccaatgcccccactccgttaattttggagagacctctgtgagcggctacacagaactccctccgctgtcccttcaggaggcggaacagctggtgcccgagtctagctgtaacatggataatcatcagtccctctctacgattaacaaactgaccaaggtcatctggcggcgcaaagctaatcaagaaagcgccaaccaaaattccttcgaggtggttgagagcgaagtgtcttttaaggggctgtgcatgctcaaacacagaatggtcgaggaatcctatcggaaccgcagaagcgtgatttgttacgacctggcctgcaattctacattctgtaagcctaccgtttatatgatcgtgcccattcatgcttgcaacatgatgaagtcctgtcttatcggactgggcccttaccggatccaggtcgtgtatgagcgcacatactgcaccacagggattctcaccgagggaaaatgttttgtgcccgataaggccgtcgttagcgctctgaaaagaggcatgtatgccatcgcgtctattgaaacgatctgcttctttattcaccagaagggcaatacctacaaaatcgtgacagccattacctccgctatggggagcaagtgtaacaatacagacaccaaggtgcagggatactatatctgcatcattggcgggaactccgcccctgtctacgctccggccggagaggatttccgggcgatggaagtgttttctggcatcattacgagcccccatggggaggaccacgatcttcctggagaagagatcgccacatatcagatttccggccagatcgaggctaaaatcccccacaccgttagctctaagaatctgaaactcacagccttcgctggcattccttcctacagctctaccagcatcctggccgcctccgaagacgggcgctttattttctctcccggactgttcccgaacctcaaccagagcgtgtgcgataataacgctctgcctcttatctggagaggcctgattgacctcaccgggtattacgaggcggtccatccctgtaatgtgttttgcgttctgtccggacctggcgccagctgtgaagccttctctgaagggggaatctttaacatcacatcccccatgtgccttgtgagcaagcaaaatcggttccgcgccgccgaacagcagatttcttttgtctgtcaaagagtggatatggacatcattgtctattgcaacggccagaaaaagacgatcctgaccaaaacactcgtgattggccagtgtatctacaccattacatccctgttcagcctgctccccggggttgctcactccatcgccatcgagctgtgcgtgcctggatttcatggctgggcgaccgctgcccttctgattacgttctgttttgggtgggtcctcatcccggcctgcacactggctattcttctggtgctcaagttctttgccaatatcctgcacacctctaaccaggagaatcggttcaaggctattctgcgcaaaatcaaggaagagtttgagaaaaccaagggaagcatggtttgtgagatctgcaaatacgaatgcgagacactcaaggagctgaaggcccacaacctttcctgtgtgcaaggcgaatgcccctattgtttcacccattgcgagcctacagaaacggcgattcaggcccactacaaagtctgtcaggctacccatagattccgggaggatctgaagaaaacagtgacaccccagaatatcgggcctggctgctatagaaccctcaacctgtttcgctacaagtctcggtgttatattctgaccatgtggacgcttctcctgatcattgagagcatcctgtgggccgcttccgccgcggaaatccccctcgtgccgctgtggaccgacaatgcccacggagttggcagcgtccctatgcatacagaccttgagctggatttctctctcccctccagctctaaatacacctataagagacacctgacaaaccctgtgaatgaccaacagtccgtgagcctgcacattgaaatcgagtctcaggggattggagctgatgtccatcaccttggccattggtacgacgcccgcctcaacctgaagaccagctttcactgctacggggcttgtacgaaatatcagtacccctggcacacagccaagtgccatttcgaaaaagattatgagtacgagaactcctgggcctgtaatcctcccgactgcccgggagtgggcaccgggtgcacagcttgtggcctgtatctcgatcaactgaagcctgttggaaccgcgtttaaaatcattagcgtgcggtactctagaaaggtctgcgtgcagttcggcgaagagtatctttgtaagaccatcgacatgaacgattgctttgttacacgccacgccaaaatctgtattatcgggacggtgtccaagttcagccagggagacaccctgctctttctgggccccatggaagggggaggcattatcttcaaacattggtgcacatccacctgtcactttggggatcccggcgacgtcatgggacctaaggacaaaccgttcatttgccccgagtttcctggccagttccggaagaaatgtaatttcgctacaacccccgtgtgcgaatacgatgggaacatcatttctggatacaagaaggttctggccacgatcgacagctttcaatccttcaatacatctaacatccattttaccgatgagagaattgagtggcgcgaccctgatggcatgcttcgggaccacatcaatattgtgatcagcaaagatattgacttcgaaaacctcgccgagaatccctgtaaggtcgggctgcaggctgccaacatcgaaggagcgtggggctccggggtgggctttaccctgacatgccaggtgtctctcaccgagtgccctacattcctgacgagcatcaaggcttgtgatatggccatttgctatggagccgaatccgtcacccttagcagaggccaaaatacagttaagatcaccgggaaaggaggccactctgggtccagctttaagtgttgccatggaaaggagtgttcttccacaggcctgcaggctagcgctccccacctcgacaaagtgaacggcatttctgagctggaaaatgagaaggtgtacgatgacggggcgccggaatgcggagtcacctgttggttcaaaaagtccggcgagtgggtgatggggatcattaacggaaattgggttgtgctgatcgtcctttgcgtgctcctgctgtttagcctcatcctgctttccattctgtgtcctgttcgcaaacataaaaagagctga

SEQ ID NO: 13514 - RNA, 3402 nt, synthetic construct
  misc_feature 1..3402: note = derived and/or modified CDS sequence (opt5) from SEOV(YongjiaRf45)__GU592926.1__GP
  source 1..3402: mol_type = other RNA
atgtggggcctgctcctgcttgccgctatggtggggcagggaagcgccctgaagaacgtcttcgacatgaaaatccaatgcccccactccgttaattttggcgagacctctgtgagcgggtacacagaactccctccgctgccccttcaggaggcggaacagctggtgcctgagtcctcttgtaacatggataatcatcagagcctctccacgattaacaagctgaccaaagtcatctggagaaagaaagctaatcaagaatctgccagccagaactccttcgaggtggttgagagcgaagtgtcttttaagggactgtgcatgctcaagcaccggatggtcgaggaatcctatcgcaatagacggagcgtgatttgttacgacctggcctgcaacacaaccttctgtaaacccacagtttatatgatcgtgcctattcatgcttgcaatatgatgaagtcttgtcttatcggcctggggccctaccgcatccaggtcatttatgagagaacctactgctccacaggaatcctcaccgagggcaaatgttttgtgcacgataagacggtggtcagcgccctgaaacggggcatgtatgctattgcctctatcgaaaccgtttgcttctttgtgcatcagaaggggaacacatacaagattgtgaccgcgatcacatccgccatgggaagcaaatgtaataacaccgactccaaggtccaaggctactatatttgcatcatcgggggaaattctgctcctgtgtacgccccggctggcgaggatttccgcgccatggaagtttttagcgggattatcacgagcccccacggagaggaccacgatcttcctggcgaagaggtggcgacatatcagattagcggccagatcgaggccaaaattccccataccgtctcttccaagaacctgaaactcacagctttcgccgggatccctagctactctagcacctccctgctggctgcctctgaagacggaagatttatcttcagccccggcctctttccgaatctgaaccagtccgtgtgcgataacaatgcccttcctctgatttggcgggggctcatcgacctgaccggatattacgaggctgttcacccctgtaacgtgttctgcgtccttagcggccctggggcgtcttgtgaagccttctccgagggaggcatttttaatatcacaagccccatgtgcctggtgtctaagcaaaaccgcttcagagctgccgaacagcagatttcctttatctgtcaacgggtcgatatggacatcattgtgtattgcaatggccagaaaaagacgatcctcaccaagacactggttattgggcagtgtatctacaccattacaagcctgttctccctcctgcccggagtggcccattctatcgctattgagctttgcgtccctggctttcacgggtgggccaccgcggctctgctcatcacgttctgttttggatgggtgctgatcccggcctgcacacttgccgttctcctcttcctgaaatttttcgctaacattctgcacaccagcaatcaggagaaccgctttaaggccatcctcagaaaaattaaggaagagttcgagaaaaccaagggctccatggtgtgtgaaatctgcaagtacgaatgcgagacactgaaagagcttaaggctcataatctgtcttgtgtccaaggggaatgcccctattgttttacccactgcgagcctacagaaacggccattcaggcgcattacaaagtgtgtcaggccacccaccggttccgcgaggatctcaagaaaacagtgacaccccagaacatcggccctggatgctatagaaccctgaatctgttccggtacaagagcagatgttatatccttaccatgtggattctcctgctggttatcgagtccattctctgggctgccagcgctgccgaaatccccctggtcccgctttggacggacaacgcgcatggcgtggggtctgtgcctatgcacaccgacctggagctcgatttttccctgccctcctcttccaagtacacatataaacgccacctgaccaatcctgtcaacgaccaacagagcgtgtctcttcatattgaaatcgagagccagggaatcggcgccgatgttcaccatctcgggcactggtacgacgctcggctgaatctgaagacatccttccactgctacggagcctgtaccaaatatcagtacccctggcatacggctaagtgctattttgaaaaagattacgagtatgagaacagctgggcctgtaaccctcccgactgcccgggcgtggggattggctgcacagcctgtggactctacctggatcaacttaagcctgtcggcaccgctttcaagatcatttctgtgagatattcccgcaaagtttgcgtgcagtttggggaagagtacctgtgtaagacaatcgacatgaatgattgcttcgtcacccggcacgcgaaaatttgtatcatcggaaccgtgagcaagttttcccagggcgacacactcctgttcctggggcccatggaaggaggcgggattatctttaaacattggtgcacgtctacctgtcacttcggcgatcccggagacgttatgggccctaaggacaaaccgtttatttgccccgagttccctgggcagtttagaaagaagtgtaacttcgccacaacccccgtgtgcgaatacgatggaaatgtcttcagcggctatcgcaaatttcttgctacaatcgactccttccaatcttttaacaccagcaatgtgcatttcacggatgagcggattgagtggagagaccctgatgggatgctccgcgaccacatcaacattgtgatctccaaggatatcgactttgaaaatctggccgataacccctgtaaagtcggactgcaggccgctaatattgagggcgcctgggggtctggcgttggattcacactgacctgccaggtgagcctgaccgaatgccctacatttcttacctccatcaaggcgtgtgacatggctatttgctacggcgccgagagcgtgacactgtctcgggggcaaaacacggtcaaaatcaccggaaagggcgggcactccggaagctctttcaagtgttgccatggcaaagaatgttccagcaatggcctccaggcctctgctccccacctggataaggtgaacgggatttccgagctggagaatgaaaaagtttatgacgatggagccccggagtgcggcatcacatgttggtttaagaaaagcggggaatgggtgatgggaatcattaacggcaattggatcgtccttattgtgctctgcgttctgctcctgttctccctgatccttctgagcattctctgtcctgtgagaaagcataagaaatcttga

SEQ ID NO: 13515 - RNA, 3402 nt, synthetic construct
  misc_feature 1..3402: note = derived and/or modified CDS sequence (opt5) from SEOV(YongjiaRn14)__GU592927.1__GP
  source 1..3402: mol_type = other RNA
atgtggggcctgctcctgcttgccgctatggtggggcagggaagcgccctgaagaacgtcttcgacatgaaaatccaatgcccccactccgttaattttggcgagacctctgtgagcgggtacacagaactccctccgctgccccttcaggaggcggaacagctggtgcctgagtcctcttgtaacatggataatcatcagagcctctccacgattaacaagctgaccaaagtcatctggagaaagaaagctaatcaagaatctgccagccagaactccttcgaggtggttgagagcgaagtgtcttttaagggactgtgcatgctcaagcaccggatggtcgaggaatcctatcgcaatagacggagcgtgatttgttacgacctggcctgcaacacaaccttctgtaaacccacagtttatatgatcgtgcctattcatgcttgcaatatgatgaagtcttgtcttatcggcctggggccctaccgcatccaggtcatttatgagagaacctactgcacaaccggaatcctcacggagggcaaatgttttgtgcctgataaggccgtggtctccgctctgaaacggggcatgtatgccattgcgagcatcgaaaccgtttgcttctttgtgcaccagaaggggaacacatacaagattgtgaccgccatcacatctgctatgggatccaaatgtaataacaccgacagcaaggtccaaggctactatatttgcatcatcgggggaaattccgccccggtgtacgctcccgccggcgaggatttccgcgcgatggaagtttttagcgggattatcacgagccctcatggagaggaccacgatcttcccggcgaagaggtggccacatatcagatttccggccagatcgaggctaaaattcctcacaccgtcagctctaagaacctgaaactcacagccttcgctgggatcccctcctacagctctaccagcctgctggccgcctccgaagacggaagatttatcttctctccgggcctctttcctaatctgaaccagagcgtgtgcgataacaatgctctccccctgatttggcgggggctcatcgacctgaccggatattacgaggcggttcatccttgtaacgtgttctgcgtcctttccggccccggggccagctgtgaggctttctctgaaggaggcatttttaatatcacatcccccatgtgcctggtgagcaagcaaaaccgcttcagagccgccgaacagcagatttcttttatctgtcaacgggtcgatatggacatcattgtgtattgcaatggccagaaaaagacgatcctcaccaagacactggttattgggcagtgtatctacaccattacatccctgttcagcctcctgcctggagtggctcactccatcgccattgagctttgcgtcccgggctttcatgggtgggcgaccgctgccctgctcatcacgttctgttttggatgggtgctgatccccgcctgcacacttgctgttctgcttttcctgaaatttttcgccaacattctgcacacctctaatcaggagaaccgctttaaggctatcctcagaaaaattaaggaagagttcgagaaaaccaagggcagcatggtgtgtgaaatctgcaagtacgaatgcgagacactgaaagagcttaaggcccacaatctgtcctgtgtccaaggggaatgcccttattgttttacccattgcgagcccacagaaacggcgattcaggcccactacaaagtgtgtcaggctacccatcggttccgcgaggatctcaagaaaacagtgacccctcagaacatcggccccggatgctatagaacactgaatctgttccggtacaagtctagatgttatatccttaccatgtggattctcctgctggttatcgagagcattctctgggccgcttccgccgcggaaatcccgctggtccctctttggacggacaacgcccacggcgtggggagcgtgcccatgcataccgacctggagctcgatttttctctgccttccagctctaagtacacatataaacgccacctgaccaatcccgtcaacgaccaacagtccgtgagccttcacattgaaatcgagtctcagggaatcggcgctgatgttcatcacctcgggcattggtacgacgcccggctgaatctgaagacatctttccactgctacggagcttgtaccaaatatcagtacccttggcacacggccaagtgccattttgaaaaagattatgagtacgagaactcctgggcctgtaatcccccggactgccctggcgtggggacaggctgcaccgcttgtggactctatctggatcaacttaagcccgtcggcacagcgttcaagattatcagcgtgagatactctcgcaaagtttgcgtgcagtttggggaagagtatctgtgtaagaccattgacatgaacgattgcttcgtcacccggcacgccaaaatctgtattatcggaacagtgtccaagtttagccagggcgacacgctcctgttcctggggcccatggaaggaggcgggatcatttttaaacattggtgcacctccacatgtcacttcggcgatcctggagacgttatgggcccgaaggacaaaccctttatctgccctgagttccccgggcagtttagaaagaagtgtaacttcgctaccacacctgtgtgcgaatacgatggaaatgtcatttctggctaccgcaaagtgcttgccaccatcgacagcttccaatcctttaacacgtctaatgtgcatttcacagatgagcggattgagtggagagaccccgatgggatgctccgcgaccacatcaacattgtcatcagcaaggatatcgactttgaaaatctggccgagaacccttgtaaagttggactgcaggctgccaatattgaaggcgcgtgggggtccggcgtgggattcaccctgacctgccaggtgtctctgacagagtgccccacctttcttacaagcatcaaggcttgtgatatggccatttgctatggcgccgaatccgtcacgctgagccgggggcaaaacaccgtgaaaatcacaggaaagggcgggcactctggatccagcttcaagtgttgccatggcaaagagtgttcttccaatggcctccaggctagcgccccgcacctggacaaggttaacgggatttctgagctggaaaatgagaaagtgtacgatgacggagcgcctgaatgcggcatcacctgttggtttaagaaatccggggagtgggtcatgggaatcattaacggcaattggatcgtgcttattgttctctgcgtgctgctcctcttcagcctgatccttctgtccattctctgtcccgtcagaaagcataagaaaagctga

SEQ ID NO: 13516 - RNA, 3402 nt, synthetic construct
  misc_feature 1..3402: note = derived and/or modified CDS sequence (opt5) from SEOV(ZT10)__DQ159911.1__GP
  source 1..3402: mol_type = other RNA
atgtggagcctgctcctgcttgccgctctggtgggccaggggttcgccctcaagaacgtctttgacatgagaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaaactgaccaaggtcatctggcggaaaaaggctaatcaagaaagcgccaaccaaaattcctttgaggtggttgagagcgaagtgtctttcaaagggctctgcatgctgaagcaccgcatggtcgaggaatcctatagaaaccggcgcagcgtgatttgttacgaccttgcctgcaattctacattttgtaagcctaccgtttatatgatcgtgcccattcatgcttgcaacatgatgaaatcctgtctgatcggactcggcccttacagaatccaggtcgtgtatgagcggacatactgcaccacagggattctgaccgagggaaagtgtttcgtgcccgataaagccgtcgttagcgctcttaagcgcggcatgtatgccatcgcgtctattgaaacgatctgctttttcattcaccagaaaggcaataagtacaagatcgtgaccgccattacatccgctatggggagcaaatgtaacaataccgacacaaaggtgcagggatactatatctgcatcattggcgggaactccgcccctgtctacgctccggccggagaggattttagagcgatggaagtgttctctggcatcattaccagcccccatggggaggaccacgatctgcctggagaagagatcgccacgtatcagatttccggccagatcgaggctaaaatcccccacacagttagctctaagaatctcaaactgaccgcctttgctggcattccttcctacagctctacaagcatcctggccgcctccgaagacgggcggttcatttttagccccggactcttcccgaacctgaaccagagcgtgtgcgataataacgcccttcctctgatctggcgcggcctcattgacctgaccgggtattacgaggcggtccatccctgtaatgtgttctgcgttctttccggacctggcgccagctgtgaggctttttctgaagggggaatcttcaacatcacctcccccatgtgcctggtgagcaagcaaattagatttcgggccgccgaacagcagatctctttcatttgtcaacgcgtcgatatggacatcattgtgtattgcaatggccagaaaaagacaatcctcacgaagaccctggtcattggccagtgtatctacacaatcacctccctgtttagcctcctgcccggggtggctcactccattgccatcgagctttgcgttcctggattccatggctgggcgacagctgccctgctcattaccttttgtttcgggtgggtgctgatcccggcctgcacgcttgctattctgctcgtcctgaaatttttcgccaacatcctgcacacatctaatcaggagaacagatttaaggctatcctccggaaaattaaggaagagttcgagaaaaccaagggaagcatggtgtgtgaaatctgcaagtacgaatgcgagaccctgaaagagcttaaggcccacaatctgtcctgtgttcaaggcgaatgcccctattgttttacacattgcgagcctaccgaaacagcgattcaggcccactacaaagtgtgtcaggctacgcatcgcttcagagaggatctcaagaaaaccgtcacaccccagaacatcgggcctggctgctatcggaccctgaatctgttcagatacaagtctcgctgttatattcttacaatgtggaccctcctgctgatcatcgagagcattctctgggccgcttccgccgcggaaatccccctggtgccgctttggacggacaacgcccacggagtgggcagcgttcctatgcataccgacctggagctcgatttttctctgccctccagctctaagtacacatataaacggcacctgaccaatcctgtcaacgaccaacagtccgtgagccttcacattgaaatcgagtctcaggggattggagctgatgtgcatcacctcggccattgctacgacgccagactgaatctgaagacatctttccactgttacggggcttgcaccaaatatcagtacccctggcacacggccaagtgtcattttgaaaaagattatgagtacgagaactcctgggcctgcaaccctcccgactgcccgggagtcggcacagggtgtaccgcttgcggcctctatctggatcaacttaagcctgtgggaacagcgttcaagatcatcagcgttcgctactctcggaaagtgtgtgtccagtttggcgaagagtatctgtgcaagaccattgacatgaatgattgtttcgtgaccagacacgccaaaatctgcattatcgggacagtttccaagtttagccagggagacacgctcctgttcctgggccccatggaagggggaggcattatctttaaacattggtgtacctccacatgccacttcggggatcccggcgacgtgatgggacctaaggacaaaccgtttatttgtcccgagttccctggccagtttcgcaagaagtgcaacttcgctaccacacccgtctgtgaatacgatgggaatatcatctctggatacaaaaaggtgcttgccaccattgacagcttccaatcctttaacacgtctaatatccatttcacagatgagcggattgagtggagagaccctgatggcatgctccgcgaccacatcaacattgttatcagcaaagatatcgactttgaaaatctggccgagaacccctgcaaggtggggctgcaggctgccaatattgaaggagcgtggggcctcggggtcggcttcaccctgacctgccaggtgtcccttacagagtgtcctacctttctgacatctatcaaggcttgcgatatggccatttgttatggagccgaaagcgtgacgctctcccggggccaaaacaccgtcaaaatcacagggaagggaggccacagcgggtcttccttcaaatgctgtcatggaaaggagtgcagctctaccggcctgcaggcttccgctccccacctggacaaagttaatggcattagcgagcttgaaaacgagaaggtgtacgatgacggggcgccggaatgtggaatcacatgctggtttaaaaagtctggcgagtgggtgatggggatcattaatggaaactgggtcgtgctcatcgttctgtgtgtgctgctcctgttctcccttattctgctcagcatcctgtgccctgtcagaaagcataaaaagtcctga

SEQ ID NO: 13517 - RNA, 3402 nt, synthetic construct
  misc_feature 1..3402: note = derived and/or modified CDS sequence (opt5) from SEOV(ZT71)__EF117248.1__GP
  source 1..3402: mol_type = other RNA
atgtggagcctgctcctgcttgccgctctggtgggccaggggttcgccctcaagaacgtctttgacatgagaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaaactgaccaaggtcatctggcggaaaaaggctaatcaagaaagcgccaaccaaaattcctttgaggtggttgagagcgaagtgtctttcaaagggctctgcatgctgaagcaccgcatggtcgaggaatcctatagaaaccggcgcagcgtgatttgttacgaccttgcctgcaattctacattttgtaagcctaccgtttatatgatcgtgcccattcatgcttgcaacatgatgaaatcctgtctgatcggactcggcccttacagaatccaggtcgtgtatgagcggacatactgcaccacagggattctggccgagggaaagtgtttcgtgcccgataaagctgtcgttagcgcccttaagcgcggcatgtatgcgatcgcctctattgaaaccatctgctttttcattcaccagaaaggcaataagtacaagatcgtgacggctattacctccgccatggggagcaaatgtaacaatacagacaccaaggtgcagggatactatatctgcatcattggcgggaactccgctcctgtctacgccccggcgggagaggattttagagccatggaagtgttctctggcatcattacaagcccccatggggaggaccacgatctgcctggagaagagatcgctacctatcagatttccggccagatcgaggccaaaatcccccacacggttagctctaagaatctcaaactgacagcttttgccggcattccttcctacagctctaccagcatcctggccgcttccgaagacgggcggttcatcttttctcccggactcttcccgaacctgaaccagagcgtgtgcgataataacgcgcttcctctgatttggcgcggcctcattgacctgacagggtattacgaggccgtccatccctgtaatgtgttctgcgttctttccggacctggcgctagctgtgaagccttttctgaagggggaatcttcaacatcacctcccccatgtgcctggtgagcaagcaaaatagatttcgggccgctgaacagcagatttctttcatctgtcaacgcgtcgatatggacattatcgtgtattgcaacggccagaaaaagaccattctcacaaagacgctggtcatcggccagtgtatttacaccatcacatccctgtttagcctcctgcccggggtggcccactccatcgcgattgagctttgcgttcctggattccatggctgggctaccgccgccctgctcatcacattttgtttcgggtgggtgctgattccggcttgcacccttgccatcctgctcgtcctgaaatttttcgctaatattctgcacacgtctaaccaggagaatagatttaaggccatcctccggaaaatcaaggaagagttcgagaaaacaaagggaagcatggtgtgtgagatttgcaagtacgaatgcgagaccctgaaagagcttaaggcgcacaacctgtcctgtgttcaaggcgaatgcccctattgttttacccattgcgagcctacagaaaccgccatccaggctcactacaaagtgtgtcaggccacacatcgcttcagagaggatctcaagaaaacggtcacaccccagaatattgggcctggctgctatcggaccctgaacctgttcagatacaagtctcgctgttatatccttaccatgtggacactcctgctgattatcgagagcatcctctgggctgcctccgcggccgaaattcccctggtgccgctttggaccgacaatgctcacggagtgggcagcgttcctatgcatacggacctggagctcgatttttctctgccctccagctctaagtacacctataaacggcacctgacaaaccctgtcaatgaccaacagtccgtgagccttcacatcgaaattgagtctcaggggatcggagccgatgtgcatcacctcggccattggtacgacgctgggctgaacctgaagaccagcttccactgctacggagcctgtacaaaatatcagtacccctggcacaccgccaagtgccattttgaaaaagattatgagtacgagaactcctgggcttgtaatcctcccgactgcccgggcgtcgggacgggctgcacagcgtgtggactctatctggatcaacttaagcctgtgggcaccgccttcaagattatcagcgttagatactctcgcaaagtgtgcgtccagtttggggaagagtatctgtgtaagacaatcgacatgaacgattgcttcgtgacccggcacgctaaaatttgtatcattggaaccgtttccaagtttagccagggcgacacactcctgttcctggggcccatggaaggaggcgggatcatttttaaacattggtgcacgtccacctgtcacttcggcgatcccggagacgtgatgggccctaaggacaaaccgtttatctgccccgagttccctgggcagtttagaaagaagtgtaatttcgccacaacccccgtctgcgaatacgatggaaacattatctctggctacaaaaaggtgcttgccacaatcgacagcttccaatcctttaatacctctaacattcatttcacggatgagcgcatcgagtggcgggaccctgatgggatgctcagagaccacattaatatcgttattagcaaagatatcgactttgaaacactggctgagaacccctgtaaggtgggactgcaggccgcgaatatcgaaggcgcttgggggtccggcgtcggattcaccctgacctgccaggtgtctctgacagagtgccctacctttcttacaagcattaaagcctgtgatatggccatctgctatggcgctgaatccgtgacgctgagccgcgggcaaaacaccgtcaagattacaggaaagggcgggcactctggatccagcttcaaatgttgccatggcaaggagtgttcttccaccggcctccaggccagcgcgccccacctggacaaagttaatgggatctctgagctggaaaacgagaaggtgtacgatgacggagctccggaatgcggcattacatgttggtttaaaaagtccggggagtgggtgatgggaatcatcaatggcaactgggtcgtgcttattgttctctgcgtgctgctcctcttcagcctgatccttctgtccattctctgtcctgtccggaagcataaaaagagctga

SEQ ID NO: 13518 - RNA, 3402 nt, synthetic construct
  misc_feature 1..3402: note = derived and/or modified CDS sequence (opt5) from SEOV(DN2)__KX289953.1__GP
  source 1..3402: mol_type = other RNA
atgtggagcctgctcctgcttgccgctctggccggccaggggttcgcgctcaagaacgtgtttgacatgagaatccaatgcccccactccgtcaatttcggagagacctctgttagcggctacacagaactgcctccgctttccctgcaggaggctgaacagctcgtgcccgagtctagctgtaacatggataatcatcagtccctgtctacgattaacaaactgaccaaggtgatctggcggaaaaaggccaatcaagaaagcgcctcccagaacagctttgaggtcgtggagtctgaagtttccttcaaagggctctgcatgctgaagcaccgcatggtggaggaaagctatagaaatcggcgctctgtcatttgttacgaccttgcttgcaactccacattttgtaagcctaccgtgtatatgatcgttcccattcatgcctgcaatatgatgaaaagctgtctgatcggactcggcccttacagaatccaggtggtctatgagcggacatactgcaccacagggattctgaccgagggaaagtgtttcgtgcccgataaagctgtggtctctgcccttaagcgcggcatgtatgcgatcgcctccattgaaacgatctgctttttcattcaccagaaaggcaacacctacaagatcgttacagctattaccagcgccatggggtccaagtgtaataacacagacaccaaagtgcaaggatactatatctgcatcattggcggaaattctgctcctgtgtacgccccggcgggggaggattttagagccatggaagtcttcagcggcatcattacgagcccccatggggaggaccacgatctgcctggagaagagatcgctacatatcagattagcggccagatcgaggccaagatcccccacaccgtgtcttccaaaaacctcaagctgacagcttttgccggcattcctagctactctagcacctccatcctggccgcttctgaagacgggcggttcatttttagccccggactcttcccgaatctgaaccagtccgtttgcgataacaatgcgcttcctctgatctggcgcggcctcattgacctgaccgggtattacgaggccgtgcatccctgtaacgtcttctgcgtgcttagcggacctggcgcttcttgtgaagccttttccgaagggggaatcttcaatatcacaagccccatgtgcctggtttctaaacaaaacagatttcgggccgctgagcagcagatttccttcgtgtgtcaacgcatcgatatggacattatcgtctattgcaatggccagaagaaaacgattctcaccaagacactggtgatcggccagtgtatttacaccatcacaagcctgttttccctcctgcccggggtcgcccactctatcgcgattgagctttgcgtgcctggattccatggctgggctaccgccgccctgctcatcacgttttgtttcgggtgggttctgattccggcttgcacacttgccatcctgctcgtgctgaagtttttcgctaacattctgcacaccagcaatcaggagaacagatttaaagccatcctccggaagatcaaagaagagttcgaaaagaccaaaggatccatggtctgtgagatttgcaagtacgaatgcgagacactgaaggagcttaaagcgcacaatctgtcttgtgtgcaaggcgaatgcccctattgttttacccattgcgagcctacagaaacggccatccaggctcactacaaggtttgtcaggccacccatcgcttcagagaggatctcaaaaagacagtgacaccccagaacattgggcctggctgctatcggaccctgaatctgttcagatacaaaagccgctgttatatccttaccatgtggacgctcctgctgattatcgagtccatcctctgggctgccagcgcggccgaaattcccctgatcccgctttggaccgacaacgctcacggagtcggctctgtgcctatgcatacagacctggagctcgatttttccctgccctcctcttccaagtacacctataagcggcacctgacaaatcctgtgaacgaccaacagagcgtttctcttcacattgaaatcgagagccaggggattggagccgatgtccatcacctcggccattggtacgacgctagactgaatctgaaaacctccttccactgctacggggcctgtacgaagtatcagtacccctggcacacagccaaatgccattttgaaaaggattatgagtacgagaacagctgggcttgtaaccctcccgactgcccgggagtgggcaccgggtgcacagcgtgtggcctctatctggatcaacttcgccctgtgggaaccgccttcaaaatcatctctgtccggtactccagaaaggtgtgcgttcagtttggcgaagagtatctgtgtaagaccattgacatgaatgattgcttcgtgacacgccacgctaaaatctgtattatcgggacggtcagcaagttttcccagggagacaccctcctgttcctgggccccatggaagggggaggcattatctttaaacattggtgcacatctacctgtcacttcggggatcccggcgacgtgatgggacctaaggacaaaccgtttatttgccccgagttccctggccagtttcggaagaaatgtaacttcgccacaacccccgtttgcgaatacgatgggaatacgatcagcggatacaagaaggtgcttgccacaatcgactccttccaatcttttaacaccagcaatattcatttcaccgatgagagaatcgagtggcgcgaccctgatggcatgctccgggaccacattaacatcgtcatttccaaagatatcgactttgaaaatctggctgagaacccctgtaaggtggggctgcaggccgcgaatatcgaaggagcttggggctctggggttggcttcacactgacctgccaggtgagcctgacagagtgccctacgtttcttacctccattaaagcctgtgatatggccatctgctatggagctgaaagcgtcacactgtctagaggccaaaacaccgtgaagattacagggaaaggaggccactccgggagctctttcaagtgttgccatggaaaggagtgttccagcaccggcctccaggcctctgcgccccacctggacaaagtgaatggcatctccgagctggaaaacgagaaggtctacgatgacggggctccggaatgcggaattacgtgttggtttaaaaagagcggcgagtgggttatggggatcatcaatggaaactgggtggtgcttattgtcctctgcgtgctgctcctcttctccctgatccttctgagcattctctgtcctgttcgcaaacataagaagtcttga

SEQ ID NO: 13519 - RNA, 3402 nt, synthetic construct
  misc_feature 1..3402: note = derived and/or modified CDS sequence (opt5) from SEOV(IR162)__KX079475.1__GP
  source 1..3402: mol_type = other RNA
atgtggagcctgctcctgcttgccgccctggtgggcagagggttcaccctcaagaacgtctttgacatgcggatccagtgcccccactccgttaatttcggagagacatctgtgagcggctacacggaactgcctccgctttccctgcaagaggccgaacagctcgtgcccgagtctagctgtaacatggataatcatcagtccctgtctaccattaacaaactgacaaaggtcatctggcgcaaaaaggcgaatcaggaaagcgctaaccaaaattcctttgaggtggttgagagcgaagtgtctttcaaagggctctgcatgctgaagcacagaatggtcgaggaatcctatcggaaccgcagaagcgtgatttgttacgaccttgcctgcaattctaccttttgtaagcctacagtttatatgatcgtgcccattcatgcctgcaacatgatgaaatcctgtctgatcggactcggcccttaccggatccaggtcgtgtatgagcgcacctactgcacaaccgggattctgacggagggaaagtgtttcgtgcccgataaagctgtcgttagcgcccttaagagaggcatgtatgctatcgcctctattgaaaccatctgctttttcattcaccagaaaggcaatacatacaagatcgtgaccgcgattacatccgccatggggagcaagtgtaacaataccgacacgaaagtgcagggatactatatctgcatcattggcgggaactccgctcctgtctacgccccggctggagaggattttcgggccatggaagtgttctctggcatcattacaagcccccatggggaggaccacgatctgcctggagaagagatcgcgacctatcaaatttccggccagatcgaggccaagatcccccacacagttagctctaaaaatctcaagctgaccgcttttgccggcattccttcctacagctctaccagcgtgctgatcgcttccgaagacgggcgcttcatttttagccccggactcttcccgaacctgaaccagagcgtctgcgataataacgcccttcctctgatctggagaggcctcattgacctgacagggtattacgaggccgtgcatccctgtaatgttttctgcgtgctttccggacctggcgctagctgtgaagcgttttctgaagggggaatcttcaacatcacgtcccccatgtgcctggtcagcaaacagaatcggtttcgcgccgctgagcaacagatttctttcgtgtgtcagagagtcgatatggacatcattgtgtattgcaacggccaaaagaaaaccatcctcacaaagaccctggttattggccagtgtatctacacaattacctccctgtttagcctcctgcccggggtggcccactccatcgccatcgagctttgcgtccctggattccatggctgggctacggccgcgctgctcattacattttgtttcgggtgggtgctgatcccggcttgcacccttgccattctgctcgttctgaagtttttcgccaatatcctgcacacctctaaccaggagaatcggtttaaagctattctccgcaagatcaaagaagagttcgaaaagacaaaaggaagcatggtgtgtgagatctgcaagtacgaatgcgagaccctgaaggagcttaaagcccacaacctgtcctgtgtccagggcgaatgcccctattgttttacacattgcgagcctacggaaaccgctattcaagcccactacaaggtgtgtcaggcgacacatagattccgggaggatctcaaaaagaccgtgacaccccagaatatcgggcctggctgctatagaaccctgaacctgttccgctacaaatctcggtgttatattcttacgatgtggaccctcctgctgatcattgagagcatcctctgggccgcttccgccacagaaatccccctggttccgctttggaccgacaatgctcacggagtcggcagcgtgcctatgcatacagacctggagctcgatttttctctgccctccagctctaagtacacctataagagacacctgacgaaccctgtgaatgaccagcaatccgtcagccttcacattgaaatcgagtctcaggggattggagccgatgtgcatcacctcggccattggtacgacgcgcgcctgaacctgaaaacatctttccactgctacggggcctgtaccaagtatcagtacccctggcacacagctaaatgccattttgaaaaggattatgagtacgagaactcctgggcctgtaatcctcccgactgcccgggaatcggcaccgggtgcaccgcttgtggcctctatctggatcagcttaaacctgttggaacagccttcaagattatcagcgtgcggtactctagaaaggtctgcgtgcaatttggcgaagagtatctgtgtaaaacgatcgacatgaacgattgcttcgttacccgccacgccaagatttgtatcattgggacagtgtccaaatttagccagggagacaccctcctgttcctgggccccatggaagggggaggcatcatttttaagcattggtgcacatccacctgtcacttcggggatcccggcgacgtcatgggacctaaagacaagccgtttatctgccccgagttccctggccagtttcggaaaaagtgtaatttcgctacgacacccgtgtgcgaatacgatgggaacattatctctggatacaagaaagttcttgcgaccatcgacagcttccagtcctttaatacctctaacattcatttcacagatgagagaatcgagtggcgcgaccctgatggcatgctccgggaccacattaatatcgtgattagcaaggatatcgactttgaaaacctggccgagaatccctgtaaagtcgggctgcaagctgccaacatcgaaggagcctggggctccggggtgggcttcaccctcacatgccaggtgtctctgacggagtgccctacctttcttacaagcattaaggcttgtgatatggccatctgctatggagcggaatccgtcaccctgagcagaggccagaatacagttaaaattaccgggaagggaggccactctgggtccagcttcaagtgttgccatggaaaagagtgttcttccacgggcctccaagctagcgctccccacctggacaaggtgaacggcatctctgatctggagaatgaaaaagtgtacgacgatggggccccggagtgcggaattacctgttggtttaagaaatccggcgaatgggtcatggggatcatcaacggaaattgggtggttcttattgtgctctgcgtcctgctcctgttcagcctgatccttctgtccattctctgtcctgtgcgcaagcataagaaaagctga

SEQ ID NO: 13520 - RNA, 3402 nt, synthetic construct
  misc_feature 1..3402: note = derived and/or modified CDS sequence (opt5) from SEOV(Gou3)__AF145977.2__GP
  source 1..3402: mol_type = other RNA
atgtggggcctgctcctgcttgccgctctggtggggcagggactcgccctgaagaacgtcttcgacatgaaaatccaatgcccccacagcgttaattttggcgagacctccgtgtctgggtacacagaacttcctccgctgcccctccaggaggcggaacagctggtgcctgagagctcctgtaacatggataatcatcagtctctgagcacgattaacaagctcaccaaagtcatctggagaaagaaagctaatcaagaatccgcctctcagaacagcttcgaggtggttgagaatgaagtgtcctttaagggactgtgcatgcttaagcaccggatggtcgaggaaagctatcgcaacagacggtctgtgatttgttacgacctggcctgcaatacaaccttctgtaaacccacagtttatatgatcgtgcctattcatgcttgcaacatgatgaagtcctgtctcatcggcctggggccctaccgcatccaggtcatttatgagagaacctactgcacaaccggaatccttacggagggcaaatgttttgtgcctgataaggccgtggtcagcgctctgaaacggggcatgtatgccattgcgtctatcgaaaccatttgcttctttgttcacaagaaggggaatacatacaaaatcgtgtccgccattaccctcgctatgggaagcaagtgtaacaatacagactctaaagtgcagggctactatatctgcatcattgggggaaactccgccccggtctacgctcccgccggcgaggatttccgcgcgatggaagtgtttagcgggatcattacctcccctcatggagaggaccacgatctgcccggcgaagagatcgccacgtatcaaatttctggccagatcgaggctaagatccctcacacagttagctccaaaaatctgaagctcaccgccttcgctgggattcccagctactcttccacaagcatcctggccgcctctgaagacggaagatttattttcagcccgggcctttttcctaacctgaaccagtccgtgtgcgataataacgctctccccctgatctggcgggggcttattgacctgaccggatattacgaggcgatccatccttgtaatgtcttctgcgtgctctctggccccggggccagctgtgaggctttctccgaaggaggcatctttaacattaccagccccatgtgcctggtttctaaacagaatcgcttcagagccgccgaacaacagatctcctttatttgtcagcgggtggatatggacatcgtcgtgtattgcaacggccaaaagaagacaattctgacgaaaaccctcgtcatcgggcagtgtatttacacaatcaccagcctgttctctcttctgcctggagtggctcactccatcgccattgagctctgcgttccgggctttcatgggtgggcgacagctgccctgcttgtgaccttctgttttggatgggtcctgatccccgcctgcacgctcgctgtgctgctgttcctcaagtttttcgccaatattctgcacacaagcaaccaggagaatcgctttaaagctatccttagaaagattaaagaagagttcgaaaagaccaagggctccatggtttgtgagatctgcaaatacgaatgcgagaccctgaaggagctcaaagcccacaacctgtcttgtgtgcagggggaatgcccttattgttttacacattgcgagcccaccgaaacagcgatccaagcccactacaaggtctgtcaggctacgcatcggttccgcgaggatctgaaaaagaccgtgacacctcagaatattggccccggatgctatagaacccttaacctcttccggtacaagagcagatgttatatcctgacaatgtggattctgctcctggtgatcgagtccattctttgggccgcttctgccgcggaaatcccgctggttcctctctggaccgacaatgcccacggcgtcgggagcgtgcccatgcatacggacctggagctggatttttcccttccttctagctccaaatacacctataagcgccacctcacaaaccccgtgaatgaccagcaaagcgtctctctgcacatcgaaattgagtcccagggaatcggcgctgatgtgcatcacctggggcattggtacgacgcccggctcaacctgaaaaccagcttccactgctacggagcttgtacaaagtatcagtacccttggcacaccgccaaatgccattttgaaaaggattatgagtacgagaactcttgggcctgtaatcccccggactgccctggcgttggggctggctgcacggcgtgtggactttatctggatcagctcaagcccgtgggcacagccttcaaaattatcagcgtcagatactcccgcaaggtgtgcgttcaatttggggaagagtatctgtgtaaaaccattgacatgaacgattgcttcgtgacacggcacgctaagatctgtatcattggaaccgtcagcaaattttctcagggcgacaccctgcttttcctcgggcccatggaaggaggcgggatcatttttaagcattggtgcacatccacgtgtcacttcggcgatcctggagacgtgatgggcccgaaagacaagccctttatctgccctgagttccccgggcagtttagaaagaaatgtaatttcgccaccacacctgtttgcgaatacgatggaaacgtgattagcggctaccgcaaggtcctggccaccatcgactccttccagtcttttaatacaagcaacgtgcatttcaccgatgagcggattgagtggaaagaccccgatgggatgctgagagaccacatcaatatcgtgatttccaaggatatcgactttgaaaacctcgctgagaatccttgtaaagtcggactgcaagccgcgaacattgaaggcgcttgggggtctggcgttggattcacgcttacatgccaggtgagcctgaccgagtgccccacctttctcacatccatcgaagcctgtgatatggccatttgctatggcgctgagtctgtgaccctgagccgcgggcagaatacaatcaagatcacgggaaagggcgggcactccggaagctctttcaaatgttgccatggcaaggagtgttccgccaacggcctgcaagcgagcgctccgcaccttgacaaagtcaatgggatttctgaactcgagaacgaaaaggtgtacgatgacggagcccctgagtgcggcatcacctgttggtttaaaaagtccggggagtgggttatgggaattatcaatggcaactgggtggtcctgattgtgctgtgcgttctcctgcttttcagcctgatcctcctgtctatcctgtgtcccgtgcggaagcataaaaagtcctga

SEQ ID NO: 13521 - RNA, 3402 nt, synthetic construct
  misc_feature 1..3402: note = derived and/or modified CDS sequence (opt5) from SEOV(HB55)__AF035832.1__GP
  source 1..3402: mol_type = other RNA
atgtggagcctgctcctgcttgccgctctggtgggccaggggttcgccctcaagaacgtctttgacatgagaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaaactgaccaaggtcgtgtggcggaaaaaggctaatcaagaaagcgccaaccaaaattcctttgaggttgtggagagcgaagtctctttcaaagggctctgcatgctgaagcaccgcatggtggaggaatcctatagaaaccggcgcagcgttatctgttacgaccttgcctgcaattctacattttgtaagcctaccgtgtatatgattgtccccatccatgcttgcaacatgatgaaatcctgtctgattggactcggcccttacagaatccaggtggtgtatgagcggacatactgcaccacagggatcctgaccgagggaaagtgtttcgtccccgataaagccgttgtgggcgctcttaagcgcggcatgtatgccattgcgagcatcgaaacgatttgctttttcatccaccagaaagggaataagtacaagattgtgaccgccatcacatctgctatgggatccaaatgtaacaataccgacacaaaggtccaaggctactatatttgcatcatcgggggaaacagcgcccctgtgtacgctccggccggcgaggattttagagcgatggaagttttctccgggattatcacctctccccatggagaggaccacgatctgcctggcgaagagattgccacgtatcagatcagcggccagattgaggctaaaatcccccacacagtgtccagcaagaatctcaaactgatcgcctttgctgggattccttcttactccagcacctctatcctggccgccagcgaagacggacggttcatcttttcccccggcctcttcccgaacctgaaccagtctgtctgcgataataacgcgcttcctctgatttggcgcgggctcattgacctgacaggatattacgaggctgtgcatccctgtaatgttttctgcgtgcttagcggccctggggcctcctgtgaggcttttagcgaaggaggcatcttcaacatcacctctcccatgtgcctggtctccaagcaaaatagatttcgggccgccgaacagcagattagcttcatctgtcaacgcgtggatatggacattatcgtctattgcaacggccagaaaaagaccattctcacaaagacgctggtgatcgggcagtgtatttacaccatcacatctctgttttccctcctgcccggagttgctcacagcatcgccattgagctttgcgtgcctggcttccatgggtgggcgaccgctgccctgctcatcacattttgtttcggatgggtcctgattccggcctgcacccttgctatcctgctcgtgctgaaatttttcgccaatattctgcacacgtccaaccaggagaatagatttaaggctatcctccggaaaatcaaggaagagttcgaaaagacaaagggctctatggtttgtgagatttgcaagtacgaatgcgagaccctgaaagagcttaaggcccacaacctgagctgtgtgcaaggggaatgcccctattgttttacccattgcgagcctacagaaaccgcgatccaggcccactacaaagtctgtcaggctacacatcgcttcagagaggatctcaagaaaacggtgacaccccagaatattggccctggatgctatcggaccctgaacctgttcagatacaagtcccgctgttatatccttaccatgtggacactcctgctgattatcgagtctatcctctgggccgctagcgccgcggaaattcccctggtgccgctttggaccgacaatgcccacggcgttgggtccgtccctatgcatacggacctggagctcgattttagcctgccctcttccagcaagtacacctataaacggcacctgacaaaccctgtgaatgaccaacagtctgtgtcccttcacatcgaaattgagagccagggaatcggcgctgatgtccatcacctcgggcattggtacgacgccagactgaacctgaagacctctttccactgctacggagcttgtacaaaatatcagtacccctggcacaccgccaagtgccattttgaaaaagattatgagtacgagaacagctgggcctgtaatcctcccgactgcccgggcgtggggacgggctgcacagcttgtggactctatctggatcaacttaagcctgttggcaccgcgttcaagattatctccgtgcgctacagccggaaagcctgcgtccagtttggggaagagtatctgtgtaagacaatcgacatgaacgattgcttcgtgaccggacacgctaaaatttgtatcattggcaccgtttctaagttttcccagggggacacactcctgttcctgggacccatggaaggcgggggcatcatttttaaacattggtgcacgagcacctgtcacttcggagatcccggcgacgtgatggggcctaaggacaaaccgtttatctgccccgagttccctggacagtttagaaagaagtgtaatttcgccacaacccccatttgcgaatacgatggcaacatcatctccgggtacaaaaaggtccttgccacaattgactctttccagagctttaatacctccaacatccatttcacggatgagcgcattgagtggcgggaccctgatggaatgctcagagaccacatcaatattgtgatctctaaagatatcgactttgaaaacctggctgagaatccctgtaaggttggcctgcaggccgcgaacattgaaggggcttggggcagcggagtgggcttcacactgacctgccaggtctccctgaccgagtgccctacatttcttacctctatcaaagcctgtgatatggccatttgctatggggctgaaagcgtgacactgtcccgcggacaaaatacggtgcggatcaccggcaaagggggacacagcgggtcttccttcaagtgttgccatggcaaagagtgtagctctacaggcctccaggcctccgcgccccacctggacaaggtcaacggaattagcgagctggaaaatgagaaagtttacgatgacggcgctccggaatgcggggtgacctgttggtttaagaaatctggagagtgggtgatgggcatcatcaacgggaattgggtcgtgcttattgttctctgcgtgctgctcctcttctccctgatccttctgagcattctctgtcctgtcagaaagcataagaaatcctga

SEQ ID NO: 13522 - RNA, 3402 nt, synthetic construct
  misc_feature 1..3402: note = derived and/or modified CDS sequence (opt5) from SEOV(L99)__AF035833.1__GP
  source 1..3402: mol_type = other RNA
atgtggagcctgctcctgcttgccgctctggtgggccaggggttcgccctcaagaacgtctttgacatgagaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaaactgaccaaggtcgtgtggcggaaaaaggctaatcaagaactcgccaaccagaatagctttgaggttgtggagtccgaagtcagcttcaaagggctgtgcatgcttaagcaccgcatggtggaggaatcttatagaaaccggcgctccgttatctgttacgacctggcctgcaatagcacattttgtaagcctaccgtgtatatgattgtccccatccatgcttgcaacatgatgaaatcttgtctcattggactgggcccttacagaatccaggtggtgtatgagcggacatactgcaccacagggatccttaccgagggaaagtgtttcgtccccgataaagccgttgtgtccgctctgaagcgcggcatgtatgccattgcgagcatcgaaacgatttgctttttcatccaccagaaaggcaatacctacaagattgtgacagccatcacctctgctatggggtccaagtgtaacaatacagacaccaaagtccaaggatactatatttgcatcatcggcgggaacagcgcccctgtgtacgctccggccggagaggattttagagcgatggaagttttctccggcattatcacgtctccccatggggaggaccacgatctccctggagaagagattgccacatatcagatcagcggccagattgaggctaagatcccccacaccgtgtccagcaaaaatctgaagctgatcgcctttgctggcattccttcttactccagcacatctatcctcgccgccagcgaagacgggcggttcatcttttcccccggactgttcccgaaccttaaccagtctgtctgcgataataacgctctgcctctcatttggcgcggcctgattgaccttaccgggtattacgaggcggtgcatccctgtaatgttttctgcgtgctgagcggacctggcgcctcctgtgaggcttttagcgaagggggaatcttcaacatcacctctcccatgtgcctcgtctccaaacaaaatagatttcgggccgccgaacagcagattagcttcatctgtcaacgcgtggatatggacattatcgtctattgcaacggccagaagaaaacaattctgacgaagaccctggtgatcggccagtgtatttacacaatcacctctctcttttccctgcttcccggggttgctcacagcatcgccattgagctgtgcgtgcctggattccatggctgggcgacagctgccctcctgatcaccttttgtttcgggtgggtccttattccggcctgcacgctggctatcctcctggtgctgaagtttttcgccaatattctccacacatccaaccaggagaatagatttaaagctatcctgcggaagatcaaagaagagttcgaaaagaccaaaggatctatggtttgtgagatttgcaagtacgaatgcgagacccttaaggagctgaaagcccacaacctcagctgtgtgcaaggcgaatgcccctattgttttacacattgcgagcctaccgaaacagcgatccaggcccactacaaggtctgtcaggctacgcatcgcttcagagaggatctgaaaaagaccgtgacacccaaaaatattgggcctggctgctatcggaccctgaaccttttcagatacaagtcccgctgttatatcctcacaatgtggaccctgctgctcattatcgagtctatcctgtgggccgctagcgccgcggaaattccccttgtgccgctgtggacggacaatgcccacggagttggctccgtccctatgcataccgacctcgagctggattttagcctgccctcttccagcaagtacacatataaacggcaccttaccaaccctgtgaatgaccagcaatctgtgtccctccacatcgaaattgagagccaggggatcggagctgatgtccatcacctgggccattggtacgacgccagactgaacctcaagacatctttccactgctacggggcttgtaccaaatatcagtacccctggcacacggccaagtgccattttgaaaaagattatgagtacgagaacagctgggcctgtaatcctcccgactgcccgggagtgggcacagggtgcaccgcttgtggcctgtatcttgatcagctgaagcctgttggaacagcgttcaagattatctccgtgcgctacagccggaaagtctgcgtgcaatttggcgaagagtatctctgtaagaccatcgacatgaacgattgcttcgttaccagacacgccaaaatttgtatcattgggacagtgtctaagttttcccagggagacacgctgctgttccttggccccatggaagggggaggcatcatttttaaacattggtgcaccagcacatgtcacttcggggatcccggcgacgtcatgggacctaaggacaaaccgttttcctgccccgagttccctggccagtttcgcaagaagtgtaatttcgctaccacacccatctgcgaatacgatgggaacattatctctggatacaaaaaggtgctcgccaccatcgacagcttccagtcctttaatacgtctaacattcatttcacagatgagcggatcgagtggagagaccctgatggcatgctgcgcgaccacattaatatcgttattagcaaagatatcgactttgaaaacctggccgagaatccctgtaaggtggggctccaagctgccaacatcgaaggagcgtggggctccggggtcggcttcaccctgacctgccaggtgtctcttacagagtgccctacctttctgacaagcattaaagcctgtgatatggccatctgctatggagccgaatccgtgacgctcagccggggccagaataccgtcagaattacagggaagggaggccactctgggtccagcttcaagtgttgccatggaaaagagtgttcttccaccggcctgcaagctagcgctccccacctggacaaggttaacggcatctctgagcttgaaaatgagaaagtgtacgatgacggggcgccggaatgcggagtgacatgttggtttaagaaatccggcgagtgggtcatggggattatcaacggaaattgggtggttctcatcgtgctgtgcgtcctgctcctgttcagccttattctgctctccatcctgtgtcctgtgcgcaagcataagaaaagctga

SEQ ID NO: 13523 - RNA, 3402 nt, synthetic construct
  misc_feature 1..3402: note = derived and/or modified CDS sequence (opt5) from SEOV(Z37)__AF187081.1__GP
  source 1..3402: mol_type = other RNA
atgtggagcctgctcctgcttgccgctctggtgggccaggggttcgccctcaagaacgtctttgacatgagaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaaactgaccaaggtcatctggcggaaaaaggctaatcaagaaagcgccaaccaaaattcctttgaggtggttgagagcgaagtgtctttcaaagggctctgcatgctgaagcaccgcatggtcgaggaatcctatagaaaccggcgcagcgtgatttgttacgaccttgcctgcaattctacattttgtaagcctaccgtttatatgatcgtgcccattcatgcttgcaacatgatgaaatcctgtctgatcggactcggcccttacagaatccaggtcgtgtatgagcggacatactgcaccacagggattctgaccgagggaaagtgtttcgtgcccgataaagccgtcgttagcgctcttaagcgcggcatgtatgccatcgcgtctattgaaacgatctgctttttcattcaccagaaaggcaataagtacaagatcgtgaccgccattacatccgctatggggagcaaatgtaacaataccgacacaaaggtgcagggatactatatctgcatcattggcgggaactccgcccctgtctacgctccggccggagaggattttagagcgatggaagtgttctctggcatcattaccagcccccatggggaggaccacgatctgcctggagaagagatcgccacgtatcagatttccggccagatcgaggctaaaatcccccacacagttagctctaagaatctcaaactgaccgcctttgctggcattccttcctacagctctacaagcatcctggccgcctccgaagacgggcggttcatttttagccccggactcttcccgaacctgaaccagagcgtgtgcgataataacgcgcttcctctgatctggcgcggcctcattgacctgaccgggtattacgaggctgtccatccctgtaatgtgttctgcgttctttccggacctggcgccagctgtgaggctttttctgaagggggaatcttcaacatcacctcccccatgtgcctggtgagcaagcaaattagatttcgggccgccgaacagcagatctctttcatttgtcaacgcgtcgatatggacatcattgtgtattgcaatggccagaaaaagacaatcctcacgaagaccctggtcattggccagtgtatctacacaatcacctccctgtttagcctcctgcccggggtggctcactccattgccatcgagctttgcgttcctggattccatggctgggcgacagctgccctgctcattaccttttgtttcgggtgggtgctgatcccggcctgcacgcttgctattctgctcgtcctgaaatttttcgccaacatcctgcacacatctaatcaggagaacagatttaaggctatcctccggaaaattaaggaagagttcgagaaaaccaagggaagcatggtgtgtgaaatctgcaagtacgaatgcgagaccctgaaagagcttaaggcccacaatctgtcctgtgttcaaggcgaatgcccctattgttttacacattgcgagcctaccgaaacagcgattcaggcccactacaaagtgtgtcaggctacgcatcgcttcagagaggatctcaagaaaaccgtcacaccccagaacatcgggcctggctgctatcggaccctgaatctgttcagatacaagtctcgctgttatattcttacaatgtggaccctcctgctgatcatcgagagcattctctgggccgcttccgccgcggaaatccccctggtgccgctttggacggacaacgcccacggagtgggcagcgttcctatgcataccgacctggagctcgatttttctctgccctccagctctaagtacacatataaacggcacctgaccaatcctgtcaacgaccaacagtccgtgagccttcacattgaaatcgagtctcaggggattggagctgatgtgcatcacctcggccattggtacgacgccagactgaatctgaagacatctttccactgctacggggcttgtaccaaatatcagtacccctggcacacggccaagtgccattttgaaaaagattatgagtacgagaactcctgggcctgtaaccctcccgactgcccgggagtcggcacagggtgcaccgcttgtggcctctatctggatcaacttaagcctgtgggaacagcgttcaagatcatcagcgttcgctactctcggaaagtgtgcgtccagtttggcgaagagtatctgtgtaagaccattgacatgaatgattgcttcgtgaccagacacgccaaaatctgtattatcgggacagtttccaagtttagccagggagacacgctcctgttcctgggccccatggaagggggaggcattatctttaaacattggtgcacctccacatgtcacttcggggatcccggcgacgtgatgggacctaaggacaaaccgtttatttgccccgagttccctggccagtttcgcaagaagtgtaacttcgctaccacacccgtctgcgaatacgatgggaatatcatctctggatacaaaaaggtgcttgccaccattgacagcttccaatcctttaacacgtctaatatccatttcacagatgagcggattgagtggagagaccctgatggcatgctccgcgaccacatcaacattgttatcagcaaagatatcgactttgaaaatctggccgagaacccctgtaaggtggggctgcaggctgccaatattgaaggagcgtggggctccggggtcggcttcaccctgacctgccaggtgtctctgacagagtgccctacctttcttacaagcatcaaggcttgtgatatggccatttgctatggagccgaatccgtgacgctgagccggggccaaaacaccgtcaaaatcacagggaagggaggccactctgggtccagcttcaaatgttgccatggaaaggagtgttcttccaccggcctccaggctagcacaccccacctggacaaagttaatggcatttctgagctggaaaacgagaaggtgtacgatgacggggccccggaatgcggaatcacctgttggtttaaaaagtccggcgagtgggtgatggggatcattaatggaaactgggtcgtgcttatcgttctctgcgtgctgctcctcttcagcctgattcttctgtccatcctctgtcctgtcagaaagcataaaaagagctga

SEQ ID NO: 13524 - RNA, 3402 nt, synthetic construct
  misc_feature 1..3402: note = derived and/or modified CDS sequence (opt5) from SEOV(Z37)__AF190119.1__GP
  source 1..3402: mol_type = other RNA
atgtggagcctgctcctgcttgccgctctggtgggccaggggttcgccctcaagaacgtctttgacatgagaatccaatgcccccactccgttaatttcggagagacctctgtgagcggctacacagaactgcctccgctttccctgcaggaggcggaacagctcgtgcccgagtctagctgtaacatggataatcatcagtccctgtctacgattaacaaactgaccaaggtcatctggcggaaaaaggctaatcaagaaagcgccaaccaaaattcctttgaggtggttgagagcgaagtgtctttcaaagggctctgcatgctgaagcaccgcatggtcgaggaatcctatagaaaccggcgcagcgtgatttgttacgaccttgcctgcaattctacattttgtaagcctaccgtttatatgatcgtgcccattcatgcttgcaacatgatgaaatcctgtctgatcggactcggcccttacagaatccaggtcgtgtatgagcggacatactgcaccacagggattctgaccgagggaaagtgtttcgtgcccgataaagccgtcgttagcgctcttaagcgcggcatgtatgccatcgcgtctattgaaacgatctgctttttcattcaccagaaaggcaatacctacaagatcgtgacagccattacctccgctatggggagcaagtgtaacaatacagacaccaaagtgcagggatactatatctgcatcattggcgggaactccgcccctgtctacgctccggccggagaggattttagagcgatggaagtgttctctggcatcattacgagcccccatggggaggaccacgatctgcctggagaagagatcgccacatatcagatttccggccagatcgaggctaagatcccccacaccgttagctctaaaaatctcaagctgacagcctttgctggcattccttcctacagctctaccagcatcctggccgcctccgaagacgggcggttcatcttttctcccggactcttcccgaacctgaaccagagcgtgtgcgataataacgcgcttcctctgatttggcgcggcctcattgacctgaccgggtattacgaggctgtccatccctgtaatgtgttctgcgttctttccggacctggcgccagctgtgaggctttttctgaagggggaatcttcaacatcacatcccccatgtgcctggtgagcaaacaaaatagatttcgggccgccgaacagcagatttctttcatctgtcaacgcgtcgatatggacattatcgtgtattgcaacggccagaagaaaacgattctcaccaagacactggtcatcggccagtgtatttacaccatcacatccctgtttagcctcctgcccggggtggctcactccatcgccattgagctttgcgttcctggattccatggctgggcgaccgctgccctgctcatcacgttttgtttcgggtgggtgctgattccggcctgcacacttgctatcctgctcgtcctgaagtttttcgccaatattctgcacacctctaaccaggagaatagatttaaagctatcctccggaagatcaaagaagagttcgaaaagaccaaaggaagcatggtgtgtgagatttgcaagtacgaatgcgagacactgaaggagcttaaagcccacaacctgtcctgtgttcaaggcgaatgcccctattgttttacccattgcgagcctacagaaacggcgatccaggcccactacaaggtgtgtcaggctacccatcgcttcagagaggatctcaaaaagacagtcacaccccagaatattgggcctggctgctatcggaccctgaacctgttcagatacaaatctcgctgttatatccttaccatgtggacgctcctgctgattatcgagagcatcctctgggccgcttccgccgcggaaattcccctggtgccgctttggaccgacaatgcccacggagtgggcagcgttcctatgcatacagacctggagctcgatttttctctgccctccagctctaagtacacctataagcggcacctgacaaaccctgtcaatgaccaacagtccgtgagccttcacatcgaaattgagtctcaggggatcggagctgatgtgcatcacctcggccattggtacgacgccagactgaacctgaaaaccagcttccactgctacggggcttgtacgaagtatcagtacccctggcacacagccaaatgccattttgaaaaggattatgagtacgagaactcctgggcctgtaatcctcccgactgcccgggagtcggcaccgggtgcacagcttgtggcctctatctggatcaacttaaacctgtgggaaccgcgttcaagattatcagcgttcgctactctcggaaggtgtgcgtccagtttggcgaagagtatctgtgtaaaaccatcgacatgaacgattgcttcgtgacaagacacgccaagatttgtatcattgggacggtttccaaatttagccagggagacaccctcctgttcctgggccccatggaagggggaggcatcatttttaagcattggtgcacatccacctgtcacttcggggatcccggcgacgtgatgggacctaaagacaagccgtttatctgccccgagttcgctggccagtttcgcaaaaagtgtaatttcgccacaacccctgtctgcgaatacgatgggaacattatctctggatacaagaaagtgcttgagacgatcgacagcttccaatcctttaatacatctaacattcatttcaccgatgagcggatcgaatggagagaccccgatggcatgctccgcgaccacattaatatcgttattagcaaggatatcgactttgagaacatggccgaaaatccttgtaaagtggggctgcaggctgccaacatcgagggagcgtggggctccggggtcggcttcaccctgacatgccaggtgtctctcaccgaatgccccacaagcctgacgtccattaaggcttgtgatatggccatctgctatggagccgagagcgtgaccctttctcggggccaaaatacagtcaaaattaccgggaagggaggccactccgggagctcttttaagagatgtcatggaaaagagtgctccagcacaggcctgcaggcttctgcccctcacctcgacaaggttaacggcatctccgaactggagaatgaaaaagtgtacgatgacggggcgcccgagtgtggaattacctgctggttcaagaaaagcggcgagtgggtgatggggatcatcaacggaaattgggtcgtgctgattgttctttgtgtgctcctgctgttttccctcatcctgcttagcattctgtgcccggtccgcaagcataagaaatcttga

SEQ ID NO: 13525 - RNA, 3402 nt, synthetic construct
  misc_feature 1..3402: note = derived and/or modified CDS sequence (opt5) from SEOV__M34882.1__GP
  source 1..3402: mol_type = other RNA
atgtggagcctgctcctgcttgccgctctggtgggccaggggttcgccctcaagaacgtctttgacatgagaatccaactgccccactccgttaatttcggagagacctctgtgagcggctacacagaatttcctccgctttccctgcaggaggcggaacagctcgtgcccgagtctagctgcaacatggataatcatcagtccctgtctacgattaacaaactgaccaaggtcatctggcggaaaaaggctaatcaagaaagcgccaaccaaaattccttcgaggtggttgagagcgaagtgtcttttaaagggctctgtatgctgaagcaccgcatggtcgaggaatcctatagaaaccggcgcagcgtgatttgctacgaccttgcctgtaattctacattctgcaagcctaccgtttatatgatcgtgcccattcatgcttgtaacatgatgaaatcctgcctgatcggactcggcccttacagaatccaggtcgtgtatgagcggacatactgtaccacagggattctgaccgagggaaagtgctttgtgcccgataaagccgtcgttagcgctcttaagcgcggcatgtatgccatcgcgtctattgaaacgatctgtttctttattcaccagaaaggcaatacctacaagatcgtgacagccattacctccgctatggggagcaagtgcaacaatacagacaccaaagtgcagggatactatatctgtatcattggcgggaactccgcccctgtctacgctccggccggagaggatttcagagcgatggaagtgttttctggcatcattacgagcccccatggggaggaccacgatctgcctggagaagagatcgccacatatcagatttccggccagatcgaggctaagatcccccacaccgttagctctaaaaatctcaagctgacagccttcgctggcattccttcctacagctctaccagcatcctggccgcctccgaagacgggcggtttattttctctcccggactcttcccgaacctgaaccagagcgtgtgcgataataacgcgcttcctctgatctggcgcggcctcattgacctgaccgggtattacgaggctgtccatccctgcaatgtgttttgtgttctttccggacctggcgccagctgcgaggctttctctgaagggggaatctttaacatcacatcccccatgtgtctggtgagcaaacaaaatagattccgggccgccgaacagcagatttcttttgtctgccaacgcgtggatatggacatcattgtctattgtaacggccagaagaaaacgatcctcaccaagacactggtgattggccagtgcatctacaccattacatccctgttcagcctcctgcccggggttgctcactccatcgccatcgagctttgtgtgcctggatttcatggctgggcgaccgctgccctgctcattacgttctgctttgggtgggtcctgatcccggcctgtacacttgctattctgctcgtgctgaagttctttgccaatatcctgcacacctctaaccaggagaatagattcaaagctattctccggaagatcaaagaagagtttgaaaagaccaaaggaagcatggtttgcgagatctgtaagtacgaatgcgagacactgaaggagcttaaagcccacaacctgtcctgcgtgcaaggcgaatgtccctattgcttcacccattgtgagcctacagaaacggcgattcaggcccactacaaggtctgccaggctacccatcgcttcagagaggatctcaaaaagacagtgacaccccagaatatcgggcctggctgttatcggaccctgaacctgtttagatacaaatctcgctgctatattcttaccatgtggacgctcctgctgatcattgagagcatcctctgggccgcttccgccgcggaaatccccctggtgccgctttggaccgacaatgcccacggagttggcagcgtccctatgcatacagacctggagctcgatttctctctgccctccagctctaagtacacctataagcggcacctgacaaaccctgtgaatgaccaacagtccgtgagccttcacattgaaatcgagtctcaggggattggagctgccgtccatcacctcggccattggtacgatgctagactgaacctgaaaaccagctttcactgttacggggcctgcacgaagtatcagtacccctggcacacagccaaatgtcatttcgaaaaggactatgagtacgagaactcctgggcttgcaatcctcccgattgtccgggagtgggcaccgggtgcacagcgtgcggcctctatctggaccaacttaaacctgttggaaccgcctttaagatcattagcgtgcgctactctcggaaggtctgtgtgcagttcggcgaggaacacctgtgcaaaaccatcgatatgaacgactgttttgttacaagacatgctaagatctgcattatcgggacggtgtccaaattcagccagggagataccctcctgtttctgggccccatggaagggggaggcattatcttcaagcactggtgtacatctacctgccattttggggaccccggcgatgtcatgggacctaaagacaagccgttcatttgtcccgagtttcctggccagttccgcaaaaagtgcaatttcgccacaacccccgtgtgtgaatatgacgggaacatcatttctggatacaagaaagttcttgccacgatcgatagctttcaatccttcaatacatctaacatccactttaccgacgagcggattgagtggagagatcctgacggcatgctccgcgatcacatcaatattgtgatcagcaaggacattgatttcgaaaacctggctgagaatccctgcaaagtcgggctgcaggccgcgaacatcgaaggagcttggggctccggggtgggctttaccctcacatgtaaggtgtctctgaccgagtgccctacattccttacgagcatcaaagcctgcgacatggccatttgttacggagctgaatccgtcaccctgagccggggccagaatacagttaagatcaccgggaagggaggccattctgggtccagctttaaatgctgtcacggaaaggagtgctcctccacaggcctccaagccagcgcgccccatctggataaagtgaacggcatttctgagctggaaaatgagaaggtgtatgacgatggggctccggaatgtggaattacctgctggttcaaaaagtccggcgagtgggtcatggggatcatcaacggaaattgggtggttcttatcgtgctctgtgtcctgctgctctttagcctgattcttctgtccatcctctgccctgtgagaaagcacaaaaagagctga

SEQ ID NO: 13526 - RNA, 3423 nt, synthetic construct
  misc_feature 1..3423: note = derived and/or modified CDS sequence (opt5) from SNV(NM H10)__NC_005215.1__GP
  source 1..3423: mol_type = other RNA
atggtgggctgggtctgcatcttcctggttgtgctcaccacagccacggctgggctgaccagaaacctttacgagctgaagattgaatgtccccacacagtgggactcggccaggggtatgtcaccggaagcgtggagatcacacctattctgcttacccaagttgccgacctgaaaatcgaatcctcttgcaattttgatctccatgtgccggcgacaaccacgcagaagtacaaccaggtcgactggaccaaaaagagctccacaaccgagtctacaaatgctggcgccaccacgttcgaagccaaaacaaaggagattaacctgaaggggacctgtaatattccccctacaacctttgaggctgcctataaaagccggaagaccgtgatctgctacgatctggcttgtaaccagacacactgcctccccacggttcatctgattgcccctgtgcaaacctgtatgtccgtccgctcttgcatgatcggacttctgagctccagaatccaggtgatctatgagaaaacatactgtgtgaccggccagctcattgagggcctgtgcttcatccccacacacaccattgcgcttacgcagcctgggcatacatatgacaccatgaccctgccggtcacatgttttctcgttgccaagaaactgggaacccaactgaagctcgctgtggaactggagaaacttatcacaggcgtgagctgcacggaaaattctttccaggggtactacatctgctttattggaaagcactccgaacccctgttcgtccctaccatggaggattatcggagcgccgaactctttacacgcatggtgctgaaccccagaggcgaggaccacgatcctgaccagaatgggcagggacttatgcggatcgctggccccgttaccgccaaggtgccgtctacagaaaccacggagaccatgcaaggcattgcgttcgccggggctcctatgtactccagcttttctacactggtccgcaaagccgatcccgagtatgtgttctcccctggaatcattgctgaaagcaaccattccgtttgtgacaagaaaaccgtgcccctcacatggaccggctttctggccgtctctggggagatcgaaaagatcacgggatgcacagtgttctgtaccctggccggccccggggctagctgcgaggcgtactccgaaacaggaattttcaatatcagctctcctacctgtctcgtcaacaaagtgcagaagtttagaggctccgagcagcggattaatttcatgtgccaacgcgttgatcaggacgtggtcgtgtattgtaacggccagaagaaagttatcctgaccaagacacttgtgattgggcagtgcatctacacgtttaccagcctgttctctctcatcccgggagtcgcccacagcctggctgtggagctttgtgtgcccggcctgcatgggtgggccacaaccgccctcctgattacattttgcttcggatggctgctcatccctgctgttaccctgattatccttaaaattctgagactcctgacgttttcctgttctcactatagcacagaatccaagttcaaagtcatcctggagcgggtgaaggtggaataccaaaagaccatgggcagcatggtctgcgatatttgccaccatgagtgtgaaaccgccaaagagcttgagacacacaagaaatcttgccccgaagggcagtgtccttactgcatgaccatcacagagtccacggaaagcgcgctccaggctcattttgccatctgtaagctgaccaatcgcttccaggagaacctgaaaaagtctctcaagagacccgaggtgcggaaaggctgctatcgcacactgggagtttttagatacaagtcccggtgttatgtgggccttgtctgggggattctgctcaccacagaactgatcatttgggccgctagcgccgacaccccgctgatggagtccggatggtctgacacggctcacggcgtggggatcattcctatgaaaaccgatcttgaactcgacttcgccctggcgagctcctctagctactcctatagacgcaagctggttaaccccgccaatcaagaggaaacactcccttttcatttccagctggataaacaggtggtccacgctgagatccagaaccttggacactggatggacggcaccttcaatatcaagacagcctttcattgctacggggagtgtaagaaatatgcttacccctggcaaaccgccaagtgcttctttgaaaaagattaccagtatgagacaagctggggctgtaaccctcccgactgcccgggagtgggcaccgggtgcacggcgtgtggagtttacctggataagctccggtctgtgggcaaagcctataagattgtctccctgaaatacacaagaaaggtgtgcatccagctggggaccgaacagacctgtaagcacattgacgtgaatgattgccttgtcacacctagcgttaaagtgtgtatgatcggaaccatttctaagctccaacccggcgacacgctgctgttcctcgggcccctggagcagggcggaatcatccttaaacagtggtgcacaacctcctgtgtgtttggcgatcctggggacattatgagcacaacctctggaatgcgctgcccggaacatacaggcagcttccggaagatctgtgggtttgctaccacgcctacctgcgagtatcaaggaaacacagtctccggcttccagagaatgatggccacccgcgacagctttcagtctttcaatgtgacagagccccacattacctccaaccggctggaatggatcgatcccgacagctccattaaagatcacatcaatatggttctcaacagagacgtgtcttttcaggatctgagcgacaatccttgtaaggtcgatctgcatacgcaatccatcgacggggcttggggctctggagtgggcttcacacttgtttgcaccgtggggctcacagagtgcgccaactttattaccagcatcaaggcctgtgattccgctatgtgctacggagcgaccgtcacaaatctgctgcgcggctctaacacggtgaaagttgtggggaagggaggccacagcggctccctcttcaaatgttgccatgacaccgattgtacagaagaggggctggccgcttctccccctcaccttgaccgggtcaccggatataatcagattgatagcgacaaggtgtacgacgatggcgctcccccgtgcacaatcaaatgttggttcaccaagtccggggaatggctgctcggcattctgaacggaaactgggtggtcgttgccgtgctgatcgtgattcttatcctgagcatcctcctgttttctttcttttgccctgtcagatcccgcaagaataaagccaactga

SEQ ID NO: 13527 - RNA, 3423 nt, synthetic construct
  misc_feature 1..3423: note = derived and/or modified CDS sequence (opt5) from SNV(1)__JQ690283.1__GP
  source 1..3423: mol_type = other RNA
atggtgggctgggtctgcatcttcctggttgtgctcaccacagccacggctgggctgaccagaaacctttacgagctgaagattgaatgtccccacacagtgggactcggccaggggtatgtcaccggaagcgtggagacaacccctatcctgcttacacaagttgccgacctgaaaattgaatcctcttgcaattttgatctccatgtgccggcgaccacgacccagaagtacaaccaggtcgactggaccaaaaagagctccacaacagagtctaccaatgctggcgccgccacgttcgaagctaaaacaaaggaggtgaacctgaaggggacctgtaatattccccctacaacctttgaggccgcttataaaagccggaagaccgttatttgctacgatctggcctgtaaccagacacactgcctccccacggtgcatctgatcgcgcctgtccaaacctgtatgtccgtgcgctcttgcatgatcggacttctgagctccagaatccaggtgatctatgagaaaacatactgtgtcaccggccagctcattgagggcctgtgcttcatccccacacacaccattgcccttacgcagcctgggcatacatatgacaccatgaccctgccggttacatgttttctcgtggctaagaaactgggaacccaactgaagctcgccgtggaactggagaaacttatcacaggcgtcagctgcacggaaaattctttccaggggtactacatttgctttatcggaaagcactccgaacccctgttcgtgcctaccatggaggattatcggagcgctgaactctttacacgcatggttctgaaccccagaggcgaggaccacgatcctgaccagaatgggcagggacttatgcggatcgccggccccgtgaccgcgaaggtcccgtctacagaaaccacggagaccatgcaaggcattgccttcgctggggcccctatgtactccagcttttctacactggtgcgcaaagctgatcccgagtatgttttctcccctggaatcattgccgaaagcaaccattccgtgtgtgacaagaaaaccgtccccctcacatggaccggctttctggccgtgtctggggagatcgaaagaattacgggatgcacagtcttctgtaccctggctggccccggggcgagctgcgaggcctactccgaaacaggaatcttcaatatcagctctcctacctgtctcgtgaacaaggttcagaaatttcggggctccgagcagcgcattaatttcatgtgccaaagagtggatcaggacgtcgtggtttattgtaacggccagaagaaggtgatcctgaccaaaacacttgtcattgggcagtgcatctacacgtttaccagcctgttctctctcattccgggagtggctcacagcctggccgtggagctttgtgttcccggcctgcatgggtgggccacaaccgctctcctgatcacattttgcttcggatggctgctcatccctaccgtcacgctgattatccttaaggtgctgcggctcctgacattttcctgttctcactatagcaccgaatccaaattcaaggtgattctggagcgcgtcaaagtggaataccaaaagaccatgggcagcatggtttgcgatatctgccaccatgagtgtgaaacagccaaggagcttgagacccacaaaaagtcttgccccgaagggcagtgtccttactgcatgacaattacggagtccaccgaaagcgcgctccaggctcatttttctatctgtaaactgacaaatagattccaggagaacctgaagaaatccctcaagcggcccgaggtgcgcaagggctgctatagaaccctgggagtctttcggtacaaaagcagatgttatgtgggccttgtttgggggattctgctcacaaccgaactgatcatctgggccgcctccgctgacacgccgctgatggagtctggatggagcgacaccgcccacggcgtggggattatccctatgaagacagatcttgaactcgacttcgctctggcctcctctagctcctacagctatcgccggaaactggtcaaccccgcgaatcaagaggaaaccctcccttttcatttccagctggataaacaggtggttcacgccgagattcagaaccttggacactggatggacggcacattcaatatcaagaccgcttttcattgctacggggagtgtaagaagtatgcctacccctggcaaacagctaaatgcttctttgaaaaggattaccagtatgagacctcttggggctgtaaccctcccgactgcccgggagtgggcacggggtgcacagcctgtggagtctacctggataaactcagatccgtgggcaaggcgtataaaattgtgagcctgaagtacacccgcaaagtctgcatccagctggggaccgaacagacatgtaagcacatcgacgttaatgattgccttgtgaccccttctgtgaaggtctgtatgattggaacgatctccaaactccaacccggcgacacactgctgttcctcgggcccctggagcagggcggaattatccttaagcagtggtgcaccacaagctgtgtgtttggcgatcctggggacattatgtctaccacaagcggaatgcggtgcccggaacataccggctccttcagaaaaatctgtgggtttgccacgacccccacatgcgagtatcaaggaaacaccgttagcggcttccagcgcatgatggctacacgggactcttttcagtccttcaatgtgaccgagcctcacatcacgagcaacagactggaatggattgatcccgactcctctatcaaggatcacattaatatggtcctcaaccgcgacgtgagctttcaggatctgtccgacaatccttgtaaagttgatctgcatacacaatctatcgacggggcctggggcagcggagtgggcttcacccttgtctgcacagtggggctcaccgagtgcgctaactttattacctccatcaaggcctgtgattctgccatgtgctacggagctacagttacgaatctgctgcggggcagcaacaccgtgaaggtcgtggggaaaggaggccactccggcagcctcttcaagtgttgccatgacacagattgtaccgaagaggggctggcggcctctccccctcaccttgacagagtgacaggatataatcagatcgattccgacaaagtctacgacgatggcgctcccccgtgcaccattaagtgttggttcacgaaaagcggggaatggctgctcggaatcctgaacggcaactgggttgtggtggccgtcctgattgtgatccttattctgtctatcctcctgttttccttcttttgccctgttcgcaatcggaagaacaaggccaattga

SEQ ID NO: 13528 - RNA, 3423 nt, synthetic construct
  misc_feature 1..3423: note = derived and/or modified CDS sequence (opt5) from SNV(1)__JQ690279.1__GP
  source 1..3423: mol_type = other RNA
atggtgggctgggtctgcatcttcctggttgtgctcaccacagccacggctgggctgaccagaaacctttacgagctgaagattgaatgtccccacacagtgggactcggccaggggtatgtcaccggaagcgtggagacaacccctatcctgcttacacaagttgccgacctgaaaattgaatcctcttgcaattttgatctccatgtgccggcgaccacgacccagaagtacaaccaggtcgactggaccaaaaagagctccaccacagagtctaccaatgctggcgccaacacgttcgaagccaaaacaaaggagatcaatctgaaggggacctgtaacattccccctacaacctttgaggctgcctataaaagccggaagaccgtgatctgctacgatctggcttgtaatcagacacactgcctccccacggttcatctgatcgcccctgtgcaaacctgtatgtccgtccgctcttgcatgattggacttctgagctccagaatccaggtgatttatgaaaagacatactgtgtgaccggccagctcatcgagggcctgtgcttcattcccacacacaccatcgcgcttacgcagcctgggcatacatatgacaccatgaccctgccggtcacatgttttctcgttgccaagaaactgggaacccaactgaagctcgctgtggaactggagaaacttattacaggcgtgagctgcacggagaactctttccaggggtactacatctgctttatcggaaaacactccgaacccctgttcgtccctaccatggaggattatcggagcgccgaactctttacacgcatggtgctgaatcccagaggcgaggaccacgatcctgaccagaacgggcagggacttatgcggattgctggccccgttaccgccaaggtgccgtctacagaaaccacggagaccatgcaaggcatcgcgttcgccggggctcctatgtactccagcttttctacactggtccgcaaagccgatcccgagtatgtgttctcccctggaattatcgctgaaagcaatcattccgtttgtgacaagaaaaccgtgcccctcacatggaccggctttctggccgtctctggggagattgaaagaatcacgggatgcacagtgttctgtaccctggccggccccggggctagctgcgaggcgtactccgaaacaggaatcttcaacattagctctcctacctgtctcgtcaataaggtgcagaaatttcggggctccgagcagcgcatcaacttcatgtgccaaagagttgatcaggacgtggtcgtgtattgtaatggccagaagaaggttattctgaccaaaacacttgtgatcgggcagtgcatttacacgtttaccagcctgttctctctcatcccgggagtcgcccacagcctggctgtggagctttgtgtgcccggcctgcatgggtgggccacaaccgccctcctgatcacattttgcttcggatggctgctcattcctaccgttacgctgcttatcctgaagattctccggctgctgacattttcctgttctcactatagcaccgaatccaaattcaaggtcatccttgagcgcgtgaaagtggaataccaaaagaccatgggcagcatggtctgcgatatttgccaccatgagtgtgaaacagctaaggagctcgagacccacaaaaagtcttgccccgaagggcagtgtccttactgcatgacaatcacggagtccaccgaaagcgccctgcaggcgcatttttctatttgtaaactgacaaacagattccaggagaacctcaagaaatccctgaagcggcccgaggtgaagaaaggctgctatcgcacccttggagtttttagatacaagagccggtgttatgtgggcctggtctgggggatcctcctgacaaccgaactgatcatttgggctgcctccgccgacacgccgcttatggagtctggatggagcgacaccgctcacggcgtggggatcattcctatgaaatccgatctcgaactggacttcgccctggcttctagctccagctactcttatagacgcaagctcgttaatcccgccaaccaagaggaaacactgccttttcatttccagcttgataaacaggtggtccacgcggagatccagaatctgggacactggatggacggcaccttcaacattaagacagcctttcattgctacggggagtgtaagaaatatgcttacccctggcaaaccgccaagtgcttctttgaaaaagattaccagtatgagacatcctggggctgtaatcctcccgactgcccgggagtgggcaccgggtgcacggcttgtggagtttacctcgataagctgcggagcgtgggcaaagcctataagatcgtctctctgaaatacacaagaaaggtgtgcatccagcttgggaccgaacagacctgtaagcacattgacgtgaacgattgcctcgtcacaccttccgttaaagtgtgtatgatcggaaccattagcaagctgcaacccggcgacacgctcctgttcctggggccccttgagcagggcggaatcattctgaaacagtggtgcacaacctcttgtgtgtttggcgatcctggggacatcatgagcacaacctccggaatgcgctgcccggaacatacaggcagcttccggaagatctgtgggtttgcgaccacgcccacatgcgagtatcaaggaaatacagtctctggcttccagagaatgatggccacccgcgactcctttcagagcttcaacgtgacagagcctcacattacctccaatcggctcgaatggatcgatcccgactctagcattaaagatcacatcaacatgattctgaatagagacgtttcctttcaggatctgtctgacaacccttgtaaggtggatcttcatacgcaaagcatcgacggggcttggggctccggagtcggcttcacactcgtgtgcaccgttgggctgacagagtgcgccaattttatcacctctattaaggcttgtgatagcgccatgtgctacggagccaccgtgacaaacctgctccgcggctccaatacggtcaaagtggttgggaagggaggccacagcggctctctgttcaaatgttgccatgacaccgattgtacagaagaggggcttgctgcgtcccctccccacctggaccgggtgaccggatataaccagatcgatagcgacaaggtctacgacgatggcgctcccccgtgcacaattaaatgttggttcaccaagtctggggaatggctcctgggaatcctgaacggcaattgggtggtggtcgccgttcttattgtgatcctgattctctccatcctgctctttagcttcttttgccctgtgagatctcgcaagaacaaagccaattga

SEQ ID NO: 13529 - RNA, 3423 nt, synthetic construct
  misc_feature 1..3423: note = derived and/or modified CDS sequence (opt5) from SNV(2)__JQ690284.1__GP
  source 1..3423: mol_type = other RNA
atggtgggctgggtctgcatcttcctggttgtgctcaccacagccacggctgggctgaccagaaacctttacgagctgaagattgaatgtccccacacagtgggactcggccaggggtatgtcaccggaagcgtggagacaacccctatcctgcttacacaagttgccgacctgaaaattgaatcctcttgcaattttgatctccatgtgccggcgaccacgacccagaagtacaaccaggtcgactggacaaagaagggcagcaccacagagtccaccaatgctggggccaacacgttcgaagccaaaacaaaggaggtgaatctgaagggaacctgtaacattccccctacaacctttgaggctgcctataaatctcggaagaccgttatctgctacgatctggcttgtaatcagacacactgcctccccacggtgcatctgatcgcccctgtccaaacctgtatgagcgtgcgctcctgcatgatcggccttctgtctagccggattcaggtgatctatgaaaagacatactgtgtcaccggccagctcattgaggggctgtgcttcatccccacacacaccattgcgcttacgcagcctggacatacatatgacaccatgaccctgccggttacatgttttctcgtggccaagaaactgggcacccaactgaagctcgctgtggaactggagaaacttatcacaggggtctcctgcacggagaacagcttccagggatactacatttgctttatcggcaaacactctgaacccctgttcgtgcctaccatggaggattatagatccgccgaagtttttacacgcatggtgctcaatcccagaggggaggaccacgatcctgaccagaacggacagggcctgatgcggatcgctggccccgtcaccgccaaggtgccgagcacagaaaccacggagaccatgcaagggattgcgttcgccggagctcctatgtactcttcctttagcacacttgttcgcaaagccgatcccgagtatgtgttctctcctggcatcattgctgaatccaatcatagcgtctgtgacaagaaaaccgtgcccctgacatggaccgggtttctcgccgtctccggagagatcgaaagaattacgggctgcacagtgttctgtaccctggccgggcccggagcttcttgcgaggcgtacagcgaaacaggcatcttcaacatctccagccctacctgtctggttaataaggtgcagaaatttcggggctctgagcagcgcattaacttcatgtgccaaagagtcgatcaggacgtggttgtgtattgtaatgggcagaagaaggtcatcctcaccaaaacactggtgattggacagtgcatctacacgtttacctcccttttcagcctgattccgggcgtggcccactctctcgctgttgagctgtgtgtccccgggcttcatggatgggccacaaccgccctgctcatcacattttgcttcggctggctgctgatccctaccgtgacgctcattatcctgaagattcttcggctgctcacatttagctgttcccactattctaccgaaagcaaattcaaggtgatcctggagcgcgtcaaagtggaataccaaaagaccatggggtccatggtttgcgatatttgccaccatgagtgtgaaacagctaaggagctggagacccacaaaaagagctgccccgaaggccagtgtccttactgcatgacaatcacggagtctaccgaatccgcccttcaggcgcattttagcatttgtaaactcacaaacagattccaggagaacctgaagaaatctctgaagcggcccgaggtgaagaaaggatgctatcgcaccctcggcgtctttagatacaagtcccggtgttatgtggggctggtttggggaatccttctgacaaccgaactcatcatttgggctgccagcgccgacacgccgctgatggagtccggctggtctgacaccgctcacggggtgggaatcattcctatgaaaacagatctggaacttgacttcgccctcgctagctcctctagctactcctatagacgcaagctggtcaatcccgccaaccaagaggaaaccctgccttttcatttccagctcgataaacaggtggttcacgcggagatccagaatctgggccactggatggacgggacattcaacattaagaccgcctttcattgctacggcgagtgtaagaaatatgcttacccctggcaaacagccaagtgcttctttgaaaaagattaccagtatgagaccagctggggatgtaatcctcccgactgcccgggcgtggggacgggatgcacagcttgtggcgtctaccttgataagctgcggtctgtggggaaagcctataagatcgtgtccctcaaatacaccagaaaggtctgcatccagctgggaaccgaacagacatgtaagcacattgacgttaacgattgcctggtgacccctagcgtgaaagtctgtatgatcggcacgatttctaaacttcaacccggggacacactcctgttcctgggccccctcgagcagggaggcatcattctgaaacagtggtgcaccacatcctgtgtgtttggggatcctggagacatcatgagcaccacatctggcatgcgctgcccggaacataccgggagcttccggaagatctgtggatttgcgacgacccccacatgcgagtatcaaggcaataccgtttccgggttccagagaatgatggccacacgcgacagctttcagtctttcaacgtgaccgagcctcacattacgtccaatcggcttgaatggatcgatcccgacagctccattaaagatcacatcaacatggtcctgaatagagacgtgtcttttcaggatctcagcgacaacccttgtaaggttgatctgcatacacaatccattgacggcgcttggggatctggcgtggggttcaccctggtctgcacagtgggacttaccgagtgcgccaattttatcaccagcatcaaggcttgtgattccgccatgtgctacggcgccacagttacgaacctcctgcgcgggtctaataccgtgaaagtcgtgggaaagggcggccacagcgggtccctgttcaaatgttgccatgacacagattgtaccgaagagggactcgctgcgtctccccctcacctggaccgggtgacaggctataaccagattgatagcgacaaggtctacgacgatggggctcccccgtgcaccatcaaatgttggttcacgaagtccggagaatggcttctgggcattctcaacgggaattgggttgtggtggccgtcctgatcgtgattctgatccttagcattctgctcttttctttcttttgccctgttagatcccgcaagaacaaagccaattga

SEQ ID NO: 13530 - RNA, 3423 nt, synthetic construct
  misc_feature 1..3423: note = derived and/or modified CDS sequence (opt5) from SNV(2)__JQ690280.1__GP
  source 1..3423: mol_type = other RNA
atggtgggctgggtctgcatcttcctggttgtgctcaccacagccacggctgggctgaccagaaacctttacgagctgaagattgaatgtccccacacagtgggactcggccaggggtatgtcaccggaagcgtggagacaacccctatcctgcttacacaagttgccgacctgaaaattgaatcctcttgcaattttgatctccatgtgccggcgaccacgacccagaagtacaaccaggtcgactggacgaaaaagagctccaccacagagtctaccaatgctggcgccaacacgttcgaagccaaaacaaaggaggtgaatctgaaggggacctgtaacattccccctacaacctttgaggctgcctataaaagccggaagaccgttatttgctacgatctggcttgtaatcagacacactgcctccccacggtgcatctgatcgcccctgtccaaacctgtatgtccgtgcgctcttgcatgatcggacttctgagctccagaatccaggtgatctatgaaaagacatactgtgtcaccggccagctcattgagggcctgtgcttcatccccacacacaccattgcgcttacgcagcctgggcatacatatgacaccatgaccctgccggttacatgttttctcgtggccaagaaactgggaacccaactgaagctcgctgtggaactggagaaacttatcacaggcgtcagctgcacggagaactctttccaggggtactacatttgctttatcggaaaacactccgaacccctgttcgtgcctaccatggaggattatcggagcgccgaactctttacacgcatggttctgaatcccagaggcgaggaccacgatcctgaccagaacgggcagggacttatgcggatcgctggccccgtgaccgccaaggtcccgtctacagaaaccacggagaccatgcaaggcattgcgttcgccggggctcctatgtactccagcttttctacactggtgcgcaaagccgatcccgagtatgttttctcccctggaatcattgctgaaagcaatcattccgtgtgtgacaagaaaaccgtccccctcacatggaccggctttctggccgtgtctggggagatcgaaagaattacgggatgcacagtcttctgtaccctggccggccccggggctagctgcgaggcgtactccgaaacaggaatcttcaacatcagctctcctacctgtctcgtgaataaggttcagaaatttcggggctccgagcagcgcattaacttcatgtgccaaagagtggatcaggacgtcgtggtttattgtaatggccagaagaaggtgatcctgaccaaaacacttgtcattgggcagtgcatctacacgtttaccagcctgttctctctcattccgggagtggcccacagcctggctgtggagctttgtgttcccggcctgcatgggtgggccacaaccgccctcctgatcacattttgcttcggatggctgctcatccctaccgtcacgctgattatccttaagattctgcggctcctgacattttcctgttctcactatagcaccgaatccaaattcaaggtgatcctggagcgcgtgaaagtcgaataccaaaagaccatgggcagcatggtgtgcgatatttgccaccatgagtgtgaaacagctaaggagcttgagacccacaaaaagtcttgccccgaagggcagtgtccttactgcatgacaatcacggagtccaccgaaagcgccctccaggcgcatttttctatttgtaaactgacaaacagattccaggagaacctgaagaaatccctcaagcggcccgaggttaagaaaggctgctatcgcaccctgggagtgtttagatacaagagccggtgttatgtcggccttgtgtgggggatcctgctcacaaccgaactgatcatttgggctgcctccgccgacacgccgctgatggagtctggatggagcgacaccgctcacggcgttgggatcattcctatgaaaacagatcttgaactcgacttcgccctggcttcctctagctcctacagctatagacgcaagctggtgaatcccgccaaccaagaggaaaccctcccttttcatttccagctggataaacaggtcgtgcacgcggagatccagaatcttggacactggatggacggcacattcaacattaagaccgcctttcattgctacggggagtgtaagaaatatgcttacccctggcaaacagccaagtgcttctttgaaaaagattaccagtatgagacctcttggggctgtaatcctcccgactgcccgggagttggcacggggtgcacagcttgtggagtgtacctggataagctccggtccgtcggcaaagcctataagatcgtgagcctgaaatacaccagaaaggtgtgcatccagctggggaccgaacagacatgtaagcacattgacgtcaacgattgccttgttaccccttctgtgaaagtgtgtatgatcggaacgatttccaagctccaacccggcgacacactgctgttcctcgggcccctggagcagggcggaatcattcttaaacagtggtgcaccacaagctgtgtctttggcgatcctggggacatcatgtctaccacaagcggaatgcgctgcccggaacataccggctccttccggaagatctgtgggtttgcgacgacccccacatgcgagtatcaaggaaataccgtgagcggcttccagagaatgatggccacacgcgactcttttcagtccttcaacgttaccgagcctcacattacgagcaatcggctggaatggatcgatcccgactcctctattaaagatcacatcaacatggtgctcaatagagacgtcagctttcaggatctgtccgacaacccttgtaaggtggatctgcatacacaatctattgacggggcttggggcagcggagttggcttcacccttgtgtgcacagtcgggctcaccgagtgcgccaattttatcacctccatcaaggcttgtgattctgccatgtgctacggagccacagtgacgaacctgctgcgcggcagcaataccgttaaagtggtcgggaagggaggccactccggcagcctcttcaaatgttgccatgacacagattgtaccgaagaggggctggctgcgtctccccctcaccttgaccgggtgacaggatataaccagattgattccgacaaggtgtacgacgatggcgctcccccgtgcaccatcaaatgttggttcacaaagagcggggaatggctgctcggcattctgaacggaaattgggtcgttgtggccgtgctgatcgtcattcttatcctgtctattctcctgttttccttcttttgccctgtgagaagccgcaagaacaaagccaattga

SEQ ID NO: 13531 - RNA, 3423 nt, synthetic construct
  misc_feature 1..3423: note = derived and/or modified CDS sequence (opt5) from SNV(CC107/POR)__KT885045.1__GP
  source 1..3423: mol_type = other RNA
atggtgggctgggtctgcatcttcctggttgtgctcaccacagccacggctgggctgaccagaaacctttacgagctgaagattgaatgtccccacacagtgggactcggccaggggtatgtcaccggaagcgtggagacaacccctatcctgcttacacaagttgccgacctgaaaattgaatcctcttgcaattttgatctccatgtgccggcgaccacgacccagaagtacaaccaggtcgactggaccaaaaagagctccaccacagagtctaccaatgctggcgccacgacattcgaagccaaaaccaaggaggtgaacctgaaggggacatgtaatattccccctaccacctttgaggctgcctataaaagccggaagacagttatttgctacgatctggcttgtaaccagacgcactgcctccccaccgtgcatctgatcgcccctgtccaaacatgtatgtccgtgcgctcttgcatgatcggacttctgagctccagaatccaggtgatctatgagaaaacctactgtgtcacaggccagctcattgagggcctgtgcttcatccccacccacacgattgcgcttacacagcctgggcatacctatgacaccatgacactgccggttacctgttttctcgtggccaagaaactgggaacacaactgaagctcgctgtggaactggagaaacttatcacgggcgtcagctgcaccgaaaattctttccaggggtactacatttgctttatcggaaagcactccgaacccctgttcgtgcctacaatggaggattatcggagcgccgaactctttacccgcatggttctgaaccccagaggcgaggaccacgatcctgaccagaatgggcagggacttatgcggatcgctggccccgtgacagccaaggtcccgtctaccgaaacgaccgagacaatgcaaggcattgcgttcgccggggctcctatgtactccagcttttctaccctggtgcgcaaagccgatcccgagtatgttttctcccctggaatcattgctgaaagcaaccattccgtgtgtgacaagaaaacagtccccctcacctggacgggctttctggccgtgtctggggagatcgaaagaattacaggatgcaccgtcttctgtacactggccggccccggggctagctgcgaggcgtactccgaaaccggaatcttcaatatcagctctcctacctgtctcgtgaacaaggttcagaaatttcggggctccgagcagcgcattaatttcatgtgccaaagagtggatcaggacgtcgtggtttattgtaacggccagaagaaggtgatcctgacaaaaacgcttgtcattgggcagtgcatctacacctttacaagcctgttctctctcattccgggagtggcccacagcctggctgtggagctttgtgttcccggcctgcatgggtgggccaccacagccctcctgatcaccttttgcttcggatggctgctcatccctacggtcacactgattatccttaagattctgcggctcctgaccttttcctgttctcactatagcaccgaatccaaattcaaggtgatcctggagcgcgtgaaagtcgaataccaaaagacaatgggcagcatggtgtgcgatatttgccaccatgagtgtgaaaccgctaaggagcttgagacacacaaaaagtcttgccccgaagggcagtgtccttactgcatgacgatcaccgagtccacagaaagcgccctccaggcgcatttttctatttgtaaactgaccaatagattccaggagaacctgaagaaatccctcaagcggcccgaggttcgcaagggctgctatagaacactgggagtgtttcggtacaaaagcagatgttatgtcggccttgtgtgggggatcctgctcaccacggaactgatcatttgggctgcctccgccgacaccccgctgatggagtctggatggagcgacacagctcacggcgttgggatcgtgcctatgaagaccgatcttgaactcgacttcgccctggcttcctctagctcctacagctatcgccggaaactggtcaaccccgccaatcaagaggaaacactcccttttcatttccagctggataaacaggtggttcacgcggagattcagaaccttggacactggatggacggcaccttcaatatcaagacagcctttcattgctacggggagtgtaagaagtatgcttacccctggcaaaccgccaaatgcttctttgaaaaggattaccagtatgagacgtcttggggctgtaaccctcccgactgcccgggagtgggcacagggtgcaccgcttgtggagtctacctggataaactcagatccgtgggcaaggcctataaaattgtgagcctgaagtacacccgcaaagtctgcatccagctggggacagaacagacctgtaagcacatcgacgttaatgattgccttgtgacgccttctgtgaaggtctgtatgattggaacaatctccaaactccaacccggcgacaccctgctgttcctcgggcccctggagcagggcggaattatccttaagcagtggtgcacaaccagctgtgtgtttggcgatcctggggacattatgtctacaaccagcggaatgcggtgcccggaacatacgggctccttcagaaaaatctgtgggtttgcgaccacacccacatgcgagtatcaaggaaacacagttagcggcttccagcgcatgatggccacccgggactcttttcagtccttcaatgtgacggagcctcacatcacaagcaacagactggaatggattgatcccgactcctctatcaaggatcacattaatatggtcctcaaccgcgacgtgagctttcaggatctgtccgacaatccttgtaaagttgatctgcatacccaatctatcgacggggcttggggcagcggagtgggcttcacacttgtctgcaccgtggggctcaccgagtgcgccaactttattacatccatcaaggcttgtgattctgccatgtgctacggagccacggttaccaatctgctgcggggcagcaacacagtgaaggtcgtggggaaaggaggccactccggcagcctcttcaagtgttgccatgacaccgattgtacagaagaggggctggctgcgtctccccctcaccttgacagagtgaccggatataatcagatcgattccgacaaagtctacgacgatggcgctcccccgtgcacgattaagtgttggttcacaaaaagcggggaatggctgctcggaatcctgaacggcaactgggttgtggtggccgtcctgattgtgatccttattctgtctatcctcctgttttccttcttttgccctgttcgcaatcggaagaacaaggccaattga

SEQ ID NO: 13532 - RNA, 3423 nt, synthetic construct
  misc_feature 1..3423: note = derived and/or modified CDS sequence (opt5) from HPS(Convict Creek 107)__L33474.1__GP
  source 1..3423: mol_type = other RNA
atggtgggctgggtctgcatcttcctggttgtgctcaccacagccacggctgggctgaccagaaacctttacgagctgaagattgaatgtccccacacagtgggactcggccaggggtatgtcaccggaagcgtggagacaacccctatcctgcttacacaagttgccgacctgaaaattgaatcctcttgcaattttgatctccatgtgccggcgaccacgacccagaagtacaaccaggtcgactggaccaaaaagagctccacaacagagtctaccaatgctggcgccacgacattcgaagccaaaaccaaggaggtgaacctgaaggggacatgtaatattccccctaccacctttgaggctgcctataaaagccggaagacagttatttgctacgatctggcttgtaaccagacgcactgcctccccaccgtgcatctgatcgcccctgtccaaacatgtatgtccgtgcgctcttgcatgatcggacttctgagctccagaatccaggtgatctatgagaaaacctactgtgtcacaggccagctcattgagggcctgtgcttcatccccacccacacgattgcgcttacacagcctgggcatacctatgacaccatgacactgccggttacctgttttctcgtggccaagaaactgggaacacaactgaagctcgctgtggaactggagaaacttatcacgggcgtcagctgcaccgaaaattctttccaggggtactacatttgctttatcggaaaacactccgaacccctgttcgtgcctacaatggaggattatcggagcgccgaactctttacccgcatggttctgaaccccagaggcgaggaccacgatcctgaccagaatgggcagggacttatgcggatcgctggccccgtgacagccaaggtcccgtctaccgaaacgaccgagacaatgcaaggcattgcgttcgccggggctcctatgtactccagcttttctaccctggtgcgcaaagccgatcccgagtatgttttctcccctggaatcattgctgaaagcaaccattccgtgtgtgacaagaaaacagtccccctcacctggacgggctttctggccgtgtctggggagatcgaaagaattacaggatgcaccgtcttctgtacactggccggccccggggctagctgcgaggcgtactccgaaaccggaatcttcaatatcagctctcctacctgtctcgtgaacaaggttcagaaatttcggggctccgagcagcgcattaatttcatgtgccaaagagtggatcaggacgtcgtggtttattgtaacggccagaagaaggtgatcctgacaaaaacgcttgtcattgggcagtgcatctacacctttacaagcctgttctctctcattccgggagtggcccacagcctggctgtggagctttgtgttcccggcctgcatgggtgggccaccacagccctcctgatcaccttttgcttcggatggctgctcatccctacggtcacactgattatccttaagattctgcggctcctgaccttttcctgttctcactatagcaccgaatccaaattcaaggtgatcctggagcgcgtgaaagtcgaataccaaaagacaatgggcagcatggtgtgcgatatttgccaccatgagtgtgaaaccgctaaggagcttgagacacacaaaaagtcttgccccgaagggcagtgtccttactgcatgacgatcaccgagtccacagaaagcgccctccaggcgcatttttctatttgtaaactgaccaatagattccaggagatcctgaagaaatccctcaagcggcccgaggttcgcaagggctgctatagaacactgggagtgtttcggtacaaaagcagatgttatgtcggccttgtgtgggggatcctgctcaccacggaactgattatctgggctgcctccgccgacaccccgctgatggagtctggatggagcgacacagctcacggcgttgggattgtgcctatgaagaccgatcttgaactcgacttcgccctggcttcctctagctcctacagctatcgccggaaactggtcaaccccgccaaccaagaggaaacactcccttttcatttccagctggataaacaggtggttcacgcggagatccagaatcttggacactggatggacggcaccttcaacattaagacagcctttcattgctacggggagtgtaagaagtatgcttacccctggcaaaccgccaaatgcttctttgaaaaggattaccagtatgagacgtcttggggctgtaatcctcccgactgcccgggagtgggcacagggtgcaccgcttgtggagtctacctggataaactcagatccgtgggcaaggcctataaaatcgtgagcctgaagtacacccgcaaagtctgcatccagctggggacagaacagacctgtaagcacattgacgttaacgattgccttgtgacgccttctgtgaaggtctgtatgatcggaacaatttccaaactccaacccggcgacaccctgctgttcctcgggcccctggagcagggcggaatcattcttaagcagtggtgcacaaccagctgtgtgtttggcgatcctggggacatcatgtctacaaccagcggaatgcggtgcccggaacatacgggctccttcagaaaaatctgtgggtttgcgaccacacctacctgcgagtatcaaggaaatacagttagcggcttccagcgcatgatggccacccgggactcttttcagtccttcaacgtgacggagccccacattacaagcaatagactggaatggatcgatcccgactcctctattaaggatcacatcaacatggtcctcaatcgcgacgtgagctttcaggatctgtccgacaacccttgtaaagttgatctgcatacccaatctattgacggggcttggggcagcggagtgggcttcacacttgtctgcaccgtggggctcaccgagtgcgccaattttatcacatccatcaaggcttgtgattctgccatgtgctacggagccacggttaccaacctgctgcggggcagcaatacagtgaaggtcgtggggaaaggaggccactccggcagcctcttcaagtgttgccatgacaccgattgtacagaagaggggctggctgcgtctccccctcaccttgacagagtgaccggatataaccagattgattccgacaaagtctacgacgatggcgctcccccgtgcacgatcaagtgttggttcacacgcagcggggaatggctgctcggcattctgaatggaaactgggttgtggtggccgtcctgatcgtgattcttatcctgtctattctcctgttttccttcttttgccctgttcggaacagaaagaataaggccaactga

SEQ ID NO: 13533 - RNA, 3423 nt, synthetic construct
  misc_feature 1..3423: note = derived and/or modified CDS sequence (opt5) from HPS(Convict Creek 74)__L33684.1__GP
  source 1..3423: mol_type = other RNA
atggtgggctgggtctgcatcttcctggttgtgctcaccacagccacggctgggctgaccagaaacctttacgagctgaagattgaatgtccccacacagtgggactcggccaggggtatgtcaccggaagcgtggagacaacccctatcctgcttacacaagttgccgacctgaaaattgaatcctcttgcaattttgatctccatgtgccggcgaccacgacccagaagtacaaccaggtcgactggaccaaaaagagctccacaacagagtctaccaatgctggcgccacgacattcgaagccaaaaccaaggaggtgaacctgaaggggacatgtaatattccccctaccacctttgaggctgccttcaaaagccggaagacagttatttgctatgatctggcttgtaaccagacgcactgcctccccaccgtgcatctgatcgcccctgtccaaacatgtatgtccgtgcgctcttgcatgatcggacttctgagctccagaatccaggtgatctacgagaaaacctattgtgtcacaggccagctcattgagggcctgtgctttatccccacccacacgattgcgcttacacagcctgggcatacctacgacaccatgacactgccggttacctgtttcctcgtggccaagaaactgggaacacaactgaagctcgctgtggaactggagaaacttatcacgggcgtcagctgcaccgaaaattcttttcaggggtattacatttgcttcatcggaaagcactccgaacccctgtttgtgcctacaatggaggattaccggagcgccgaactcttcacccgcatggttctgaaccccagaggcgaggaccacgatcctgaccagaatgggcagggacttatgcggatcgctggccccgtgacagccaaggtcccgtctaccgaaacgaccgagacaatgcaaggcattgcgtttgccggggctcctatgtattccagcttctctaccctggtgcgcaaagccgatcccgagtacgtgttttcccctggaatcattgctgaaagcaaccattccgtttgtgacaagaaaacagtccccctcacctggacgggcttcctggccgtgtctggggagatcgaaagaattacaggatgcaccgtcttctgtacactggccggccccggggctagctgcgaggcgtattccgaaaccggaatctttaatatcagctctcctacctgtctcgtgaacaaggttcagaaattccggggctccgagcagcgcattaattttatgtgccaaagagtggatcaggacgtcgtggtttactgtaacggccagaagaaggtgatcctgacaaaaacgcttgtcattgggcagtgcatctataccttcacaagcctgttttctctcattccgggagtggcccacagcctggctgtggagctttgtgttcccggcctgcatgggtgggccaccacagccctcctgatcaccttctgctttggatggctgctcatccctacggtcacactgattatccttaagattctgcggctcctgaccttctcctgttctcactacagcaccgaatccaaatttaaggtgatcctggagcgcgtgaaagtcgaatatcaaaagacaatgggcagcatggtgtgcgatatttgccaccatgagtgtgaaaccgctaaggagcttgagacacacaaaaagtcttgccccgaagggcagtgtccttactgcatgacgatcaccgagtccacagaaagcgccctccaggcgcatttctctatttgtaaactgaccaatagatttcaggagatcctgaagaaatccctcaagcggcccgaggttcgcaagggctgctacagaacactgggagtgttccggtataaaagcagatgttacgtcggccttgtgtgggggatcctgctcaccacggaactgattatctgggctgcctccgccgacaccccgctgatggagtctggatggagcgacacagctcacggcgttgggattgtgcctatgaagaccgatcttgaactcgactttgccctggcttcctctagctcctatagctaccgccggaaactggtcaaccccgccaaccaagaggaaacactccctttccatttccagctggataaacaggtggttcacgcggagatccagaatcttggacactggatggacggcacctttaacattaagacagccttccattgctatggggagtgtaagaagtacgcttatccctggcaaaccgccaaatgctttttcgaaaaggattaccagtacgagacgtcttggggctgtaatcctcccgactgcccgggagtgggcacagggtgcaccgcttgtggagtctatctggataaactcagatccgtgggcaaggcctacaaaatcgtgagcctgaagtatacccgcaaagtctgcatccagctggggacagaacagacctgtaagcacattgacgttaacgattgccttgtgacgccttctgtgaaggtctgtatgatcggaacaatttccaaactccaacccggcgacaccctgctgtttctcgggcccctggagcagggcggaatcattcttaagcagtggtgcacaaccagctgtgtgttcggcgatcctggggacatcatgtctacaaccagcggaatgcggtgcccggaacatacgggctcctttagaaaaatctgtgggttcgcgaccacacctacctgcgagtaccaaggaaatacagttagcggctttcagcgcatgatggccacccgggactctttccagtcctttaacgtgacggagccccacattacaagcaatagactggaatggatcgatcccgactcctctattaaggatcacatcaacatggtcctcaatcgcgacgtgagcttccaggatctgtccgacaacccttgtaaagttgatctgcatacccaatctattgacggggcttggggcagcggagtgggctttacacttgtctgcaccgtggggctcaccgagtgcgccaatttcatcacatccatcaaggcttgtgattctgccatgtgctatggagccacggttaccaacctgctgcggggcagcaatacagtgaaggtcgtggggaaaggaggccactccggcagcctcttcaagtgttgccatgacaccgattgtacagaagaggggctggctgcgtctccccctcaccttgacagagtgaccggatacaaccagattgattccgacaaagtctatgacgatggcgctcccccgtgcacgatcaagtgttggtttacaaaaagcggggaatggctgctcggcattctgaatggaaactgggttgtggtggccgtcctgatcgtgattcttatcctgtctattctcctgttctcctttttctgccctgttcgcaaccggaagaataaggccaactga

SEQ ID NO: 13534 - RNA, 3423 nt, synthetic construct
  misc_feature 1..3423: note = derived and/or modified CDS sequence (opt5) from BRV(Indiana)__AF030551.1__GP
  source 1..3423: mol_type = other RNA
atggtgggctgggtctgcatcttcctggttgtgctcaccacagccacggctgggctgaccagaaacctttacgagctgaagattgaatgtccccacacagtgggactcggccaggggtatgtcaccggaagcgtggagacaacccctgttccgctgggccaagtgacagaccttaaaatcgaatcctcttgcaattttgatctgcatgtccccagcaccacgattcagaagtacaaccaggtggagtgggccaaaaagacctccacaaccgaatctacaaatgcgggggctagcaccttcgaggccaaaacgaaggaggttaacctcaagggaacatgtaatatccctgtgaccacatttgaagccgcttataaatcccggaagaccgtcatttgctacgacctggcctgtaaccagacccactgcctgcccacagtgcatctcatcgctcctgtgcaaacgtgtatgtctgtccgcagctgcatgatcggcctgctttccagccggattcacgttatctatgagaaaacctactgtgtgacaggccaggtggtcgaagggctgtgcttcattcccacccatacaatcgccctcacccagcctggacacacgtatgatacaatgaccctgccgattacctgttttcttgtggcgaagaaactgggcacacagctcaagatcgccgttgagctggagaagctgattaccgcttctgggtgcacagaaaattccttccaaggatactacatctgctttctcggcaaacacagcgagcccctgtatgtgcctacgatggacgattacagatctgccgaacttttcacccgcatggtcctgaaccccaagggggaggaccatgatcctgaccaggatggacagggcctcatgagaatcacaggccccattaccgctaaagtgccgtccacagaaaccacggagaccatgcagggggttgcctttgcgggaacacctatgtatagctctttctccaccctgcttcggaaggccgaccccgagtacgtgtttagccctggcatcattcccgaatccaatcactctgtctgtgataaaaagacaatgcccatcacctggacggggttcctggctgtgagcggagagattgagaaaatcacaggctgcaccgtcttttgtacactcgccgggcctggagcttcctgcgaagcctatagcgaaaccggcatcttcaacatttcttccccgacctgtctggtgaataaggttcaaaagttccgcggcagcgagcagagagtgaactttatgtgccagcgggtcgaccaagatgtggttgtgtactgtaatgggcagaaaaaggtcatcctgacaaaaacgctcgtgattggacagtgcatctataccttcacatctctgtttagccttctgcccggcgtggcccattccctcgctgttgagctgtgtgtccctgggcttcacggatgggcgaccacagccctgctcattaccttctgctttggctggctgctgatcccctctgtgacgctcatcattctgcgcatccttagactgctcacattcagctgttcccactacagcaccgaatctaagtttaaaattctgctggagaaggtgaaggtcgaataccagaaaaccatggggtccatggtgtgcgacatctgccatcacgagtgtgaaacagctaaggagcttgacacccatcggaaaagctgccctgagggccaatgtccctattgcatgacaatgacggaatctaccgagtccgccctccaggcccacttcagcgtttgtaagctgacaaaccgctttcaggaaaatctgaaaaagtccctcaagcatccggaggtgaaacagggatgctacagaaccctgggcgtcttccggtataagtctcgctgttacgtggggcttgtttggggcattctgctcacagctgagctgatcatttgggccgcgagcgctgaaacccctctgatggagtccggatggtctgatacggcccacggggtgggaatcgtccccatgaaaaccgaccttgaactcgattttgccctggctagctccagctcttattcctacagacggaagctggtgaaccctgccaacagcgaggaaacactccccttccacctccaacttgagaaacaggttgtgcatgctgagatccacaatctgggccattggatggacgggacctttaacattaagacagccttccactgctatggcgaatgtaagaaatacgcgtacccttggcagaccgccaagtgcttctttgagaaagattatcagtacgaaacatcttggggatgtaatcccccggactgccctggcgtcgggaccggatggacggcttgcggcgtgtatctcgataagctgagatccgtggggaaagcctacaagatcgtcagcctgaaatatacacgcaaggtttgtattcaacttggaaccgagcagacctgcaagcacatcgacgtgaacgattgtctcgtgacaccctctgtcaaagtgtgcatgattggcaccgttagcaagctgcagcccggggacacgctgctgttcctgggccctcttgaacagggaggcatcatcctgaaacaatggtgtacaacctcctgcgtgtttggggatccgggagacattatgagcacaacctctggcatgaagtgtcccgagcatacagggtccttccggaaaatctgcggatttgctaccacgcctacctgtgagtaccagggcaatacagtcagcgggttcaagagaatgatggccacccgcgactcctttcagtctttcaacgtgacagaaccccacattaccagcaatcggctcgagtggatcgatcctgactcctctattaaggatcatatcaacgttgtgctgaatagagacgtcagctttcaagatctgtccgacaacccctgcaaagtggatcttcacacgcagtctatcgacggcgcgtggggaagcggcgttgggttcacactcgtgtgtaccgtcggactgacagaatgcgccaattttattacctccatcaaggcttgcgatctggccatgtgttatggcgctaccgtgacaaacctcctgcgcgggagcaatacggtgaaagtcgttggaaagggcggccattctgggtcccttttcaaatgctgtcacgacaccgattgcacagacgagggactggccgccagccctccccacctcgatcgggtgaccggctttaaccagattgactctgacaaggtgtacgatgacggggctccgccttgttccgtcaagtgctggttcacaaaaagcggagaatggctgctgagaatccttaatggcaactggatggtggttgcggtgctgattgtcatcctcatcctgtctattctcctgttctcctttttctgtcccatccgcagccggaagtccaaacctaactga

SEQ ID NO: 13535 - RNA, 3423 nt, synthetic construct
  misc_feature 1..3423: note = derived and/or modified CDS sequence (opt5) from BRV(Oklahoma)__AF030552.1__GP
  source 1..3423: mol_type = other RNA
atggtgggctgggtctgcatcttcctggttgtgctcaccacaagcacggccgggctgaccagaaacctttacgagctgaagattgaatgtccccacacagtgggactcggccaggggtatgtcaccggatccgtggagatcacacctgttccgctgggccaagtgaccgaccttaaaattgaatctagctgcaattttgatctgcatgtcccctccacaaccatccagaagtacacccaggtggagtgggctaaaaagtctagcacgacagaatccaccaacgccgcggctacaaccttcgaggccaaaacgaaggaggtttctctcaaggggacatgtaatattcctgtgaccacatttgaagccgcttataaaagccggaagaccgtcatctgctacgacctggcctgtaaccagacccactgcctgcccacagtgcatctcatcgctcctgtgcaaacgtgtatgtccgtccgcagctgcatggttggactgctttcttcccggattcaggtgatctatgagaaaacctactgtgtgacaggccagctggtcgaaggcctctgcttcattcccacccacacaatcgccctgacccagcctgggcatacgtatgatacaatgacccttccgattacctgttttctggtggcgaagaaactcggaacacaactgaagatcgccgttgagctggagaagctcattaccgctagcggctgcacagaaaattctttccaggggtactacatctgctttctgggaaaacactccgagcccatgtatgtgcctacgatggacgattacagaagcgccgaacttttcacccgcatggtcctgaaccccaagggcgaggaccacgatcctgaccagaatgggcagggactcatgagaatcgctggccccattacagccaaagtgccgtctaccgaaacaaccgagacgatgcaaggcatcgcgtttgccggggctcctatgtattccaccttcgccacactggttcggaaggctgatcccgagtacgtgtttagccctggaattatccccgaatccaaccattctgtctgtgacaaaaagaccatgcccattacatggaccggcttccttgccctgagcggggagatcgaacgcatcacgggatgcacagtgttttgtaccctcgccggccctggggcttcctgcgaggcgtatagcgaaacaggaattttcaatatctcttccccgacctgtctggtcaacaaagtgcagaagttcagaggcagcgagcagcggattaattttatgtgccaacgcgttgatcaggacgtggtcgtgtactgtaacggccagaagaaagttatcctgaccaagacactcgtgattgggcagtgcatctatacgttcacctctctgtttagccttctgcccggagtcgcccactccctcgctgtggagctgtgtgtgcctggccttcatgggtgggccacaaccgccctgctcatcacattctgctttggatggctgctgattcccgctatcaccctcattgttctgaaaatccttagactgctcacgttctcttgtagccactactccaaggaaagccggtttaaaattctgctggagaaggtcaaggtggaataccaaaagacaatgggctctatggtgtgcgatatctgccaccatgactgtgagaccgccaaggaacttgacacccacaaaaagtcctgccctgaggggcagtgtccctattgcatgacaatgaccgagagcacagaatctgcgctccaggctcatttctccgtctgtaaactgacgaatcgctttcaggagaacctgaaaaagagcctcaaacacccggaagtgaagcaaggctgctacagaaccctgggagttttccggtataaatcccgctgttacgtgggccttgtctgggggctgctcctgacaaccgagctgattatctgggccgcctctgctgagacacctcttatggaaagcggatggtccgataccgcccatggcgtggggatcgttcccatgagaacggacctcgagctggattttgctctggcctctagctccagctattcttaccggagaaagctcgtgaatcctgcgaacaccgaagagacactgcccttccaccttcagctggaaaaacaggtcgtgcacgccgagattcagaacctcggacattggatggacggcacctttaatatcaagacagctttccactgctatggggagtgtaagaaatacgcctacccttggcaaaccgctaagtgcttctttgaaaaagattatcagtacgagacatcctggggctgtaatcccccggactgccctggagttggcaccgggtgcacggcctgtggagtgtatctggataagctgcgcagcgtcggcaaagcgtacaagattgtgtctcttaaatatacacggaaggtgtgcatccagctcgggaccgaacagacctgtaagcatattgacgtcaacgattgcctggtttcccccagcgtgaaagtgtgtatgatcggaacagtctctaagctgcaacccggcgacaccctcctgttccttgggcctctggagcagggcggaatcattctcaaacagtggtgcacgacaagctgtgtgtttggcgatccgggggacatcatgtccaccacaagcggaatgagatgccccgaacacaccggctctttccgcaagatttgtgggtttgccacaacccctacgtgcgagtaccaaggaaacaccatctccggcttcaaacggatgatggctacaagagacagctttcagtccttcaatgttaccgagccccacattacatctaaccgcctggaatggatcgatcctgacagctccatcaaggatcatattaatgtggtcctgaaccgggacgtgtcttttcaggatcttagcgacaatccctataaggttgatctccacacccagtccatcgacggggcctggggctctggagtgggcttcacgctggtctgtattgtggggctgacagagtgcgctaactttatcaccagcattaaagcctgcgatatggccatgtgttacggagctacagttaccaatctcctgagaggctccaacaccgtgaaggtcgtggggaaaggaggccatagcggctctcttttcaagtgctgtcacgacacagattgcacggaagaggggctggcggcctcccctccccatctcgaccgcgtgaccggatacaatcaaatcgatagcgacaaagtctgtgacgatggcgctccgctgtgctctgttaagtgttggtttacaaagtccggggaatggctgcttggaatcctgaacggcaattggatggtggtggccgtcctcgtggttattctgatcctcagcattctgcttttctctttcttttgccctatccggtccaaaaagagcaaacccaactga

SEQ ID NO: 13536 - RNA, 3399 nt, synthetic construct
  misc_feature 1..3399: note = derived and/or modified CDS sequence (opt5) from THAIV(Thai749)__L08756.1__GP
  source 1..3399: mol_type = other RNA
atgtggggcctgctcgtgatcgccgtcctggttgggcccggattcgccattaagaacgtgtacgacatgaaaatcgagtgccctcacagcgtgaattttggcgaaacctccgtcacaggacaggtggagcttccggccctgcccattacggaagcggagcaactcgttcctgaatctagctgtaacatggataatcatcagtccctggctaccatcaacacacttaccaaggtgtcttggcggaaaaaggccgaccaggtcagcgcctcccagaatagcttcgaggtgattgaggctgaaacatcttttaaaggactgtgcatgctcaagcacagaatgatcgaggaatccttcaagaaccgcagaagcgttatctgttatgatctgtcttgcaataccacattttgtaaacccaccgtgtacatggtcgtgcctgtgcatgcctgcaacatgatgaagtcctgtctggtcggcctcgggccctatcgggttcaagtggtgtacgagcgcacgtattgcaccgtcgggattctgacagagggcaaatgtttcatccctgacaagaccattcttagctctatcaaaagaggcatgtttgtggttacatccgtgcaggtcctgtgcttctttattgtgcagaaggggcacagctacaagatcatggatgaagttaaaaagtctatgatgaataaatgtaacgacaccgagaataaggtgcagggatattacatttgcatcctcggcgggaactccgctccggtctacgtgcccagcctggatgacttccggtccatggaaatcttttctaatatgcttcgcagccctttcggagaggatcatgacctgcccggcgaagagttttccacgtatcaaattgccgggcctacagaggcgaaagtcccccacaccgccagctctaagaacctcgctctgatcgcctactccggaaatccgagctattctagcctgtccctcattacatctagccaggatggcagatacgtgttctcccctggcctgttccccaaccttaaccagacccagtgcgagaaaaatgctctgcctatggtttggcgggggatgatcgacctcagcggatattacgaagccattcacccctgtaacatcttttgcgtgctgtctggccccggggcgtcctgtgaagccttcagcgagggaggcatctttaatattacctctcctacatgccttgtctccaagcaaaaccgcttcagagctgccgaacagcagatcaattttgtgtgtcaacgggttgatatggacattgtggtctattgcaacgggcagaagaaaacgatcctgaccaagacactcattatcggacagtgtatctacaccattacaagcctgttctccctgctcccgggcgtggctcattctatcgccattgagctgtgcgtgcccggctttcacgggtgggccaccgctgcgcttctgatcacgttctgttttggatggattctcatccctacaattaccctggccgttcttgtcgtgctgaaattcatcgctaatatcctccataccaacagccaggagaatcgctttaagctgattctgaaaaaggtgaaggaagagttcgagaaaacaaagggctccatggtctgcgaagtgtgtaaatacgaatgcgagacctctaaggagctcaaagcccacaacctgagctgcccccaatccaagtgtccttattgctttacacactgtgaacccacggaggccaccttcaaggctcattacaaagtttgccaggccacacacagattccgggaagaccttaagaaaaccgtgacaccgcagaccgtcgggcctggatgttatcgcacgctgaatctctttagatacaagagccggtgctatatcctgaccatgtggctgttccttctctctattgagtccatcatgtgggcggctagcgccgccgagattcccctggtgcctctgtggacagataacgctcatggcatcgggtctgttcccatgcacaccgacctcgaactggatttttcccttcctagctctagcaaatacacatataagagaaagctgaccaatcccgtgaacacggagcagggcgtccaactccatatcgaaattgaggaacagggaatcggcgccgacgtgcaccacctggggcattggttcgatgctcgcctgaatcttaaaacatcctttcactgttacggagcctgcagcaagtaccagtatccgtggcataccgcgaaatgtcacttcgagaaggactacgagtatgaaaactcttgggcctgcaaccctgctgattgtcccggcgttgggacaggatgcaccgcctgcggcctctacctggaccagatgaaacccattgggaccgcttataagctggtggccatccggtactccagaaaagcgtgtgtccaatttggcgaggaacacctctgcaagacaattgatatgaatgactgtttcgtgacgcgccatgtgaagatctgcatcattggaaccgtcagcaaatttatccagggcgatacactgcttttcctggggcctctcgagggaggcgggctgatttttaagcactggtgtacctccacatgccagttcggagacccgggcgacatcatgtctcccaaagataagccttttctgtgtcccgagttccctgggcagttccggaaaaagtgcaactttgccaccacgcccgtttgtgaatatgacggcaatcaaattagcggatacaagaaaatgaaggctacaatcgattccttccagtcttttaacaccagctccatccatttcaccgacgagagacttatggaagatcctgacggcatgctccgcgatcacattaatatcgtggtgacaaaagacattgattttgagaacctggccgaaaatctgtgcgggatcggactccaggtctctgctattaagggcgcctgggggagcggagtgggcttcaccctgacatgtcaagtttcccttacggagtgccccacctttctgacaagcatcaaagcctgcgacatggctatttgttacggggcggaatctgtgaccctcgtccggggccagaacacagtgaagatctccggaaagggcgggcatagcggatcttccttcaaatgctgtcacggcgttgattgcagctctaatgggctgcaggccaacccgcctcacctggacagagtggctggagtctccgagcttaccaatgagaaggtgtatgatgacggcgctccccagtgtggcatcgcctgctggtttattaaaagcggggaatgggttaagggaatcttctccggcaactggattgtgctcatcgtcctgtgtgtgctgctcctgattagccttatcctgctcgggatcttttgccctgtgcgcaaacataagaagtcttga

SEQ ID NO: 13537 - RNA, 3426 nt, synthetic construct
  misc_feature 1..3426: note = derived and/or modified CDS sequence (opt5) from TULV(Moravia/5302v/95)__NC_005228.1__GP
  source 1..3426: mol_type = other RNA
atgttctgcctgtgtctcagcctgcttggcctgctcctgtgctggcccgccgctaccagaaaccttctggagctcaaggtggaatgtcctcacacaatcgggctgggacagggcattgtcatcgggtccgccgagctgccgcccgttcctctcgcgaaagtggaatctctgaaacttgagagctcctgcaattttgacctgcatacgtctaccgctgcccaacaggccttcacaaaatggagctgggaaaagaaagctgataccgccgagaacgctaaggccgcgtccacaacctttcagtctagctccaaggaggtgcagctccggggactgtgtgtcattcccacacttgtgctggaaaccgccagccgcacgagaaaaaccgttacatgcttcgacctctcttgtaatcaaaccgtgtgccagcctacagtctacctgatggctcccatccagacctgtgtgacgacaaagtcctgcctgctcggcctgggggatcagcggattcaagttgtgtatgagaaaacctactgtgtcagcggacagcttatcgaaggcaactgctttaatcctctgcacacaatcgccatttctcagccgacccatacctatgacatcatgacactcgctgtgcactgcttctttatttccaagaaaggcgggacggatgacaccctgaagatcgagaagcagttcgagacacttgtggaaaagaccggatgtacagagaacgccctgaagggctactatgcgtgcattctcgggaccagctctgaagtcgtttacgtgcccgccatggatgactatcgctccagcgagatcctgtccagaatgacgacagctcctcatggagaagatcacgacattgatcccaatgccatctctagcctgcggatcgtgggccaactcaccgggaaagctccttccaccgagagctctgacacagtccagggaattgcctttgccggcacacccctgtacacctccacgagcatccttgtgcgcaaggaggatccgatttacctgtggtctcctggcatcattcccgaagggaaccacagccagtgtgacaaaaagaccctccctctgacatggaccggattcatcacacttcccggcgagatcgagaaaaccacgcaatgcaccgttttctgtacactgtccgggcccggagctgactgcgaagcgtattctgataccggcattttcaatatcagctcccctacatgtctcgtgaacagagtccagcggtttcgcggggccgaacaacaggtgaagttcgtttgccagagagtggacctggatattaccgtctactgtaatggagtgaagaaagtcatcctgacgaagacactcgtgattggccagtgcatctataccttcacaagcatcttttctctgatgccgggcgttgctcattcccttgccgtggagctgtgtgtccccgggctccacggatgggccaccattagcctgctgatcaccttctgctttggctggcttgctattcctctcctgtctatgatcattatccggttcctgctcatttttacatacctgtgctccaaatatagcacggactccaagttcaaacttatcatcgagaaggtgaagcaggaataccagaaaaccatggggtctatggtttgtgaggtgtgccaacagggatgtgaaacagccaaggagctggaaagccataaaaagtcctgcccccacggccagtgtccttattgcctcaaccccaccgaggcgacagagtctgctctgcaggcccactttaaagtctgtaagctgaccacgcgcttccaagaaaatcttaagaaaagcctctccacatacgagccgaagagagggctgtaccggaccctgagcatgtttcgctataaatctaagtgctacgtgggcctcgtgtggtgtattctgcttaccatggaactgatcgtttgggccgcttccgccgagacaattaacctcgagcctggatggaccgatacagctcatggcagcgggatcattcccctgaaaacggacctggaacttgatttctctctcccttccagcgccacctatacatacagacgggagctgcagaatcccgcgaacgaacaggagaagatcccttttcacttccagatggaaagacaagtcatccatgccgagattcagcacctgggacattggatggacggcacctttaacctcaagacagctttccactgctatgggtcttgtatcaaatacgcctatccctggcagaccgctaagtgcttcctggagaaagattttgaatttgagacgggatggggctgcaatccgcctgactgtcccggggtgggcaccggatgcacagcctgtggcgtgtaccttgataagctgcgcagcgtcgggaaagtgtacaagattctctccctgaaatatacccggaaggtttgcatccaactgggaacagaacagacctgtaagacaattgacagcaacgactgccttgtgaccacgtctgtcaaagtgtgtatgatcggcacaatctccaagtttcagcccggggataccctcctgttcctgggacctctcgaggaaggcgggatgatttttaaacagtggtgcaccacaacctgtcaattcggcgacccgggagatatcatgagcacgcccctgggcatgaagtgccctgagcacgcggggtcctttcgcaaaaagtgttctttcgccacacttcccagctgccagtacgacggaaataccgtttccggctatcagagaatgattgctacaaaggattcttttcagagcttcaacatcaccgagcctcatattacaaccaattccctggaatgggtggaccccgattctagcctcaaagaccacgtcaacctgatcgtgaatcgggatctgtcctttcaagaccttgccgagaacccttgccaggttgatctgagcgtgtcttccatcgacggggcttggggaagcggcgtcgggttcaatctcgtgtgttctgtgtccctgacggaatgcgccagctttctcacctctattaaggcctgtgattccgctatgtgctacggcagctccacagcgaacctggtcagaggacagaataccgttcatgtggtgggcaaagggggacacagcggctctaagttcatgtgttgccacgacaaaaagtgtagcgccacagggcttgtcgctgccgctccccatctggaccgcgtgaccggatataaccagatcgatacgaataaggttttcgacgatggcgccccgcaatgcggcgtgcactgttggtttaaaaagtccggggagtggctcctgggcattctgtctggaaactggatggtcgtggccgttcttatcgcgctgttcatttttagcctcctcctgttctccctgtgctgtcctcggagacagaattacaaaaagaacaaatga

SEQ ID NO: 13538 - RNA, 5055 nt, synthetic construct
  misc_feature 1..5055: note = derived and/or modified CDS sequence (opt5) from CCHFV(10200)__U39455.2__GP
  source 1..5055: mol_type = other RNA
atgcacatcagcctgatgtacgccattctctgcctgcagctttgtggcctgggggagacccatggatcccacaacgaaacaagacataataagacggacaccatgacaacccacggcgataacccctctagcgagcctccggtgtccacagctctctctatcaccctggaccccagcacagtcacccctacgacccccgcctccgggcttgaaggatctggcgaggtttatacaagccctcccattaccacagggtccctgcctctcagcgaaaccacgccggagctgcccgtgacaaccggaacagataccctgtctgcgggcgacgtggatccttccacccagacagctggcgggacgagcgcccccaccgtccggacatctctccctaattcccccagcaccccgtctacacctcaggacacccatcaccccgtgcgcaacctgctttccgttacgagccctggacccgatgagacatccaccccctctggcaccgggaaagaaagctccgccacaagctctcctcacccggtgtccaatagaccccctacaccccctgctaccgcccagggacccacggagaacgacagccataatgctaccgaacacccggagtctctgacacagagcgccacccctggcctcatgacatcccccacccaaatcgtccatcctcagtctgcgacgcccattaccgtgcaggatacacaccctagccccaccaaccggtccaagcgcaatctgaaaatggagatcatccttacactgagccaggggctcaagaaatactatggaaagattctgagactgctccaactgacccttgaagaggacacggaaggcctgctcgagtggtgcaagcggaacctgggccttgattgtgacgatacattctttcagaaacgcatcgaagagttctttattaccggggagggacacttcaatgaagttctgcagtttagaacaccgggcaccctctctaccacagagtccacgcctgccgggctgcccaccgctgaacccttcaagagctactttgccaaaggattcctgtctatcgactccggctattacagcgctaagtgctattccgggacatctaacagcggactccagctgattaatatcacccggcattccacacgcattgtggacacccctggcccgaaaatcacgaaccttaagacaatcaattgtattaacctgaaggcctctatctttaaagagcacagagaagtcgagattaacgtgctcctgccccaagtggcggtcaatcttagcaactgccatgttgtgatcaagtcccacgtgtgtgattacagcctggacattgatggcgccgtccggctccctcatatctaccacgagggggtgttcatccccggaacctataaaattgttatcgacaagaaaaataagctgaacgatcgctgcaccctgtttacagactgtgtgattaaaggcagagaagtccggaaggggcagtctgtgctccgccagtacaagaccgagatcagaattggaaaggcttccacaggcttccggagactgcttagcgaggaaccttctgatgactgcgtttcccgcacgcaactgctccggaccgaaacagccgagatccacggggataattatggcggacccggcgacaagatcaccatttgtaacgggagcacaatcgtggatcagagactgggatctgagctgggctgctacaccattaatcgcgtccggagctttaaactttgcgaaaactccgctacggggaagaattgtgagatcgacagcgtgcctgtcaaatgcagacagggatattgtctccgcattacccaggaaggccgggggcatgtgaagctgtctagaggctccgaggttgtgctggacgcctgcgatacaagctgtgagatcatgattcccaagggaaccggcgacatcctcgtcgattgctccgggggacaacagcacttcctgaaagacaaccttatcgatctgggctgtccgaagattcctctcctggggaaaatggccatctacatttgccgcatgtctaatcatcccaagacaaccatggctttcctgttttggttcagctttggatatgtgatcacatgtattctttgcaaagcgatcttctacctcctgatcattgttggcaccctggggcggagactcaagcagtaccgcgaactgaagcctcagacgtgtacaatctgcgagaccacccccgtgaacgccattgacgctgaaatgcacgatcttaattgctcctataacatctgtccgtactgcgcctctcggctgacaagcgacggcctcgccagacacgtcattcaatgtcctaaacggaaggagaaagtggaagagaccgagctgtatctgaatcttgaacgcatcccctgggtggttagaaagctcctgcaggtctccgagtctacgggagtggctctgaaacggagctcctggctcatcgtgctgcttgtcctgtttacagtgagcctctctcctgttcagtccgcccccattggccaggggaagaccatcgaagcgtacagagctcgcgagggatatacaagcatttgcctgttcgtgctgggctctatcctttttattgtctcctgtctcatgaaggggctggtggatagcgttggaaactctttctttcccggcctgtccatctgcaaaacctgtagcatctccagcattaacgggttcgaaatcgagtctcataagtgctactgtagcctcttttgctgtccttattgccggcactgctccacagacaaagagattcataagctgcacctttctatctgtaaaaagagaaaaaccggcagcaatgtgatgctggccgtctgcaagctcatgtgtttccgcgccacgatggaagtgtccaacagagctctgtttattcggtctatcattaataccacattcgttctgtgcatccttatcctggccgtgtgtgtcgtgagcacctccgctgtggagatggaaaacctcccggccggaacatgggagcgcgaagaggatctgaccaatttctgccatcaagagtgtcaggtcacggaaacagagtgcctctgtccctacgaagcgctggttcttagaaagcctctgtttctcgactctaccgccaaaggcatgaagaacctgctgaatagcacatcccttgagaccagcctgtctattgaggctccctggggagccatcaacgtgcagtccacctacaaacctacagtgagcacggctaatattgccctctcttggtccagcgtcgaacaccggggaaacaagatcctggtgtccggccgctctgagagcattatgaaactcgaagagagaaccgggatctcctgggatctgggagttgaagacgcgagcgagtctaaacttctgacagtgtccgtcatggacctcagccagatgtattctcccgtgttcgagtacctgagcggcgatcggcaagttgaagagtggcctaaggctacctgcacaggcgactgtccggaacgctgcgggtgcacctcctctacgtgtctgcacaaagagtggccccatagcagaaattggcggtgcaaccctacatggtgttggggagtgggcaccgggtgcacctgttgcggacttgatgtcaaggacctgtttacagattatatgttcgtgaaatggaaggttgaatacatcaaaaccgaggccattgtgtgtgtcgagctcacatcccaggaacgccagtgctctctgatcgaggccggcacgagatttaatctcgggcccgtgaccattacactgagcgaacctcggaacatccaacagaaacttcccccggagattatcaccctgcaccctagaatcgaagagggattctttgacctgatgcatgtgcagaaggtcctctccgctagcacagtttgtaaactgcagtcttgcacccacggcgtgcccggcgatcttcaagtgtatcatattgggaatctgctcaagggagacaaagtcaacggccacctgatccacaagattgagccccatttcaacacgtcctggatgagctgggatgggtgtgacctcgattactattgcaatatgggagactggccttcctgcacctacacaggcgtgacccagcacaaccatgcctcttttgttaatctgcttaacatcgaaacagattacaccaaaaatttccactttcacagcaagcgcgtgacagcccatggggacacgccccagctggacctgaaggctcggcctacctatggagcgggcgagattacagtcctcgtggaagttgccgatatggagctgcacaccaaaaagatcgagatttccggccttaaattcgcttctctggcctgtaccgggtgctacgcctgtagctccagcatctcttgcaaggtgagaatccatgtcgacgaaccggatgagctcacagtgcacgtcaaatccgacgatcccgacgtggttgctgcctctagctccctgatggcgcgcaagctcgaatttggaacggatagcaccttcaaggctttctctgccatgcctaagacaagcctgtgtttttatattgtggagcgggaacattgcaagtcctgttctgaggaggacaccaaaaagtgcgtcaacacaaaacttgaacagccccaaagcatcctgattgagcacaagggcaccatcattgggaaacaaaattccacgtgtacagccaaggctagctgctggctggaatccgtgaagtctttcttttacggactcaaaaacatgctgagcggcatcttcgggaatgtttttatgggaatcttcctttttctggcccctttcattctcctgatcctctttttcatgtttggctggcgcattctgttctgtttcaagtgctgcagacggaccagaggcctttttaaatatcgccacctgaaggatgacgaggaaaccgggtaccggagaatcattgagaaactgaacaataagaaggggaaaaacaagctcctggatggcgagcggcttgcggacgggcgcatcgctgaactgttctccacaaaaacccatatcggatga

SEQ ID NO: 13539 - RNA, 5055 nt, synthetic construct
  misc_feature 1..5055: note = derived and/or modified CDS sequence (opt5) from CCHFV(IbAr10200)__AF467768.2__GP
  source 1..5055: mol_type = other RNA
atgcacatcagcctgatgtacgccattctctgcctgcagctttgtggcctgggggagacccatggatcccacaacgaaacaagacataataagacggacaccatgacaacccccggcgataacccttctagcgagccgcccgtgtccacagctctctctatcaccctggaccctagcacagtcacccccacgacccctgcctccgggcttgaaggatctggcgaggtttatacatctccccctattaccacagggtccctgccgctcagcgaaaccacgcccgagctgcctgtgacaaccggaacagataccctgtctgcgggcgacgtggatccctccacccagacagctggcgggacgagcgcccctaccgtccggacatctctccccaattccccgagcaccccttctacaccccaggacacccaccatcctgtgcgcaacctgctttccgttacgagccccggacccgatgagacatccaccccttctggcaccgggaaagaaagctccgccacaagctctccgcaccccgtgtccaatagacctcccacccctcccgctacagcccagggaccgacggagaacgacagccacaatgctaccgaacatcctgagtctctgacacagagcgccacccccggcctcatgacatcccctacccaaatcgtccacccccagtctgcgacgcctattaccgtgcaggatacacatcccagcccgaccaaccggtccaagcgcaatctgaaaatggagatcatccttacactgagccaggggctcaagaaatactatggaaagattctgagactgctccaactgacccttgaagaggacacggaaggcctgctcgagtggtgcaagcggaacctgggccttgattgtgacgatacattctttcagaaacgcatcgaagagttctttattaccggggagggacacttcaatgaagttctgcagtttagaacacctggcaccctctctaccacagagtccacgcccgccgggctgcccaccgctgaacctttcaagagctactttgccaaaggattcctgtctatcgactccggctattacagcgctaagtgctattccgggacatctaacagcggactccagctgattaatatcacccggcactccacacgcattgtggacaccccgggccccaaaatcacgaaccttaagacaatcaattgtattaacctgaaggcctctatctttaaagagcatagagaagtcgagattaacgtgctcctgcctcaagtggcggtcaatcttagcaactgccacgttgtgatcaagtcccatgtgtgtgattacagcctggacattgatggcgccgtccggctcccccacatctaccatgagggggtgttcatccctggaacctataaaattgttatcgacaagaaaaataagctgaacgatcgctgcaccctgtttacagactgtgtgattaaaggcagagaagtccggaaggggcagtctgtgctccgccagtacaagaccgagatcagaattggaaaggcttccacaggcagccggagactgctttctgaggaaccctccgatgactgcatcagccgcacgcaactgctccggaccgaaacagccgagatccacggggataattatggcggacctggcgacaaaattaccatctgtaacgggtctacaattgttgatcagagactgggaagcgagctgggctgctacaccatcaatcgcgtgcggtccttcaaactttgcgaaaacagcgctacggggaagaattgtgagattgactctgtccccgtgaaatgcagacagggatattgtctccgcatcacccaggaaggccgggggcacgtcaagctgtccagaggcagcgaggtggttctggacgcctgcgatacatcctgtgagattatgatcccgaagggaaccggcgacatcctcgtggattgctctgggggacaacagcattttctgaaagacaaccttattgatctgggctgtcctaagatccccctcctggggaaaatggccatttacatctgccgcatgagcaatcaccctaagacaaccatggctttcctgttctggttttccttcggatatgtcattacatgtatcctttgcaaagcgatcttttacctcctgattatcgtgggcaccctggggaagcggctcaagcagtacagagaactgaaaccccagacgtgtacaatttgcgagaccaccccggttaacgccatcgacgctgaaatgcatgatcttaattgctcttataacatttgtccttactgcgccagccgcctgacatccgacggcctcgcccggcacgtgatccaatgtcccaagagaaaagagaaggtcgaagagaccgagctgtatctgaatcttgaacggatcccttgggtggtgcgcaaactcctgcaggtttctgagagcacgggagtcgctctgaagagatccagctggctcattgtgctgcttgtgctgttcacagtctctctctcccccgtgcagagcgcccccatcggccaggggaagaccattgaagcgtaccgggctagagagggatatacatctatctgcctgtttgttctgggctccattcttttcatcgtgagctgtctcatgaaagggctggtcgattctgtgggaaactcctttttccctggcctgagcatctgcaagacctgttccattagctctatcaacgggtttgaaattgagagccacaaatgctactgttccctcttctgctgtccgtattgccgccattgctctacagacaaggagatccacaaactgcatcttagcatttgtaagaaacggaagaagggctccaatgttatgctggccgtgtgcaaactcatgtgttttagagccaccatggaagtctctaaccgcgctctgttcatcagaagcattatcaatacgacctttgtgctgtgcatccttattctggccgtttgtgtggtctccacatctgctgtggagatggaaaacctccccgccggaacctgggagcgggaagaggatctgacaaatttctgccaccaagagtgtcaggtgaccgaaacggagtgcctctgtccttacgaagcgctggtccttcgcaagcccctgttcctcgacagcacagccaaaggcatgaagaacctgcttaattccaccagcctggagacatctctgtccatcgaggctccttggggagccattaacgttcagagcacctacaaacccaccgtgtctacagctaatatcgccctctcctggagctccgtggaacatagagggaacaagattctggtctctggccggagcgagtccatcatgaagctcgaggaacgcacggggatcagctgggatctgggagtggaagacgcgtctgagtccaaacttctgaccgttagcgtgatggacctctctcagatgtatagccctgtctttgagtacctgtccggcgatagacaagtgggcgaatggccgaaggccacatgcaccggggactgtcccgagcggtgcggatgcacatctagcacctgtctgcacaaagaatggcctcactcccgcaattggagatgcaaccccacgtggtgttggggcgttgggacaggatgcacctgttgcggccttgatgtgaaggacctgttcaccgattatatgtttgtcaaatggaaggtggagtacattaagacagaagctatcgtttgtgtggagctcacctctcaggagcggcagtgcagcctgattgaagccgggacacgcttcaatctcggacctgtcacgatcaccctgtccgagcccagaaacattcaacagaaacttccgcctgaaatcatcacactgcatccccggattgaggaaggctttttcgacctgatgcacgtgcagaaggtgctcagcgcttctaccgtctgtaaactgcagtcctgcacacatggcgttcccggggatcttcaagtgtatcacatcggaaatctgctcaagggcgacaaagtgaacgggcatctgattcacaagatcgagcctcactttaacaccagctggatgtcctgggatggatgtgacctcgattactattgcaatatgggcgactggccctcttgcacgtacaccggggtcacacagcataaccacgccagcttcgtgaatctgcttaacattgagaccgattacacaaagaattttcatttccactccaaaagagttaccgcccacggagacacacctcagctggacctgaaggctcgcccgacgtatggcgcgggcgaaatcaccgtgctcgtcgaggtggccgatatggaactgcataccaaaaagattgagatctctgggcttaaatttgctagcctggcctgtacaggatgctacgcctgttccagcggcatctcttgcaaggttcggattcacgtggacgagcccgatgaactcaccgtccatgtgaaatccgacgatcctgacgtcgtggctgcctctagctccctgatggcgagaaagctcgagttcgggacagatagcacgtttaaggctttctctgccatgcccaaaaccagcctgtgtttctatatcgttgaacgcgagcactgcaagtcctgttctgaagaggacaccaaaaagtgcgtgaacacaaaacttgagcagcctcaaagcattctgatcgaacataagggaacaattatcggcaagcaaaattccacctgtacggccaaagctagctgctggctggagtccgtcaagagctttttctacgggctcaaaaacatgctgagcggaatctttggcaatgtgttcatgggcatttttcttttcctggccccctttatcctcctgattctcttctttatgttcgggtggcggatcctgttttgtttcaagtgctgcagacgcacacggggacttttcaaatatagacacctgaaggatgacgaagagaccggctaccgccggattatcgaaaagctgaacaataaaaaggggaaaaacaagctcctggatggagagagacttgcggaccggcgcatcgctgagctgttttccaccaaaacacacattggctga

SEQ ID NO: 13540 - RNA, 5067 nt, synthetic construct
  misc_feature 1..5067: note = derived and/or modified CDS sequence (opt5) from CCHFV(Turkey-Kelkit06)__GQ337054.1__GP
  source 1..5067: mol_type = other RNA
atgcccaccaacatcatgcacacacctctggtgtgcttcattctctacctgcagcttctgtgtctcggcggggcccatggacaactgaatgctacggagcacaacggcaccaataacacaaccgccccgggggcgagccagtcccccaagcctcccatgtctacaacccctccccatgctcctgaaagctccacaatcaaaccgaccacgcccatttctgaggccgaaggaagcggcgagaccacatcccctcccaataccacacaggggctttctagccctgaaaccacgtccgagagacccgccacaaccagcatctctacatccagcaccgactctaccaacccgacaacgcagatgaccgataatacacctacccccacagtctccaccagcccttcttccagcccctccacgccctctacacctcaagggattcaccatccggctcggagcctgctctccgttagctctcccaagaccgtgaccacacctacccccacatcccctggcgagatgagctctgaaacgagctcccagcactctgccatgagccgcatccccaccccgcacacagctaccagagtgtccacagagatcaccaaccatcggacgcctcgccagagcgaatcttccgcccagcaaaccacacccagccctatgacctctcccgcgcagtccattctgctgatgagcgccgctcctacagccgtccaggacatccacccctccccgaccaatagatctaaacggaacctcgagacggagattatcctgacacttagccagggcctgaagaaatattacgggaagattctcaagctgcttcatctgaccctcgaacaagatacagagggactgctggaatggtgcaaaggcaatctcgggtccaactgtgacgatgactttttccagaagcgcatcgaggaatttttcatgaccggagagtgctattttaatgaggtgctgcagttcaaaaccctttctacactgagccctacggaaccctcccacgctagactccccaccgccgagccttttaagagctacttcgcgaaaggctttctgtctattgattccgggtatttcagcgccaagtgttacccgcggtcttccgctagcggacttcaactgatcaacgttacacagcaccccgcccgcatcgctgaaacccctggccccaagacaacctctctcaaaacgattaattgcatcaacctgagagccagcgtgtttaaggagcatcgggaagtcgagattaacgtgctgctccctcagatcgccgttaatctgtccaactgtcacgtggtcattaatagccatgtgtgcgactattctcttgatacagacggccccgtgcgcctgcctagaatctaccacgaggggaccttcatccccggaacctacaaaattgtcatcgataagaaaaacaagctcaatgaccggtgtacactggttaccaactgcgtgattaaaggccgcgaagtgagaaaggggcagtccgtccttcggcaatataagacagagatcaaaattggaaaggctagcacgggctttagaaaactgctctccgaggaaccgggggatgactgtatctctcgcacccagctgctgcggacagaaaccgcggagatccatgacgataattacggaggccctggcgacaagattacaatctgcaacgggagcaccattgtggatcagagactcggatccgagctgggctgctatacgatcaatcgcgttaaatctttcaaactttgtaagaacagcgccaccgggaagacatgcgaagtggactccacccccgtcaagtgtcggcagggattctgcctgaaaattacacaagagggcagagggcacgtgaagctctctcgcggcagcgaagttgtgctggatgcttgtgactccagctgcgaggtcatgatccctaaaggaaccggcgatattctggtggactgttctgggggacagcagcactttcttaaggataatctcatcgacctgggctgcccccatatcccgctgctcgggcggatggccatttacatctgtagaatgtccaaccaccctcgcacaaccatggccttcctgttttggttcagctttggatatgtcattacgtgcatcttctgtaaggctctgttttactctctgattatcatcggcacactcgggaaaaagattaaacagtatcgggagctgaagccccaaacctgcaccatctgcgaaacagcccctgtgaatgcgattgatgctgagatgcatgacctgaactgttcctacaatatctgcccctactgtgccagcagacttacctctgacggcctcgcccgccacgttacgcagtgccccaaacggaaggaaaaggtggaggaaacagagctgtatctgaacctcgagcggattccttggatcgtcagaaaactgcttcaggtgtccgaaagcaccggagttgctctgaagcgctccagctggctcatcgtgctgctggtccttctcacagtgtctctgagcccggtgcagtccgcccccgttggccacgggaaaaccattgagatctaccaaacaagagaaggattcgcttctatttgtctgtttatgctcggcagcatcctgttcattgtctcctgccttgtgaaggggctggtggattctgtcagcgagtcctttttccctggactctctgtgtgtaaaacctgcagcatcggctccgttaacgggtttgaaatcgagagccataagtgttattgctctctgttctgttgcccctactgccggcactgttccgccgacagagagattcatcagctgcaccttagcatctgcaaaaagcgcaagacgggctctaatgtgatgctcgcggtctgtaaacggatgtgcttcagagccaccattgaggcttcccgcagagccctgctgatccggagcattatcaacacaacctttgtgatttgtatcctcacactgaccatctgcgttgtgtccacgtctgctgtcgaaatggaaaatcttcctgccggaacatgggagcgcgaagaggatctgaccaacttctgtcatcaggagtgccaagtgacagaaaccgagtgtctctgcccctatgaagcgctggttctgagaaagcctctttttctggacagcattgtgaaaggcatgaagaatctcctgaactccaccagcctcgagacatctctgtccatcgaggccccgtggggagctattaatgtccagagcacgttcaaacccaccgtgtctacagccaacatcgctcttagctggtcctctgtggtccaccggggaaataagattctggttaccggccgcagcgaatccatcatgaagctcgaggaaagaacaggggtgtcttgggatctgggagtggaggacgccagcgaatccaaactgcttaccgtcagcatcatggatctgtctcagatgtactcccctgtgtttgagtatctcagcggcgaccggcaggttgaggaatggcccaaggccacgtgtacaggggattgccctgagcgctgcggctgtacctcctctacctgcctgcacaaagaatggagccattccagaaactggcggtgtaatcccacatggtgctggggagtgggcaccgggtgtacatgctgtggagtcgacgtgaaggatctcttcacggaccacatgtttgttaaatggaaggtggagtacattaagaccgaagctatcgtctgcgtggcgctgacatctcaagagcgccagtgtagccttattgaggccggcaccagattcaacctggggccggttacaatcaccctctccgaacctcggaatattcagcagaaactgcctcccgagatcatcacgctgcatcccaagattgaagagggatttttcgatcttatgcacgtgcaaaaagtcctgagcgcttctaccgtgtgcaagctccagtcctgtacacatggcatccccggcgaccttcaggtgtaccacattgggaacctcctgaaaggagacagagtcaatggccaccttatccataagattgaaagccactttaacacctcttggatgtcctgggatgggtgcgacctggattattactgcaacatgggagactggcctagctgtacatataccggcgttacacagcataatcacgccgccttcgtgaacctgctcaatatcgagacggattacaccaagacatttcacttccattctaaacgcgtgaccgctcacggggacaccccgcaactggatcttaaggcccggcccacatatggagcgggcggcattacggtcctggtggaggttgctgacatggaactccataccaaaaaggtggagatcagcgggctgaaattcgcctccctcgcctgcacaggatgttacgcttgctctagcggcatctcctgtaaggtccgcattcacgtggatgaacctgacgagctgaccgttcatgtgaaaagctccgatcccgacgtcgtggccgcgtctacaagccttatggctagaaagctggagtttgggaccgattccacgttcaaggccttttctgccatgcctaaaacaagcctgtgcttctatatcgtcgaacgggagtactgtaagtcctgctctgaagacgacacccagaaatgtgtggataccagactcgagcagccccaaagcattctgatcgaacacaagggaacaattatcggcaaacagaacgatacctgcacagctaaggcctcctgttggcttgagagcgttaagtcctttttctacgggctgaaaaatatgctcggatctgtgtttggcaacctgttcatcggcattctcctgtttcttgctccgttcgtcctgctggtgctctttttcatgttcgggtggaagatcctgttttgcttcaaatgctgtcgccggaccagaggactttttaagtatcgccacctgaaagacgacgaggaaacgggctaccggagaattatcgagcggctcaatagcaagaaggggaaaaaccgcctgctcgatggagacagactggccgatcggaagattgcggaacttttctctacaaaaacccatatcggctga

SEQ ID NO: 13541 - RNA, 5103 nt, synthetic construct
  misc_feature 1..5103: note = derived and/or modified CDS sequence (opt5) from CCHFV(UCCR4416)__KY484026.1__GP
  source 1..5103: mol_type = other RNA
atgttcctgcactttaagttcatgctcctgaccaactttttcttttgccagcttctgtggggcgggggaggcgtggccagcgggggaagaacaaatacgtcctctacccaaacaaccctcatcagctccaacacacttaattctaccatgagcgtccttgagtcctctattggcacagctaccgaaacggttcccagcaccacaaccaacacacctgacacccaggtgacgacagattccgggagcggagagtcttccaccgacccgcagacaaccagcaaagaagtgccctctacctccgtcgccacaatcaagacgcaggagagcgaaacccatcgggcgcaaaatccttctacaaccgctggctccggcgccagcacaccctccaacaccacgtctaataaacctgatgtgaacagcctgacatcccccattctcgaggccaagagctctccttccccgagcaaaacctctatgccccagaccgctcaccatctgagccgctccctgctctctgccgctacaaccgagacaaatcaggccgcgagcgttatgacgaccacaagagaaaccacaaccatgtccagccctacgaccgtgaagaactctgtcacagccatccccacccaggggattacaacctccaatacgagcaagcaaacagacaccatcacactggagatctctcctaaaattcagaccacccagtcccagcaaacagctacgcccgccatcgctccggccaccacagcgattgccttcatcagccctaccaaccggtccaagcgcgaatctaaagtgcagattatccttacatttagccagggactgaagaaatactattccaagattctcaagctgcttcacctgacccaagaggaggattctgaaggcctcctggagtggtgtacgagagttctggaacaggcttgcaatgacgattacttcaacgagcggatcgaagagtttttcatcacagggaaaggatattttaatgacgtgctccagttccgcctgtacgatacccttagcaccacagagtccacccagaacacaagccccacggccaagccttttagatcttattacgctaaaggctccctgaccttcgacagcgggtatttctctgccaagtgttacccccgggcctccaacagcggactccaactgattaatgtcacacagcattctgtgaaaatcgctaacacccccggccctaagattagcaatccgaaaacaatcaactgcattaatcttaaggtgtccaccgataaggaccacagcaaactggaaatcaacgtcctcctgccccaggttgcggtgaatctgtctaactgtcacgtgctcatcgagtcccatgtctgcgattacagcctggacacggacggcaccattaagctgcctaaaatcacacacaatggggcctttattcccggaacctataagatcgtgattgataaaaagaacaagctgaatgaccgctgtgctctcttcacaaactgcgttatcaaaggcagagaagtgcggcgcgggcagtccgccctgagacaataccggaccgagatccgcattggacagacatttaccggctctagacggcttctggccgaagggggaagcaatgattgtgtctccagaacgcagctcgtgaagacagaggttgctgagatccatgaagactcttatggcggccctggggagaaaattaccatctgcaacggaagcaccattgtggatcagcgcctgggctccgaactggggtgttacacaatcaatcgggtcagaacctataagctctgcgagaactctgccacggaaaaatcttgcgagattgactccgtgcccgtcaagtgtaagcaaggattctgcctgaaaatcacacaggagggccgcgggcacgtgaaacttagccggggcaccgaaatcgttctggatgtgtgtgacacatcttgcgagctcatgattccgaaaggaaccggcgatatcctggtcgactgttccgggggacagcagcactttctgcaagataaccttattgacctcggctgccctaatatccccctgctggggagaacagcgatttacgtgtgtcgcatgagcaaccatcctaagaccacgatggctttcctcttttggttctcttttggatatgttattacctgcgtggtctgtaaagtgctgttctaccttctgatcgtgatcggcacactcgggaagcggctgaagcagtacagagaactgaaaccccagacctgcatcgtttgtgagtccattcctgtcaatgccatcgacgccgagatgcacgatcttaactgcaattataacatttgcccctactgtgctagccgcctcacatctgacggcctggtgcggcatgtgacccaatgcccgaagagaaaagaaaaggtcgaggaaacggagctgtatctcaatctggaacgcatcccttggcttgtgcggaaactgctccaggtttccgagagcacaggagtggccctgaagagatcctgttggatgatcaccctgcttattctcctgacagtcagcatgtctcccgtgcagagcgctcccgttggccacaaacgggccgtggaggtctaccagatgcgcgaatcctataccgggatctgcctgtttgtgctcggatctgttctgttcgcggtgagctggcttgtcaaggccctgattgattccatcggcaacagctttttccctgggctcagcatttgtaagacctgctccatcggatctatcaatggcttcgagattgaaagccataaatgttactgctccctgttttgttgcccgtattgtagagcttgcagctctgacaagatcacacaccggatgcacctgaacgtgtgcaaaaagagaaaagtggggtccaatgtcatgcttgccgtttgtaagcgcatgtgcttcaaggctacgattgaggccagcaaccgggcgacctttatcagaaatattatcaactctacattcgtgatttgtatcctcatcctggtgatttgcgtcgtgtccaccagcgccgttgatatggaaaatctgcccgctggcatctgggagaaagaggaagacctcacaaacttttgtcatcaagagtgccaggtgaccgaaacggagtgtctgtgcccttacgaagcccttatgctgcgcaagcccctcttcctggatagaattgctaaaggaatgaagtccctgcttaactctacaagcctggagacctccctcagcatcgaggccccttggggcgccattaatgtccagtctacctttaaacccacagtgtccgctgcgaacatcgccctgagctggtctagcgttgaacacaaggggaataagatcctcgtgtccggacggtctgagagcattatgaaactggaggaacgcaccggcatctcctggtgtcttggggtcgaggacgcttctgaaagcaagacactgacggtgtccgttatggatctcagccagatgtactctcctgtgttcgagtatctgtccggagacagacaagtcgaagagtggcccaaagctacctgcacaggcgattgtccggaacggtgcgggtgcaccagctccacatgtctgcataaggagtggcctcactctcgcaactggagatgcaatcccacctggtgttggggcgtgggaacgggctgcacctgttgcgggcttgacgtgaaagatctgtttacagactacatgctcgtcaagtggaaggttgagtatattaaaaccgaagccatcatttgtgtggagctgacaagccaggaacggcagtgctccctcatcgaggccggaacccgcttcaacctgggccctgtgacaatcacgctttctgaacccagaaatgtccagcaacggctgccgcctgagattatcaccctccaccccaagattgaggaagggtttttcgacctgatgcatgtgcagaaagttatgagcgcctccacagtgtgtaagctgcagagctgcacccacggagtccctggcgatcttcaagtgtaccatgttggcaacctgctcaaaggggacaaggtgaatggacactctatccataaaattgagtcccacctgaacaccagctggatgtcttgggatggctgtgacctcgattatttttgcaatatgggggactggccctcctgcacatacacgggagtcacccagcacaaccatgcggctttcatcaatatgctgaacattgaaacagattataccaagacattccactttcatagcaagcgcgtgaccgcccacggcgacacgccccagcttgatctgaaagccagacctgcttacggggccggagagatcacagtcctggtggaagttgcggacctcgagctgcataccaagaaaatcgaggtgtctggccttaagttcgctagcctgtcctgttctggctgctacgcctgtagctccgggattagctgcaaagtccggatccacgtgaatgaaccggatgagtttaccgttcacgtgaagtccaacgaccccgatgtcgtggccgctggatctagcctcatggccagaaagattgaatccggcgctgactctacattcaaagcctttagctccatgcctaagaactctctgtgtttctatatcgtggagcgcgactactgcagctcctgtaccgatgacgatacacagaaatgcgttgacattaagctcgagcatccccaaagcatcctgatcgaacacaaagggaccattatcggaaagcagaatgatacgtgtcctacaaagacctcttgctggcttgagtccattaagagctttttctatggcctgaagaacatgctgtctgggatctttggaaatgtcttcctcggcatgctgctttttctggcgcccttcattctcctgatcctcttctttttctttggctggcggctgcttttctgtctgaaatgctgcagacgcacacggaagctgctcaaatacaagcatctgagagacgaagaggaatccgggtataagaaaatcattgagcgccttaacgataagaaaggaaagagccggctgtttgacggcgagagactcgccgatcgcaaaatcgctgaactgttctctaccaagacgcacattgggtga

SEQ ID NO: 13542 - RNA, 5103 nt, synthetic construct
  misc_feature 1..5103: note = derived and/or modified CDS sequence (opt5) from CCHFV(ArD15786)__DQ211627.1__GP
  source 1..5103: mol_type = other RNA
atgttcctgcactttaagttcgtgctcctgaccaactttttcttttgccagcttctgtggggcgggggaggcgtcacaagcgggggaggcacgaatacctcctctacacaagccatcctcattagctccaacacccccaattctacaatgagcgttctggagtcctctaccgggacagctgccgaaaccgtgcctagcacgaccatcaacacaccggacacccaggtgacaaccgattccggaagcggcgagtcttccacggacccccagacaaccaatggcgaagtccctagcacatctattgcgaccatcaaaacccaggagtccgaaacaagacggacgcaaaaccttagcaccacagctgggtctggagcctccacccccggcaatacaaccagcaacaagcctgatgtgaatctgctcacgtcccccatttctgaggccaaaagctcccctagcccgtctaagacatccacaccccagaccgctcatcacctgagccgctctctgctcagcgccgctacaaccgagacatcccaggccgcgtctgttatgacgaccacaagagaaaccacaaccatgagctcccctacgaccgtgaaaaacagcgccacagctacccccacacaggggatcaccacgtctaatacatccaagcaaaccgacacaaccaccctggagatccctcccaagattcagacaacgcagagccagcaaaccgccacaccggctatcacccctgccacaaccgcgattgccttcatctctcccacgaaccggtccaaacgcgaaagcaaggtccagattatccttacattttcccagggactgaaaaagtactattctaaaattctcaagctgcttcatctgacccaagaggaggatagcgaaggcctcctggagtggtgtaccagagtgctggaacaggcttgcgacgatgactacttcaatgagcggatcgaagagtttttcatcacagggaagggatattttaacgatgttctccagttccgcctgtacgacaccttttccacaacggagtctacccagaatacaagccctaccgccaaacccttcagatcctattacgctaagggcagccttacattcgattctggctatttttccgccaaatgttacccccgggccagcaactctgggctgcaactcattaacgtgacccagcactccgtcaagatcgctaatacgcctggaccgaaaattagcaaccccaagaccatcaattgcattaacctgaaagtgtctacagacaaggatcatagcaaacttgaaatcaatgtgctgctccctcaggtcgcggttaacctgtccaattgtcacgtgctgatcgagagccacgtgtgcgactactctctcaacaccgacggcacaattaagctgcccaagatcgcccataatggggctttcattcctggaacctataaaatcgtcattgataagaaaaacaaacttaatgaccgctgtgccctgtttacaaactgcgtgatcaagggcagagaagttcggcgcgggcagtccgccctcagacaataccggaccgagatccgcattggacagacgttcacaggcagcagacggctgcttgctgaaggcgggtccaatgattgtgtgtctagaacccagctggtcaagaccgaggtgacagagatccacgaagacagctatggaggccccggggagaagattaccatctgcaacggatccacgattgttgatcagcgcctcggctctgaactggggtgttacacaatcaatcgggtgagaacctataaactgtgcgagaacagcgccacagaaaagtcctgcgagattgactctgtcccggtgaaatgtaagcaaggcttttgcctcaagatcacccaggagggacgcggccatgtcaaactgagccgggggacagaaatcgtgcttgatgtttgtgacacctcctgcgagctgatgattcctaagggaacgggcgatatcctcgtggactgtagcgggggacagcagcacttcctgcaagataacctgattgaccttggctgccccaatatccctctcctggggcagaccgcgatttacgtctgtagaatgtctaaccaccccaaaacaaccatggcttttctgttctggttttccttcggctatgtgatcacatgcgttgtgtgtaaggtcctcttttacctgcttatcgtgattggaaccctgggcaaacgcctcaagcagtaccgggaactgaagcctcaaacgtgcatcgtgtgtgagagcattcccgttaatgccatcgacgccgagatgcatgatctgaactgcaattataacatttgcccgtactgtgcttctagacttacatccgacgggctcgtccgccacgtgacccagtgccctaaacggaaggaaaaagtggaggaaacagagctgtatctgaatctcgaaagaatcccctggctggtccgcaaacttcttcaggtgagcgagtctaccggagttgccctcaagcggtcctgttggatcattaccctgctgatccttctcacagtgagcatgtcccccgtccagagcgctcctgtgggccataagagagccgttgaggtgtaccaaattcgggaatcttatacggggatctgcctgttcgtcctgggaggcgtgctctttgcggttagctggctggtgaaagcccttattgattccatcgggaactctttcttcccgggcctgagcatctgtaagacctgctccattggatctatcaatggctttgagattgaaagccacaagtgttactgctccctcctgtgttgcccctattgtcgcgcttgctctagcgacaaaatcacacatagaatgcacctgaacgtctgcaagaaacggaaggtggggtccaatgtgatgcttgccgtctgtaaaagaatgtgcttcaaggctaccattgaggccaacaatcgcgcgacatttatccggaacattatcaatagcaccttcgttatctgtattctcatcctggtgatttgcgtggtctctacgtccgccgtggatatggaaaacctgcctgctggaatctgggagaaggaggaagacctcacaaacttttgtcaccaggagtgccaggttaccgaaaccgagtgtctgtgcccctacgaagcccttatgctgagaaaacctctcagcctggattctattgctaagggcatgaaatccctgcttaatagcacatccctggagacctctctcagcatcgaggccccctggggagccatcaacgtgcagtccacattcaagcctacgattagcgctgcgaatatcgccctgtcttggtccagcgtcgaacataaagggaacaagattctcgtgtctggccgcagcgagtccatcatgaagctggaagagagaaccgggatttcttggtgtcttggcgttgaggacgctagcgaatccaaaacactgaccgtgtctgtcatggatctcagccaaatgtactcccccgtgtttgagtatctgagcggagaccggcaggttgaagagtggccgaaggccacatgcaccggcgattgtcctgaacgctgcgggtgcacgtcttccacctgtctgcacaaagagtggccccatagcagaaattggcggtgcaaccctacatggtgttggggagtgggcaccgggtgcacatgttgcggacttgacgtcaaggatctgttcaccgactacatgctcgtgaaatggaaggtggagtatatcaagacagaagccatcatttgtgtcgagctgacgtcccaggaacgccagtgctctctcatcgaggctggcaccagatttaatctgggccccgttacaattacccttagcgaaccgcggaacgtgcaacagcgcctgcctcccgagatcattaccctccaccctaaaatcgaggaagggttctttgacctgatgcacgtgcagaaggtcatgtccgcctctacagtgtgtaaactgcaaagctgcacgcatggagttcccggcgatcttcaggtgtaccacgtcgggaatctgctcaagggagacaaagtgaacggccattccattcacaagatcgagagccatctgaatacctcttggatgtcctgggatgggtgtgacctcgattatttctgcaacatgggagactggcccagctgcacatacaccggcgttacacagcacaatagagcggcttttatcaacatgctgaatattgaaaccgattatacgaaaacattccacttccattctaagcgggtgaccgcccacggcgacacccctcagcttgatctgaaggcccgcccgacatacggggctggagagatcaccgtcctggtggaagtcgccgacctcgagctgcataccaaaaagattgaggtgtccggccttaaatttgcgagcctgacctgttctgggtgctacgcttgtagctccggaatctcttgcaaggttcggattcacgtgaacgaacccgatgagttcacggtccatgtgaaaagcaacgaccctgatgttgtggccgccggctccagcctcatggctagaaagatcgaatccggggccgactctacatttaaggctttcagctccatgcccaaaaattctctgtgtttttatatcgtcgagagagactactgcagctcctgtaccgatgacgatacacaaaagtgcgtggacattaaactcgagcaccctcagtctatcctgattgaacacaagggaaccatcattggcaaacagaacgatacgtgtcccaccaagacaagctgctggcttgagtccatcaagagcttcttttatggcctgaaaaatatgctgtctgggatcttcggaaacatttttctcggcatgctgcttttcctggccccttttgtgctcctgatcctcttcttctttttcgggtggcgcctgctgttttgtctgaagtgctgccggagaacccgcaaactgctcaagtacaaacatctgcgggacgaagaggaatccggatataagaagattatcgagagacttaatgataaaaagggcaaaagccgcctgttcgacggggagcggctcgcggatagaaagattgccgaactgttttctacaaaaacccacgttggatga

SEQ ID NO: 13543 - RNA, 5100 nt, synthetic construct
  misc_feature 1..5100: note = derived and/or modified CDS sequence (opt5) from CCHFV(UCCR4432)__KY484047.1__GP
  source 1..5100: mol_type = other RNA
atgttctgcctgagactcgtgctgcttatcaacctggccctctgtcagctgcttgagggcaatgacggggtcaccagcgctgatgaaattaactccaatacaacgcaaacctctctgggactccccacaatcctgaacagcaccacccctgccccgggcccctccattgacgcgaccatggaggctgttcctgggacaaccaattctgtgctggaaacacaggtgaccatggatagcggatccggcgagctctctacagaccccaccacaacccgggaagccacgacacctatcaccgccgctacagtcagcgcccaggagaccaagacccacatgacacagaaccccgggacgaccgtggatcctgacacaaccacatccaataccacgacaagcattgagccgatcaccacaccccctacatctcccacccctcaagctacacccacgccgtcctacagcgaaacccctacactgcccaacacccatcacctttctcgctccctgctcagcgccgttggaacagaggcgggccagaccgcccctgctacgcccaccgccgaagtggctctggcccccggcgggtcttccacagcggagagcaataccatctccattcctgcccaggatacaaccatctctggagtcagcaaacaggacaacccgacgacaaccggcatttcccccgaggctcaaacaatgcagagccagcaggccgtggctcctgttaccacccccgccacagccatctctgctcctacgtcccccaccaatagaagcaagcgggaatctaaagtgcaaattatccttacatttccgcaggggctgaagaaatattacagcaagattctcaagttcctgcatctgacccaggaggaagattccgagggactcctggaatggtgcacacgcgtccttcaacaggtgtgtgacgatacctattttaacgagagaatcaaagagttctttatcacgggcaaggggtacttcaatgacgtgctgcagtttaaactccacgatacgcctgcgaccaccgtccccgccctggctgcctctagcacagccatgcctttccggtcctattacgctaagggaagccttaccctggactctggctatttttccgccaaatgctacccccgcgcgagcaactctggcatgcagctcattaatgttacacaacatcctatgaagatcgctaacacgcccgggccgaagatttccaacctgaaaaccatcaattgtattaacctgaaggtgagcacagacaaagaacactccgagctcgaaatcaatgtgctgatccctcaggtcgccgtgaacctttctaattgcttcgttagcattaagtcccacgtgtgtgattactctctggacaccgatggagccatcagactccccaaagtcgctcataacggcgtgtttatgcccgggacatataagattgttatcgacaaaaagaataagctgaacgatcggtgcgcccttattaccaattgtgtgatcaaaggacgcgaggtcagaaagggccagagcacgctgcggcagtacaaaaccgaaatccgcattgggcaaacaatcgctggatccagacggctcctggccgagggcgtgagcaacgactgcgtctctcgcacccagctgattaagacagaggtggcggaaatccacgaggattcctatggcgggcctggagaaaagattaccatctgtaatggcagcacaattgttgaccagagactcgggtctgagctgggatgctacaccatcaaccgggtgaagacgtataaactttgcgaaaattccgccacagagaaaggctgtgagatcgatagcgtcccggtgaagtgcaaacaggggttctgtctgaaggttacccaagaaggcagaggacatgtgaaactctctcgcggcaccgagattgtcctggacgtgtgcgatacaagctgtgaactgatgatccccaaggggaccggagacattcttgtggactgctccggcgggcagcagcactttctccaggataacctgatcgacctgggatgtcctaatgttcccctcctgggcaagatggctatttacatctgccggatgagcaaccaccctaaaacgacaatggccttccttttctggttttctttcgggtatgtcatcacctgtattgtgtgcaaggtgctgttttacctcctgatcgtcattggcacactgtccaaaaagctgaaacaatacagagagctcaagccccagacctgtatcgtgtgcgagagcacacctgttaacgctattgatgccgaaatgcatgagctgaattgcaactataatatctgtccctactgcgcgtcccgcctgacctctgacggactcgtgcggcacgtcaaccagtgtccgaagagaaaagaaaaggtggaggaaacggagctgtatcttaatctggagcgcatcccttggctcgttcggagactgctgcaagtgagcgaatccaccggcatggcccttaaacgctcttgctggatgacaaccctcctgattctgctcgtcgtgagcctgtcccccgttcagtctgctcctgtggggcagggaaaggccgtcgaggtgtaccgggtgagagaaagctatacatccatctgtcttttcgtcctgggcagcgttctctttgctgtgtcttggctgattaaagggctgatcgatggaattggcaactccttctttcccgggcttagcgtgtgcaagacctgttctatcggctccatcaatggattcgagattgaaagccataaatgctactgttctctcttttgctgtccgtattgccgcgcctgctccagcgacaagatcacgcaccggatgcatctgaacgtctgtaagaaaagaaaggccggctccaatgtgatgctggctgtttgcaaacggatgtgtttcaaggcgacagtggaggccagcaacaccgctctcctgattcgcgggatcattaattctacatttgtcatctgcgtgcttattctggttatctgtgtggtcagcacctccgccgtggatatggagaacctccctgccggaatctgggaaagagaggaagacctgaccaatttctgccaccaggagtgtcaagttacagaaacggagtgcctgtgtccctacgaggctcttattctgcggaaacctctctacctggattctatcgccaagggcatgaaaagcctcctgaactccaccaatcttgaaacatctctgagcattgaggcgccctggggcgctatcaacgtgcagtccacctttaagcccacagtctctgccgccaacattgctctcagctggtccagcgtggaacacagaggaaataagatcctggtgtctggccgctccgagagcatcatgaaactggaggaacggaccgggatttcttggtcccttggcgtcgaggacgccagcgaatccaagacgctgacagtttctgtgatggatctcagccagatgtattcccctgtgttcgagtacctgagcggagacagacaggtcgaagagtggccgaaagcgacctgcaccggcgattgtcaagagcgctgcgggtgcacatcttccacctgtctccataaggaatggccccacagcagaaactggcggtgcaatcctacatggtgttggggagtgggcacggggtgcacctgttgcggactggacgttcgcgaccttttcacagattatatgatggtgaagtggaaagtcgagtacgtgaagaccgaagctatcatgtgtgttgagctgacatctcaggaaagacagtgcagcctcattgaggccggcacccggtttaacctgggccccgtgacgatcaccctgtccgagcctcgcaatattcagcaaagacttccctctgaaatcgtcacactgcatcctaaaatcgaggaagggttctttgacctcatgcacgtgcagaaggtcctgagcgcctccaccgtgtgtaaactccagtcttgcacacacggagttccgggcgatctgcaagtgtatcatgtcgggaaccttctgaagggagacaaggtgaatggccacagcattcataaaatcgagtcccacttcaacaccagctggatgtcttgggatgggtgtgacctggattacttttgcaatatgggagactggccctcctgcacatatacgggcgttacccagcataaccgggctgccttcattaatatgctcaacatcgaaacagattacaccaagacctttcacttccacagcaaacgcgtgacagctcatggcgacacgcctcagctggatcttaaggccagacccacctacggggcgggagaggtcacagtgctggtggaggttgccgacctcgaactgcacaccaaaaagattgaggtctccggcctcaaatttgcttctctgacatgtagcgggtgctatgcctgttcctctggaatcagctgcaaggtgcggattcatgtgaatgaacctgatgagttcaccgtccacgtgaagtccagcgaccccgacgttgtggctgccgggtcttcccttatggcccgcaaaatcgagtttggggctgatagcacgttcaaggcgttttcttccatgccgaaaaacagcctgtgtttctacatcgtcgaaagagactattgctctagctgtacaaatgatgacacccagaagtgcgtggataccaaactggagcatcctcaatccattctcatcgaacacaagggaacaattatcggcaagcagaacgacacctgttctacaaaaaccagctgctggctggagtccgttaagagcttcttttacggccttaaaaacatgcttgggggaattttcggcaatgtgtttctcgggatcttcctgtttctcgcccccttcgctctgcttatctttttctttttctttggatggcggctgctgttctgtctcaagtgctgcagacgcacgcggggcctgcttaaatataagcagctgaaggatgaagaggaggccgggtacaaaaagattatcgaaagactcaacgacaaaaagggaaaatcccgcctgttcgatggcgagcggctcgccgacagaaagattgctgaactgttttctacaaagacccacatcggctga

SEQ ID NO: 13544 - RNA, 5100 nt, synthetic construct
  misc_feature 1..5100: note = derived and/or modified CDS sequence (opt5) from CCHFV(Nakiwogo)__KX013484.1__GP
  source 1..5100: mol_type = other RNA
atgttctgcctgaagctcgtgctgcttatcaacctgaccctctgtcagctgcttgagggcaatgacagagtcacaagcgccgatgggattaactccaatacgacccaaacaaacctgggaatctctaccattctcaatagcacaacccccgctcctggcccgtccacagacaccacgatggaaaccgttccctctacagccgatagcatgctggagacccaggtgacaaccgactccgggtctggagaacctagcacggagcccacaaccacaggcgaagcgacctccagcaccacagctgccacggtgtctatgcaggagaccaaaaagcacatgacacagaacacccggtccacagccgatcctgacaccacgacacccaatagcaccacctctgtcgagcctacaaccatcccgcccacatcccctattccccaagctacgcctacccccgggcatggaaaagccccgacactgcctaacacccaccatctcagccgctctctgctttccgctgtgagcacagaagccggccagaccacgcccgcgacctccacaaccgaggccgcttctgcccctagctccagctctacagctgaaaataacaccgtttcccagcccgcccaggatacgacaaccagcggcgtgtctgagcaatacaatcccacaaccaccgggatcagccctaaggcgcagacaatgcagggacagcaagccatcgtcccggtgacgacccccgttacaaccacatttacccctacgaaccccacaaatagatccaaacgggagtctaaggtgcagattatcctgaccttccctcagggcctcaagaaatattacagcaagattctgaaacttctgcacctcacccaagaagaggactccgaagggctgctggagtggtgcacacgcgtcctccaacaggtgtgtgatgacacctattttaacgaaagaatcgaggagttctttattacaggaaagggctacttcaatgatgtgctgcagtttaaacttcatgacacgcccaccacaaccgtcagcgctctggccgcttcttccacagccatgccgttccggagctattacgccaaggggtctctcaccctggattccggatattttagcgctaagtgctaccctcgcgcgtccaactctggcatgcagcttatcaacgttacgcagcaccccatgaaaattgccaatacccctggccccaagacaagcaacctgaaaaccatgaattgtatcaacctcaaggtgtccacagacaaagaacactctgagctggaaatcaatgtgctgattcctcaggtcgctgtgaacctcagcaattgcctggtttccatcaagagccatgtgtgtgactactctcttgataccgacggggccattagactgcccaaagtcgcctataacggagtgttcatgccgggcacatacaagatcgttattgataagaaaaatcggctcaacgaccgctgcgctctgatcaccaattgtgtgatcaaggggagagaggtccggaaaggacagtccacgcttcgccaatataagacagaaattagaatcggccagaccctgatggggagccggcgcctcctggccgagggagtgtctaacgattgcgtctccagaacccagctgattaaaacagaggtggcggaaatccacgaggacagctacggcggccctggggaaaagattaccatctgtaatggatctacgatcgttgatcagcggctcggcagcgagctggggtgctatacaattaacagagtgaagacctacaaactttgcgaaaattccgctacagagaagggatgtgagatcgacagcgtccccgtgaaatgcaagcaaggcttttgtctgaaagttacccaggaagggcgcggccatgtgaagctctctcggggaacagagattgtcctggatgtgtgcgacacctcctgtgaactgatgatccccaagggcacgggggatattcttgtggactgcagcggaggccagcagcacttcctccaagacaacctgatcgatctggggtgtcctaacgttccgctcctgggaaaaatggccatttatatctgcagaatgtccaatcaccccaagaccacaatggcctttcttttctggttctcttttggctacgtcatcacctgtgtggtgtgcaaagtcctgttctacctcctgattgtgatcgggacactgggcaagaaacttaagcagtatcgcgagctcaagcctcagacctgtattgtttgcgagagcatccccgtgaacgtcattgacgctgaaatgcatgagctgaattgcaactacaatatctgtccttattgcgcctcccggctgacgtctgatggactcgtgagacacgttacacaatgtcccaaacgcaaggaaaaagtggaggaaaccgagctgtaccttaacctggagcggatcccttggctcgtcagacgcctgctccaggtgagcgaatccacaggcatggctcttaagcggtcttgctggatgaccaccctcctgattctgctcgttgtgagcctgtcccccgtccagagcgccccggtggggcaggagaaagcgatcgaagtgtatcaagtcagagagtcttacacatccatgtgtctttttgttctgggaagcgtgctgttcgccgtgtcttggctggtcaagggcctgattgacgggatcggaaattcctttttccctggccttagcgtgtgcaaaacgtgttctattgggtccatcaacggctttgaaatcgagagccataagtgctattgttccctcttctgctgtccctactgccgcgcttgcagctctgataagattacccaccggatgcatctgaatatctgtaaaagacggaaggttggaagcaacgtgatgctggccgtctgcaaacgcatgtgttttaaggctacagtggaggcctccaattctgcgctcctgattagaagcatcattaactccaccttcgttatctgcgtgcttatcctggtcatttgtgtggtttctacaagcgccgtggacatggaaaatctccctgctggcatctgggagcgggaagaggatctgaccaacttttgccaccaggaatgtcaggtcacggagacagagtgcctgtgtccctacgaagcccttattctgagaaaaccgctctatctggactccatcgctaaggggatgaagtctctcctgaatagcaccaaccttgagacctccctgagcattgaagccccttggggagccatcaacgtgcagtctacattcaaacccaccgtgtccgctgcgaatattgccctcagctggtcttccgtcgagcaccgcggcaacaagatcctggttagcgggcggtccgagtctatcatgaaactggaagagagaacaggaattagctggtcccttggcgtggaagatgctagcgagtctaagacgctgaccgtgtccgtcatggacctcagccaaatgtactctcctgtgtttgaatatctgagcggggatcgccaggttgaggagtggcccaaagccacatgcaccggcgactgtcccgaaagatgcggatgcacatcctctacctgtctccataaggagtggcctcacagccggaattggcgctgcaacccgacgtggtgttggggcgtggggaccggatgcacatgttgcggcctggatgtcagagaccttttcaccgactacatgatggtgaagtggaaagttgaatatgtgaagacagaggccatcatgtgtgtcgaactgacctcccaggagcggcagtgctctctcattgaggctgggacacgcttcaatctgggacccgtgacgatcaccctgagcgaacctagaaacgtccaacagcggcttccctccgagattgtgacactgcatcctaaaatcgaagagggctttttcgatctcatgcacgttcagaaggtgctgttttgtaaacacagcctccaagccacctcttgcacccatggcgtccccggggaccttcaggtgtaccacgttggaaatctgctgaagggcgataaggtgaacgggcattccatccacaaaattgaaagccatttcaatacatcctggatgtcttgggacggatgtgatctggactatttttgcaacatgggcgattggcctagctgcacgtacaccggggtcacacagcacaatcgcgcggctttcgtgaacatgctcaatatcgagaccgactacacaaagacctttcacttccattccaaaagagtgacggcccacggagatacaccgcagctggaccttaaggcccggcccacctatggcgctggcgaggttaccgtcctggtggaagtggccgatctcgagctgcataccaaaaagattgaagtctctgggctcaaatttgcgagcctgacatgttccggatgctacgcttgtagctctggcatctcctgcaaggtgcgcattcacgttaacgagcctgacgagttcacagtgcatgtcaagagcaatgatcccgacgtggttgccgccgggtcttcccttatggctagaaaaatcgaactgggagccgacagcacctttaaggctttctctagcatgcctaaaaactccctgtgtttttatatcgtggagcgggattactgctctagctgtacggacgatgacacacaaaagtgcgtcaacaccaaactcgaacacccccagtccattctgatcgagcacaagggcacaattatcgggaagcagaatgatacctgtccgacgaaaaccagctgctggcttgaatccgtgaagtctttcttctatggactgaaaaacatgctcggcggcatttttgggaatgttttcctgggaatctttctcttcctggccccttttgcgcttctgattctgttctttttctttggctggagactcctgttctgtcttaagtgctgccgccggacaagagggctgctcaaatacaagcagctgaaggacgaggaggaagccggatataaaaagatcatcgagcgcctcaacgataaaaagggcaaaagccggctgtttgacggggaaagacttgctgatcgcaagattgccgagctgttctccaccaagacacatatcggatga

SEQ ID NO: 13545 - RNA, 5100 nt, synthetic construct
  misc_feature 1..5100: note = derived and/or modified CDS sequence (opt5) from CCHFV(UG3010)__AY900143.1__GP
  source 1..5100: mol_type = other RNA
atgttctgcctgagactcgtgctgcttatcaacctggccctctgtcagctgcttgagggcaatgacggggtcaccagcgctgatgaaattaactccaatacaacgcaaacctctctgggactccccacaatcctgaacagcaccacccctgccccgggcccctccattgacgcgaccatggaggctgttcctgggacaaccaattctgtgctggaaacacaggtgaccatggatagcggatccggcgagctctctacagaccccaccacaacccgggaagccacgacacctatcaccgccgctacagtcagcgcccaggagaccaagacccacatgacacagaaccccgggacgaccgtggatcctgacacaaccacatccaataccacgacaagcattgagccgatcaccacaccccctacatctcccacccctcaagctacacccacgccgtcctacagcgaaacccctacactgcccaacacccatcacctttctcgctccctgctcagcgccgttggaacagaggcgggccagaccgcccctgctacgcccaccgccgaagtggctctggcccccggcgggtcttccacagcggagagcaataccatctccattcctgcccaggatacaaccatctctggagtcagcaaacaggacaacccgacgacaaccggcatttcccccgaggctcaaacaatgcagagccagcaggccgtggctcctgttaccacccccgccacagccatctctgctcctacgtcccccaccaatagaagcaagcgggaatctaaagtgcaaattatccttacatttccgcaggggctgaagaaatattacagcaagattctcaagttcctgcatctgacccaggaggaagattccgagggactcctggaatggtgcacacgcgtccttcaacaggtgtgtgacgatacctattttaacgagagaatcaaagagttctttatcacgggcaaggggtacttcaatgacgtgctgcagtttaaactccacgatacgcctgcgaccaccgtccccgccctggctgcctctagcacagccattcctttccggtcctattacgctaagggaagccttaccctggactctggctatttttccgccaaatgctacccccgcgcgagcaactctggcatgcagctcatcaatgttacacaacatcctatgaagattgctaacacgcccgggccgaagatctccaacctgaaaaccattaattgtatcaacctgaaggtgagcacagacaaagaacactccgagctcgaaatcaatgtgctgattcctcaggtcgccgtgaacctttctaattgcttcgttagcatcaagtcccacgtgtgtgattactctctggacaccgatggagccattagactccccaaagtcgctcataacggcgtgtttatgcccgggacatataagatcgttattgacaaaaagaataagctgaacgatcggtgcgcccttatcaccaattgtgtgatcaaaggacgcgaggtcagaaagggccagagcacgctgcggcagtacaaaaccgaaattcgcatcgggcaaacaattgctggatccagacggctcctggccgagggcgtgagcaacgactgcgtctctcgcacccagctgatcaagacagaggtggcggaaattcacgaggattcctatggcgggcctggagaaaagatcaccatttgtaatggcagcacaatcgttgaccagagactcgggtctgagctgggatgctacaccatcaaccgggtgaagacgtataaactttgcgaaaattccgccacagagaaaggctgtgagattgatagcgtcccggtgaagtgcaaacaggggttctgtctgaaggttacccaagaaggcagaggacatgtgaaactctctcgcggcaccgagatcgtcctggacgtgtgcgatacaagctgtgaactgatgattcccaaggggaccggagacatccttgtggactgctccggcgggcagcagcactttctccaggataacctgattgacctgggatgtcctaatgttcccctcctgggcaagatggctatctacatctgccggatgagcaaccaccctaaaacgacaatggccttccttttctggttttctttcgggtatgtcattacctgtatcgtgtgcaaggtgctgttttacctcctgattgtcatcggcacactgtccaaaaagctgaaacaatacagagagctcaagccccagacctgtattgtgtgcgagagcacacctgttaacgctatcgatgccgaaatgcatgagctgaattgcaactataatatctgtccctactgcgcgtcccgcctgacctctgacggactcgtgcggcacgtcaaccagtgtccgaagagaaaagaaaaggtggaggaaacggagctgtatcttaatctggagcgcattccttggctcgttcggagactgctgcaagtgagcgaatccaccggcatggcccttaaacgctcttgctggatgacaaccctcctgatcctgctcgtcgtgagcctgtcccccgttcagtctgctcctgtggggcagggaaaggccgtcgaggtgtaccgggtgagagaaagctatacatccatttgtcttttcgtcctgggcagcgttctctttgctgtgtcttggctgatcaaagggctgattgatggaatcggcaactccttctttcccgggcttagcgtgtgcaagacctgttctatcggctccattaatggattcgagatcgaaagccataaatgctactgttctctcttttgctgtccgtattgccgcgcctgctccagcgacaagattacgcaccggatgcatctgaacgtctgtaagaaaagaaaggccggctccaatgtgatgctggctgtttgcaaacggatgtgtttcaaggcgacagtggaggccagcaacaccgctctcctgatccgcgggattatcaattctacatttgtcatttgcgtgcttatcctggttatctgtgtggtcagcacctccgccgtggatatggagaacctccctgccggaatttgggaaagagaggaagacctgaccaatttctgccaccaggagtgtcaagttacagaaacggagtgcctgtgtccctacgaggctcttatcctgcggaaacctctctacctggattctattgccaagggcatgaaaagcctcctgaactccaccaatcttgaaacatctctgagcatcgaggcgccctggggcgctattaacgtgcagtccacctttaagcccacagtctctgccgccaacatcgctctcagctggtccagcgtggaacacagaggaaataagatcctggtgtctggccgctccgagagcattatgaaactggaggaacggaccgggatctcttggtcccttggcgtcgaggacgccagcgaatccaagacgctgacagtttctgtgatggatctcagccagatgtattcccctgtgttcgagtacctgagcggagacagacaggtcgaagagtggccgaaagcgacctgcaccggcgattgtcaagagcgctgcgggtgcacatcttccacctgtctccataaggaatggccccacagcagaaactggcggtgcaatcctacatggtgttggggagtgggcacggggtgcacctgttgcggactggacgttcgcgaccttttcacagattatatgatggtgaagtggaaagtcgagtacgtgaagaccgaagctattatgtgtgttgagctgacatctcaggaaagacagtgcagcctcatcgaggccggcacccggtttaacctgggccccgtgacgattaccctgtccgagcctcgcaatatccagcaaagacttccctctgaaatcgtcacactgcatcctaaaattgaggaagggttctttgacctcatgcacgtgcagaaggtcctgagcgcctccaccgtgtgtaaactccagtcttgcacacacggagttccgggcgatctgcaagtgtatcatgtcgggaaccttctgaagggagacaaggtgaatggccacagcatccataaaattgagtcccacttcaacaccagctggatgtcttgggatgggtgtgacctggattacttttgcaatatgggagactggccctcctgcacatatacgggcgttacccagcataaccgggctgccttcatcaatatgctcaacattgaaacagattacaccaagacctttcacttccacagcaaacgcgtgacagctcatggcgacacgcctcagctggatcttaaggccagacccacctacggggcgggagaggtcacagtgctggtggaggttgccgacctcgaactgcacaccaaaaagatcgaggtctccggcctcaaatttgcttctctgacatgtagcgggtgctatgcctgttcctctggaattagctgcaaggtgcggatccatgtgaatgaacctgatgagttcaccgtccacgtgaagtccagcgaccccgacgttgtggctgccgggtcttcccttatggcccgcaaaatcgagtttggggctgatagcacgttcaaggcgttttcttccatgccgaaaaacagcctgtgtttctacattgtcgaaagagactattgctctagctgtacaaatgatgacacccagaagtgcgtggataccaaactggagcatcctcaatccatcctcattgaacacaagggaacaatcattggcaagcagaacgacacctgttctacaaaaaccagctgctggctggagtccgttaagagcttcttttacggccttaaaaacatgcttgggggaatcttcggcaatgtgtttctcgggatcttcctgtttctcgcccccttcgctctgcttatctttttctttttctttggatggcggctgctgttctgtctcaagtgctgcagacgcacgcggggcctgcttaaatataagcagctgaaggatgaagaggaggccgggtacaaaaagattattgaaagactcaacgacaaaaagggaaaatcccgcctgttcgatggcgagcggctcgccgacagaaagatcgctgaactgttttctacaaagacccacattggctga

SEQ ID NO: 13546 - RNA, 5100 nt, synthetic construct
  misc_feature 1..5100: note = derived and/or modified CDS sequence (opt5) from CCHFV(Semunya)__DQ094832.1__GP
  source 1..5100: mol_type = other RNA
atgttctgcctgaagctcgtgctgcttatcaacctggccctctgtcagctgcttgagggcaatgacagagtcaccagcgctgatgggattaactccaatacaacgcaaaccaacctgggaatctctacaattctcaatagcaccacacccgcccctggcccgtccaccgacacaaccatggaaacggttccctctaccgcggatagcatgctggagacacaggtgaccacagactccgggtctggagaacctagcaccgagcccacgacaaccggcgaagctacatccagcaccaccgccgccacagtgtctatgcaggagacgaaaacccacatgacacagaacacccggtccacagctgatcctgacaccacgacacccaataccaccacaagcgtcgagcctaccacaatcccgcccacgtctcctattctgcaagccacccccacacctgggcatggaaaggctcccaccctcccgaacacacaccatctgtcccgcagccttctgtctgccgtgtccaccgaagcgggccagacgacccctgccacaagcaccacagaggctgcctccgctccctctagctccagcaccgccgaaaataacacgatgtttcagcctgcgcaggatacaaccacatctggcgtttccgagcaatacaatcccaccaccacagggatcagccccaaagcccagacgatgcaggctcagcaagccatcgtgcctgtcaccacaccggtgaccacaaccttcacgcccattaaccctacaaatagatctaagcgggagagcaaagttcagatcattctcacctttccccagggactgaagaagtattactccaaaatccttaagctgctccacctgacccaagaagaggactctgaaggcctgctcgagtggtgcacacgcgtgctgcagcaggtctgtgatgacacctatttcaacgaaagaattgaggagtttttcatcacagggaaaggatactttaatgatgtgcttcagttcaagctgcatgacacgcctaccacaaccgtgcccgctctcgccgccagctccacagctatgccgtttcggagctattacgcgaaaggctctctgacccttgattccgggtatttcagcgccaagtgctaccctcgcgcttctaactccggaatgcaactgattaacgtcacgcagcaccccatgaagatcgccaatacccctggccccaaaacaagcaacctcaagaccatgaattgtatcaacctgaaagtttccacagacaaggaacactctgagctggaaattaatgtgctcatccctcaggtggccgtcaacctgagcaattgccttgtgtccattaaatctcatgtttgtgactacagcctggataccgacggcgctatcagactccccaaggtggcctataacggggtctttatgccgggaacatacaaaattgtgatcgataagaagaatcggctgaacgaccgctgcgcgcttatcaccaattgtgttattaaaggcagagaggtgcggaaggggcagtccacgctgcgccaatataaaacagaaatcagaattggacagaccctcatgggcagccggcgcctgctggctgagggggtctctaacgattgcgtgtccagaacccagctcatcaagacagaggtcgccgaaattcacgaggacagctacggaggccctggcgagaaaatcaccatctgtaatgggtctacgattgtggatcagcggctgggatccgaacttggctgctatacaatcaacagagttaagacctacaagctgtgcgaaaatagcgccacagagaaagggtgtgagattgactctgtgcccgtcaagtgcaaacaaggattctgtctcaaggtgacccaggaaggccgcgggcatgttaaactgagccggggcacagagatcgtgctggatgtctgcgacacctcctgtgaacttatgattcccaagggaacgggcgatatcctcgtggactgcagcgggggacagcagcactttctgcaagacaacctgattgatctcggctgtcctaacgtgccgctgcttgggaagatggctatctatatctgcagaatgtctaatcaccccaaaaccacaatggccttcctgttctggttttccttcggatacgttattacctgtgtcgtgtgcaaggtgctcttttacctgctgatcgtcattggcacacttgggaaaaagctcaaacagtatcgcgagctgaagcctcagacctgtatcgtgtgcgagagcattcccgttaacgctatcgacgccgaaatgcatgagctgaattgcaactacaatatctgtccttattgcgcgtcccggctcacgtctgatggcctggtgagacacgtcacacaatgtcccaagcgcaaagaaaaggtggaggaaaccgagctttacctgaacctcgagcggattccttggctggttagacgcctgcttcaggtgagcgaatccacaggaatggccctcaaacggtcttgctggatgaccaccctgctgatcctcctggtcgtgagcctttcccccgttcagtctgctccggtgggccaggagaaggccattgaagtctatcaagtgagagagagctacacatccatctgtctgttcgtgctcgggagcgtcctgtttgctgtttcttggctggtgaaaggacttattgacggcatcggcaattccttctttcctggactcagcgtgtgcaagacgtgttctatcggctccattaacgggttcgaaatcgagagccataaatgctattgttctctgttttgctgtccctactgccgcgcctgctccagcgataagattacccaccggatgcatctgaatatctgtaagagacggaaagtcggctccaacgtgatgctcgcggtttgcaagcgcatgtgtttcaaagccacagtggaggctagcaattctgccctgcttattagaagcatcatcaactccacctttgtcatttgcgtgctgatcctcgttatttgtgtggtctctacaagcgctgtggacatggaaaatctgcctgccggaatctgggagcgggaagaggatctgaccaacttctgccaccaggaatgtcaggttacggagacagagtgcctttgtccctacgaagccctgattctcagaaagccgctgtttctcgactccatcgctaaaggcaagaagtctctgcttaatagcaccaacctggagacctccctctctattgaagcgccttggggagccatcaacgtgcagagcacattcaaacccaccgtctccgctgccaatatcgccctgagctggtcttccgtggagcaccgcgggaacaagattctggtgagcggccggtctgagtccatcatgaaacttgaagagagaacagggattagctggtccctgggagtcgaagatgcttctgagagcaagacgctcaccgtttccgtgatggacctgagccaaatgtattctcctgtgttcgaatacctctccggcgatcgccaggtcgaggagtggcccaaagccacatgcaccggggactgtcccgaaagatgcggctgcacaagctctacctgtctgcataaggagtggcctcacagccggaattggcgctgcaacccgacgtggtgttggggagtgggcaccgggtgcacatgttgcggacttgatgttagagacctgtttaccgactatatgatggtgaagtggaaagtcgaatacgtgaagacagaggcgatcatgtgtgttgaactcacctcccaggagcggcagtgctctctgattgaggctggcacacgcttcaatctggggcccgtgacgatcacccttagcgaacctagaaacgtccaacagcggctgccctccgagatcgtgacactccatcctaaaattgaagagggatttttcgatctgatgcacgtccagaaggtgctcttttgtaaatattctctgcaagccaccagctgcacccacggcgttcccggcgaccttcaggtgtaccatgtcgggaatctgctgaagggagataaggtgaacggccactccatccataaaattgaaagccacttcaatacatcttggatgtcctgggacgggtgtgatctcgactatttttgcaacatgggagattggcctagctgcacgtacaccggcgttacacagcataatcgcgccgctttcgtgaacatgctgaatatcgagaccgactacacaaagacctttcacttccactccaaaagagtcacggcccatggggatacaccgcagcttgacctgaaggcgcggcccacctatggagctggcgaggtgaccgtgctcgttgaagtcgccgatctggagctccacaccaaaaagattgaagtgtctggcctgaaatttgccagccttacatgttccgggtgctacgcttgttctagcggaatctcctgcaaggtgcgcatccatgtcaacgagcctgacgagttcacagtgcacgttaagagcaatgatcccgacgtggtcgccgctgggtcttccctgatggccagaaaaattgaatttggggcggacagcaccttcaaggccttctcttccatgcctaaaaacagcctgtgtttttatatcgtggagcgggattactgctctagctgtacggacgatgacacacaaaagtgcgttaacattaaactcgaacatccccagtccatcctgattgagcacaagggaaccatcattggcaagcagaatgatacatgtccgaccaaaacgtcttgctggcttgaaagcgtgaagtccttcttttatgggctgaaaaacatgctcggaggcatcttcggcaatgtctttctggggatcttcctctttctggctcctttcgcccttctgattctgtttttctttttcggatggagactcctgttctgtcttaagtgctgccgccggaccagaggcctgctcaaatacaagcagctgaaggacgaggaggaagctgggtataaaaagatcattgagcgcctcaacgataaaaagggaaaaagccggctgtttgacggcgaaagacttgccgatcgcaagatcgccaagctgttctccacaaaaacccacattgggtga

SEQ ID NO: 13547 - RNA, 5094 nt, synthetic construct
  misc_feature 1..5094: note = derived and/or modified CDS sequence (opt5) from CCHFV(79121)__AB069673.1__GP
  source 1..5094: mol_type = other RNA
atgctgttccactttaagttcatgctcctcatcaactttattctttgccatctgctctggggcgggggaggcgtgaccgggggagtggagaccaatagcagctctacgcaggccatccaaacaccccctgttacaagcaacagcaccaccccgggcccctctaccgacacagctaccgaaacggccagctccatgaccacatctacccctgacacacaggtgaccacggacaatgggagcggagagccctccacagatcctctgaccacaaacgaagcgacaccccctcttagcgtgaccacagctcagacgaccgagaccaagaagcacaccacactggacccgtctacctccacgaatcccgatgccacaacccctagcattaccatcctctctgcctccaacacaagcctgcccatttcttccgtccatgctagcccttccccctctagctccgaggaaccgacccctcagaatgcccaccatctgagcagatctctcctgtccgctgtgagcacagagacgggccaaatcgcctctgcggccaccgctgccaaagaaatcacaaccaagaactctccccctacagctggcaatgacaccatggttacgtccgcccccaacgggaatattcggaacacccccgagcaggcgaatcctacagccccggaggcttcccccaaaatccagaccacacagaaccaacagaccgtgacgcctgaggccacacccattaccacaatcaccgctcttaccgatctgacaaatcgcagcaagagagactccaaggtccagaaaattctcacgttcagccagggactgaagaaatactattctaagatccttaaactgctccaactgacccaggaggaagattccgagggcctgctcgaatggtgtacacgggtgctggagcaggcctgcgacgatgactactttaacaagcgcattgaagagttctttatcaccgggaagggatatttcaacgatgttcttcaatttagactgcacgacgccctcagcaatacagagcctgctcagaccacgtctcccacagcggtgccgttcaaatcctactatgccaagggcagcctgacctttgactccgggtacttctctgctcggtgttatcctcgcgccagcaactccggacttcagctgatcaatgtcacccagcaccccgtgaaaattgccaacacacctggccccaagctctctaatctgaaaaccatcaactgcattaatctgaaggtgagcacagataaagaacattccgagctcgaagtcaacgttctgcttcctcaagtggctgtgaatctgagcaactgtcacgtctctatcaagtcccatgtgtgcgactacagcctcgatacggacggcgccattaagctgcccagagttgcgcacaatggggtgtttatcccgggaacctacaaaatcgtcattgataagaaaaacaatcttaacgaccggtgtacactgatcaccaattgcgtgattaagggccgcgaggttagaaaagggcagtctgctctccggcagtataagacagaaatccgcattggacagaccttcacgggctccagacggctgctggccgaaggcgggagctctgattgtatcagccgcacccaactcgtgaagacagaggtcgccgaaatccacgaggactcctacgggggccctggggagaaaatcaccatctgcaacggaagcacaattgtggatcagggcctggggtctgagcttggatgttataccatcaacagagtccggtcctacaagctgtgcgaaaatagcgcttccggcaaatcttgcgagattgacagcatccccgtgaagtgtaaacaggggttctgcctcaagattacacaggagggcagaggacatgttaagctgtcccgcggcaccgaaatcgtgctggatgtctgtgactctagctgcgagcttatgatccccaaagggacgggagacattctcgtggattgttccggcgggcaacagcactttctgcagaacaatctgatcgacctcggatgccctaacgttccgctgcttggcaagatggccatttatgtgtgtcggatgtctaatcatcccaaaacaaccatggctttcctgttttggttcagctttgggtacgtcattacctgcattgcctgtagagtcctcttctatctgctgatcgcgatcggcacagtgggaaagaaacttaagcagtaccgcgaactcaagcctcaaacctgcattgtttgtgagtccgtccccgtgaacgccatcgatgctgagatgcacgaactgaattgcagctacaacatttgcccttattgtgcctctcggctgtccacggacggcctcatcagacatgtgacacagtgccccaaacgccgggagaaggtcgaagagaccgaactgtttcttaatctggagcggattccttggctcgtgcgcaaactgctgcaggttagcgagtctacagggatggctcttaagcggtcctgttggatgatcaccctcctgatcctgctcctggtgagcatttctcccgtccaatccgccccggtgggaaaagaaagagcgatcgagacataccaggcccgcgaaacctatacgggcatttgccttttcgttctggggagcgtgctctttgctgtctcctggctgaccaaggccctgatcgatggaattggcaacagcttctctcctgggcttagcgtgtgtaaaacatgctccatcggctctatcaatggatttgagattgaaagccacaagtgttactgctccctcttctgttgcccctattgtcgggcttgctctagcgacaagaacacccacagaatgcatctgaatgtttgcaaaaagcggaaaatgggctccaacgtgatgctggccgtctgtaagcgcatgtgctttagagccacaatcgaggcttctaataaagcgctcctgattcggagcatcattaactccaccttcgtgatctgtattcttatcctgacgatctgcgtggtcagcacatctgccgttgatatggagaacctccctgctgggatttgggaaaaggaggaagacctgaccaatttctgtcaccaggagtgccaggtgacagaaaccgagtgtctgtgcccctacgaggccatggtgcttagaaagccgctgtttctcgattccaccgccaaaggaatgaaaagcctgctcaactctacatccctggaaacgagcctttccatcgaggctccttggggcgccattaatgtccaatctaccttcaaacccacagtgagcgcggctaacatcgccctgtcctggagctctgttgaacatcgcgggaataagattctcgtgtccggacggagcgagtctatcatgaaactggaggaaagaaccggcgtcagctggaacctgggggtggaggacgcctccgaatctaagacacttaccgttagcgtgatggatctgtcccagatgtattctcctgtctttgagtacctcagcggcgaccgccaggtggaagagtggcccaaggctacgtgtacaggagattgccccgagagatgtggctgcacctcctctacctgcctgcacaaagaatggcctcactcccggaattggcgctgtaacccgacatggtgctggggagttggaaccggctgtacatgctgtgggctcgacgtgaaggacttctttacggattacatgctggtcaaatggaaggtggagtatatcaaaaccgaagccattgtgtgcgtcgagcttacatcccaggaaagacaatgtagcctgatcgaggcgggaacccggttcaatctcggccccgttacaattaccctgtccgagcctcgcaacgtgcagcagagactgccccctgaaatcgtgacgcttcatcccaagattgaggaaggctttttcgacctgatgcacgtccagaagatcctctctgctagcaccgtgtgcaaactgcaatcctgtacacatggggttcctggagattttcagatctaccacgtgggcaatctcctgagaggggacaaggtcaacggacattctattcacaaaatcgagccgcacttcaataccagctggatgtcctgggatggctgcgaccttgattatttttgtaacatgggggactggcccagctgcacatacaccggagtgacacagcataatcgcgccgccttcattaacatgctgaacatcgaaacggattataccaagacatttcacttccattctaaaagagttaccgctcacggcgacacccctcaactggatctcaaggcccggcccgcttacggcgccggggaggtgacagtcctggtggaggtcgcggaccttgaactgcatacgaaaaatctcgaggtgtccggactgaagattgccagcctgacctgctctggctgttatgcttgctccagcgggatctcttgtaaggttcgcattcacgtgaacgaacctgatgagttcacagtccacgtgagaagctccgaccccgacgttgtggccgctggatctagcctgatggcccggaaaatcgagtttggcgccgattccaccttcaaggcttttagctccatgccgaaagactctctttgcttctacatcgtcgaaaaggattactgtagctcctgcacagacgatgacacccagaaatgtgtgaatacgaagctggatcatcctcagtctattctgatcgagcacaaggggacaattatcggaaaacagaacgatacctgcagcaccaagacatcctgttggctcgaatctgtgaaaggctttttctatggcctgaagaatatgcttagcgggatttttggaaacgttttcctgggcatctttctcttcctggcgccctttgtcctcctgatcttcttctttttctttgggtggagacttctgttctgcctgaaatgttgccgccggaccagaggactcctgaagtacaagcatcttaaagatgaggaagaggccggctataagaaaattatcgagcgcctgaatgggaagaaaggaaagtcccaactctttgacggcgaacggctggctgatagaaagattgccgaactcttcagcacaaaaatccacattggctga

SEQ ID NO: 13548 - RNA, 5094 nt, synthetic construct
  misc_feature 1..5094: note = derived and/or modified CDS sequence (opt5) from CCHFV(7001)__AB069670.1__GP
  source 1..5094: mol_type = other RNA
atgctgttccactttaagttcatgctcctgatcaactttattctttgccatctgctctggggcgggggaggcgtgaccgggggagtcgagacaaatagctcctctacgcaggccatccaaacaccccctgttacaagcaactccaccacaccgggcccctctaccgacacagctaccgaaacggccagctccatgaccacatctacccctgatacacaggtgaccacggacaatgggagcggagagccctccacagatcctctgaccacaaacgaagcgacaccccctcttagcgtgaccaccgctcagacgaccgagaccaaaaagcacaccacactggacccgtctacctccacgaatcccgatgccacaacccctagcattaccatcctctctgcctccaacacaagcctgcccatttcttccgtccatgctagcccttccccctctagctccgaggagccgacccctcagaatgcccaccatctgagcagatctctcctgtccgctgtgagcacagagacgggccaaatcgcctctgcggccaccgctgccaaagaaatcacaaccaagaacagccctcccacagctggcaatgacaccatggttacgtccgcccccaacgggaatattcggaacacccccgagcaggcgaatcctacagccccggaagctagccccaaaatccagaccacacagaaccaacagaccgtgacgcctgaggccacacccattaccacaatcaccgctcttaccgatctgacaaatcgcagcaagagagactccaaggtccagattatcctcacgttcagccagggactgaaaaagtactattctaaaattcttaagctgctccaactgacccaggaggaagattccgagggcctgctcgaatggtgtacacgggtgctggagcaggcctgcgacgatgactactttaacaaacgcatcgaagagttctttatcaccgggaagggatatttcaacgatgttcttcaatttagactgcacgacgccctcagcaatacagagcctgctcagaccacgtctcccacagcggtgccgttcaagtcctactatgccaaaggcagcctgacctttgactccgggtacttctctgctcggtgttatcctcgcgccagcaactccggacttcagctgattaatgtcacccagcaccccgtgaagatcgccaacacacctggccccaaactctctaatctgaagaccattaactgcatcaatctgaaagtgagcacagataaggaacattccgagctcgaagtcaacgttctgcttcctcaagtggctgtgaatctgagcaactgtcacgtctctattaaatcccatgtgtgcgactacagcctcgatacggacggcgccatcaagctgcccagagttgcgcacaatggggtgtttatcccgggaacctacaagattgtcatcgataaaaagaacaatcttaacgaccggtgtacactgattaccaattgcgtgatcaaaggccgcgaggttagaaaggggcagtctgctctccggcagtataaaacagaaattcgcatcggacagaccttcacgggctccagacggctgctggccgaagggggaagctctgattgtatcagccgcacccaactcgtgaagacagaggtcgccgaaattcacgaggactcctacggcggccctggggaaaagatcaccatttgcaacggaagcacaatcgtggatcagagactgggctctgagcttgggtgttataccattaaccgggtcagatcctacaaactgtgcgaaaatagcgcttccggaaagtcttgcgagatcgacagcattcccgtgaaatgtaagcagggcttctgcctcaaaatcacacaggaggggcgcggccatgttaagctgtcccggggaaccgaaatcgtgctggatgtctgtgactctagctgcgagcttatgattcccaagggcacgggggacatcctcgtggattgttccggaggccaacagcactttctgcagaacaatctgattgacctcgggtgccctaacgttccgctgcttggaaaaatggccatctatgtgtgtagaatgtctaatcatcccaagacaaccatggctttcctgttttggttcagctttggctacgtcattacctgcatcgcctgtcgcgtgcttttctatctgctgatcgcgattgggacagtgggcaaaaagctcaaacagtaccgggaactcaagcctcaaacctgcatcgtttgtgagtccgtccccgtgaacgccattgatgctgagatgcacgaactgaattgcagctacaacatctgcccttattgtgcctctagactgtccacggacggactcattcgccatgtgacacagtgccccaagcggagagagaaagtcgaagagaccgaactgtttcttaatctggagcgcatcccttggctcgtgcggaagctgctgcaggttagcgagtctacaggcatggctcttaaaagatcctgttggatgatcaccctcctgattctgctcctggtgagcatctctcccgtccaatccgccccggtggggaaggaacgcgcgattgagacataccaggcccgggaaacctatacgggaatctgccttttcgttctgggcagcgtgctctttgctgtctcctggctgaccaaagccctgattgatgggatcggaaacagcttctttcctggcctttctgtgtgtaagacatgcagcatcgggtccattaatggcttcgagatcgaatctcacaaatgttactgcagcctcttttgttgcccctattgtagagcttgctcctctgacaagaacacccaccggatgcatctgaatgtttgcaagaaacgcaagatgggaagcaacgtgatgctggccgtctgtaaaagaatgtgcttccgggccacaattgaggcttccaataaggcgctcctgatcagatctattatcaacagcaccttcgtgatttgtatccttatcctgacgatttgcgtggtctccacaagcgccgttgatatggagaacctccctgctggcatctgggaaaaagaggaagacctgaccaatttttgtcaccaggagtgccaggtgacagaaaccgagtgtctgtgcccctacgaggccatggtgcttcgcaagccgctgttcctcgataacattgccaaggggatgaaatctctgctcaattccaccagcctggaaacatctctttccatcgaggctccttggggagccattaacgtccaaagcacgtttaagcccaccgtgtccgcggctaatatcgccctgtcttggagctccgttgaacatcggggcaacaaaatcctcgtgagcgggagatctgagtccattatgaagctggaggaacgcacaggagtcagctggaatctgggcgtggaggacgcctctgaaagcaaaacccttacagtttccgtgatggatctgtctcagatgtatagccctgtcttcgagtacctctccggggacagacaggtggaagagtggcccaaggctacctgtacgggcgattgccccgagcggtgtggatgcacatcttctacctgcctgcacaaggaatggcctcactcccgcaactggagatgtaatccgacctggtgctggggcgttgggacaggatgtacctgctgtggcctcgacgtgaaagactttttcacagattacatgctggtcaagtggaaagtggagtatatcaagacggaagccattgtgtgcgtcgagcttaccagccaggaacggcaatgttctctgatcgaggcggggacacgctttaacctcggacccgttaccattacactgtccgagcctagaaatgtgcagcagcggctgccccctgaaatcgtgacccttcatcccaaaatcgaggaaggcttctttgacctgatgcacgtccagaagattctcagcgcttccacggtgtgcaagctgcaatcttgtacccatggcgttcctggggatttccaggtgtaccacgtcggaaacctcctgcgcggcgacaaagtgaatgggcatagcatccacaagattgagccgcactttaacacatcctggatgtcttgggatggatgcgaccttgattatttctgtaatatgggcgactggcccagctgcacctacacaggggttacccagcataacagagccgcctttatcaacatgctgaatattgaaacagattatacgaaaaccttccacttccattccaagcgggtgacagctcacggagacacccctcaactggatctcaaagcccgccccgcttacggcgccggcgaggtcaccgtgctggtcgaggtggcggaccttgaactgcatacaaagaaactcgaggttagcgggctgaagatcgcctctctcacgtgctccggatgttatgcttgcagctctggcatttcctgtaaggtgagaatccacgtcaacgaacctgatgagtttaccgtgcacgttcggagctctgaccccgacgtggtcgccgctgggagctccctgatggccagaaaaatcgagttcggagccgattctacatttaaggctttcagctccatgccgaaagacagcctttgcttttacattgtggaaaaggattactgttcctcttgcaccgacgatgacacacagaaatgtgtgaataccaagctggatcatcctcagagcatcctgattgagcacaagggcacgatcattgggaaacagaacgacacatgctccaccaagacctcttgttggctcgaaagcgttaaaggattcttttatggcctgaagaatatgctttccggcatcttcgggaacgtctttctgggaatcttcctctttctggcgcccttcgtgctcctgattttctttttctttttcggctggcgccttctgttttgcctgaaatgttgccggagaacacgcgggctcctgaagtacaagcatcttaaagatgaggaagaggccggatataagaaaatcattgagcggctgaatggcaagaaagggaagtctcaactcttcgacggagaaagactggctgatcgcaagatcgccgagctctttagcaccaaaattcacatcggctga

SEQ ID NO: 13549 - RNA, 5094 nt, synthetic construct
  misc_feature 1..5094: note = derived and/or modified CDS sequence (opt5) from CCHFV(YL16070)__KY354081.1__GP
  source 1..5094: mol_type = other RNA
atgctgttccactttaagttcatgctcctgatcaactttattctttgccatctgctctggggcggggtgggagtcaccggcggggttgagacaaatagctcctctacgcaggccatccccacccctccggtgacaagcaactccaccacacccggaccttctaccgacacagctaccgaaacggccagctccatgaccacatctacccccgatacacaagtgaccacggacaatggcagcggggagccttccacagatcccctgaccacaaacgaagcgacccctccgcttagcgtcaccacagctcagacgaaagagaccaagaaacacacaaccctggaccccaatacatctgccaaccctgatgccaccacgccctccattacaatcctcagcgcttctaatacctccctgcctaccagctctgtgcatgcctcccccagcccgtcctctagcgaggaacctacaccccagaacgctcaccatctgtccagaagcctcctgtctgccgtttccaccgagacaggacagacggcgagcgccaccacagctaccaaggaaattacaaccaaaaattctcctcccacggccggcaacgacaccatggtgacaagcgctcccaatggcaacacccggaatacacctgagcaagccaacccgaccgcgcccgaagcctcccttaagatccagacgacacagaatcagcaaaccgtcacacctgaggctacccccatcaccacagtgacggccctgaccgatctcacaaaccgctctaagagagacagcaaagttcagattatcctgaccttctcccaggggcttaagaaatactatagcaagattctgaaactcctgcagctgacacaagaggaagattctgagggactcctggaatggtgtacccgggtgcttgagcaggcttgcgacgatgactactttaacaagcgcatcgaagagttctttattacgggcaaggggtatttcaatgatgtcctgcagtttagactccacgacgccctgtccaacacagagcctgcccaaaccaccagccccacagctgtgccgttcaaatcttactatgcgaagggatcccttacctttgacagcggctacttctccgcccggtgttatcctcgcgcttctaatagcgggctgcagctcatcaacgtgacacagcaccccgtcaaaattgccaatacgcctggacccaagctgtccaacctgaaaaccatcaattgcatcaacctcaaggtttctacagataaagaacatagcgagctggaagtgaatgtgcttctgcctcaggtcgccgtgaacctctccaattgtcacgttagcattaagtctcatgtgtgcgactactccctggataccgacggcgctatcaaacttcccagagtcgcccacaacggcgtgtttattccggggacatacaaaatcgttattgataagaaaaataacctgaatgaccggtgtaccctcacgaccaactgcgtgatcaagggacgcgaggtcagaaaaggccaaagcgcgctgcggcagtataagacagaaatccgcattgggcagaccgtgacaggatctagacggctgctcgctgagggcgggtccagcgattgtatctctcgcacccagctggtcaagacagaggtggccgaaattcacgaggacagctacggaggccctggcgaaaagatcaccatttgcaacgggtccacgatcgttgatcaaagacttggaagcgagctgggctgttatacaatcaatcgggtgaagtcttacaaactctgcgaaaactccgccagcgggaagtcctgcgagattgactctatccccgtcaaatgtaagcagggattctgcctgaagattacccaggagggcagagggcatgtgaaactgagccgcggcaccgaaatcgttcttgatgtgtgtgactcctcttgcgagctcatgattcccaagggaacaggcgacatcctggtcgattgtagcgggggacagcaacacttcctgcagaataacctcattgacctgggctgccctaatgtgccgcttctggggaaaatggctatctatgtgtgtcggatgtccaaccatcccaagaccacgatggcctttctcttctggttttctttcggatacgttatcacatgcattgtctgtagagtgctgttttatctgcttatcgctattggcaccgtggggaaaaagctcaagcagtaccgcgaactgaaacctcagacatgcatcgtctgtgagagcgtgcccgttaatgccattgatgcggagatgcacgaactgaactgctcctacaatatctgcccttattgtgccagccggctctctaccgacggcctgatcagacatgtgacacaatgccccaagcgccgggagaaagtcgaagagaccgaacttttcctgaacctcgagcgcattccttggctggtgagaaagctgcttcaggtttccgagagcacgggaatggctctcaaacggtcttgttggatgatcaccctgctgattctcctgcttgtgtccatgagccccgtccagtctgccccggtgggcaaggaaagagctatcgagacataccaagcccgcgaagcgtataccgggatttgcctgtttgttctcggatccgtgctgttcgccgtcagctggctgacaaaagctcttatcgatggcatcgggaatagctttttccctggactcagcgtgtgtaagacctgctctattggcagcatcaacgggtttgagattgaatcccacaagtgttactgctctctgttctgttgcccctattgtcgggcctgcagctccgacaaaaatacgcacagaatgcatctgaacgtgtgcaagaaacggaagatgggctctaatgtcatgctcgctgtttgtaaacgcatgtgctttagagccacaatcgaggccagcaacaaggctctgcttattcggtccatcatcaactctaccttcgtgatttgtatcctgattctcacaatctgcgtggtcagcacctccgcggtggatatggagaatctgcctgccggaatttgggaaaaggaggaagacctgaccaacttctgtcaccaggagtgccaggttacagaaacggagtgtctttgcccctacgaggctatggtgctgagaaaaccgctctttctggatagcatcgccaagggcatgaaatctctcctcaattccaccagccttgaaacatctctgtccattgaggccccttggggagctatcaacgtccagagcaccttcaagcccacagtgtccgccgcgaatatcgctctctcttggagctccgttgaacatcgcgggaacaaaattctggtgagcggccggtctgagtccatcatgaagctggaggaaagaaccggggtcagctggaatcttggagtggaggacgcctctgaaagcaagacgctgacagtttccgtgatggatctctctcaaatgtatagccctgtctttgagtacctgtccggcgaccgccaggtggaagagtggcccaaagccacctgtaccggggattgccccgagagatgtggctgcacatctagcacatgcctccacaaggaatggcctcactcccggaactggcgctgtaatccgacctggtgctggggagtgggcacggggtgtacctgctgtggactggacgtcaaagacttctttacagattacatgcttgttaagtggaaagtggagtatattaagaccgaagctatcgtgtgcgtcgagctgacaagccaggaaagacagtgttctctcattgaggccggcacccggttcaacctggggcccgtgacgatcaccctgtccgagcctcgcaatgttcaacagagacttccccctgaaatcgtgacactgcatcccaagattgaggaaggatttttcgacctcatgcacgtccagaaaatcctgagcgcgtccaccgtgtgcaagctccagtcttgtacacatggcgttcctggcgattttcaagtgtaccacgtcgggaacctgcttcggggagacaaagtgaatggccatagcattcacaagatcgagccgcacttcaacacctcctggatgtcttgggatgggtgcgacctggattatttttgtaatatgggagactggcccagctgcacatacacgggcgtcacccagcataaccgcgctgccttcattaacatgctgaatatcgaaacagattataccaaaacctttcacttccattccaagagagtgacagcccacggggacacgcctcagctcgatctgaaagctcggcccgcctacggagctggcgaggttaccgtgcttgtcgaggtggccgacctggaactccatacaaagaagctggaggttagcggcctcaaaatcgcgtctctgacctgctccgggtgttatgcctgcagctctggaatttcctgtaaggtgcgcatccacgtcaacgaacctgatgagttcacagtgcacgtgagaagctctgaccccgacgttgtcgctgccggcagctcccttatggctcggaaaattgagtttggggccgattctaccttcaaggcctttagctccatgccgaaagacagcctgtgcttctacatcgtggaaaaggattactgttcctcttgcacggacgatgacacacaaaagtgtgtgaataccaaactggatcatcctcagagcattctcatcgagcacaagggaaccattatcggcaaacagaacgacacatgctccaccaagacatcttgttggctgaaatcctttaaggggttcttttatggacttaagaatatgctgtccggcatcttcggcaacgtctttctcgggattctgctgttcctggctccctttgtgcttctgatcttcttctttttctttggatggagactcctgttctgcctgaaatgttgcaagaaaaccaagggccttctgaaatacaagcatctcaaggataaagaagaggcggggtataagaaaattatcgaacgcctgaatggaaagaaaggcaagtctcagctctttgacggggagcggctggccaacagaaagattgctgagcttttcagcacgaaaatccacatcggatga

SEQ ID NO: 13550 - RNA, 5094 nt, synthetic construct
  misc_feature 1..5094: note = derived and/or modified CDS sequence (opt5) from CCHFV(YL04057)__FJ562094.1__GP
  source 1..5094: mol_type = other RNA
atgctgttccactttaagttcatgctcctgatcaactttattctttgccatctgctctggggcgggggaggcgtgaccgggggagtcgagacaaatagctcctctacgcaggccatccccacccctccggttacaagcaactccaccacacccggcccttctaccgacacagctaccgaaacggccagctccatgaccacatctacccccgatacacaagtgaccacggacaatgggagcggagagccttccacagatccccctaccacaaacgaaaccaccccgccccctagcgcgacaacggctcagaccacagagaccaaaaagcacacaaccctggaccccaatacgtctacaaaccctgatgccattaccccctccatcaccattcttagcgcctctaatacatccctgccgatcagctctgtgcatgcttcccctagcccctcctctagcgaggagcctacaccccagaacgcccaccatctctccagaagcctgctgtctgctgtctccaccgagacgggccagatcgccagcgcgaccacagccgctaaagaaattaccacaaagaactctccccctaccgccggcaatgacacgatgatcaccagcgctccgaatgggaacacacggaatacccccgagcaagccaaccctacagcgcccgaagcctcccctaaaattcagaccacgcagaatcagcaaacagtgatccccgaggctaccccgattacaaccatcaccgccctcacagatctgacgaaccgctctaagagagacagcaaggttcagattatccttaccttctcccagggactgaaaaagtactatagcaaaatcctcaagctgcttcagctgacacaagaggaagattctgagggcctcctggaatggtgtacccgggtgctggagcaggcttgcgacgatgactactttaacaaacgcattgaagagttctttatcacagggaagggatatttcaatgatgtcctccagtttagactgcacgacgccctttccaacaccgagcctgcccaaacgacaagccccaccgctgtgcctttcaagtcttactatgcgaaaggctccctgacctttgacagcgggtacttctccgcccggtgttatccccgcgcttctaatagcggactccagctgattaacgttacacagcaccctgtgaagatcgccaatacccccggcccgaaactttccaacctgaagacaattaattgcatcaacctcaaagtctctacggataaggaacatagcgagctggaagtgaatgtgctgctccctcaggtcgccgttaacctgtccaattgtcacgtgagcatcaaatctcatgtgtgcgactactcccttgataccgacggcgctattaagctgcccagaatcgcccacaacggggtctttattcccggaacatacaagatcgtgattgataaaaagaataacctcaatgaccggtgtaccctgacaaccaactgcgttatcaaaggccgcgaggtgagaaaggggcaaagcgcgcttcggcagtataaaacggaaatccgcattggacagaccttcacaggctctagacggctgctcgctgaagggggatccagcgattgtatctctcgcacccagctggtcaagacagaggtggccgaaattcacgaggacagctacggcggccctggggaaaagatcaccatttgcaacggatccacaatcgttgatcaaagactgggccgggagctcgggtgttataccattaatagagtgcgcagctacaaactgtgcgaaaactctgcctccggaaagagctgcgagatcgactccatcccggtcaaatgtaagcagggcttctgccttaaaattacgcaggaggggcggggccatgtgaagctgtctagaggaacagaaatcgtcctcgatgtgtgtgacagctcctgcgagctgatgattcccaagggcaccggggacatcctggttgattgttctggaggccagcaacactttcttcagaataacctcattgacctggggtgccctaatgtgcccctgctcggaaaaatggctatctatgtctgtcgcatgagcaaccatcctaagaccacaatggccttcctgttttggttctcctttggctacgtgattacctgcatcgcttgtcgggttcttttctatctgctcatcgccattgggacggtgggcaaaaagctgaaacagtacagagaactgaagccccagacatgcatcgtctgtgagtctgtgcctgtgaatgcgattgatgccgagatgcacgaacttaactgcagctacaatatctgcccctattgtgcttcccgcctcagcaccgacggactgatccggcatgttacacaatgcccgaagagacgcgagaaagtcgaagagaccgaactgtttctcaacctggagcggattccttggcttgtgagaaagctgctccaggtgtctgagtccacaggcatggccctgaaacgcagctgttggatgatcaccctgcttattctcctgctggtctctatctcccccgtgcagagcgctcctgttgggaaggaacgggccattgagacgtaccaagcgagagaaacctatacaggaatctgcctcttcgtgctgggctctgtcctttttgccgtgtcctggctgaccaaagctctcatcgatgggattggaaatagcttctttcccggcctgtccgtttgtaagacatgcagcatcgggtctattaacggcttcgagatcgaaagccacaaatgttactgctccctgttttgttgcccgtattgtcgggcctgctctagcgacaagaatacccaccgcatgcatcttaacgtgtgcaagaaaagaaagatgggatccaatgtcatgctcgctgtgtgtaaacggatgtgcttcagagccacgattgaggcctctaacaaggctctgctgatccgcagcattatcaactccacattcgttatctgtattctcatcctgaccatttgcgtggtctctacaagcgcggtggatatggagaatcttcctgccggcatctgggaaaaagaggaagacctgaccaacttttgtcaccaggagtgccaggtgaccgaaacagagtgtctctgcccctacgaggctatggtcctgcggaagcctctgttccttgattccattgccaaggggaaaaagagcctgctcaattctacgtccctggaaaccagcctctctatcgaggccccctggggagctatcaacgttcagtccacatttaaacccaccgtgagcgccgcgaatattgctctgtcctggtctagcgtggaacatagaggcaacaagatccttgtctccgggcgcagcgagtctattatgaaactggaggaaagaacaggagtgtcctggaatctcggcgttgaggacgccagcgaatctaagaccctgacggtgagcgtcatggatctgtcccaaatgtattctcctgtgttcgagtaccttagcggggaccggcaggttgaagagtggccgaaggccacatgtaccggcgattgccccgagcgctgtggatgcacctcctctacatgcctgcacaaagaatggcctcacagcagaaactggcggtgttcccccacctggtgctggggcgtggggacaggatgtacgtgctgtggcctcgacgtcaaggactttttcaccgattacatgctggtgaaatggaaggttgagtatatcaaaacagaagctattgtgtgcgtcgagctcaccagccaggaacgccagtgttctctgatcgaggccgggacaagatttaatcttggacctgtgaccatcacgctgtccgagccccggaacgtgcaacagcgcctccctccggaaattgtcaccctgcatcccaagatcgaggaaggcttctttgacctgatgcacgttcagaagattcttagcgcgtccacagtgtgcaaactgcagtcttgtacccatggcgtgcctggggatttccaagtctaccacgtgggaaatctcctgagaggcgacaaggttaacgggcatagcatccacaaaattgagccccactttaatacatcctggatgtcttgggatggatgcgacctcgattatttctgtaacatgggcgactggcctagctgcacctacacaggggtgacgcagcataatcgggctgcctttatcaacatgctgaacattgaaaccgattatacaaagaccttccacttccattccaaacgcgtcaccgcccacggagacacaccccagcttgatctgaaggctagaccggcctacggcgctggcgaggtgacggttctggtggaggtcgccgacctcgaactgcataccaaaaagctggaggtgagcgggcttaagatcgcgtctctcacatgctccggatgttatgcctgcagctctggcatctcctgtaaagtccggattcacgtgaatgaacctgatgagtttaccgttcacgtgagaagctctgaccccgacgtcgtggctgccgggagctccctgatggctcgcaagatcgagttcggagccgattctacatttaaagccttcagctccatgcccaaggacagcctctgcttttacattgttgaaaaagattactgttcctcttgcaccgacgatgacacgcaaaagtgtgtgaacacaaagctggatcatcctcagagcatccttattgagcacaaaggcaccatcatcgggaagcagaatgatacctgctccacaaaaacctcttgttggctggaaagcgtcaagggattcttttatggcctgaaaaacatgctctccggcattttcgggaatgtgtttctgggaatccttctgttcctcgctccctttgtgctgctcattttcttctttttctttggctggcggctgcttttctgcctgaagtgttgcagacgcacacgggggctgctcaagtacaaacatctgaaggacgaggaagaggcgggatataaaaagatcattgagagacttaacggcaaaaaggggaagtctcagctgtttgacggagaacgcctcgccgatcggaaaatcgctgagctgttcagcaccaagatccacattggctga

SEQ ID NO: 13551 - RNA, 5094 nt, synthetic construct
  misc_feature 1..5094: note = derived and/or modified CDS sequence (opt5) from CCHFV(79121M18)__GU477493.1__GP
  source 1..5094: mol_type = other RNA
atgctgttccactttaagttcatgctcctcatcaactttattctttgccatctgctctggggcgggggaggcgtgaccgggggagtggagaccaatagcagctctacgcaggccatccaaacaccccctgttacaagcaacagcaccaccccgggcccctctaccgacacagctaccgaaacggccagctccatgaccacatctacccctgacacacaggtgaccacggacaatgggagcggagagccctccacagatcctctgaccacaaacgaagcgacaccccctcttagcgtgaccacagctcagacgaccgagaccaagaaacacaccacactggacccgtctacctccacgaatcccgatgccacaacccctagcattaccatcctctctgcctccaacacaagcctgcccatttcttccgtccatgctagcccttccccctctagctccgaggaaccgacccctcagaatgcccaccatctgagcagatctctcctgtccgctgtgagcacagagacgggccaaatcgcctctgcggccaccgctgccaaagaaatcacaaccaagaactctccccctacagctggcaatgacaccatggttacgtccgcccccaacgggaatattcggaacacccccgagcaggcgaatcctacagccccggaggcttcccccaaaatccagaccacacagaaccaacagaccgtgacgcctgaggccacacccattaccacaatcaccgctcttaccgatctgacaaatcgcagcaagagagactccaaggtccagaaaattctcacgttcagccagggactgaagaaatactattctaagatccttaaactgctccaactgacccaggaggaagattccgagggcctgctcgaatggtgtacacgggtgctggagcaggcctgcgacgatgactactttaacaagcgcattgaagagttctttatcaccgggaagggatatttcaacgatgttcttcaatttagactgcacgacgccctcagcaatacagagcctgctcagaccacgtctcccacagcggtgccgttcaaatcctactatgccaagggcagcctgacctttgactccgggtacttctctgctcggtgttatcctcgcgccagcaactccggacttcagctgatcaatgtcacccagcaccccgtgaaaattgccaacacacctggccccaagctctctaatctgaaaaccatcaactgcattaatctgaaggtgagcacagataaagaacattccgagctcgaagtcaacgttctgcttcctcaagtggctgtgaatctgagcaactgtcacgtctctatcaagtcccatgtgtgcgactacagcctcgatacggacggcgccattaagctgcccagagttgcgcacaatggggtgtttatcccgggaacctacaaaatcgtcattgataagaaaaacaatcttaacgaccggtgtacactgatcaccaattgcgtgattaagggccgcgaggttagaaaagggcagtctgctctccggcagtataagacagaaatccgcattggacagaccttcacgggctccagacggctgctggccgaaggcgggagctctgattgtatcagccgcacccaactcgtgaagacagaggtcgccgaaatccacgaggactcctacgggggccctggggagaaaatcaccatctgcaacggaagcacaattgtggatcagggcctggggtctgagcttggatgttataccatcaacagagtccggtcctacaagctgtgcgaaaatagcgcttccggcaaatcttgcgagattgacagcatccccgtgaagtgtaaacaggggttctgcctcaagattacacaggagggcagaggacatgttaagctgtcccgcggcaccgaaatcgtgctggatgtctgtgactctagctgcgagcttatgatccccaaagggacgggagacattctcgtggattgttccggcgggcaacagcactttctgcagaacaatctgatcgacctcggatgccctaacgttccgctgcttggcaagatggccatttatgtgtgtcggatgtctaatcatcccaaaacaaccatggctttcctgttttggttcagctttgggtacgtcattacctgcattgcctgtagagtcctcttctatctgctgatcgcgatcggcacagtgggaaagaaacttaagcagtaccgcgaactcaagcctcaaacctgcattgtttgtgagtccgtccccgtgaacgccatcgatgctgagatgcacgaactgaattgcagctacaacatttgcccttattgtgcctctcggctgtccacggacggcctcatcagacatgtgacacagtgccccaaacgccgggagaaggtcgaagagaccgaactgtttcttaatctggagcggattccttggctcgtgcgcaaactgctgcaggttagcgagtctacagggatggctcttaagcggtcctgttggatgatcaccctcctgatcctgctcctggtgagcatttctcccgtccaatccgccccggtgggaaaagaaagagcgatcgagacataccaggcccgcgaaacctatacgggcatttgccttttcgttctggggagcgtgctctttgctgtctcctggctgaccaaggccctgatcgatggaattggcaacagcttctctcctgggcttagcgtgtgtaaaacatgctccatcggctctatcaatggatttgagattgaaagccacaagtgttactgctccctcttctgttgcccctattgtcgggcttgctctagcgacaagaacacccacagaatgcatctgaatgtttgcaaaaagcggaaaatgggctccaacgtgatgctggccgtctgtaagcgcatgtgctttagagccacaatcgaggcttctaataaagcgctcctgattcggagcatcattaactccaccttcgtgatctgtattcttatcctgacgatctgcgtggtcagcacatctgccgttgatatggagaacctccctgctgggatttgggaaaaggaggaagacctgaccaatttctgtcaccaggagtgccaggtgacagaaaccgagtgtctgtgcccctacgaggccatggtgcttagaaagccgctgtttctcgattccaccgccaaaggaatgaaaagcctgctcaactctacatccctggaaacgagcctttccatcgaggctccttggggcgccattaatgtccaatctaccttcaaacccacagtgagcgcggctaacatcgccctgtcctggagctctgttgaacatcgcgggaataagattctcgtgtccggacggagcgagtctatcatgaaactggaggaaagaaccggcgtcagctggaacctgggggtggaggacgcctccgaatctaagacacttaccgttagcgtgatggatctgtcccagatgtattctcctgtctttgagtacctcagcggcgaccgccaggtggaagagtggcccaaggctacgtgtacaggagattgccccgagagatgtggctgcacctcctctacctgcctgcacaaagaatggcctcactcccggaattggcgctgtaacccgacatggtgctggggagttggaaccggctgtacatgctgtgggctcgacgtgaaggacttctttacggattacatgctggtcaaatggaaggtggagtatatcaaaaccgaagccattgtgtgcgtcgagcttacatcccaggaaagacaatgtagcctgatcgaggcgggaacccggttcaatctcggccccgttacaattaccctgtccgagcctcgcaacgtgcagcagagactgccccctgaaatcgtgacgcttcatcccaagattgaggaaggctttttcgacctgatgcacgtccagaagatcctctctgctagcaccgtgtgcaaactgcaatcctgtacacatggggttcctggagattttcagatctaccacgtgggcaatctcctgagaggggacaaggtcaacggacattctattcacaaaatcgagccgcacttcaataccagctggatgtcctgggatggctgcgaccttgattatttttgtaacatgggggactggcccagctgcacatacaccggagtgacacagcataatcgcgccgccttcattaacatgctgaacatcgaaacggattataccaagacatttcacttccattctaaaagagttaccgctcacggcgacacccctcaactggatctcaaggcccggcccgcttacggcgccggggaggtgacagtcctggtggaggtcgcggaccttgaactgcatacgaaaaagctcgaggtgtccggactgaagattgccagcctgacctgctctggctgttatgcttgctccagcgggatctcttgtaaagttcgcattcacgtgaatgaacctgatgagttcacagtccacgtgagaagctccgaccccgacgttgtggccgctggatctagcctgatggcccggaagatcgagtttggcgccgattccaccttcaaggcttttagctccatgccgaaggactctctttgcttctacatcgtcgaaaaagattactgtagctcctgcacagacgatgacacccagaagtgtgtgaacacgaagctggatcatcctcagtctattctgatcgagcacaaagggacaattatcggaaagcagaatgatacctgcagcaccaaaacatcctgttggctcgaatctgtgaagggctttttctatggcctgaaaaacatgcttagcgggatttttggaaatgttttcctgggcatctttctcttcctggcgccctttgtcctcctgatcttcttctttttctttgggtggagacttctgttctgcctgaagtgttgccgccggaccagaggactcctgaagtacaaacatcttaaggatgaggaagaggccggctataaaaagattatcgagcgcctgaacgggaaaaagggaaagtcccaactctttgacggcgaacggctggctgatagaaaaattgccgaactcttcagcacaaagatccacattggctga

SEQ ID NO: 13552 - RNA, 5088 nt, synthetic construct
  misc_feature 1..5088: note = derived and/or modified CDS sequence (opt5) from CCHFV(ArD39554)__DQ211628.1__GP
  source 1..5088: mol_type = other RNA
atgctgtgccacatcaagcatattctcctgttctgtatcattctttaccaccagcaatggaacaccggcgccagcaatacaacgatctcccccaccacaaacaaatctcataccgacattagccaccagcctacatccatcaccgctgcctctagcccggggtcccccgcgacaaccgctcctcccgagagatctgtgacgcctagccatacccccacaacctccgtcagcgaagccggatctggcgagcctccggccgctacacccgcctccgctaccgcccagagccctgaacccgcgtctgccgctcagccttcccccacgatcccgaagcctacaacccccgatcctacaagcgaggccctgtctacccccgctacctcccggccccaagaacctagcacacacccgtcccctcgctctagcccctccaaacccgttgagacgcagagcaccagacacacagcccgggagctcctgtctgtgaccgggacagaagcggagcagcttattacccagacgatccatacaaccaaggaagccaccaaagctacatcccctcaacccaccgccagcaatccggaccctacactggctacgacctctcgcagcattaactccatcaatcccaagggacctgagtctacaagagccacaccccagagcacctcccctacccccgagagctctacgattcagacccagatcctcccgattatcacaacccctggcacactggaagccatcattcaccccaccaaccggtccaagcgcaatctggggacggagatcattctcacactgccccaaggacttaaaaagtattacagcaaagtgctgaagctcatgcatctgaccagagaagaggattctgaaggccttctggagtggtgcacacggatcctcggccagacctgtgacgatgactattttcagaaacgcattaccgagttctttatcacaggggtcggatacttcaacgaagtgctgctgtttaaggagacgaccgatgctcctacactcgcgccgacccacaagggcgctccccctacagaacccttcaaatcctattacgccaaggggtttatcaccatggacagcggatatttctccgccaaatgctactctagagccagcaattccggcctgcaacttattaacgttacgatgcactctagcaagatgcctatcacacccgggcctaaatactccaatctgaagaacattaattgtatcaacctcaaagtgagcaccgataaggagcataatgaagtcgagattaacgtgctgcttccccaggttgctgtgaacctgtcttcctgccacgtcctcgtgcggagccatgtgtgtgactattctctggatgccgacggaatgatcaagctgccgcagatcacccacgagggcacatttattcctggcacctacaaaatcattatcgataagaaaaataagcagaacgaccgctgcacactcattacgaattgtgtcatcaaagggagagaagttcggaagggacaatccgcgctgcgccagtataagaccgagattagagtgggccaggctagctctgggacacggagacttctgagcgaatccaacaataacgactgcgtgagccgcacccagctcatcaaaacagagaatgccgaaatccatggagatgactacggcgggcccggagagaagattaccatctgtaacggctctacgattgtcgagcaacggctgggctccgaacttgggtgctataccatcaatagaattaagagcttcaagctgtgcgagaactccgcctctggaaaaggctgtgaaatcgatagcacacctgtgaagtgcaagcaggggttttgtctcaaaatcacccaggagggacgcggccacgttaagctgtcccgggggtctgagattatcctggacgtgtgcgatagctcctgtgaaatgatgattcccaaaggctctggagacatcctcgtcgattgcagcggcgggcagcaacacttcctgcaggacaatcttgtggatctgggatgtccgaacgttcctctcctgggcaagatggctatttacatctgcagaatgtccaatcatcccaaaacaaccatggcctttctgttctggttcagctttgggtatgtgatcacatgtattttctgcaaggtcatcttttacgtgcttattatcattggaaccctcggcaagcgcatcaaacagtaccgggagctgaagcctcagacgtgtacaatctgcgaagctacccccgtcaacgccattgacgcggagatgcacgatctgaattgctcttataacatctgtccctactgcgcctccagactcaccagcgaagggctggtgcgccatgttacacaatgtcctaaacggaaggagaaaattgaggaaaccgagctttatctgaacctcgaaagaatcccgtggttcgtgcgcaagctgctgcaggtctctgagtccacgggcgtggctcttaaacggagctcttggctcgttacactgctggtgctcctgaccgtctcccttagccccgtgcagtccgcccctattggacaagaaagaacagtggttacctaccaggtccgggagagctatacaggcatgtgcctgtttatcctcgggtctgtgctgttcgctattagctggctgaccaagggacttgtggactccgtcggcaatatctttttccccgggctctctgtgtgtaagacgtgcagcatcggatccattaacggctttgagatcgaatctcacaaatgttactgcagcctgttctgttgcccttattgtcgctactgctccgccgacagaggggcgcaccagtctcatctgagcgtttgcaagaaacggaagaccggctccaatgtgatgctcgccgtctgtaaaagaatgtgctttcgcgctacactgaaggtgagctctgaggcccttattatccggtccattatcaacaccacattcgttgtgtgtatcctgattctcgtcgtgtgcgttgtgagcacctctgctgtcgaaatggagaatctgcccgccggaacgtgggaaaaggaggaggatctgacaaacttttgtcaccaggaatgccaagtgaccgagacagaatgtctttgcccttacgaggccttcgtgctcagaaaaccgctgttcctggactccaccgctaagagcatgaaatccctcctgaatagcaccagccttgagacatccctgagcatcgaagcgccctggggcgccattaacgtccagtctacgtttaagcctaccgcttccacagccaatatcgccctcagctggtctagcgttgagcatcgcgggaacaaaattctggtgaccggaagatccgaatctatcatgaagctggaggaacggacaggcatcagctggaatcttggggtggaggatgcttccgagtctaagaccctgacggtcagcgtgatggacctctcccagatgtatagcacagttttcgaatacctgtctggagatcgccaggtggaggaatggcccaaagccacctgtaccggcgactgccctgagagatgtgggtgcacatcctctacctgcctccacaaggcgtggccccattcccggaactggcgctgtaatccgacatggtgctggggcgtcggaacgggctgtacctgctgtgggctggatgtgaaaaacctttttacagactatatgctgattaagtggaaagttgagttcatcaagaccgaggctattgtgtgcgtcgagctcacatctcaagaaagacagtgtagcctgatcgaggccggaacccggtttaatctgggccctgtgacgattaccctttccgaaccccgcaacatccagcagaagctgccccctgagctcgttacactgcaccccagagtggaagaggggttctttgatctcatgcacgtccaaaaagtgctgtctgccagcaccgtgtgcaaacttcagtcctgtacacatggagtccctggcgacctgcaggtttaccacgtgggcaacctcctgaaaggggataagattaatggaaacagcttccataaaatcgagccgaatctgaacacctcttggatgtcctgggacggctgcgatcttgactattactgtaatatgggggactggcccagctgcacatatacgggagtgacccaacacaaccatgctgcctttgtcaatctgctcaacatcgaaacagattacaccaagaatttccactttcactctaaacgggtgaccgcgcatggcgagacacctcagctggacctcaaggctcgccccaagtacggggccggagaagttacggtgctggtcgaggtggccgatatggagcttcacaccaaaaagattgaaatctccggcctgaaattcgctagcctgacatgcaccggctgttatgcctgctctagcgggatttcctgtaaggttagactccatgtggacgagcctgatgaactgacagtccacgtgaaatctgacgatcccgacgtcgtggctgccagctccagccttatggcgcggaagatcgagtttggaaccgattccacgttcaaggccttctctagcatgccgaaagacaagctgtgcttttacattgttgaaagagattattgttcctcttgcagcaaagaggacacacagaagtgtgtgaacgctaaactcgagcagcctcaatccatcctgatcgaacacaagggcaccattatcgggaagcagaatgatacctgcacagtcaaagcctcttgttggctcgagagcgtgaagtccttcttttacggactgaaaaacatgcttggcgggattttcggaaatgttatcctgggcattatcatgtttctggctcccttcgccctcctgcttctgtttttcctctttggctggcgcatcctgttctgcctccggtgttgcagacgcacccgggggctgtttaagtataaacatattaaggacgacgaagagagcggatacaagagaatcattgaacgccttaacaataaaaagggcaaaaacaagctgttcgatggggagcggctggccgacaaaaagatcgctgaactcttctctacaaagacccacattggatga

SEQ ID NO: 13553 - RNA, 5088 nt, synthetic construct
  misc_feature 1..5088: note = derived and/or modified CDS sequence (opt5) from CCHFV(AP92)__DQ211625.1__GP
  source 1..5088: mol_type = other RNA
atgcccgaccacttcatcctgctcctgcttatgtacaccgtgtttcatcagcaccctcaagatgtcagcgccaacgttcatctggtgaatccgtccaactctacaacgggcgctagcaccgccttcaatcccgtgcacaacgcgacaaccgacgggcagaagcagtccacatctaccacaaccatggctagacctagcacggtcacccagattacaaccgcccaagccatggaggtggatggatccggcgaatctacaaccctccccgctgttacgcctacacccgccgagaccacaacccatgctaatcagaaaagcgcctccaccatggggacactgacgaccagccttgaagacacagcgctgatgaccctcacaggacggtctatcctgacctcccagagccagacgggctcttttgatcgcacatccaagcctcaaaccccgagaagcaccaaccagcccctgcggaaactcctgtctgccgtgtccacagaggctgcccctcagaccagccccacagctgtcacggccgaccagaccgaagcgtccacatctcctcaagtgaccacagataccagcccctccacgccgacccaggttacaagctctgccgggtccagctctagcaatacctccaaccactctaagacaacccctcagcttacgagctccggaagcgaggctcaacagacacagcccaccacaatgcctaataccaccgccctggtgacacccacggctcacatttctcccaccaaccgctccaaaagaaatagcgaggtcgaaatcattctcacactgcctcagggccttaagaagtattactctaaaatcctgaagctcctgcatctgaccctcgaggaagactccgagggcctgcttgagtggtgcacacggaccctgaaacaagcctgtgatgacgggtatttccaggaacgcatcaaggagtttttcctcacgggagaaggctactttaacgaggtgctgcttttcagaagcccgtcccagctggggacaaccggatctcccctcgccagccctcccaccgctgaaccttttaaatccttctatgcgaagggctttctgattatggattctgggtacttcagcgccaagtgctatcccaaagctagcaatagcggactgcagctcatcaacattacacaacactctatcaaggtggtcaataccccgggccctaaatactccaacctgaagacagttaactgtattaatcttaaagtgagcacggacaaggatcattctgagctggaggtgaacgtcctcctgccccaggtggccgttaatatctccaactgccacgtgcttattaaaagccacgtctgtgactactctctggacaccgatggcatgatccggctccctcaggtgacacatgaagggacctttatccccggaacatataagattgttatcgacaagaaaaataagctgaacgatcgctgcaccatgacgaccaattgtgtgattaaaggcaaggaggtcagaaaagggcagagcacactgcggcaataccgcaccgaaatcagagtgggacagatgtccagcggcacacggcgcctcctgtctgaagggggagacggcggctgcatttccagaacccagcttatcaagacagaaaccgccgaggtccacggggatgactatggaggccctggggagaagatcacgatttgtaacggaagcacaatcgtggatcagcggctgggctccgaactcgggtgctacaccattaatagaatcaaatctttcaagctgtgtgagaacagcgctcaaggcaaaaattgcgaaattgactccgcccccgttcagtgccgccagggatattgtctgaagatctctcaagagggccgggggcatgtgaaacttagcagaggatccgaaatcgtcctcgatgtgtgcgacacctcttgtgagattatgatcccgaagggcacaggggatattctggttgactgcagcggaggccagcagcacttcctgcagtccaacctcgtggacctggggtgtcctaatatcccccttctgggcaagatggcgatttacatctgccgcatgagcaaccatcccaaaaccacgatggcttttctcttctggttttctttcggatatgtcattacatgtatcctgtgcaagaccctgttttacatccttattatcattggcacactcgggaaaaagctgaaacaataccgggagctgaagcctcagacctgtacaatctgcgaatccgtgccggtgaatgccattgatgccgagatgcacgacctcaactgtagctataacatctgcccctactgcgcttctagactgacctccgaaggacttacgcgccacgttaatcagtgtcctaagcggaaagagaaggtcgaggaaaccgagctgtatctcaacctggaaagaatcccctggattgtgcgcaaactgcttcaggtgagcgagtctacaggcgtcgccctcaagcggtccagctggatgatcgtgctgctgattctcctgatcgtttccatgagccctgtgcaatctgctcccattagccaggaaagaaccgtcgccctttaccagtcccgcgaggattatatggggatctgcctggtgatcatgggatctgttctcctggcggtgagcctgcttgtccggggcctcattgactccatctctagcacattctttcctgggctgtccgtgtgtagaacctgccatattggctctatcaatggattcgagattgaaagccacaaatgttactgcggcctgctctgttgcccctattgtcgggcctgctccacggatcaggacgctcatcaatttcacctgagcgtttgtaagaaacgcaaggccgggtctaacgtgatgcttgctgtctgcaagagaatgtgcttcaaagccatcatcgaggcgtccaataaggtgctgtttattcggaacgtgatcaatacaaccttcgtcgtttgtattctcgtgatggtggcctgcatcgctagctctgccgctgtcgaaatggagaacctgccggccggaacatgggaaagagaggaggaactgaccaatttttgtcaccaggagtgccaggtgaccgaaacagagtgtctttgcccttacgaatccttcattctgcgcaaacccctcttcctggatagcatcgccaagggcgttaaaaacctccttaattccacgtctcttgagaccagcctgtccattgaggctccttggggagcgatcaacgcccaaagcacatacaagcccaccgcttcttccgccaatatcgccctcacatggagctctgtggaacatcgggggaacaagattctggtcagcggcagatccgagtctatcatgaaactggaggagcgcaccgggattagctggaatcttggcgtggaggacgcttccgaatctagaacgctgacaatcagcgttatggatctctcccagatgtatagcccggtgtttgagtacctgtctggagaccggcaggtcgaagagtggcctaaggccacctgtaccggcaactgccccgaacgctgtgggtgcacatccagcacctgtctctataaagagtggcctcactccagaaactggcggtgcaatcccacatggtgctggggagtgggcacggggtgtacctgctgtggactggatgttaaggagcttttcacagaccatatgctggtgaaatggaaggtcgaatacattaagaccgaggcgatcgtgtgcgtggaactcacatctcaggagcgccaatgtagcctgatcgaagctggcaccagattttccctgggccccgtcacgattaccctttctgagcctcggaacatccagcagaaactgccgcccgagctcattacactgcaccctaagatcgaagatgggtatttcgacctcatgcatgttcagaaagtgatgagcgcctccaccgtgtgcaagctgcaaagctgtacacacggagtccccggcgaccttcagatttaccacgtggggaatctgctgaaaggagatcgcgttaacggccatctcatccacaaggtggagcctcatctgaatacctcttggatgtcctgggacgggtgcgatcttgactatttttgtaacatgggagattggcccagctgcacatacacgggcgtcacccagcacaatcatgccgctttcgccaacctgctcaatatcgaaacagactacaccaagacctttcacttccactctaaaagagtgacagcgcatggcgatacgcctcagctggacctcaaggctcggccgcgctatggggccggagagattaccgttctggtggaagtcgccgatatggagcttcacaccaaaaaggtggaggtcacaggcctgaaatttgcttccctgacatgtagcgggtgctacgcctgctctagcggaatctcctgtaaggtgcggattcatgttgacgaacccgatgagctcaccgtgcacgtcaaatctagcgaccctgatatcgtggctgcctccagctccctgatggcgagaaagattgagttcggcgttgactctacgtttaaggccttcagctccatgcccaaagactctctttgcttttatatcgtggaaagagattactgtaacagctgcaagaatgaggaaacacaacgctgtgtcaacgctaaactggagcagcctcagtccattctcatcgaacacaccgggaccatcattggaaagcagaatgacacatgcggctctcggaccagctgttggctggattccttcaaatccttcttttatggcctcaagtctatgctgtccgggatcttcggaaacgtgtttcttggcattttcctgtttctggcccccttcgctctcctgctgtttttctttttctttgggtggagaatcctgttctgcttcaagtgttgccgccggacaagaggactctttaaataccgccatattaaggacgatgaggaagtgggctataaaaagatcatcgagcggctgaataacaaaaaggggaagcacagactcctggacggagagcgccttgccgatcggaaaattgccgaactgttcagcaccaagacgcatatcggctga

SEQ ID NO: 13554 - RNA, 5085 nt, synthetic construct
  misc_feature 1..5085: note = derived and/or modified CDS sequence (opt5) from CCHFV(UCCR4413)__KY484038.1__GP
  source 1..5085: mol_type = other RNA
atgctgagatacatcctctatgccctgcttgctagcgccattctgcaccagcatctctacaaggtgggcgcggacacccaaaaacccacagtccggacgaacaccacacacaagatctcccctaccgctacagccaatcgcaccacatatgagcaggccaccccgtctacgacccccaaaagctccacaaagcctaccacacatattgctaccgcccacctggctgaatctgatgggagcggagagacgacacttctgctccccaccacagcctcccagtacaccaccgaaggccagacatctctggagcctacggcggaagagaccgggagcaacacaatcccctccgacaccacaagcacctctcctattacggaaaattccgaaagcacagatacccaaatgaacgtttctgactcctcttcttccccgctggccacccagggagctagaagccccgcccggaatctcctgtccgtgccttctgtggagcccggccagcagacaacccctaaacaacccacaacgaaggggaccgtcacaccgaccacacctcagcccaccacgagctcccctacccccgctcccacaagcgccaccctttctacaaactccagctctatcagcacccctgtgcagacgtcctctccgctgcagcccatggcgcctagccatgaaacacaacacgccctctataccacatccaccgagagcaccctgcgcacactttctgctgagagaatccaccccacgaatcggtcccgcagaaacagcgaagttgagattatcctgaccctccctcagggactgaagaaatactattctcggctgctcaagctgcttcatctgacaatggaagaggataccgaaggcctccaggagtggtgcgtgcgcgtcctgggccaaacatgtgacgattcctacttccacaaaagacttgccgagtttttcattaccgggacgggatttttcaatgaagtgctgctctttcggagcccctccacaccgaccaccatcaagccttctcccacaggcagccctaccgttgagcccttccgctcctactatgctaaagggtctctgacaattgacagcggatacttttccgccaagtgctatcctagaacgagcaactctggcctgcagctcatcaatctgacccagcattccgtggaaattgccaacacacccgggccgaagcacagctctcttaaaaccatcaattgtatcaacattaaggcttccacagataaagagcacaatgaagtcgagatcaacgtgctgctccctcaggtggcgattaacctgagcaattgccatgtctctatccggagccacgtttgtgactactcccttgataccgacggaaagattcgcctgccccaaatcagccatgagggcacgttcatccccggcacctataaaattatcattgataagaaaaacaagctcaatgacagatgctctctgatcacatcctgtgtgattaaggggcgggaactgagaaaaggacagagcaccctccgccagtacaagacagagatcaaaatcggccagacctcctctgggagccggagactgctttccgaatctagcgcctccggatgcatttctcgcacacaaatgatcaagagcgagaccgctgaaattcacgacgatatctatggcgggcctggagagaaactgacgatttgtaacggcacaaccgtggtcgaccagcggctcggctccgagctggggtgctacaccatcaatagaattaagacatacaagctgtgtgaaaacagcgtgaaagagaagacctgcgaaatcgattctgttccggtgaaatgccgccagggactttgtctcaagatcacgcaggagggccgggggcatgtcaaactgtccagaggaagcgagattgtgctggacatctgcgattcttcctgtgaactcatgattcccaagggcacaggggacatcctggttgattgcagcggcggacaacagcactttcttcaggacaatctggtggatctcggctgtcctaacattcccctgctggggaaggtcgccatctatatctgccgcatgtctaatcaccctaaaaccacaatggccttccttttctggttctcctttggatacgtgattacctgtatcctctgcaagattctgttctatctgctcatcattacaggcaccctggggaaaaagctgaaacagtaccgggagcttaagccccaaacgtgtaccatctgcgaaagcacacctgtcaacgctatcgacgccgagatgcatgatctcaattgttcctataacatttgcccctactgcgcgagcagactgacctctgacggactgatccgccacgtgaatctttgtccgaagcggaaagaaaaggttgaggagacagaactctatctgaacctggagcgcattccttggttcgtgcggaaactcctgcaggtcagcgaatccaccggcgtggctcttaagcgctctagctggctgctcatcctggttattctgcttacggtgtccatgtctcccgtccagagcgcccctatcaatcaacagagagccgtggaggcttaccaggcccgggaagggtacacaggcatctgcctctttattctgggatccgtgctgttcatgacctcttggctcacaaaaggcctgatcgacagcattggggattcctttttccccggactttttgtttgtaagacctgcagcatcggctctattaacgggttcgagatcgagtcccatagatgttattgcagcctgctctgttgcccgtactgtagaacctgctctgctgacaaagattcccaccagctgcacctgagcatttgtaagaagaaaaaggccggatccaacgtcatgcttgcggtgtgcaaacggatgtgctttaaggccacaatcgaagctagcaatagagtgctgctcatccgcagcattatcaacacgaccttcattatctgtatgctgattctcgtcgtgtgcgttatctccacaagcgccgtggagatggaagacctgcctgctggcacctgggagagagaagaggatcttacaaatttttgtcatcaagagtgccaggtcaccgaaacggagtgtctgtgcccctatgaagccttcgtgctccggaaacctctgtttctgtcttccatcgttaaggggaagaaaaaccttctgaatagcgcgtctctcgagacaagcctgtccattgaggccccctggggcgctatcaacgcccagtctaccttcaagcccaccattagcacagctaatatcgccctctcctggtctagcgtggaacaccgcggaaacaaagtcctggtgtccggcagaagcgagtctattatgaaacttgaggagcggaccgggatctcctggaatctgggagttgaagacgccagcgagtcccgcatgctcacagtgtctgtcatggatctgagccagatgtacctgcctgtgtttgagtatctttccggcgacagacaagtggaagagtggccgaaagctacgtgtaccggggattgccccgaacggtgtggatgcacatctagcacctgtctgcataaggagtggcctcactcccgcaactggagatgcaatcccacatggtgctggggcgtcgggaccggctgtacgtgctgtggactcgacgttaaggatctgttcaccgactacatgttcgtgaaatggaaggtggaatatatcaaaacagaggcgattgtctgcgtggagctcaccagccaggaacggcagtgttctctgatcgaggccggcacacgctttaaccttgggcctgttaccattacactgtccgaacccagaaatatccagcaaaagctgcctagcgagattgtgacgctccatccgaaaatcgaagagggattctttgatctgatgcacgtccagaaggtgctttctgcttccaccgtttgcaagctgcagagctgtacacacggcgtggccggggacctccaagtctaccatgtgggaaacctgctcaaaggcgacaagattaatggccactctatccataaaatcgagccccacctgaacaccagctggatgtcctgggatgggtgcgaccttgattactattgtaacatgggagactggccttcttgcacctacacaggcgttacgcagcataatcacgccgctttcgtgaacctgctgaatattgaaaccgattatacaaagagctttcacttccattccaaacgggtcaccgcccacggggacacaccccagctcgatctgaaggcgagacctatgtacggagctggcgagatcaccgtgcttgtggaagtcgccgacatggagctgcatagcaaaaacattgagatctccgggctcaagtttgcctctctgacgtgtagcggatgctatgcttgctcctctggcattagctgtaaggttcgcatccacgtggatgaacccgacgagctcgccgtgcacgtcaaatccgatgacctggatgtggttgcggcttctagctcccttatggcccggaagatcgaatttggcacagacagcacctttaaagccttctcttccatgccgaaggagagcctgtgcttttacattgtggaaagagacttctgtaaatcttgcgctgccgaggatacccagaagtgtgtcaaggctaaactggagcaacctcagtccatcctcattgaacataaggggacaatcattggaaaacagaatgatacctgcagcacaaagacctcttgttggctggagtcctttaagagcttcttctatggccttaagaacatgctgtccggggtgtttggaagcgccatcatgggcatcctcctgttcctcgcgccctttattctgcttatcctgttctttttctttgggtggcgcattctgttctgcctccggtgttgcagacgcacgcggggactgtttaagtacaaacacatcaaggacgacgaagaggccggctacaaaaagattatcgaaaaacttaataacaagaagggcgggacatctaaactgctcgatggagagagactggctgaccgcaagattgccgagctgttcagcaccaaagctcatatcggctga

SEQ ID NO: 13555 - RNA, 5076 nt, synthetic construct
  misc_feature 1..5076: note = derived and/or modified CDS sequence (opt5) from CCHFV(SCT ex Afghanistan)__KC344856.1__GP
  source 1..5076: mol_type = other RNA
atgcaccatgcctaccagatcatgtataccctgctcgtgtgcgctattctgtgtccccaaccttggagccttgagggcacacacgtcccgctgaacgggacgaagcataatggaaccggcatcacagccgcgcccgggggatcccagggccctacctctcccgctagcacagccgtttccctcacccctgaccccttcacaaccgaacctacggcctctgctgtggagctggaaagctccggggagggacacacctctcttagcgtgacaacccagggcctgacatccccggaaaccacgcccggcctccctacagtcaccgatacaggggtgagctctacctccatttttggaatcggcattagagttgccggggacacccccacaagcacgacccatacaggactgccttcttcccccagcatgccgtctaccgctcagggccctcaccacgccgtgcgggggctgctctccgtcagctccacacgccccggagaggcgtctaccatcacggtgcctggcgaggccggcacagaagctaacagctccagctctgccatctccaaaaagcccgctcccagccctaccgccgaggcgattaccgaagccaataactctagcaatccgagacaacccgagctgtccacacagcctgctatccccgggcttgttacctctagcgcccagcctattctgctccagtccgctacaagcacggccgcccaagatatctacccctctccgaccaaccggtccaaacgcaatctggagatggaaattatccttacactgagccagggactcaagaaatattacggcaagattctgagaatcctggacctcaccctggaggaagatacagaggggcttctggaatggtgcaagcggaacctcggactgacctgtaatgacaacttctttcaggagcgcatcgaggagttctttcttacgggcgaagggcatttcaatgaagtgctgcagtttaaaaccccttctacactctcccccaccgagcctacacacaccagaacgcccacagtcaagcctttcaaaagctattttgctcggggattcctgtccattgattctggctactttagcgcgaagtgctattccaaaacctctaacagcggcctgcaactcatcaatattacacagcatcccgcccgcatcgctgacaccccggggcctaagattaccaacctgaaggccatcaattgtatcaaccttaaagcctccgtgttcaaggaacacagagagattgagatcaacgtgctgctcccccaggtcgctgttaatctgagcaactgccacgtgcttattaaatctcatgtgtgtgattactccctggacatcgatggagccgtccggctcccccacgtgcatcacaagggcacatttattcctgggacgtacaaaatcgttatcgacaagcgcaataaacaaaacgatagatgcaccctggtgacaaattgtgtcattaagggaaaggaaatccggaaaggccagagcgcgctgcgccagtatagaaccgagattcggatcgggaaggcttctgccggctccagacgcctcctgagcgaagagtctggagacgactgcattagccggacacagcttctgagaaccgaaacggccgaggtgcataacgataattacggcgggccgggagacaaaatcacaatttgtaacggctccaccatcgttgatcaacgcctcgggagcgagctgggatgctataccatcaatcgggtgaagtctttcaaactgtgcgaaaactccgctacaggcaagagctgtaagattgactccacccccgtcaaatgcagacaggggttctgtcttaagatcacacaggagggccgcggacacgtgaaactctctcggggcagcgaagtcgtgctggatgcctgcgactcctcttgtgagattatgatccctaaggggacgggagatattctggttgactgcagcggcgggcagcaacactttctcaaagataatctgatcgaccttggatgtcccaacatccctctgctcggcaagatggctatttacatctgcagaatgtccaatcatcccaagaccacaatggccttcctgttttggttctcttttgggtatgtgattacctgtatcttctgcaaagtcatcttttacctgcttattgtggttggcacactcggaaagaaattcaagcagtatcgcgagctgaaacctcagacctgtacgatctgcgaaaccacacccaccaacgcgattgatgccgagatgcacgacctgaattgcagctacaacatctgtccgtactgcgcttcccggctcacaagcgacggcctggccagacatgtgacccagtgtcctaagcgcaaggaaaaagtcgaggaaacagagctttatctgaacctcgagcggattccctggatcgtgagaaagctgctgcaagtgtctgaatccaccggggttgctcttaaacggagctcttggctcattgtcctgctggtgctcctgacggtgtcccttagccctgtccagtctgcccccatcggacacggcaagacaatcgagacctaccagacccgcgaagggtatatttccgtgtgcctgtttgttctcggaggcatcctgttcgtggtcagctgtctgattaaagggcttgtggattccgttggcaatagctttttcccgggactctctatctgcaagacatgtagcattggctccgtgaacgggtttgagatcgaatctcacaaatgctactgtagcctgctgtgctgtccttattgcagacattgctccaccgaccgggagattcaccagctccatctgtctatctgtaagaagagacgcacgggaggcaatgtcatgcttgcggtgtgcaaacggatgtgtttcagagccacaatggaggttagcaacaaggtgctgttcatccgcaatattatcaacaccacatttgtcatttgcatcctcattctggctgtgtgtgtggtctccacctctgccgttgaaatggagagcctgcccgctgggacatgggaaagagaggaagatcttaccaatttctgccaccaagagtgtcaggtgacggagaccgaatgcctgtgtccttacgaggccctcgtgctgcggaaacccctctttctgaactccatcgtcaagggaatgaaaaatcttctgaacagcacaaatctcgaaacctctctgtccatcgaggccccctggggcgctattaacgtgcagagcacattcaagcctaccgtttctacggcgaatatcgccctgtcctggagctccgtggagcatcgcggcaacaagattcttgtctctgggagaagcgaatccatcatgaaactggaggaacggacaggaattagctgggacctcggcgtggaggatgcttctgaatccaagagcctgaccgtttctgtgatggacctcagccaaatgtattccccggtctttgagtacctgtctggggatcgccaggtggaggaatggcccaaagccacatgcaccggagactgtcctgagagatgcggctgcaccagctccacatgtcttcacaaggaatggccccactctcggaattggcgctgcaaccctacgtggtgttggggagttgggaccggctgcacatgttgcggcctggatgtgaaagacctcttcaccgattacatgtttgtcaagtggaaggtggagtatatcaaaacagaagccatcgtgtgtgtcgagctgaccagccaggagagacagtgctccctgattgaagctgggacgcggttcaaccttggacccgttacaatcaccctgagcgagcctcgcaatattcaacagaagctcccgcccgaaatcattaccctgcatcctagaatcgaggaaggctttttcgacctcatgcacgtgcagaaagtgctgtctgcctccacagtctgtaaacttcagagctgcacccatggggtgcccggagatctgcaagtttaccacattggcaacctgctcaaaggggacaagctgaatggacatatgatccacaagatcgagcctcactttaacacatcctggatgtcttgggacggctgtgatcttgactattactgcaatatgggcgattggcccagctgcacgtataccggggtgacacagcataaccacgcggctttcgtcaatctgctcaacattgagaccgactacaccaaaaattttcatttccactccaagcgggtgacagcccacggagatacgccgcagctggacctcaaagccagacctacctatggcgctggggaaatcacagttctggtggaggtcgccgatatggaacttcataccaagaaaattgacatctctggactgaagttcgcgagcctgacatgtgctggctgctacgcctgttccagcgggatttcttgcaaagtgcgcatccacgtcgatgagcccgacgagctcaccgtgcatgttaagtccgaagatcccgacatcgtggccgctagcacatctctgattgcccggaaacttgagctgggaacggattccacctttaaggctttcagcgccatgcctaagacatctctctgtttttacatcgtcgaaagagagtattgcaaaagctgttccaaggaagacacccagaaatgcgtgaacaccaagctggagcacccccaaggcattctcatcgagcataagggcacaattatcgggaaacagaatgacacgtgtaccgcgaaggccggatgctggctggaatctgttaagagcttcttttacggccttaagaacatgctgtccgggatcttcggaaatgtgtttattggcatcttcctgtttctcgctcctttcgtcctgcttattctgtttttcatgttcgggtggcgcctcctgttttgtttcaaatgctgccggagaacacgcggactctttaagtatcggcacctgaaggaggatgaagagagcggctacagacgcatcattgaacggcttaacaataaaaagggcaaaaacaagctgctggacggggagagactcgccgatcggcgcatcgctgagctgttctccaccaaaacacacattggatga

SEQ ID NO: 13556 - RNA, 5070 nt, synthetic construct
  misc_feature 1..5070: note = derived and/or modified CDS sequence (opt5) from CCHFV(SPU 431/85)__KJ682812.1__GP
  source 1..5070: mol_type = other RNA
atgcccgtgaacatcatgtacacccctctggtctgcgccgttatttgtctccagctgtggaatcttggcgggacactggtgagcacgaacagaacccaacacaatgagacaggaaccgtggctacaccggaaggcaccctccggccccgcctgcctgtctccacagcccttcccaccaagtctgacagacctagcgtggggcccgcggcttcctctagcggactggagggctccggggaacctaacacgtctccgagcatcaccacaaaaggactcacaccccctgagaccacccccgccctgcctacggccacagataccgacgcttccagcacaggcgttgtggatgtctctacccagatgaccaaggacattcccatgtccacagcctatacgaatccgcctagcaccccctctgctccttccacaccccagggcacccatcacacagcccgggggctgctcagcgtggcgtctaccaaatccgaagaggttagcatgtccacgtctcccgccaagacaagcaccgagacctccagccctccgcccgctacatctgaaacccctacaccctcccctacgacccaggtgcccacaggaaacaataacccgaataccagccgccaacctacaccctctgcccagcctgctatgagcaaccccgccacctcccctgcgcagcccaatctgtctcagagcgccccgcctacggctgatcaaggcgtccatccctcccccaccaacagaagcaaacggaatcttgagatcgaaattatcctgacactctctcaggggctgcgcaagtactatggaaagatccttaaactgctcgacctgaccctggaggaggatacagaaggcctcctggagtggtgcaagagaaaccttgggctgacctgtgacgataatttctttcagaaacggattgaagagttctttctcacgggagaaggctacttcaacgaggtgctgcagtttaaggtgccttccacacttagctctaccgagccgacacacaccagaccccctaccgtcgaacccttcaaatcctattttgccaagggcttcctgagcatgaactccgggtacttttctgctaagtgctatcctagaacaagcaattccggactccaactgatcaacgttacgaaacattctgccaagattgccgacacccccggccctaaaatcacaaatctgaagaccattaactgtatcaatctccgggctagcgtgttcaaagagcaccgcgaagtggagattaacgtcctgcttccccaggtggcggttaatctgtccaactgccacgcccagatcaagagccatgtgtgtgattactctctcgctacagacgggatggtcagactgccgcacatccatcacgaaggaacctttattcctggcacgtacaaaatcgtgattgataagaagaataaacaaaacgaccggtgcacacttgttaccaattgtgtgatcaaggggcgcgaggtcagaaaaggacagtccgccctgcggcagtataagaccgagattagaatcggcaaagccagctctggctcccgccggctcctgagcgaagagtctgacggggattgcatcagcagaacacagctgctccgcaccgaaacaacggagattcactccgacaactacggaggccccggggataagatcaccatttgtaatggaagcacaatcgtggaccaacggctgggctctgaacttgggtgctataccattaacagagtcaagtccttcaaactgtgcgagaatagcgctacaggcaagtcctgtgagatcgattctacccctgtgaaatgccgccagggattttgtctcaagatcacgcaggaaggccgggggcatgttaaactgagcagaggatccgagattgtgctggacgcctgcgattctaactgtgaaatcatgattcccaagggcaccggggacatccttgtcgattgcagcggaggccagcaacacttcctcaaggacaacctgattgatctggggtgtccgaatatccctctcctgggcaaaatggcgatttacatctgccgcatgtccaaccatcccaagacaaccatggctttcctgttttggttctcttttggatatgtgatcacatgtattctgtgcaaagttatcttctacctcctgattgtggccggcaccgtcgggaagaaatttaagcagtatcgggagctgagacctcagacatgtaccatctgcgagacgattcccgtgaatgccatcgacgctgaaatgcacgaccttaactgcagctacaatatctgtccctactgcgcctcccgcctcacaagcgatggactggctcggcatgtgatgcagtgtcctaagagaaaagagaaggttgaagagaccgaactgtatctcaacctggagcggattccgtgggtcgtgcgcaaacttctgcaagtgtctgagtccaccggcgtcgccctcaagagaagctcttggctgacagtgctgcttgttctcctgatcgtgtccctgagccccgtccagtctgcgcctattgggcacggaaaaaccatcgaaacgtaccaggcccgggagggctatacatccttctgcctctttattctggggagcatccttttcgtggtttcctgtctggtgaagggcctcatcgacagcgtcggaaatagctttttccccggcctgtctatttgcaaaacctgttccatcgggtctattaacggatttgaaatcgagagccacaagtgctactgttccctgttctgctgtccttattgcagacattgccccgctgatcgcgaaattcacaaacttcatctctctatctgtaagaagcggaaaacaggcagcaatgtgatgctggccgtttgcaagagaatgtgttttcgcgctaccatcgaggtgtccaacagagccctgctcattcggaatatcattaacacaaccttcgtcgtgtgcatcctgacgcttgcggtgtgtgtcgtttctaccagcgccgtggagatggaatccctgcctgctgggacatgggagaaagaagaggacctcaccaatttctgccaccaggaatgtcaagtgacagagaccgagtgcctgtgtccgtacgaagccctggtccttcgcaagcccctgtttctcgatagcattgtgaagggacgcaaaaacctgctcaattctacgtccctggagacaagcctttctatcgaagctccttggggcgccattaacgttcagtccaccttcaagcccacagtgagcgccgctaacatcgcgctgtcctggtctagcgtcgagcaccgggggaataaaatcctcgtgtccggccgcagcgagtctattatgaagctggaagagagaaccggaatctcctgggacctgggcgttgaagatgccagcgagtctaaacttctgaccgtgagcgtcatggacctctcccagatgtattctcctgtgtttgaatacctgagcggggatcggcaagttgaggagtggcccaaggctacatgcacgggagactgtccggaacgctgcggctgcacctcctctacatgtctccataaggagtggcctcacagcagaaactggcggtgcaatcccacctggtgttggggagtggggacaggctgcacctgttgcggcctggatgtcaaagaccttttcacggattacatgtttgtgaagtggaaagtggaatatattaagacagaggccatcgtctgtgttgaactgacctcccaggagcgccagtgcagcctcattgaggccgggaccagattcaacctgggacccgtgacaatcaccctgtctgaacctcggaatatccagcaaaaacttccccctgagattatcacactgcatccgagaattgaagagggctttttcgacctcatgcacgtgcagcgcgtcctgtccgctagcacggtgtgtaagctccagtcctgcacccatggggttcccggagaccttcaggtgtaccacatcggcaaccttctgaagggggataaagtcaatggacacctgattcataagatcgaacctcactttaacacatcttggatgagctgggacggctgtgatctcgactattactgcaatatgggcgattggccctcctgcacctatacaggggtgacccaacataaccacgccgcgttcgttaatctgcttaacatcgagacggactacaccaaaaattttcatttccactctaagcgggtgacagctcacggagatacccctcagctggacctcaaagccagacccacatatggcgccggggaggtcaccgtgctggtcgaagtggctgatatggagctccatacaaagaaaattgaaatcagcggactgaagtttgcctcccttacgtgtaccggctgctacgcgtgtagctctgggatttcctgcaaggttaaaatccacgtggacgagccggatgagctgacagtccatgttaagagcgaagaccctgatattgtggctgccggatcttccctgatggcccgcaaactcgagttcggcgctgacagcaccttcaaggccttttctgctatgcccaaaaccagcctgtgtttctacatcgtggaacgggagtattgcaagtcctgttctagagaagacacacgcaagtgcgtcaacacgaaacttgatcggcctcagagcattctgatcgagcacaagggcaccatcattgggaaacagaataacacatgtaccgccaaggcgtcctgctggctcgagagcgtgaaatcctttttctacggactgaagaacatgctctctggcatctttgggaatgtgttcattggaatctttctgttcattgccccctttgttcttctgatcctgttctttatgttcggctggagaatcctcttctgttttaagtgctgccgccggacaagagggctgttcaaatatcggcaccttaaggacgatgaagagaccggataccgcaaaattatcgaaagactgaacaataagaaaggcaagaacaagctcctggacggcgagcggctcgctgatcgcaaaattgccgaactgtttagcacgaagtcccatatcgggtga

SEQ ID NO: 13557 - RNA, 5070 nt, synthetic construct
  misc_feature 1..5070: note = derived and/or modified CDS sequence (opt5) from CCHFV(SPU 556/87)__KJ682811.1__GP
  source 1..5070: mol_type = other RNA
atgacggtgaacacagtctgcacgcccctggtttgtgccgtgttctgcctccagctgtggaatcttggcgggaccctggtgcctacaaacagaacccaacacaataagacaggaaccatggctacaccggagggcaccctcgggccccggctgcctgtcagcacggcccttcccaccaaatccgaccgcccttctgtgggacccgcggctcctagctccggcctggaagggtctggagagccgaacacaagcccctccatcaccacaaagggcctcgccctgcctgaaaccacgcccgcccctcccacagctaccgatacagacgcctctagcaccggcgttgtgaatgtctccacccagatgacaaaagatattccgatgagcacggcttacaccaaccctccctctacaccttccgcccccagcacgccccaggggacacatcacaccgcgagaggactgctctctgtggcctccaccaagagcgaggaagtttctatgtccacaagccctggcaaaacctccaccgagacatctagcccgccccctgctacctccgagacacccgcccctagccccacgacccaggctccgacagggaataacaatcctaacacctctcggcaacccacaccttccgcccagcccgcgatgagcaatcctaccacgtctcccgcccagccgaacctgcttcagaatgctcctcccaccgccgaccaaggagtgcatcccggccctacaaaccgcagcaagagaaatctggaaatggagatcattctcaccctgtcccaggggcttcggaagtattacggaaaaatcctgaagtttctcgatctgacactggaagaggacaccgagggcctcctggaatggtgtaaacgcaaccttggcctgacgtgcgatgacaacttctttcagaagagaattgaggagttctttctcacaggggaaggatatttcaatgaagtcctgcagtttaaagtgccgtctacccttagctccacagagcccacccacaccggcagccctacagtggagcccttcaagtcttactttgctaaggggttcctgtccatgaacagcggatatttttctgccaaatgttaccctcggacgtccaatagcggcctccaactgatcaacgtcaccaagcattccgccaaaatcgctgatacacccgggcctaagattaccaatctgaaaacaatcaactgcattaatctccgcgcgtctgttttcaaggaacacagagaggtggaaatcaacgtgctgcttccccaggtcgccgtgaatctgagcaactgtcacgctcagattaaatcccatgtttgcgactattctctcgccaccgatggaatggtgcggctgccgcgcatccaccatgagggcacgtttattcctggcacatacaagatcgtcatcgacaagaaaaataagcaaaacgatagatgtacccttgtgaccaattgcgttattaaagggcgggaagtgcgcaagggacagagcgccctgagacagtacaaaacagagatccggattggcaaggcttccagcgggtctagacgcctcctgtccgaggaaagcgacggagactgtatctctcggacccagctgctcagaacagagacggccgaaattcactccgataactatggcgggcccggcgacaagatcaccatctgcaatggaagcacaattgtcgatcaacgcctgggctctgagcttgggtgctacaccatcaaccgggtgaaatctttcaagctgtgtgaaaactccgcgacaggaaaaagctgcgagattgactctacccctgtcaagtgtagacagggcttctgcctcaaaatcacgcaggaggggcgcggacacgtgaagctgtcccggggcagcgaaattgttctggatgcttgtgactcctcttgcgagatcatgatccccaaggggaccggcgatattcttgtggactgtagcggaggccagcaacattttctcaaagataatctgatcgacctggggtgcccgaacattcctctcctgggaagaatggccatctatatttgtcgcatgtccaatcaccccaagacaaccatggccttcctcttttggttctcttttggctacgtcatcacatgcattctgtgtaaagtgatcttctatctcctgatcgttgctgggaccgtgggaaagaaatttaagcagtaccgggaactgagacctcagacatgcaccatttgcgagacgacacccgtcaacgccatcgatgctgagatgcatgaccttaattgtagctataacatttgcccctactgtgcctcccgcctcacctctgacggcctggcgcggcacgtgatgcagtgccctaagagaaaagaaaagatcgaggaaaccgagctgtacctcaatctggaacggattccgtgggtggttcgcaaacttctgcaagtcagcgagtccacaggggtggccctcaagagaagctcttggctgaccgtgctgcttgtcctcctgatcgtgtccctgagccccgttcagtctgctcctatcggccatggaaaaacgattgagacatatcaggcccgggaaggctacacctccttctgtctctttatcctggggagcattcttttcatcgtgtcttgcctggtcaagggactcattgattccgtgggcaacagctttttccccgggctgtccatctgtaaaacatgcagcatcggatctgttaatggctttgagattgaaagccacaagtgttattgctccctgttctgttgcccttactgcagacactgttctgctgaccgcgagatccataagctgcacctcagcatttgcaaaaagcggaaaaccgggtccaacgtgatgtctgccgtctgtaagagaatgtgcttccgcgcgacaatcgaagtgagcaatagagccctgctgattcggtccatcatcaacaccacgtttgctgtttgtattctcaccctggccgtgtgcgtcgtgtctacaagcgctgtggagatggagtcccttcccgccggcacctgggaacgcgaggaagatctgacaaatttctgtcatcaggagtgccaagtcaccgaaacggagtgtctctgcccttatgaggccctggttctgagaaaaccgctttttctggacagcatcgtgaagggaaagaaaaacctccttaattctacatccctcgaaaccagcctgtctattgaggctccctggggcgcgatcaacgtgcagtccacattcaagcctaccgtcagcgccgctaacattgccctttcctggtctagcgtggaacaccgggggaataaaatcctggtttccggacgcagcgagtctattatgaagctcgaggaaagaaccggcatctcctgggatctgggggtggaggacgccagcgaatctaaactgcttacagtcagcgtgatggatctgtcccagatgtactctcccgtttttgagtatctcagcggagaccggcaagtggaagagtggcctaaggctacgtgtaccggcgattgccccgagcgctgcggctgtacatcctctacctgcctgcacaaggaatggccgcatagcagaaactggcggtgtaatcctacatggtgctggggagtcgggaccggctgtacgtgctgtgggctcgacgtgaaagatctgttcacagactacatgtttgttaagtggaaagtggagtacatcaagaccgaagccattgtctgcgtggagcttacctcccaggaacgccagtgtagcctgatcgaggcgggaacaagattcaacctcggccccgtgaccattacactgtctgagccccggaatatccagcaaaaactgcctcccgaaattatcacgcttcaccctagaatcgaggaagggtttttcgatctgatgcatgtccagaaggttctctccgctagcaccgtgtgcaagctgcagtcctgtacacacggagtgccgggcgacctccaggtctatcatattggcaacctgcttaaaggggacaaggtgaatggacacctgatccacaaaattgagccccattttaacacctcttggatgagctgggatggctgcgacctggattactattgcaatatgggggactggccttcctgtacatacaccggagttacgcaacacaaccatgccgccttcgtgaatctcctgaacatcgaaaccgattatacaaagaattttcacttccattctaaacgcgtcaccgctcacggcgacacaccccagcttgatctgaaggcccggcctacctacggggcgggagaggtgacagttctcgtggaggtcgctgacatggaactgcacacgaaaaagattgagatcagcggcctcaagttcgcctccctgagctgcaccggctgttatgcctgcagctccgggatcagctgtaaagtgcgcattcatgtcgatgaacccgacgagcttacagtgcacgttaagtctgaggatccggacatcgtggctgccggatccagcctgatggctagaaaactggaatttggcgccgattctaccttcaaggcgtttagcgccatgcctaaaacctccctctgcttctacattgtcgagcgggaatactgtaagtcttgcagcagagaggacacacagaagtgtgtgaacacgaaactggaacgcccccagtccatccttattgagcataaggggaccatcattggaaaacaaaatgacacatgcaccgctaaggccagctgttggctggagtccgttaaatctttcttttatggcctcaagagcatgctgtccgggatctttggaaacgtgttcatcggcatttttctcttcatcgctccttttgtcctgcttattctgttcttcatgtttggctggcggatcctgttctgctttaagtgctgtagacgcacacgggggcttttcaaatacagacacctgaaggatgacgaagagaccggatatcggaaaattatcgaacgccttaacaataagaaaggcaagaacaagctgctcgatggggagagactggccgaccggaaaatcgccgaactcttttctaccaagagccacattggatga

SEQ ID NO: 13558 - RNA, 5070 nt, synthetic construct
  misc_feature 1..5070: note = derived and/or modified CDS sequence (opt5) from CCHFV(SPU 18/88)__KJ682810.1__GP
  source 1..5070: mol_type = other RNA
atgcccttcaacatcatgtacacccctctgctctgcgccattctgtgtcttcagctgtggagcctcgagggcatctatgggctgtccaataagacacaacacaacgacacgtctaccattaaagtgccggaagagagccagaagacatcccttcccgctaataccgcctctcctatcacaagcgatccctcctctgcgaccagcacagctctggcctccggacctgaaggcagcggggacacctctacgtcccccagcgtcaccacacagggacctaccctcctggagacaaccccggaaccccatacgacaattgatatcgacgagtcttccaccgccatcgctgatattagcacacagaccgttaaagacatccctacccccacaacgcacacctctctgccttccacacccagcgccccgaccattcctcaagaggctcatcacacagccagaggcctcctgtccgtgacctctacgaagcccggggaaacaagcacccctacctcccccggagaggcgagcacagaagcctcttctccccagcctaccatcagcgagacaccgtctccccctcccacgacccaggctcctacagagattaacaatcccaacaccagccggcagccgatgccttccacacaacccgccgctcctaattctgtgacgccccctgtccagcccacctttagccagtccgatgtgagcaccgttgcccaggacatccatccgtctcctacaaaccgctccaaaagaaatcttgaaatggagattatcctgaccctcagccaaggcctgaagaagtactatggcaaagtgcttaagctgctcgatctgacactggaagaggacaccgaagggctcctggagtggtgcaaacggaaccttggactgacgtgtgatgacaatttctttcagaagcgcatcgaggagttctttctcacaggcgaagggcacttcaacgaagtcctgcagtttaaaaccccctctacactttcccccaccgagcctgcgagagtggaaagcccgaccgttgagcccttcaagtcctactttgccaagggattcctgtctatggatagcggctatttttccgctaaatgctaccctaagtctagcaattccgggctccaactgattaacgtgacacagcacagcatccggattacggacacccccggacctaaaatcacatctctgaagaccattaattgtatcaacctcaaagccctggtcttcaaggagcatcgcgaaatcgagattaacgtgcttctgccccaggtggctgtcaatctctccaactgccacgttctgatcaaaagccatgcctgtgactattctcttgatattgacggccctgtgagactgccccggatccaccacgaaggcacatttattccggggacctacaagatcgtgatcgataagaaaaataagcagaacgaccgctgcacgctcgtcacaaattgtgtgattaaaggaagagagatccggaagggccaatccgttctgcgccagtacagaaccgaaattaaaatcgggaaggccagctctggaagccggcgcctgctctccgaggagagcaacgatgactgcctgtctagaacccagcttctgcggacagaaaatgctgagattcattccgataactatggcgggcctggagacaagatcaccatttgtaatggcagcacaatcgtggatcagagactcggctccgaactggggtgctacacgatcaaccgcgtcaaatctttcaagctgtgcgagaatagcgcgaccggaaaatcctgtgagattgactctacacccgtgcggtgcagacaaggcttctgtcttaagatcacccaggaagggcgcggacacgttaaactcagccggggctccgaggtggtcctggatgcctgcgactctagctgtgaaattatgatccctaaggggacaggcgacattctggtggattgctccggaggccagcagcattttctcaaggacaacctggtcgatcttgggtgtcccaatatcccgctgctcggaaaaatggctatctatatttgcagaatgagcaaccaccctaagaccacgatgggcttcctgttttggttctcttttgggtacgtgatcacctgtattctgtgcaaagttatcttctatcttctcattgtggtcggaacactgggcaagaaatttaagcaataccgcgagctgaagccccagacctgtacaatctgcgaaaccaatcctgtgaacgccatcgacgccgagatgcatgatctcaactgctcctataatatttgtccctactgcgctagccggctgacatctgacgggcttgccagacacgttatgcagtgtcccaaacgcaaggagaaaatcgaagagaccgaactgtacctcaacctggagcggattccttgggtggtcagaaagctgcttcaggtgtccgaaagcacgggcgtggcgctcaaaagatcttcctggctggttatcctgctcgtcctgcttacagtgagcctgtccccggtgcaaagcgctcccatttctcacggagagaccgtcgaggtgtatcagacccgggaaggctacacaagcatctgcctcttcgttctggggtccatcctgtttcttgtgtcttgtctcatgaagggactggtcgatagcgtgggcaattccttctctcctgggctgagcatttgcaaaacctgttccatcggatctattaacggctttgagatcgaaagccataagtgctattgttccctcttctgctgtccctactgcagacactgcagcgccgacattgagatccataagctgcacctttctatttgtaaaaagcggaaaacggggtccaatgttatgctggccgtgtgcaagcgcatgtgttttagagctacagtcgaagtgagcaacaaagccctcctgatccggaatatcattaacaccacattcgttgtgtgcatcctgattcttgctgtctgtgtggtgtctacctccgccgtcgagatggagaatctgcctgcgggcacatgggaaaaggaggaagatctcaccaacttctgccaccaggagtgtcaagttacggagaccgaatgcctgtgtccctatgaggccctcgtgctgagaaagcctctttttctggacagcatcgtgaaaggaaagaaaaatctcctgaactccacatctctggaaaccagcctttccattgaggctccgtggggcgccatcaatgtccagagcacattcaagcccaccgtgtctgctgccaacatcgcgctgtcctggagctctgttgaacatcgcgggaataaaattctcgtgagcggacggtccgagtctatcatgaagctggaggaaagaacgggcattagctgggatctcggggtcgaggacgcctccgaatctaagctgcttacagtgagcgttatggatctgtcccagatgtacagccctgtgtttgagtatctctctggagaccgccaggtcgaagagtggcccaaagctacctgcacaggcgactgtcctgagagatgcgggtgcacctccagcacctgtctgcacaaggaatggccccattcccggaactggcgctgcaacccgacatggtgttggggcgtgggaacgggctgcacctgttgcgggctggatgttaaagaccttttcacagattacatgtttgtgaagtggaaagtcgactacatcaagaccgaggccattgtgtgtgtggaactgacatctcaagagagacagtgcagcctcatcgaagctggaacccggttcaatctgggccctgtcacgatcacactctccgagccccgcaacattcagcagaagctgccccctgagatcgttacccttcaccccagaattgaagaggggtttttcgatctgatgcatatccaaaaagtgctgtctgccagcaccgtgtgtaagctccagtcctgcacacacggagtccctggcgacctgcagatttatcacatcggcaatcttctgaaaggggataaggtgaacggacatctcattcacaaaatcgaaccgcattttaataccagctggatgtcttgggacggctgtgatctggactactattgcaacatgggggattggccctcctgcagctacacaggagttacgcagcacaatcatgccgctttcgtgaacatgctcaatatcgagaccgactatacaaagaactttcacttccactctaaacgggtcaccgcgcatggcgatacacctcaactggaccttaaggcccgccccacctacggggctggagagattacggtgctggttgaagtggccgacatggagctgcacaccaagaaaatcgaaatttccggcctcaagtttgccagcctgacatgtaccggctgctatgcttgttctagcgggatctcctgcaaagtccgcattcatgtggatgagcctgacgaacttacagtccacgtgaagtctgaggatcccgacatcgttgccgcgagctccagcctgatggctcggaaactcgagttcggaaccgattccacattcaaggccttttctgccatgccgaagacgagcctgtgtttctacatcgtggaacgcgagtactgcaaatcctgttctaaggaagacacccagaaatgcgtcaatacaaagctcgagcagcctcaaagcattctgatcgaacacaaaggcaccattatcgggaagcagaacgatacctgtacaggaaaggctggctgctggcttgagtccattaaatcctttttctatgggctgaagaatatgctgagcggaatctttggcaacgtgttcatcggcatttttctcttcctggccccctttatcatgcttattctgttctttatgttcgggtggagaatcctcttctgttttaaatgctgccggagaacgcgcggactgttcaagtaccggcatctcaaagacgatgaggaaattggctatagaaagatcattgagcgcctgaagaataaaaaggggaaaaacaaacttctggacggagaacggctggcggatagaaagatcgctgagctcttttccaccaagacacacatcggctga

SEQ ID NO: 13559 - RNA, 5070 nt, synthetic construct
  misc_feature 1..5070: note = derived and/or modified CDS sequence (opt5) from CCHFV(SPU 497/88)__KJ682808.1__GP
  source 1..5070: mol_type = other RNA
atgcccttcaacatcatgtacacccctctgctctgcgccattctgtgtcttcagctgtggagcctcgagggcatctatgggctgtccaataagacacaacacaacgacacgtctaccattaaagtgccggaagagagccagaagacatcccttcccgctaatatcgcctctcctaccacaagcgatcccccttccgcgacctctacagctagcgcctccggacccgaaggcagcggggacacctctacgtcccctagcgtcaccacacagggaccgacacccctggagattacccctgaaccccataccacgatcgatatcgacaaatcttccacaagcattgccgatatctctaccagaacagttaaggacattcctacccccaccacacacacgtccctcccgagcaccccttccgctcccacaatccctcaggaggtgcatcacaccgcccggggcctgctgtctgtgacaagcaccaaacccgaggaggcttccacgctcacaagccccggggaggcctctaccgaagcgtccagccctcaaccgaccatttctgagacacccagccctccccctaccacacaggcccccacggagatcaacaatccgaacacctcccgccagcctatgccctctacacagcctgctgcccccaatagcgtcacccctcccgtgcaaccgacattttcccagagcgatgtttctaccgctgcccaggacattcatccttcccccacgaacagaagcaagcggaatctggaaatggagatcatccttaccctgtctcagggactcaagaaatactatggcaaggtgctgaaacttctggatctcacactggaagaggacaccgaaggcctgctcgagtggtgcaagcgcaacctggggcttacatgtgatgacaatttctttcaaaagagaattgaggagttctttctgaccggagaaggccacttcaacgaagtcctccagtttaagacgccctccacactgagccctaccgagccggcgcgggtggaatcccccacagttgagcctttcaagtcttactttgccaaagggttccttagcatggattccggatatttttctgctaagtgctaccccaaaagctccaatagcggcctgcagctcatcaacgtgacccaacacctgattcgcatcaccgacacacctgggcccaagattacgaatctgaaaaccatcaactgtatcaacctcaaggccctggtcttcaaagagcatagagaaattgagatcaatgtgcttctgcctcaggtggctgtcaacctctctaattgccacgttctgattaagtcccatgtgtgtgactatagccttgatatcgacggacccgtgcggctgccgcgcattcaccacgaaggcacatttatccctggcacctacaagatcgtcattgataaaaagacaaaacagaacgacagatgcaccctcgtgacgaattgtgttatcaaggggcgggagattcgcaaaggacagtctgtgctgagacaataccggacagaaatcaagattggcaaggcctccagcgggtctcgcagactgctcagcgaggagtccaacgatgactgcctgagccggacccagcttctgagaaccgaaaatgccgagatccattctgataactatggaggccccggggacaaaattacaatctgtaatggatccaccatcgtcgatcagcgcctcggcagcgaactgggctgctacacaattaaccgggtgaagtccttcaaactgtgcgaaaattctgctacggggaaaagctgtgagatcgactccacccctgttagatgccgccagggattctgtcttaaaattacacaagaaggcaaggggcacgtgaagctctctcggggaagcgaggtcgtgctggatgcgtgcgactcctcttgtgaaatcatgattcccaaaggcaccggggacatcctggtcgattgcagcggcggacagcagcattttctcaaggacaacctggtggatcttggctgtccgaatatccctctgctcgggaaaatggccatttatatctgcagaatgtccaaccaccccaagacaaccatggttttcctgttttggttcagctttggatacgtgattacgtgtatcctgtgcaaagtcattttctatcttctcatcgtggttggcaccctggggaagaagtttaaacagtaccgcgagctgaagcctcaaacatgtaccatctgcgaaacaaatcccgtgaacgctattgacgccgagatgcatgatctcaactgctcttataatatctgtccctactgcgcctcccggctgaccagcgacggacttgctagacacgtcatgcagtgtcctaaacgcaaggagaaaattgaagagacagaactgtacctcaacctggagcggatcccgtgggtggtgagaaagctgcttcaggtttctgaatccaccggcgtcgccctcaaacgcagctcttggctggtgattctgctcgtgctgcttacggtctccctgagccccgtgcagtccgcgcctatcagccacggggagacagttgaggtgtatcaaacccgggaaggctacacctctatctgcctcttcgtcctgggaggcattctgtttcttgtgagctgtctcatgaaggggctggttgattccgtgggaaattctttctttcccggcctgagcatctgcaagacatgttccattgggtctatcaacggattcgagattgaaagccataaatgctattgttccctcttttgctgtccttactgcagacactgctctgctgacatcgagattcataagctgcaccttagcatctgtaaaaagcggaaaacctggtccaatgtcatgctggccgtgtgcaagcgcatgtgtttcagagccacggttgaagtgagcaacaaggctctcctgatccggaatattatcaacacaaccttcgtcgtgtgcattctgatccttgccatttgtgtggtctctacatccgctgttgagatggagaatctgcccgccggcacctgggaaaaagaggaagatctcacaaacttttgccaccaggagtgtcaggtgaccgagacggaatgcctgtgtccttatgaggcgctcgtgctgagaaagccgcttttcctggacagcatcgtcaaagggatgcgcaatctcctgaactctacctccctggaaacaagcctttccatcgaggccccctggggcgctattaatgtgcaatctacctttaagcctacagttagcgccgctaacatcgccctgtcctggagctctgtggaacatcggggaaataaaattctcgtctccggcagaagcgagtctatcatgaagctggaggaacgcaccgggattagctgggatctcggagtggaggacgcgtccgaatctaagctgcttacggttagcgtgatggatctgtcccagatgtactctcccgtcttcgagtatctcagcggcgacagacaggtggaagagtggcctaaagccacatgcaccggggactgtcccgagcggtgcggatgcacatccagcacctgtctgcacaaggaatggccgcattctcgcaactggagatgcaaccctacctggtgttggggcgttgggacaggctgcacgtgttgcggactggatgtgaaagacctttttaccgattacatgttcgtcaagtggaaagtggactacatcaagacagaggctatcgtgtgtgtcgaactgacctcccaggagcggcaatgcagcctcattgaagccggcacacgctttaatctggggcccgttaccatcacgctctccgagcccagaaacattcagcagaagctgcctcccgagatcgtgacacttcaccctcggattgaagagggattctttgatctgatgcatatccagaaagtgctgtctgctagcaccgtctgtaagctccaatcctgcacccacggcgtgccgggggacctgcagatttatcacatcggaaatcttctgaaaggcgataaggttaacggccatctcatccacaaaattgaaccccatttcaatacatcttggatgagctgggacgggtgtgatctggactactattgcaacatgggagattggccttcctgcagctacaccggcgtgacacagcacaatcatgccgcctttgtcaacatgctcaatatcgagacggactataccaagaacttccactttcactctaaacgcgtgacagctcatggggatacaccccagctggaccttaaggcgagacctacctacggagccggcgagattaccgttctggtggaagtcgctgacatggagctgcacacgaagaaaatcgaaatttccgggctcaagttcgccagcctgacctgtacaggatgctatgcctgttcttccggcatcagctgcaaagtgcggatccatgtcgatgagcccgacgaacttaccgtgcacgttaagtctgaggatccggacattgtggctgccagctcctctctgatggcgcgcaaactcgagttcggcacagatagcacctttaaggctttctccgccatgcctaagacaagcctgtgtttttacatcgtcgaaagagagtactgcaaatcctgttctaaggaagacacgcaaaaatgcgtgaataccaagctcgagcagccccagagcattctgatcgaacacaaagggacaattatcggaaagcaaaacgatacctgtaccgcccgggcttcctgctggcttgagtctatcaagagcttcttttatggcctgaaaaatatgctgtccgggattttcggaaacgtttttatcggcattttcctctttttcgccccttttatcatgctgattcttttcttcatgtttgggtggagaatcctgttctgttttaagtgctgccgccggacaagaggactcttcaaataccgccatctgaaggacgatgaggaagtgggctatcggaaaattatcgagagactcaataacaagaagggcaaaaacaagctgcttgacggggaacgcctggcggatcggaaaatcgctgagctgttttctacgaagacccacattggatga

SEQ ID NO: 13560 - RNA, 5070 nt, synthetic construct
  misc_feature 1..5070: note = derived and/or modified CDS sequence (opt5) from CCHFV(SPU 130/89)__KJ682807.1__GP
  source 1..5070: mol_type = other RNA
atgcccttcaacatcatgtacacccctctgctctgcgccattctgtgtcttcagctgtggagcctcgagggcatctatgggctgtccaataagacacaacacaacgacaattctacgaccaaagctccggaagagagccataagacatcccttcccgccaacaccgcgtctcctattacaagcgatcccccttccaccacatctaccacgagcgcttccggacccgaaggcagcggggacacctctacatcccctccggtgaccacacagggacccgccagccctgagaccacgcccgaacctcacacaaccatcgatattgacaaatcttccacagccatcgctgatatcagcacccagaccgtcaaggacattcccacaccgacgacccatacatctctgccttccaccctcagcgcccccacaatccctcaggaggctcaccataccgccagaggcctgctgtccgttacgcggcacaaacccggggaggcgtctaagcccacaagccctggagaagcctccaccgaggcttcttcttcccaaccgaccattagcgaaacaccctctcctccccctaccacacaggcccccacggagatcaataacccgaataccagccgccagcctatgccctccacacagcctgctgccccctctagcgtgacccaccctgcgcaacccacaccgtcccagagcgatgtgcctaccgccgctcaggacattcatccctctcccacgaacagatccaagcggaatctcgagatggaaatcattctgacccttagccagggcctgaaaaagtactatggcaaagtcctcaagctgcttgatctgacactcgaggaagacaccgaggggctgctggaatggtgcaaacgcaacctcggactgacatgtgatgacaactttttccaaaagagaatcgaggagtttttccttaccggcgaagggcactttaatgaggtgctgcagttcaagacgccttctacactctccccgaccgaacccgcccgggttgagagccctacagtggaaccctttaaatcctacttcgctaagggatttctgtctatggatagcggctatttctccgccaaatgctaccctaagtctagcaattccgggcttcagctgatcaacgtcacccaacatctcattcgcatcaccgacacacccggacctaaaattacgaatctgaagaccatcaactgtattaacctgaaagccctcgtgtttaaggagcacagagagatcgaaatcaatgttctgcttccccaggtggctgtcaacctgagcaattgccacgtgctcattaagtctcatgtgtgtgactattccctggatatcgacggcccggtccggcttcctagcattcaccatgagggcacattcatccccgggacctacaaaattgttatcgataagaaaaacaagcagaatgaccgctgcacactggtgaccaactgtgtgatcaaaggaagagaaattcggaagggccagtctgtcctccgccaatacagaacggagatcaagattgggaaagcgtccagcggatctcggcgcctgctgagcgaggaacctaattatgattgcctctccagaacacagctgcttcggaccgagaacgccgaaatccacagcgacaattacggcgggcccggagataagattaccatctgtaacggctctacaattgtggaccagagactgggctccgagctcgggtgctataccatcaatcgcgttaagagctttaagctgtgcgaaaactccgctacaggaaaatcttgtgagatcgatagcacgccggtgcggtgcagacagggcttctgtctgaagattacccaagaggggcgcggacatgtcaaactttcccggggctctgaagtggttctcgacgcctgcgatagctcctgtgagatcatgattcctaaagggacaggcgacatcctggtggactgctctggaggccagcagcacttcctgaaggataatctcgtcgacctggggtgtcccaacattcctcttctgggaaaaatggccatctacatctgcagaatgagcaatcaccccaagaccacaatggcttttctcttctggttttccttcggctatgtgattacctgtatcctgtgcaaagtcatcttttacctgcttattgtggttgggacgctcggaaagaagttcaaacagtatcgcgaactgaagccccaaacctgtacaatttgcgagaccaaccctgtgaacgccatcgatgcggaaatgcatgacctgaattgcagctacaacatctgtccgtactgcgcttctcggctcacatccgatggcctggccagacacgtcatgcagtgtcccaaacgcaaggagaaaattgaggaaaccgagctttatctgaatctcgaacggatcccttgggtggttagaaagctgcttcaggtgagcgagtctacaggggtcgcccttaaacgctccagctggctcgtggtgctgctggttctcctgaccgtctctctttcccccgtgcagagcgctcctatttcccatggcgaaacggtggaggtctaccaaacacgggagggatataccagcatctgcctgtttgtgctcggctctattctgttcctggttagctgtcttatgaaggggctcgtggactccgtcggaaacagctttttccccggcctgagcatctgcaagacctgttccatcgggtctattaatggatttgaaatcgagagccacaaatgctactgttccctgttctgctgtccttattgcagacactgctctgccgatattgaaatccataagctccacctgagcatttgtaaaaagcggaaaacaggctccaacgtgatgcttgctgtttgcaagcgcatgtgttttagagccaccgtggaggtcagcaataaggcgctgctcatccggaacattatcaatacgacattcgtggtttgcatcctgattctggccgtgtgtgtcgtgtctacctccgctgtggaaatggagaaccttccggccgggacatgggagaaagaagaggacctgaccaatttctgccatcaggaatgtcaggtcacagagaccgagtgcctctgtccctacgaagctctggttctcagaaagcctctgagccttgattctatcgtgaaaggcatgaagaacctgctcaattccacgagcctggagacctccctgtctattgaagccccctggggagcgatcaacgtgcaaagcacatttaaacctaccgtctccgccgctaatattgcccttagctggtcttccgtggagcaccgcggcaacaagatcctggttagcgggcggtctgaaagcatcatgaagctcgaggagagaacaggaatttcctgggacctgggcgtggaagatgcttctgagagcaaactcctgaccgtctccgtgatggacctttctcagatgtatagccccgttttcgaatacctgtccggggatcgccaggtggaggaatggccgaaggccacgtgcacaggagactgtcctgagagatgcggctgcaccagctctacatgtctccataaagagtggccccactcccggaactggcgctgcaatcccacctggtgttggggcgtcgggaccggatgcacatgttgcggcctggacgtgaaggatctgtttacggactacatgttcgttaaatggaaggtggattatatcaagaccgaagccattgtctgtgtggagcttacaagccaggaaagacaatgctccctgatcgaggctgggacccggtttaacctcggacctgtgacaattaccctgtctgaaccccgcaatatccagcagaaactccctccggagatcgtcacgctgcaccccagaattgaggaaggcttctttgaccttatgcatatccagaaggttctgagcgcgtccacagtgtgtaaactgcaatcttgcacccacggggtgcctggagatctccagatttaccatatcggcaacctgcttaagggcgacaaagtcaatgggcacctgattcataagatcgagccccacttcaacaccagctggatgtcctgggatggatgtgacctcgattattactgcaatatgggcgactggcctagctgctcttatacaggggtgacccagcacaaccatgccgcttttgttaatatgctgaacattgaaacagattacacgaaaaatttccactttcattccaagcgggtgaccgcccacggagacacaccccagctcgatctgaaggcccgcccgacctatggcgctggggagatcacagtccttgtggaggttgccgacatggaactgcacaccaaaaaggtggagatcagcggactgaaattcgcgtctctcacgtgtaccggctgctacgcttgttccagcggcatttcttgcaaggtcagaatccatgtggacgaacctgatgagctgacagtccacgtgaaaagcgaagaccccgatattgttgccgcctcctctagccttatggctcggaagctggagtttgggaccgactccacattcaaggccttcagcgcgatgcctaaaacctccctctgtttttacatcgtggagcgcgaacattgcaagtcttgtagcaaagaggatacacaaagatgcgtcaacacgaagctggaacagccccagtccattctcatcgagcacaaaggaaccatcattggcaagcaaaatgacacatgtaccgctaaggcctcttgctggctggaaagcatcaaatccttcttttatgggcttaagaacatgctgtctggaattttcggcaatgtgtttatcggggttttcctgtttctcgcccctttcattatcctgatcctgtttttcatgtttggatggcggattctgttctgtttcaaatgctgcagacgcacccggggcctcctgaagtacagacatctcaaagatgacgaggagatcggctatcgcaagattatcgaacggctgaacaacaagaaagggaagaataaacttctggatggagagagactggctgaccgcaagattgccgaactctttagcacaaaaacgcacatcggctga

SEQ ID NO: 13561 - RNA, 5070 nt, synthetic construct
  misc_feature 1..5070: note = derived and/or modified CDS sequence (opt5) from CCHFV(SPU 383/87)__KJ682806.1__GP
  source 1..5070: mol_type = other RNA
atgcccttcaacatcatgtacacccctctgctctgcgccattctgtgtcttcagctgtggagcctcgagggcatctatgggctgtccaatagaacacaacacaacgacacgtctaccattaaggtgccggaagagagccagaaaacatcccttcccgctaataccgcctctcctatcacaagcgatcccccttccaccacatctaccgcgagcgcttccggacccgaaggcagcggggacacgtctacctcccctccggtcacaacccagggacccacacctcccgagaccacgcctgaaccccatacaaccattgatatcgacaagagctctacagccatcgccgatatttccacccagaccgttaaagacatcccgacacctacgacccacacaagcctgccctctaccctctccgctcctacaattccccaagaggcccatcacaccgctcggggcctgctgagcatcacgtccacaaagcccggggaggcctctacccctattagcccgggagaagcgtccaccgaggccagctctccccagcctacaatctccgaaacccccagccctcccccgacagctcaggcccctacggagattaactctcccaataccagccgccagcctatgccctccacacaacctgctgcccccaactctgtgacccatccggcgcagcctacacccagccagtccgatgtgcccaccgccgctcaggacatccaccctaatccgatcaacagaagcaaacggaatctcgagatggaaattatcctgacgctttctcaaggcctgaagaagtactatggcaaagtcctcaagctgcttgatctgaccctcgaggaagacacagaggggctgctggaatcctgcaaacgcaacctcggactgacctgtgatgacaactttttccagaagagaattgaggagtttttccttacaggcgaagggcactttaatgaggtgctgcagttcaaaacccccagcacgctctctcctacagaacccgcccgggttgagtcccctaccgtggaaccctttaagagctacttcgctaagggatttctgtccatggattctggctatttcagcgccaaatgctactccaagtctagcaattccgggcttcaactgatcaacgtcacacagcatctcattcgcatcaccgacacccctggacccaaaatcacaaatctgaagacgattaactgtatcaacctgaaagccctcgtgtttaaggagcacagagagattgaaatcaatgttctgcttccccaggtggctgtcaacctgagcaattgccatgtgctcattaaatctcacgtgtgtgactattccctggatatcgacggccctgtccggcttccccgcatccaccatgagggcaccttcattcctgggacatacaagatcgttattgataagaacaataaacagaacgacagatgcaccctggtgacaaattgtgtgatcaagggacgggaaattcgcaaaggccaaagcgtcctcagacagtaccggaccgagatcaagattgggaaagcgtcttccggaagccgcagactgctgtctgaagagagcaacgatgactgcctctcccggacgcagctgcttagaacagagaatgccgaaatccacagcgataactatggcgggcccggagacaagatcaccatttgtaatggctctaccatcgtggatcagcgcctgggctccgagctcgggtgctacacaattaaccgggttaagagctttaaactgtgcgaaaattccgctaccggaaagtcttgtgagatcgacagcacaccggtgagatgccgccaaggcttctgtctgaaaattacgcaggaggggcggggacatgtcaaactttccagaggctctgaagtggttctcgatgcctgcgacagctcctgtgagatcatgatccctaaagggaccggcgacattctggtggattgctctggaggccagcagcacttcctgaaggacaacctcgtcgatctggggtgtcccaatatccctcttctgggaaagatggccatttatatctgccgcatgagcaaccatcccaaaacaaccatggcttttctcttctggttttccttcggctacgtgattacatgtatcctgtgcaaggtcatcttttatctgcttgtggttgtggggaccctcgggaaaaagttcaaacaataccgggaactgaagccccagacgtgtaccatttgcgagacaaaccctgtcaatgccatcgacgcggaaatgcacgatctgaactgcagctataatatttgtccgtactgcgcttctagactcacctccgacggcctggcccgccacgtgatccagtgtcccaagcggaaagagaagattgaggaaacagagctttacctgaacctcgaaagaatcccttgggttgtgcgcaaactgctgcaggtcagcgagtctaccggggtggcccttaagcggtccagctggctcgtgatcctgctggttctcctgacagtctctctttcccccgtgcaaagcgctcctatttcccatggcgaaaccgtggaggtctatcagacgagagagggatacacaagcatctgcctgtttgtgctcggctctattctgttcctggttagctgtcttatgaaagggctcgtggattccgtcggaaatagctttttccccggcctgagcatctgcaagacctgttccattgggtctatcaacggatttgaaattgagagccacaaatgctattgttccctgttctgctgtccttactgccggcattgctctgccgacatcgaaatccaccgcctccacctgagcatttgtaagaagagaaaaaccggctccaatgtgatgcttgctgtttgcaagcggatgtgttttagagccacagtggaggtcagcaacaaagcgctgctcatccgcaatattatcaacaccacgttcgtggtttgcattctgatcctggccgtgtgtgtcgtgtctacatccgctgtggaaatggagaatcttccggccgggacctgggagaaggaagaggatctgacaaacttctgccatcaggaatgtcaagtcaccgagacagagtgcctctgtccctatgaagctctggttctccggaaacctctgtttcttgacagcatcgtgaagggcatgaagaatctgctcaactctacctccctggagacgagcctgtccattgaagccccctggggagcgatcaatgtgcagtctaccttcaaacctacagtcagcgccgctaacattgccctttcctggagctctgtggagcacagaggcaacaagatcctggtttccgggcgcagcgaatctattatgaaactcgaggagagaaccggaatcagctgggatctgggcgtggaagacgcttccgagtctaagctcctgacagtcagcgtgatggatctttcccagatgtactctcccgtttttgaatatctgagcggggaccgccaggtggaggaatggccgaaagctacctgcacgggagactgtcctgagcggtgcggctgcacatccagcacctgtctccataaggagtggccccactctagaaattggcggtgcaaccccacatggtgttggggagtcggcaccggatgcacctgttgcggcctggatgtgaaggacctgttcacagattacatgtttgttaaatggaaggtggactacatcaaaacggaagccattgtctgtgtggagcttacctcccaagaacgccagtgcagcctgatcgaggccgggacaagattcaatctcggacctgtgaccattacactgtccgaaccccggaacatccagcagaagctccctccggagattgtcaccctgcatccccgcatcgaggaaggctttttcgatcttatgcacattcaaaaagttctgtctgcgagcacggtgtgtaagctgcagtcctgcacacacggggtgcctggagacctccagatctatcatatcggcaatctgcttaagggcgataaagtcaacgggcacctgattcataagatcgagccccactttaatacctcttggatgagctgggacggatgtgatctcgactactattgcaacatgggcgattggccttcctgcagctacaccggggtgacacagcataatcacgccgctttcgttaacatgctgaatattgaaaccgactatacaaagaactttcacttccattctaagagagtgacggcccacggagataccccgcaactcgacctgaaagcccggccgacatacggcgctggggagatcaccgtccttgtggaggttgccgacatggaactgcatacaaagaaaattgagatctccggactgaagtttgcgagcctcacctgtacgggctgctatgcttgttcttccggcatcagctgcaaggtgcgcattcacgtcgatgaacctgacgagctgaccgtgcacgtcaaatctgaagatcccgacatcgtggccgccagctcctctcttatggctagaaagctggagttcgggacagatagcaccttcaaagccttttccgcgatgcctaagacaagcctctgtttctacattgttgagcgggaatactgcaaatcctgttctaaggaggacacccagaagtgcgtgaatacaaaactggaacagccccaaagcatcctcattgagcataagggaacgatctttggcaaacagaacgatacctgtacagctaaggcctcctgctggctggaatctgtcaaatctttcttttatgggcttaagaatatgctgtccggaatcttcggcaacgtgtttattggggttttcctgtttctcgcccctttcatcatgctgattcttttctttatgttcggatggagaatcctgttttgtttcaagtgctgccgccggaccagaggcctctttaaataccgccacctgaaggacgatgaggagattggctatcggaaaatcattgaaagactcaacaataagaaagggaagaacaagctgcttgacggagagcgcctggctgatcggaaaatcgccgaactgttctctaccaagacacatatcggctga

SEQ ID NO: 13562 - RNA, 5070 nt, synthetic construct
  misc_feature 1..5070: note = derived and/or modified CDS sequence (opt5) from CCHFV(SPU 44/08)__KJ682805.1__GP
  source 1..5070: mol_type = other RNA
atgcccttcaacatcatgtacacccctctgctctgcgccattctgtgtcttcagctgtggagcctcgagggcatctatgggctgtccaataacacacaacacaatgacacgtctaccattaaggtgccggaagagagccagaaaacatcccttcccgctaacaccgcctctcctatcacaagcgatccccctcccaccacacctaccgcgtccgcttctggaccggaaggcagcggggacacgtccaccagcccgcctgtcacaacccagggacccacacctcccgagaccacgccggaacctcatacaaccattgatatcgacaagtcttccacagccatcgccgatattagcacccagaccgttaaaaatatccccacacctacggctcacacctctctgccctccacactcagcgcccccaccatgcctcaagaggctcatcacacagccagaggcctgctgtctgtgacctccacgaagccgggggaggcgagcacacccacctcccctggagaagcctctaccgaggctagcagcccccagcctacaattcgggaaacccccagcccgcctcccacaacgcagacccctacagagatcaacaatcccaacacctctcgccagcctatgccctccacacaaccggccgctcctagctctgtgacccatcccgcccagcccacgcctagccagtccgacgtcccgaccgcggcccaggatattcacccctctcctacaaatagaagcaaacggaacctcgagatggaaatcattctgaccctttcccaaggcctgaagaagtactatggcaaagtgctcaagctgcttgacctgacactcgaggaagataccgaggggctgctggaatggtgcaaacgcaatctcggactgacgtgtgacgataactttttccagaagagaatcgaggagtttttccttacaggcgaagggcactttaatgaggttctgcagttcaaaacccccagcacactctctcctaccgaacccgctcgggtggagtcccctaccgtcgaaccctttaagagctacttcgccaagggatttctgcttatggactctggctatttctccgctaaatgctaccccaagagctccaactctgggctgcaactcatcaatgtgacacagcatctgattcgcatcacggatacccctggacccaaaattacaaacctgaagaccatcaactgtattaatctcaaagccctggtttttaaggagcacagagagatcgaaatcaacgtgcttctgcctcaggtcgccgtgaatctcagcaactgccatgtgctgattaaatcccacgtctgtgactattctatcgacattgatggccccgttcggcttccgcgcatccaccatgagggcacattcattcctgggacctacaagatcgtgatcgacaagaaaaataagcagaacgatagatgcacgctggtgacaaattgtgtcattaaaggacgggaaatccgcaagggccaaagcgtgctcagacagtaccggaccgagattaaaatcgggaaggcttccagcggatctcgcagactgctgtccgaagagagcaacgacgattgcctctctcggacccagctgcttagaacagagaatgcggaaattcactccgacaactatggcgggcccggagataagatcaccatttgtaatggcagcacaatcgttgaccagcgcctgggctctgagctcgggtgctacacgatcaaccgggtgaaatcctttaagctgtgcgaaaattccgccaccggaaaaagctgtgagattgattctacacctgtcagatgccgccaaggcttctgtctgaagatcacccaggaggggcggggacatgtgaaactttccagaggcagcgaagttgtgctcgacgcttgcgattcctcttgtgagattatgatccccaaggggacaggcgacattctggtcgactgcagcggaggccagcagcacttcctgaaggataacctcgtggacctggggtgtcccaatatccctcttctgggaaaaatggccatctatatttgccgcatgtccaaccatccgaagaccacgatggcctttctcttctggttttctttcggctacgtcatcacctgtattctgtgcaaagctatcttttatctgcttattgtggttgggacactcggaaagaaattcaagcaataccgggaactgaagccccagacctgtacaatctgcgagaccaaccctgtgaatgccatcgatgcggaaatgcacgacctgaactgcagctataatatttgtccctactgcgcttccagactcacatctgatggcctggcccgccacgtcatgcagtgtcctaaacggaaggagaaaatcgaggaaaccgagctttacctgaacctcgaacgcattccctgggtggttagaaagctgcttcaggtgagcgagtccacgggggtcgccctgaaacggagctcttggctcgtgatcctgctggtgctcctgacagtttcccttagccctgtccaatctgctccgatttcccatggcgaaaccgtggaggtgtatcagaccagagagggatacacaagcatctgcctgtttgtcctcggctctatcctgttcctggtgtcctgtcttatgcgggggctcgttgacagcgtgtccaatagctttttccccggactgtctatttgcaagacctgtagcatcggctccattaacgggtttgaaatcgagtctcacaaatgctattgtagcctgttctgctgtccttactgccgccattgctccgccgatattgaaatccacaagctccacctgtctatttgtaagaaaagaaagacgggaagcaatgtcatgcttgctgtgtgcaaacggatgtgttttagagccacagttgaggtgtccaacaaggcgctgctcatccgcaatatcattaacaccacattcgtcgtgtgcatcctgattctggccgtttgtgtggtctctaccagcgctgtggaaatggagaatcttcccgccggcacatgggagaaagaagaggacctgaccaacttctgccatcaggaatgtcaagtgacggagaccgagtgcctctgtccttatgaagctctggtcctccggaagcccctgtttcttgattccatcgttaaggggatgaaaaatctgctcaacagcacatctctggagacctccctgagcattgaagccccgtggggcgcgatcaatgtgcagtctacattcaagcctaccgtgtccgccgctaacatcgcccttagctggtcctctgtcgagcacagaggaaacaaaattctggtgagcggccgctccgaaagcatcatgaagctcgaggagagaacggggatttcttgggacctgggagttgaagatgcttccgagagcaaactcctgacagtgtctgtcatggaccttagccagatgtactcccccgtgtttgaatatctgtctggcgatcggcaggttgaggaatggcccaaggctacctgcacaggggactgtcctgagcgctgcggatgcaccagctccacctgtctccataaggagtggccccactctagaaattggcggtgcaaccctacatggtgttggggcgtggggacgggctgcacctgttgcggactggacgtcaaagatctgttcacagactacatgtttgtgaagtggaaagttgattacatcaagaccgaagccattgtgtgtgtcgagcttacaagccaagaacgccagtgctccctgatcgaggccggcaccagattcaatctcgggccggtgacgatcacactgagcgaaccccggaacattcagcagaaactccctcccgagatcgtgaccctgcatcctcgcattgaggaaggatttttcgaccttatgcacatccaaaaggtcctgtctgcgtccaccgtttgtaagctgcagagctgcacacacggcgtgcccggggatctccagatttatcatatcggaaatctgcttaaaggcgacaaggtgaacggccacctgattcataaaatcgagccgcactttaatacctcctggatgtcttgggatgggtgtgacctcgattactattgcaacatgggagactggcctagctgctcctacacaggcgtcacgcagcataatcacgccgctttcgtgaacatgctgaatatcgaaaccgattatacaaagaactttcacttccattctaaaagagttaccgcccacggggacacaccccaactcgatctgaaggcccggcctacctacggagctggcgagattacggtgcttgtcgaggtggccgacatggaactgcataccaaaaagatcgagattagcgggctgaagtttgcgtccctcacatgtaccggatgctatgcttgtagctctggcatctcctgcaaagttcgcattcacgtggacgaacccgatgagctgacagtccacgtgaagtctgaagaccctgatatcgtcgccgcctcttccagccttatggctagaaaactggagttcggcaccgactctacattcaaggcctttagcgcgatgcccaaaacgtccctctgtttctacatcgtggagcgggaatactgcaagtcttgtagcaaggaggatacccagaaatgcgttaatacaaagctggaacagccgcaatccattctcatcgagcataaagggaccattatcggaaagcagaacgacacctgtacagctaaagccagctgctggctggaatccattaagagctttttctatggccttaagaatatgctgagcgggatctttggaaacgtgttcatcggcatttttctgttcctcgccccttttatcatgctgattcttttctttatgttcgggtggagaatcctgttctgttttaaatgctgccgccggacgagaggactcttcaagtaccgccacctgaaagatgacgaggagattggctatcggaagatcattgaaagactcaacaataaaaagggcaagaacaaactgcttgatggggagcgcctggctgaccggaagatcgccgaactgttttccaccaaaacacatatcggatga

SEQ ID NO: 13563 - RNA, 5070 nt, synthetic construct
  misc_feature 1..5070: note = derived and/or modified CDS sequence (opt5) from CCHFV(Matin)__AF467769.2__GP
  source 1..5070: mol_type = other RNA
atgagcttcaacatcatgtacaccctgctcctgtgcgccattctttgttcccagctgtggtctagcgagggcatccacgggctctccaatgaaacacaacatggaaacgcttctacgattaaggcccccgaggtgagccagggcctggggcttcctgtctccaccgcgccgcccatcacatctgaccctcccagcattacctccgctgccagcgtttctggacctgaaggctccggggatacaaataccagccctcccgtgacaacccagggactgacgctcccggagaccacactggaactgctcaccacaaccaacacgggcgcctcttccacagtgatcgtcgacgtgagcacccagacagttaaagatacccccgtgtctaccgctcacacatcccctcccggcacgcctagcgcccccaccacaccgcaagggacccatcacacagctagaggactgctttccgtcacctctacgaagtccgaggaggcctccacacagaccaatcctaaaaagaccagcatggaaacaaactctcccggccctgcgacctccgagacacccagcccctctcctacgacccaggccccgacagaaaataacaatcccaacacccctcggcagcccacacctcccacccaaccggctacgcctagccccgtgacctcccctgccctgctcgcttctagccagggggacacatccaccgccgttcaggatgtgcatcccagccctacaaatcgctctaaaagaaacctggagatggagatcattcttaccctgtcccagggactcaagaagtattacggcaaaatcctgaagctgctcgacctgacgcttgaagaggatacagaagggctgctcgagtggtgcaaacggaatctgggacttgtctgtgacgatagctttttccaaaagcgcattgaagagtttttcctgaccggcgagggccactttaacgaagtgctccagttcaaaacaccctctaccctgtccccgaccgagcctgcgagagccgggagccccacagtggaaccctttaagtcctatttcgctcggggactgctctctatggacagcggctacttttccgccaagtgctatcctcgcgcttctaatagcgggctgcagcttatcaacattacgcaacactccgccagaatcaccgatacaccgggacccaaaattaccaacctgaagacaatcaattgtatcaacctcaaagccagcaccttcaaggagcatcgggaaattgagatcaatgtcctgcttcctcaggttgctgtgaacctgtcttcctgccacgtgctcattaaaagccatgtctgtgactactctctggatatcgacggccccgtgcgcctgcctcggattcaccacgaggggacgtttatccccggaacatataagatcgttattgacaaaaagaataagcagaacgatagatgcaccatcgtgaccaattgtgtcattaaaggccgcgaaatcagaaagggccagtccgtgctccggcaatacaaaacagagattaagatcgggaaagcgagctctggaagccgcagactgctttccgaagagagcggcgacgattgcatctctcggacccagctgctcagaacagaaacggccgagattcattccgacagctacgggggacctggcgataagatcaccatttgtaacgggtccacagttgtggaccagcgcctgggctctgagctgggatgctataccatcaatcgggtcaagagcttcaaactttgcgaaaactccgctacaggcaagtcttgtgagattgatagcacccccgtgaaatgcagacaggggttttgtctcaagatcacgcaagaaggacgcggccacgtcaaactgtcccgggggtctgaggtggttctggacgcctgcgatagctcctgtgagattatgatcccgaagggaaccggcgacatcctcgtggattgcagcgggggccagcagcatttcctgaaggacaatcttattgacctgggatgtcctaacatccccctcctgggcaaaatggccatttacatctgcagaatgtctaatcaccctaagacaaccatggtcttcctgttttggttctcctttgggtatgtgattacatgtatcctttgcaaagttatcttctacctcctgattgtggtcggaaccctgggcaagaaatttaagcagtatcgcgaactcaagccccaaacatgtaccatctgcgagacgacaccggtgaacgctattgatgccgaaatgcatgacctgaattgcagctacaacatctgtccttattgcgcgtctcggcttacctccgatgggctggctagacacgtgatgcagtgtcccaaacgcaaggagaaaattgaagagaccgagctctacctgaacctggaacggatcccttgggttgtcagaaagctgctccaggtgagcgagtctacaggagtggccctgaaacgctccagctggctggtcgtgctcctggttcttctgaccgtgtccctcagccccgtccagtctgcccccatcggccacgggaagacggtggaaacataccaaattcgggagggctataccagcgtttgcctgttcgtgctgggatccatcctttttattgtctcttgtctcatgaaaggcctggtggacagcgatgggaatagcttctttcctggactgtctatctgcaagacatgtagcattggctccatcaacgggttcgaaatcgagtctcataagtgctactgtagcctcttttgctgtccgtattgcagacactgctccaccgaccgggagattcataaactgcaccttagcatctgtaagaaacgcaagacaggatctaatgttatgctggctgtgtgcaaaagaatgtgtttccgggccaccgtcgaagtgtccaacaaggctctcctgattagaagcatcattaatacgacctttgtggtctgcatcctgattcttgccgtttgtgtggtgtctacatccgcggtcgagatggaaagcctgcccgccggcacctgggagcgcgaagaggatctcatcaacttctgccaccaggagtgtcaggtgacagaaaccgagtgcctgtgtccttacgaagctctcgttctgcggaagccccttttcctggactccatcattaaagggatgaagaatctcctgaactctacgagcctggagacatcccttagcatcgaggccccttggggcgctattaatgtgcaatctacctttaaacccacaatgtccgccgcgaacatcgccctgagctggtctagcgtcgaacatagaggaaataagattctcgtgtccggccgctctgagagcatcatgaaactggaagagagaaccgggatctcctgggatctcggagttgaagacgcttctgagagcaagctgcttaccgtgtccgtcatggatctgagccagatgtattctcctgtgttcgagtacctctccggcgaccggcaggttgaagagtggccgaaggccacatgcacgggggattgtcccgaacgctgcggatgcaccagctccacatgtctgcacaaagagtggcctcattctagaaactggcggtgcaatcccacctggtgttggggcgtgggcacagggtgcacctgttgcggactggacgtcaaggacctttttacggattatatgttcgtgaaatggaaggtggaatacattaaaacagaggtcatcgtttgtgtggagctgaccagccaggaacgccaatgctccctcattgaggctggcaccagatttaacctggggcctgtgacaatcaccctctctgaaccccggaatattcagcagaagctgccgcctgagatcgtcacacttcacccccgcatcgaagagggattctttgacctgatgcatgtgcagaaggttctgagcgcctccacggtgtgtaaactccaaagctgcacccacggcgtccccggggatcttcaggtgtaccacattggaaaccttctgaagggcgacaaagttaacggccatctcatccacaagattgagcctcatttcaatacatcttggatgtcctgggatgggtgtgacctggattattactgcaacatgggagactggcccagctgctcttataccggcgtgacacagcacaatcatgccgcttttgtcaacatgctctccatcgaaaccgattacacgaaaaatttccactttcacagcaagagagtgaccgcgcatggggacacacctcagctggatcttaaagcccggccgacctatggagctggcgagattacagtcctggtggaagttgccgacatggagctgcacaccaagaagatcgagatttctgggctcaaattcgccagcctgacatgtacgggatgctacgcttgttcctctggcatcagctgcaaggtgcgcatccatgtcgatgaacccgacgagcttaccgtgcacgttaaatccgaagaccctgatattgtggccgcgagctcctctctgatggctagaaagctcgagtttggcacagacagcaccttcaaagccttctccgccatgcccaagacctctctgtgtttttatatcgtcgaacgggagtactgcaagagctgttccaaagaggatacacaaaagtgcgtgaacacgaaactcgaacagcctcagtctattctgatcgagcacaaggggaccattatcggaaaacaaaatgacacatgtaccgctaaggccagctgctggcttgaatccgttaagagcttcttttacggcctgaaaaacatgctgtctgggatcttcggaaatgtgtttattggcatcttcctctttctggcgcccttcgcccttctgattctctttttcatgtttgggtggagaatcctgttctgtttcaagtgctgccgccggacaagaggactctttaaatatcgccatctgaaggatgacgaggaaaccggctaccggaaaattatcgagagacttaacaataagaagggcaaaaacaagctgctggatggggagcgcctcgctgaccggaaaatcgccgaactgttctccacgaagacacacgtcggatga

SEQ ID NO: 13564 - RNA, 5070 nt, synthetic construct
  misc_feature 1..5070: note = derived and/or modified CDS sequence (opt5) from CCHFV(TADJ/HU8966)__AY179962.1__GP
  source 1..5070: mol_type = other RNA
atgcccgtgagcatcatgcacatgctgctcatgtgcgccgtcctgtgtcttcagctgtacggcctcgggggaaccctgagatccaacaatggcacagagcataacaagacgaatgttcttaccacacctggggacaaactgtctccggaaccccctgtgagcaccgctctccccgtgacacctgattcctctaccgtcacacccaccacgcctgccagcggactggagggctccggggaagtgtatacctctccgcccattacaaccaagggactgagcccttccgaggcgacaagcgaaccccctgctaccacgggcatgggcatctcttccgccagcggggttgacttctctacacaagccgctcgggatacctccacactcaccgtgctgaccagcccgcccaactctcctaatacaccccctacgtcccaggacacccaccatcccgtccgcagccttctgtccgtgacatctcccagacctgaggagaccacagccccgagcaaatccggaaaggaaagccccgctgccaactcttcccaccctgttaccagccggccctctagccctctcattacggtgcgcggccccacagaaaattcctctcataacaccaccgggcagctggaaagcatgacacagtccaccacacttgtcccgatggcgagccctacgcaaaccgtgctgtctcagtccgtgacaagcatcgccgtccaggatgctcacccctcttccaccaatagaagcaaacggaacctcgagatggagattatcctgacactgcctcagggactcaagaagtactatggcaaagttctgcgccttctgcaactcaccctggaagaggacacggaagggcttctggagtggtgcaagagaaatctcggactggattgtgacgatacctttttccagaaacggatcgaagagtttttcattacaggcgagggccactttaacgaagtgctgcagttccgcacccccgggacactctccaccacggagtctacacatgccggaagccctaccgctgaaccctttaagtcctacttcgccaaaggctttctgtctatcgacagcgggtatttctccgcgaagtgctacagcagaacatctaattccggacttcggctgattaacgtgacccgccacagcaccagaatcgccgatacaccgggccctaagattacgaatctcaaaaccatctcttgtattaacctgcgggcttccatctttaaggagcatcgcgaagtcgagatcaacgtgcttctgccccaggttgccgtgaatctcagcaactgccacgtcgctattaaatctcacgtgtgtgactatagcctggatgttgacgggacagtgagactgccccatatccaccatggaggcaccttcattcctggcacatacaagatcgtcattgacaaaaagaataaactcaacgatcggtgcaccctgtttacgaattgtgtgatcaaggggagagaggtccgcaagggacaatccatccttcggcagtacaaaacagaaattagaatcggcaaggccagcaccgggtctcgccggctgctctccgaggaaagcggagacgattgcatttccagaacccagctgctgcgcacagagaccgccgaaatccacggcgacgattatgggggcccgggagacaaaattacaatctgtaacggctctacgatcgtggatcaacggcttgggagcgagctcggatgctacaccattaatagagttaagtccttcaaactgtgcgagaactctgctacaggcaagaattgtgaaatcgacagcgtgcccgtcaagtgccgccaggggtattgtctgaaaattacccaggagggacggggccatgtgaagctctccagagggtctgaagttgtgctggatgcgtgcgacagctcctgtgaggtcatgatccctaaaggcacaggagatattagcgtggactgctctggcgggcagcaacacttccttaaggacaacctgatcgatctcggatgtcccaaaattcctctgctgggcaagatggccatctacatctgccgcatgtccaatcaccccaagaccacgatggcttttcttttctggtttagcttcgggtatgtgattacccggatcctctgtaaagccatcttttacctgctgattattgttggaacactcggcaagagattcaaacagtatcgggagctgaagcctcagacctgcacaatctgtgaaaccacacccgccaacgctatcgacgccgagatgcatgatcttaattgctcttacaacatttgcccgtactgtgcgtcccgcctgaccagcgacgggctcgctagacacgtcacgcagtgccctaaacggaaggaaagagtggaggaaacagagctgtatctgaatcttgagcgcatcccctggattgtgcggaagctcctgcaagtctctgaatccaccggcgtggccctgaaaagaagctcctggctcatcgttctgcttgtgctgtttaccgtcagcctctctcctgtgcagagcgcccccattggatacggcaacacaatcgagacctatcaggctcgcgaagagtacacgtccatctgtctgttcgttctggggtctattctttttatcgtgagctgcctcatgaagggactggtcgattccattggcaacatcttctttccggggctgacaatttgtaaaacctgctctatcggaagcatcaatggcttcgaaattgagtcccataagtgttattgctctctcctgtgttgcccttactgtagacactgcagcgccgaccgggagatccaccagcttcatctgtccatttgcaaaaagcgcaaaacagggagcaacgtgatgctcgctgtttgtaagagaatgtgctttcgggccaccatggaagtgtctaataaggcgctgctgatccgctccattatcaacacaaccttcgtcgtgtgtattcttatcctggccgtgtgcatcgtcagcacgtctgctgttgagatggaatccctccccgccggcacctgggagagagaagaggatctgacaaatttctgtcaccaagagtgccaggtgaccgaaacagagtgtctctgcccttatgaagctctggtgcttcggcgccccctgtttctcgacagcattgtcaaaggaatgaagaaccccctgaatagcacctctctggagacgagcctttccatcgaggccccttggggcgcgattaacgtgcagagcacatacaaaccgaccgtttctacagccaatatcgctctgtcctggagctctattgaacatagagggaacaatatcctcgtgagcggacggtccgagtctatcatgaagctggaggagcgcaccggcattagcggggatctcggagtcgaagacgcctccgagtctaaactgcttaccgtgagcgttatggatctgtcccagatgtacagccccgtgttcgagtatctctctggcgacagacaagtcgaagagtggcctaaggctacatgtacgggcgattgccccgaacggtgtgggtgcacctccagcacatgcctgcacaaggagtggcctcattccagaaactggcgctgtaatcccacctggtgctggggagtgggcacagggtgtacctgctgtggactggacgttaaagacctttttatcgattacatgttcgtgaagtggaaagtcgactatattaagacggaagccatcgtgtgcgtggagctgacatctcaggagcggcagtgtagcctcgtcgaagccggcaccagatttaacctggggcctgttaccattacactctccgagccgcgcaatatccaacagaaactgccccctgaaatcattacccttcacccccggatcgaggaaggattctttgatctgatgcacgtgcagaaggtgctgtctgctagcacagtctgcaagctccagtcctgtacgcatggcgtgcctggcgacctgcaagtttaccacattgggaaccttctgaaaggagataaggagaacggccatctcatccacaaaattgagccccatttcaataccagctggatgtcttgggacgggtgcgatctggactattactgtaacatgggagattggccgtcctgcacatataccggcgtgacacagcacaatcacgcgagctttgtcaacctcctgaatatcgaaaccgactacacgaagtctttccattttcactccaaaagagtgaccgcccatggggatacacctcagcttgacctgaaggctcgccccacctacggagccggcgagattacagttctggtggaagtcgccgatatggagctccacaccaagaaaatcgagatcacaggcctgaagttcgctagccttacgtgcaccgggtgttatgcctgctctagcggaatttcctgtaaagtgcggatccacgtcgacgaacccgacgagctgacagtgcatgttaagtctgatgaccctgatgtggtcgcggctagctccagcctcatggccagaaaactggaatttggcaccgactccaccttcaaggccttctctgctatgcccaaaacaagcctctgcttttacattgtggagcgcgaatatcggaagtcctgttctaaggaggatacgcagaaatgcgttaacaccaagctggagcaacctcagagcatccttattgaacacaaagggacaatcatcggaaagcagaataacacctgtacagccaaagcgtcctgctggctggagtctgtgaagtccttcttttacggcctgaagaatatgctctccgggattttcggaaacgtctttgtgggcatcttcctgtttcttgctccgttcattctgctcatcctgtttttcatgtttggctggcggattctcagctgtttcaaatgctgtagacgcaccagagggctgcttaagcatcggcacctgaaagacgatgaagagacgggatatcgcagaatcatcgaacggctgaataacaagaaaggcaagaataagctcctggacggggagagacttgccgatcgccggattgccgagctgttctctacaaaaacccatatcggatga

SEQ ID NO: 13565 - RNA, 5070 nt, synthetic construct
  misc_feature 1..5070: note = derived and/or modified CDS sequence (opt5) from CCHFV(88166)__AB069675.1__GP
  source 1..5070: mol_type = other RNA
atgagcttctccgtgatgtacacacccctgctctgcgccgtcctgtgtcttcagctgtggtctctcgagggcagccacgggctgtccaacaagacccaacattctaatacgagcaccacaaaagctcctgaagtttcccaggagcttggactgccggtgtctaccgtgagcacaatcacctccgatccccctagcattacatctgccgtctccgtgagcggctctgaagggtccggagacaccaacacgagcccctctgttaccacacagggccctaccctccccgagacaaccctggaacctctgacgacaaccgacacagatgcgtccagcaccgtggtcgtggacgtttccacccagacagtgaaggatacgccgatctctaccacatataccagcctcccctccacacctagcgagcccaccacgcctcaagggacacaccataccgctagaggactgctttctgtcacctccacaaaacccgaggaagccagcacccaggccaatccgggcaagatttctatggagacaaacagccctcggctggctatctccgaaacgccctcttttagccctaccacacaggcccccaccgaaaattccaaccccattacaagcaaacagctcatgctgtctgctcaacctgtgaccccgaatcccatgacgtcccctgtgcagcccgcccttagccagtctgacacctccacagcgatccaggatatccaccctagccccaccggccgctccaagagaaacctggagatggaaattatcctcacactgtctcaagggctgaagaaatactatggaaagattctcaaactgcttgacctgaccctcgaggaagatacggagggcctgcttgaatggtgcaagcggaatctggggctcgtctgtgacgataacttctttcagaaacgcatcgaggagttctttctgacaggaaagggccatttcaatgaagttctgcagtttaagaccccgagcacactctcccctaccgggcccgccagaaccggatctcctacagtggagcccttcaaaagctactttgctaagggcttcctgtccatggacagcggctatttttctgccaaatgctaccctcgggcttccaacagcgggcttcaactgattaatgtgacgcagcactctacccgcatcacagatacccccggaccgaagattacaaacctcaaaaccatcaattgtatcaacctgaaggcctccgtcttcaaagaacacagagagattgaaatcaacgtgcttctgcctcaggttgcggtgaatctcagctcttgccatgtcctgattaagagccacgtgtgtgactattccctggacatcgatggccccgttcggctcccccgcattcatcacgaggggacgtttatccctggaacatacaagatcgtgattgacaaaaagaacaaacagaatgatagatgcaccctggtcaccaactgtgtgatcaagggccgggagattcgcaaagggcaaagcgtccttagacagtaccggacagaaatcaagattggaaaggcctcttccggcagccgcagactgctctccgaggaatctggcgacgattgcatcagccggacccagctgctgagaacagagacggctgaaatccactccgacaattatgggggaccgggcgataaaattaccatctgtaacgggtctacagtggttgaccagcgccttggaagcgagctcggctgctacaccattaatcgggtgaagtccttcaaactgtgcgagaactctgccacaggcaagagctgtgaaatcgattccacccccgtcaaatgcagacaagggttctgtctgaagattacgcaggagggacgcggccatgtgaagctcagccgggggtctgaagttgtgctggacgcttgcgattccagctgtgagatcatgattcctaaaggaaccggcgacatccttgtcgactgctctgggggacagcagcactttctgaaggataatctcatcgacctgggctgtcccaacattcctctgcttgggaaaatggccatctatatttgcagaatgtccaatcatcccaagacaaccatgggcttcctcttttggttcagctttggatacgtggtgacatgtatcctgtgcaaagttattttctatctgctcatcgtcgtgggcaccctggggaagaagtttaaacaataccgcgagcttaagcctcagacatgtaccatctgcgaaacgacacccgtgaacgccattgatgctgagatgcacgacctgaattgctcttataacatctgtccgtactgcgcgtcccggctcaccagcgatggactggccagacatgtcatgcagtgtcctaaacgcaaggaaaagattgaggaaaccgagctgtaccttaatctcgagcggatcccctgggtggttagaaagctgcttcaggtgtccgaaagcacaggcgtcgctctcaaacgctctagctggctggtggttcttctggtgctcctgaccgtctccctgtctcctgtgcaaagcgcccccattgggcacggaaagacggttgagacatatcagacccgggaaggctacacatccatctgccttttcgtgctcgggtctatcctgtttattgtcagctgtctgatgaagggcctcgtggactccgtgggaaactctttctttccgggcctgagcatctgcaaaacctgttccattgggagcgtcaacggattcgagatcgaatctcacaagtgctattgttccctgttttgctgtccttactgcagacattgcagcgccgatcgggagattcaccgcctgcatctctctatctgtaaaaagagaaaaacatggtccaatgttatgctggctgtgtgcaagcggatgtgtttcagagccaccgtggaggtcagcaacaaggcgctgcttatccgcaatattatcaacacgaccttcgtgctgtgcattctcatcctggctgtttgtgtggtctccacatctgccgtggaaatggagagcctccccgccggcacctgggaacgggaggaagacctgacaaatttttgccaccaggagtgtcaagttaccgagacggaatgcctttgtccttatgaggctctggtgctcagaaaacccctgttctccgatagcattgtcaaggggatgaaaaacctgcttaattctacatccctggaaaccagcctctctatcgaggccccctggggagctattaacgtgcagagcacatttaagcctaccatgtccgccgcgaatatcgccctgtcttggagctccgttgagcaccgcggcaacaaaatcctcgtgtctgggagaagcgaatccattatgaagctggaggaacggaccggcatcagctggaatcttggagtcgaggacgcttctgaatccaagctgctcacagtgagcgtgatggatctgtcccagatgtactctccggtcttcgagtatctgagcggcgaccgccaggttgaggaatggcccaaagccacgtgcaccggggattgtcctgagagatgcggatgcacatcctctacctgtcttcataaggaatggccccacagccggaactggcgctgcaatcctacatggtgttggggcgtggggaccggatgcacgtgttgcggcctggacgtgaaagacctctttacagattacatgttcattaagtggaaagtcgagtacatcaagaccgaagctattgtgtgtgttgagctgacctcccaagagagacagtgcacactcatcgaagccggcacccggtttaacctggggcccgtgacaatcacgcttagcgagcctcgcaatattcagcagaagctgccgcccgaaatcgtcaccctgcatcctagaattgaggaaggattctttgacctcatgcacgtgcaaaaagttctgtctgcgtccacagtgtgtaaacttcagagctgcacccatggcgtccccggggatctccaggtgtatcacatcggaaacctgctgaaaggcgacaaggtcaacgggcacctcattcataaaatcgagcctcacttcaatacatcttggatgtcctgggatggatgtgacctggattactattgcaacatgggcgactggcccagctgcacctacacgggcgtgacccagcataatcacgccgcttttgttaacatgcttaatatcgagacagattataccaagaacttccattttcactctaaacgggtgacagcccacggggacaccccgcaactggatctgaaggctcgccctacatacggagccggcgaaattacggtcctcgtggaggttgccgacatggaactgcataccaagaaaatcgagattagcgggcttaagttcgcttccctgacatgtaccggatgctatgcgtgttctagcggcatctcctgcaaagtgcggattcacgtcgatgagcccgacgaactcaccgtgcatgttaagagcgaggaccccgatctggtggccgcttcctctagcctcatggccagaaaactggagttcgggacagactccacgtttaaggccttctctgctatgcctaagaccagcctttgtttttacatcgtcgagagagaatactgcaaatcctgttctaaggaggatacacagaaatgcgtgaataccaagctggagcagccccaaagcattctgatcgaacacaaaggaacaatcattggcaagcagaacaatacctgtacggccaaggcgtcctgctggctcgagagcgtgaaatctttcttttatggcctgaagaacatgctttccgggatcttcggaaatgtctttattggcgtgttcctgtttttcgctccttttatcctcctgattctcttcttcatgtttgggtggcgcatcctgttctgttttaaatgctgccggagaacacgcggacttttcaagtaccggcacctgaaagacgatgaagagaccggctatagaaagatcattgaacgcctgaacaataagaaagggaagaacaaactcctggacggagagcggcttgccgatagaaagatcgccgagctgtttagcaccaaaacacatattggctga

SEQ ID NO: 13566 - RNA, 5070 nt, synthetic construct
  misc_feature 1..5070: note = derived and/or modified CDS sequence (opt5) from CCHFV(8402)__AB069674.1__GP
  source 1..5070: mol_type = other RNA
atgagcttctccgtgatgtacacacccctgctctgcgccgtcctgtgtcttcagctgtggtctctcgagggcagccacgggctgtccaacaagacccaacattctaatacgagcaccacaaaagctcctgaagtttcccaggagcttggactgccggtgtctaccgtgagcacaatcacctccgatccccctagcattacatctgccgtctccgtgagcggctctgaagggtccggagacaccaacacgagcccctctgttaccacacagggccctaccctccccgagacaaccctggaacctctgacgacaaccgacacagatgcgtccagcaccgtggtcgtggacgtttccacccagacagtgaaggatacgccgatctctaccacatataccagcctcccctccacacctagcgagcccaccacgcctcaagggacacaccataccgctagaggactgctttctgtcacctccacaaaacccgaggaagccagcacccaggccaatccgggcaagatttctatggagacaaacggccctcggctggctatcagcgaaacgccctccttttctcctaccacacaggcccccaccgagaatagcaaccccattacatccaaacagctcatgctgagcgctcaacctgtgaccccgaatcccatgacgtctcctgtgcagcccgccctttcccagagcgacacctctacagcgatccaggatgtccacccttcccccaccgggcgcagcaagagaaacctggagatggaaatcattctcacactgtcccaaggactgaagaaatactatggcaagatcctcaaactgcttgacctgaccctcgaggaagatacggaggggctgcttgaatggtgcaagcggaatctgggactcgtttgtgacgataacttctttcagaaacgcattgaggagttctttctgacaggcaaggggcatttcaatgaagtgctgcagtttaagaccccgtctacactcagccctaccggacccgccagaaccggctcccctacagtggagcccttcaaatcttactttgctaagggcttcctgagcatggactccgggtattttagcgccaaatgctaccctcgggcttctaactccggacttcaactgatcaatgtcacgcagcacagcacccgcattacagatacccccggcccgaagatcacaaacctcaaaaccattaattgtatcaacctgaaggcctctgtgttcaaagaacacagagagatcgaaattaacgttcttctgcctcaggtggcggtcaatctctccagctgccatgtgctgatcaagtctcacgtttgtgactatagcctggacattgatgggcccgtgcggctcccccgcatccatcacgagggaacgtttattcctggcacatacaagatcgtcatcgacaaaaagaacaaacagaatgatagatgcaccctggtgaccaactgtgtcattaaggggcgggagatccgcaaaggacaatccgtgcttagacagtaccggacagaaattaagatcggcaaggccagctctggctcccgcagactgctcagcgaggaatccggggacgattgcatttctcggacccagctgctgagaacagagacggctgaaatccacaatgacaactatggaggcccgggggataaaatcaccatttgtaatggaagcacagttgtggaccagcgccttggctccgagctcgggtgctacaccatcaaccgggtcaagtctttcaaactgtgcgagaatagcgccacaggcaagtcctgtgaaattgattctacccccgtgaaatgcagacaaggattctgtctgaagatcacgcaggagggccgcgggcatgttaagctcagccggggatccgaagtggtcctggacgcttgcgatagctcttgtgagattatgatccctaaaggcaccggggacattcttgtggactgctccggaggccagcagcactttctgaaggataacctcatcgacctggggtgtcccaatatccctctgcttggcaaaatggccatttatatctgcagaatgagcaaccatcccaagacaaccatggccttcctcttttggttctcttttggatacgtggttacatgtattctgtgcaaagtcatcttctatctgctcattgtggtgggcaccctggggaagaagtttaaacaataccgcgagcttaagcctcagacatgtaccatctgcgaaacgacacccgtcaatgctatcgatgcggagatgcacgacctgaactgctcctataatatttgtccgtactgcgccagccggctcacctctgatggactggctagacatgtgatgcagtgtcctaaacgcaaggaaaagatcgaggaaaccgagctgtaccttaacctcgagcggattccctgggttgtgagaaagctgctgcaggtctccgaaagcacaggcgtggccctcaaacgctccagctggctggttgtgcttctggtcctcctgaccgtgtctctgagccctgttcaatccgcccccatcgggcacggaaagacggtggagacatatcagacccgggaaggctacacatctatttgccttttcgtcctcgggagcatcctgtttatcgtgtcctgtctgatgaagggcctcgtggactctgtcggaaacagcttctttccgggcctgtccatttgcaaaacctgttctatcgggagcgttaatggattcgagattgaatcccacaagtgctattgtagcctgttttgctgtccttactgcagacattgctctgctgatcgggagatccaccgcctgcatctctccatttgtaaaaagagaaaaacaggcagcaacgtgatgctggccgtgtgcaagcggatgtgtttcagagcgaccgtcgaggtgtctaataaggctctgcttatccgcaacatcattaatacgaccttcgttctgtgcatcctcattctggccgtgtgtgtcgtgtccacaagcgccgttgaaatggagtccctccccgctgggacctgggaacgggaggaagacctgacaaacttttgccaccaggagtgtcaagtgaccgagacggaatgcctttgtccttatgaggccctggtcctcagaaaacccctgttctctgatagcatcgtgaagggaatgaaaaatctgcttaactccacaagcctggaaacctctctctccattgaggctccctggggcgccatcaatgttcagagcacatttaagcctaccgtgtctgcggccaacattgctctgagctggtcctctgtcgagcaccgcgggaataaaatcctcgtgagcggcagatccgaatctatcatgaagctggaggaacggaccggaattagctgggaccttggcgtggaggatgcctccgaaagcaagctgctcacagtctctgttatggacctgtcccagatgtacagcccggtgttcgagtatctgtccggggatcgccaggtggaggaatggcccaaagctacgtgcaccggagactgtcctgagagatgcggctgcacatctagcacctgtcttcataaggaatggccccactcccggaactggcgctgcaatcctacatggtgttggggagtcgggaccggctgcacgtgttgcggcctggacgtgaaagatctctttacagactacatgttcatcaagtggaaagttgagtacattaagaccgaagccatcgtgtgtgtcgagctgacctctcaagagagacagtgcacactcattgaagcggggacccggtttaacctgggacccgtgacaatcacgcttagcgagcctcgcaatatccagcagaagctgccgcccgaaattgttaccctgcatcctagaatcgaggaaggcttctttgatctcatgcacgtgcaaaaagtcctgtccgccagcacagtgtgtaaacttcagtcttgcacccatggggtccccggagaccttcaggtgtatcacattggcaacctcctgaaaggggataaggttaacggacacctcatccataaaattgagcctcacttcaatacatcctggatgagctgggacggctgtgatctggactactattgcaacatgggcgattggccctcttgcacctacacgggggtgacccagcataatcacgctgcctttgtcaacatgcttaatatcgagacagactataccaagaacttccattttcactccaaacgggtgacagctcacggagataccccgcaactggacctgaaggcccgccctacatacggcgccggggaaatcacggttctcgtggaggtcgctgatatggaactgcataccaagaaaattgagatcagcggacttaagttcgcgtctctgacatgtaccggctgctatgcctgtagctccgggatttcttgcaaagtgagaatccacgtggacgagcccgacgaactcaccgttcatgtcaagagcgaggatcccgacattgtggctgcctccagctccctgatggcccggaaactcgagttcggaacagattctacgtttaaggctttcagcgccatgcctaagacctccctgtgtttttacatcgtggaaagagaatactgcaaatcttgtagcaaggaggacacacagaaatgcgtcaataccaaacttgagcagccccaatccattctgatcgaacacaagggcacaatcattggcaagcagtctaacacctgtacggcgaaggctagctgctggctggagtccgtgaaatccttcttttatgggctcaagaatatgctgtctggaatcttcggcaacgtttttattggggtgttcctgtttttcgccccttttatccttctcattctgttcttcatgtttggatggcgcatcctcttctgttttaaatgctgccggagaacacgcggcctgttcaagtaccggcaccttaaagatgacgaagagaccgggtatagaaagatcattgaacgcctgaataacaagaaaggaaagaataaactgctcgatggcgagcggctggccgacagaaagatcgctgagctttttagcaccaaaacacatattggctga

SEQ ID NO: 13567 - RNA, 5070 nt, synthetic construct
  misc_feature 1..5070: note = derived and/or modified CDS sequence (opt5) from CCHFV(7803)__AB069672.1__GP
  source 1..5070: mol_type = other RNA
atgcccgtgagcatcatgcacatttccctgatgtgcgccgtgctctgtctgcagctttacggcctgggggagacccatggatctagcaacgaaacagagcacaataagacgaacgttgtgaccacacctggcgactcccaatctccggaacccctcgtgagcaccacactgcctgtcacccttgattcctctacagtgacccccacgacccctgctagcgagcccgaagggtccggagaggtttatacaagccctccgatcaccacagagggcctgtctccctccgaagccaccagcgagctccctgtgacgacagggattggaatctcttccgcgagcgacgtcgattcttccacccaggctgccggcgacacaagcacccccaccgtgagaacatcccctcccaattctccgagcacgcctcccacctcccaggatacacatcaccctatgcggaacctgctgagcgttacctctctcaaatccgaagagacaagcgccccctctaagagcggcaaagagtcccccgctgcctctagccctcatccggtggcttccagaccccctacccaccccattacggcccaggggcctacagaaaataacagccacaataccaccggacaactggagtctgtcacacagtccgcgacccttggccccatggccagcccgacacagacggtgctgtctcagaacgtgacctccatcgctatccaagacacacatcctagccccaccaatcgctccaagcggaacctcgaaatggagattatcctgacacttcctcaggggctgaaaaagtactatggaaaggtcctccgcctgctgcagctcaccctggaagaggatacggagggccttctggaatggtgcaaaagaaatctcgggctggactgtgatgacaccttctttcagaagcggattgaggagttctttatcacaggagaaggccacttcaacgaagttcttcaatttcgcacccccggcacactgtctaccacggagagcacacatgccgagtcccctaccgctgaacccttcaaatcttactttgccaaggggttcctcagcattgattccggatattttagcgcgaaatgctactctagaacatccgacagcggcctgcagctgatcaatgtgacccggcactctacccgcattgccgatacaccggggcctaagatcacgaacctcaagaccatctcctgtattaatctgaaagctagcgtgttcaaggagcacagagaagtcgagatcaacgtgcttctgccccaggttgccgtgaacctctctaattgccatgtcacaattaaaagccacgtgtgtgactattccctggacatcgatggaaccgttcggcttccccatattcaccatgaaggcacatttatccctgggacctacaagatcgtgattgacaaaaagaacaaactgaatgatcgctgcacgctctttacaaactgtgtcatcaagggaagagaggtgcggaagggccaaagcgtcctgcgccagtacaaaaccgagattagaatcggcaaggcttctaccgggtcccggagactgctcagcgaagagtccggagacgattgcatttctcgcacacagctgcttcggaccgaaacagccgagatccacggcgacaattatgggggaccgggcgataaaatcacgatttgtaacgggagcaccatcgtggaccagagactgggctccgagatgggatgctacacaattaatcgcgttaagtcttttaaactctgcgaaaacagcgccaccggcaagtcctgtgagatcgattctattcccgtgaagtgccggcaagggtattgtctgaaaatcacacaggaaggaagaggccacgtcaagctgagccgcgggtccgaggtgattcttgacgcttgcgatagctcttgtgaagttatgatccctaaaggaaccggcgacatcctcgtggactgctccgggggccagcagcatttcctgaaggataatctgattgacctcggatgtcccagcatccctctgcttggcaaaatggcgatttacatctgccggatgtctaaccaccccaagacgaccatggccttcctgttttggttctcctttgggtatgtcattacatgtatcctctgcaaggctatcttctacctgctgattatcgtgggaacccttggcaaaagatttaagcaatatcgcgagctcaaacctcagacatgtaccatttgcgagacaacccccgccaatgccatcgatgctgaaatgcatgacctgaactgcagctacaatatttgtccgtactgcgcctctcggctgacgtccgatgggctcgcgagacacgtgacacagtgtcctaagcgcaaagagaaggttgaagagaccgaactgtatcttaacctggagcggatcccctgggtcgtgagaaagctccttcaggtgagcgagtccaccggagtcgctctgaaacggagctcttggcttatcgtgctcctggttctgttcgccattagcctctcccctgtgcaatctgcccccatcagccacggcaagacaattgaaacctaccaggctcgcgaggaatatacgtccatctgcctgtttgtccttgggtctattctgttcatcgtgagctgtctcatgaaaggcctggttgactccatcggaaatattttcttcccgggcctgtctatctgcaagacatgtagcattgggtccatcaacggatttgagattgaaagccataaatgctactgttctcttctctgctgtccttattgcagacactgctccgccgatcgggagatccatcagctgcacctgagcatttgtaagaaaagaaagaccggctctaacgtgatgctcgctgcctgcaagcgcatgtgtttccgggcgacaatggaggtctccaataaagccctgcttatcagaagcatcattaacaccacatttgtggtttacatcctgattctcgctgtgtgcgtcgtgtccacctctgccgtggaaatggagagcctgcccgctgggacgtgggaacgcgaggaggacctgaccaatttctgtcatcaggaatgccaagtcacagagaccgaatgtctttgcccttatgaggccctggttctcagacggcccctgttcctcgattccatcgtgcgcggaatgaagaaccccctgaatagcacatctcttgaaacctccctgagcattgaggcgccttggggcgccatcaacgtgcagtctacgtacaaaccgacagtcagcaccgctaatatcgccctctcctggtctagcgtggagcacagagggaacaagattctggtttccggccggtctgaaagcatcatgaaactggaggaacgcacaggaatttcctgggaccttggcgtggaggatgctagcgaatctaagctgctcaccgtctccgtgatggacctgagccagatgtactcccccgtttttgagtatctctctggggatagacaagtggaggaatggcctaaggccacctgtacaggagactgccccgagcggtgtggctgcacgaccagcacatgcctgcacaaagaatggcctcattcccgcaattggagatgtaaccccacctggtgctggggagtcgggacaggctgtacctgctgtggccttgacgtgaaggatctgttcacggactacatgatcgttaaatggaaggtggagtatattaaaacacgggggatcgtctgcgtggaactcacctctcaggagcgccagtgtagcctgatcgaggccggaaccagatttaatctgggctccgtgacaattacccttagcgaacctcggaacatccagcaaaagctgccgcccgagattatcacactccaccctagaattgaagaggggttctttgatctgatgcatgtccagaaggttctctctgcttccacggtgtgcaaactgcagagctgtacccacggagtgcccggcgaccttcaggtctaccatgtggggaatctgctgaagggagataaagttaacggccacctcatccacaagattgagcctcatctgaatacatcttggatgtcctgggacggctgcgatcttgactattactgtaacatgggggattggcccagctgcacctatacaggagtgacccaacacaaccatgcgtctttcgtcaatctgctcaacatcgaaacggactacaccaagagctttcacttccactccaaacgcgtgacagcccatggcgataccccgcagctggacctcaaggctcggcctacatacggggccggagagatcaccgttctggtggaagtcgccgatatggagtttacacccaaaaagattgaaatctctggccttaaattcgctagcctgacgtgcaccgggtgttatgcctgctccagcggaatttcctgtaaggtgagaatccacgtcgacgagcccgacgagctgacagtgcatgttaaatctgatgaccctgatgtggtcgcggctagctcctctctcatggcccgcaagctggaatttggcaccgacagcaccttcaaagccttttccgctatgcccaagacatctctttgcttctacattgtggagcgggaatattgtaagagctgctccaaagaggatacgcagaagtgtgttaataccaaactggaacagcctcaaagcatcctcatcgagcacaagggcacaattatcgggaaacagaacaatacctgcacagccaaggcgtcttgttggctggagtccgtcaagagcttcttttacggactcaaaaacatgctgtctggcattttcgggaactttttcatgggaatctttcttttcctggctccgtttattctgctcatcctgttctttatgttcggctggagaatcctgttttgcttcaagtgttgccgccggaccagagggctgttcaaatatcgccatctcaaggacgatgaagagacgggataccggagaattatcgaacggctgaataataaaaagggcaagaacaaactcctggacggcgagcgccttgccgatagacggattgccgaactgttttccacaaagacccacatcgggtga

SEQ ID NO: 13568 - RNA, 5070 nt, synthetic construct
  misc_feature 1..5070: note = derived and/or modified CDS sequence (opt5) from CCHFV(75024)__AB069671.1__GP
  source 1..5070: mol_type = other RNA
atgcccgtgagcatcatgcacatttccctgatgtgcgccgtcctctgtctgcagctttacggcctgggggagacccatggatctagcaacgaaacagagcacaataagacgaacgttgtgaccacacctggcgactcccaatctccggaacccctcgtgagcaccacactgcctgtcacccttgattcctctacagtgacccccacgacccctgctagcgggcccgagggatccggcgaagtttatacaagccctccgatcaccacagaggggctgtctccctccgaggccaccagcgaactccctgcgacgacaggaattggcatctcttccgctagcgacgtggattcttccacccaggccgccggcgacacaagcacccccaccgtcagaacatcccctcccaattctagctccacgccgcctaccagccaggatacacatcaccccatgcggaacctgctgtctgtgacctccctcaaacctgaggaaacaagcgctccctctaagagcgggaaagagtcccccgccgcttctagccctcatccggttgcctccagaccccctacgccccctacgacagcgcagggacccattgagaataacagccacaataccaccggccaactggaatctgtgacacagtccgccacccttgggccgatggctagccctacacagacggtcctgtctcagaacgtgacctccatcgccatccaagacacacaccccagccctaccaatcgctccaagcggaacctcgagatggaaattatcctgacacttccccagggactgaaaaagtactatggcaaggtgctccgcctgctgcagctcaccctggaggaagatacggaggggcttctggagtggtgcaaaagaaatctcggactggactgtgatgacaccttctttcagaagcggattgaagagttctttatcacaggcgaaggccatttcaacgaggtccttcaatttcgcacccctgggacactgtctaccacggaaagcacacacgctgagtcccccaccgccgagccgttcaaatcttactttgcgaagggattcctcagcattgattccggctattttagcgccaaatgctactctagaacatccaatagcgggctgcagctgatcaacgttacccggcattctacccgcattgctgacacacctggacccaagatcacgaatctcaagaccatctcctgtattaacctgaaagccagcgtgttcaaggaacacagagaggtggaaatcaacgtccttctgccccaggtggctgttaatctctctaactgccacgtgacaattaaaagccatgtctgtgattattccctggacatcgacggcaccgtgcggcttcctcacattcatcacgaggggacatttatcccgggaacctacaagatcgttattgataaaaagaataaactgaacgaccgctgcaccctcttcacaaattgtgtgatcaagggcagagaagtccggaagggccaaagcgtgctgcgccagtacaaaaccgagattagaatcgggaaggcctctaccggatcccggagactgctcagcgaggaatccggcgatgactgcatttctcgcacacagctgcttcggaccgagacagccgaaatccatggggataactatggaggccccggggacaaaatcacgatttgtaatggcagcaccatcgtcgatcagagactgggatccgagatgggctgctacacaattaaccgcgtgaagtcttttaaactctgcgagaatagcgctaccgggaagtcctgtgaaatcgactctattcctgttaagtgccggcaaggatattgtctgaaaatcacacaggagggcagagggcacgtgaagctgagccgcggatccgaagtcgtgcttgatgcgtgcgacagctcttgtgaggttatgattcccaaaggcaccggggatatcctcgtggactgctccggcggacagcagcacttcctgaaggacaacctgatcgatctcggctgtcctagcattcccctgcttgggaaaatggccatctacatttgccggatgtctaatcatcctaagacgaccatggctttcctgttttggttctcctttggatatgtcatcacatgtattctctgcaaggccatcttctacctgctgatcattgtgggcacccttgggaaaagatttaagcaatatcgcgaactcaaaccccagacatgtaccatctgcgagacaaccccggccaacgctattgacgccgagatgcacgatctgaattgcagctacaacatctgtccttactgcgcgtctcggctgacgtccgacggactcgctagacatgtgacacagtgtcccaagcgcaaagaaaaggttgaggaaaccgagctgtatcttaatctggaacggattccttgggtcgtgagaaagctccttcaggtgagcgagtccaccggcgtcgccctgaaacggagctcttggcttatcgtgctcctggttctgttcgccatcagcctctcccccgtgcaatctgctccgattgggcacggcaagacaatcgagacctaccaggcccgcgaagagtatacgagcatttgcctgtttgtccttggatccatcctgttcattgtgtcttgtctcatgaaaggcctggttgatagcatcgggaacatctttttccctggactgtccatttgcaagacatgttctatcggcagcattaacgggtttgaaatcgagtcccacaaatgctactgtagccttctctgctgtccctattgcagacattgctctgctgaccgggaaattcaccagctgcatctgtccatctgtaagaaaagaaagaccggaagcaatgtgatgctcgccgtctgcaagcgcatgtgtttccgggcgacaatggaggtgtctaacaaagccctgcttattagatccatcatcaataccacatttgttgtgtgcattctgatcctcgctgtctgtgtggtgagcacctccgccgtcgagatggaatctctgcctgctggcacgtgggagcgcgaagaggatctgaccaacttctgccaccaggagtgtcaagttacagaaaccgagtgcctttgtccctacgaagccctggtgctcagacggcccctgttcctcgacagcattgtgcgcgggatgaagaatcagctgaactccacaagccttgagacctctctgtccatcgaagcgccttggggcgccattaatgtccagagcacgtataaaccgacagtgtctaccgctaacatcgccctcagctggtcctctgttgagcatagaggaaataagatcctggtgagcggccggtccgagtctattatgaaactggaggaacgcacagggatcagctgggatcttggagtcgaagacgcttccgagagcaagctgctcaccgtgtctgttatggatctgtcccaaatgtacagccccgtgtttgaatacctctccggcgacagacaggtcgaggagtggcctaaggctacctgcacaggggattgtcccgaacggtgcggatgcacgacctctacatgtctgcacaaagagtggcctcacagccgcaactggagatgcaatcccacctggtgttggggcgtgggcacagggtgcacctgttgcggacttgacgttaaggacctgttcacggattatatgattgtgaaatggaaggtcgaatacatcaaaacagaggccattgtgtgtgtggaactcacctcccaggagcggcagtgctctctgatcgaggctggcacccgctttaacctggggagcgtcacaatcaccctttccgaacctagaaatattcaacagaagctgccgcccgagatcattacactccatcctcggatcgaagagggattctttgacctgatgcacgttcagaaggtgctcagcgcgtctacggtgtgtaaactgcagtcctgcacccatggcgtccccggggatcttcaagtgtatcacgttggaaacctgctgaagggcgacaaagtgaatggccatctcattcacaagatcgagcctcacctgaacacaagctggatgtcttgggatgggtgtgaccttgattactattgcaacatgggagactggccctcctgcacctacacaggcgtcacccagcataatcacgccagcttcgtgaacctgctcaatattgaaacggattataccaaatcttttcatttccacagcaagagagttacagctcacggggacaccccgcagctggatctcaaggcccgccctacatacggagccggcgagatcaccgtgctggtcgaagtggctgacatggagtttacacccaaaaagatcgaaatttccgggcttaaattcgcctctctgacgtgtaccggatgctacgcgtgtagctccggcatcagctgcaaggtccggattcatgtggatgagcccgacgagctgacagttcacgtgaaatccgacgatcctgacgtcgtggctgcctctagctccctcatggccagaaagctggaatttggcaccgattctaccttcaaagcctttagcgccatgcccaagacatccctttgtttctatatcgttgagcgcgaatactgcaagtcttgtagcaaagaggacacgcagaagtgcgtgaacaccaaactggaacaacctcagtccattctcatcgagcataaggggacaatcattggaaaacagaataacacctgtacagcgaaggctagctgctggctggagtctgtcaagtccttcttttatggcctcaaaaatatgctgagcgggatcttcggaaacctttttatgggcattttcctgtttctggccccgttcatcctcctgattctgtttttcatgtttgggtggcggatcctgttctgttttaagtgctgcagacgcacccggggactcttcaaatacagacacctgaaggatgacgaagagacgggctatcgccggatcattgaaagactcaataacaaaaagggcaagaataaactgcttgatggggagcggctggccgaccgcagaatcgctgaactgttctctacaaagacccatattggatga

SEQ ID NO: 13569 - RNA, 5070 nt, synthetic construct
  misc_feature 1..5070: note = derived and/or modified CDS sequence (opt5) from CCHFV(66019)__AB069669.1__GP
  source 1..5070: mol_type = other RNA
atgcccgccaacatcatgtacaccctgctcgtgtgcgctgtcctgtgtcctcagctttggagcctggagggcacacacgttccgcataatgaaacgaagcacaacgggaccggaattacagccgcgcccggcgagtcccaagggcctatgtctcccgctagcaccgccgtgcctctcacacccgaacctccgaataccaaacccgccgcttccgcctctgagctggaaagctccggagagggccatacatctcttctggctaccacgcaggggctcaccagccctgaggccacacccgaactgcctaccacaaccgacacgggagtgtccagcacatctgtcgtggatatcggcacccagatggcgaaggacacacccacctccaccgcccacacaagcctgccgtctaacccttccgctcccagcacggcccagggcacccatcacacaattagagggctcctgtctgttacctccacaaaacctgaggaagctagcacccccacggatcccggaaaggccggcgcggagacagggtcccctcggccggccatctctcgcaaacccacccttagccctaccgctgaggcccccacagaaattaataactccagcacccctaagcaacccgagccgtctatccagcctgctacaccctccctggtgatcagccctgcccagcccgccttccctcagtctgctacgagcaccgcggcccaagacatttattcctctcccacaaatagaagcaagcggaacctcaaaatggaaatcattctgaccctttcccagggactgaagaaatactatggcaagatccagaaaacactcgggctgaccctggaggaagatacggagggactcctggagtggtgcaagcgcaatcttggcctgacctgtgacgataactttttccagaagagaattgaagagtttttcctcacaggcgaagggtactttaatgaggtcctgcaattcaaaaccccgagcacacctggatctaccgaacccacgcacacagaggctcccaccgtgaagccttttaaatcctatttcgcccggggctttcttacaatcgacagcgggtacttctctgccaagtgctattcccgcaccagcaactccggactgcagctcattaatgttacccagcatccggctagaatcgccgatacacccggccctaaaatcacgaacctgaagaccattaattgtatcaacctgaaagcgtctgtgtttaaggagcaccgggaaattgagatcaacgtcctcctgccccaagtggctgtgaatcttagcaactgccatgtcctgattaagtcccacgtttgtgactactctctcgatatcgacgggacaatccgcctgcctagaatttaccacgaaggaaccttcatccccggcacatataaaattgtgatcgataagcgggacaaacagaatgaccgctgcacccttgtgacgaactgtgtcattaagggcagagaggtgcggcgcgggcagagcgccctgagacagtaccggacagaaatcagaatcggaaaagcctccgctggcagccgccggctcctgtctgaggagtccggggatgactgcattagcagaacccaactgctccgcaccgaaacagccgaggttcatggagataattatggcgggcctggcgacaagatcaccatttgtaacggatctacaatcgtggatcagcggctgggctccgaacttgggtgctacacgattaatagagtcaagagctttaaactgtgcgagaactctggaaccggcaagagctgtaaaatcgacaatacacccgtgaagtgccgccaggggttctgtctcaaaattacccaggagggacggggccacgttaagctgtccagagggagcgaagtggtcctggatgcttgcgactcttcctgtgagatcatgatcccgaagggcacaggagatattcttgtggactgcagcggcgggcaacagcatttcctcaaagataacctggtcgacctgggatgtcctaatatccccctcctgggcaagatggccatttatatctgccgcatgtccaaccaccctaaaaccacgatggcgtttcttttctggttttctttcgggtacgtgattacctgtatcttttgcaagatcattttctatctgctcatcgttgtgggaacactgggcaaaaagtttaagcagtaccgggaactgaaaccccagacctgtacaatttgcgagaccacaccgaccaatgccatcgacgctgaaatgcatgatcttaagtgcagctacaacatttgtccttattgcgcctccagactcacgtctgacgggctggctcgccacgtcacacaatgtcccaaacggaaggagaaagtggaggaaaccgagctgtacctcaatctggaaagaatcccttggatcgttcggaaacttctccaggtgagcgagtccaccggcgtcgccctgaaacgctctagctggctgattgtgctgcttgtgctcctgacagtttccctgagccccgtccagtctgcgcccatcggacacggcaagaccattgaagcctatcagacgagagaggggtacacatccgtgtgcctcttcatgctgggaggcatcctttttgtggtcagctgtctgatgaaggggctcgtggattctgtttccaacagcttctttcctggactgtctatttgcaaaacctgttccatcggcagcgtgaacgggttcgagatcgaatcccataagtgctattgtagcctgctttgctgtctctactgccggcactgctctgctgacagagagattcatcaactgcacctgagcatctgtaaaaagcgccgggccggcggaaatgtcatgctcgctgtgtgcaaaagaatgtgtctgcgcgccacaatggaagtttccaacaaggtgctttttattagatctatcattaataccacattcgtcatctgcattctggtgctcgccgtttgtatcgtgagcacctccgctgtcgagatggaatctctgccggcgggcacgtgggagcgggaggaagatctgaccaacttctgccaccaggagtgtcaggtgacagaaaccgagtgcctttgtccctatgaggccctggtgctccgcaagcctctgtttagcgactccatcgtcaaagggatgaagaatctcctgaactctacaagccttgaaacctccctgagcattgaggctccctggggagccatcaatgttcaatctacgttcaaacctacagtgtccaccgccaacattgctctcagctggtcttccgtggaacatagaggcaataagatcctggtcagcgggcggtccgagtctattatgaaactggaagagagaacaggaatcagctgggatcttggcgtggaggacgcctccgaaagcaagctgctcaccgtttctgtgatggatctgtcccagatgtacagccccgtctttgagtacctctctggcgacagacaggtggaagagtggcctaaggcgacctgcacagggaactgtccggatcggtgcggatgcacgagctccacctgtctgcacaaagaatggccccattctcgcaattggagatgcaaccctacatggtgttggggcgttgggaccggatgcacatgttgcggccttgacgtgaaggatctgttcaccgactatatgtttgtcaaatggaaggtggagtacatcaaaacggaggctattgtttgtgtggaactcaatagccaggagcggcaatgctccctgatcgaagccgggacacgcttcaacctgggacccgtcaccattaccctttctgagcctagaaatatccagcagaagctgcccagcgaaattatcacactccacccgcggatcgaggagggctttttcgacctgatgcatgtgcagaaggtgctctccgccagcaccgtctgtaaactgcaatcttgcacacacggcgttcctggggatcttcagatttatcacatcggaaacctgctgaagggcgacagagtgaacgggcatctcattcacaaaatcgaaccccattttaatacgtcctggatgagctgggatggatgtgacctggattactattgcaacatgggcgactggccctcctgcacctacacaggggtgacccagcacaatcatgctgccttcgtcaaccttctgaatattgagacagattataccaagaactttcacttccactctaaacgcgtgacggcgcatggagacacccctcagctcgatctgaaggctcggcccacatacggcgccggcgaaatcaccgttctcgtggaggtcgccgacatggagctgcacacaaagaagattgctatcagcgggcttaagtttgcctccctgacctgtacaggatgctacgcttgttctagcggcatctcctgcaaagtgcgcattcatgttgatgaacctgacgagctgacggtgcacgtcaagagcgaagatccggacatcgtggccgcgtcttccagcctcatggcccgcaaactggagttcgggaccgactctacattcaaggctttttccgccatgcccaaaaccagcctttgtttctatattgtcgaacgggagtactgcgagtcttgtagcaaggaagatacccaaaagtgcgtgaatacaaaactggagcagcctcagtccatcctcattgaacacaagggaacgatcatcggcaaacaaaacgacacctgtacagctaaggcctcttgctggctggagagcgttaaatcctttttctatgggctcaagaatatgctgagcggaatttttggcaacgtgttcatcggcatttttcttttcctggccccctttatcctgctcattctgttctttatgttcgggtggagaatccttttctgttttaagtgctgccgccggaccagaggactgttcaaataccgctatctcaaggatgacgaagagtccggctaccggagaatcattgagcggctgaataacaaaaaggggaaaaataagctcctggatggagaacgccttgctgacagacggatcgcggagctgttttctacaaagacccatattggctga

SEQ ID NO: 13570 - RNA, 5070 nt, synthetic construct
  misc_feature 1..5070: note = derived and/or modified CDS sequence (opt5) from CCHFV(BA8402)__AF350449.1__GP
  source 1..5070: mol_type = other RNA
atgagcttctccgtgatgtacacacccctgctctgcgccgtcctgtgtcttcagctgtggtctctcgagggcagccacgggctgtccaacaagacccaacattctaatacgagcaccacaaaagctcctgaagtttcccaggagcttggactgccggtgtctaccgtgagcacaatcacctccgaaccccctagcattacatctgccgtctccgtgagcggctctgaggggtccggagacaccaacacgagcccctctgttaccacacagggccctaccctccccgaaacaaccctggagcctctgacgacaaccgatacagacgcgtccagcaccgtggtcgtggatgtttccacccagacagtgaaggacacgccgatctctaccacatataccagcctcccctccacacctagcgagcccaccacgcctcaagggacacaccataccgctagaggactgctttctgtcacctccacaaaacccgaagaggccagcccgcaggccaatcctggcaagatttctatggaaaccaacggcccccggctggctatcagcgagacaccttccttttctcccacgacccaggcccccacagagaatagcaaccctattacctccaaacagctcatgctgagcgctcaaccggtgacacccaatcctatgacctctcccgtgcagcctgccctttcccagagcgatacgtctaccgcgatccaggacgtccacccctccccgacagggcgcagcaagagaaacctggaaatggagatcattctcaccctgtcccaaggactgaagaaatactatggcaagatcctcaaactgcttgatctgacactcgaagaggacaccgaagggctgcttgagtggtgcaagcggaatctgggactcgtttgtgatgacaacttctttcagaaacgcattgaggagttctttctgacgggcaaggggcatttcaatgaggtgctgcagtttaagacaccttctaccctcagccccacaggacctgccagaaccggctcccccaccgtggaacctttcaaatcttactttgctaagggcttcctgagcatggattccgggtattttagcgccaaatgctacccccgggcttctaactccggacttcaactgatcaatgtcacacagcacagcacgcgcattaccgacacaccgggccctaagatcaccaacctcaaaacaattaattgtatcaacctgaaggcctctgtgttcaaagagcacagagaaatcgagattaacgttcttctgccccaggtggcggtcaatctctccagctgccatgtgctgatcaagtctcacgtttgtgattatagcctggacattgacgggcccgtgcggctccctcgcatccatcacgagggaacctttattccgggcacgtacaagatcgtcatcgataaaaagaacaaacagaatgacagatgcacactggtgaccaactgtgtcattaaggggcgggaaatccgcaaaggacaatccgtgcttagacagtaccggaccgagattaagatcggcaaggccagctctggctcccgcagactgctcagcgaagagtccggggatgactgcatttctcggacacagctgctgagaaccgaaacagctgagatccacaatgataactatggaggccccggggacaaaatcacgatttgtaatggaagcaccgttgtggatcagcgccttggctccgagctcgggtgctacacaatcaaccgggtcaattctttcaacctgtgcgaaaataccgccacaggcaagagctgtgagattgactccacccctgtgaaatgcagacaaggattctgtctgaagatcacgcaggaaggccgcgggcatgttaaactctctcggggaagcgaggtggtcctggatgcttgcgagtccagctgtgaaattatgatccccaagggcaccggggacattcttgtggattgctctggaggccagcagcactttctgaaggacaacctcatcgacctggggtgtcctaatatccccctgcttggcaaaatggccatttatatctgcagaatgtccaaccatcctaagacaaccatggccttcctcttttggttcagctttggatacgtggttacatgtattctgtgcaaagtcatcttctatctgctcattgtggtgggcaccctggggaagaaatttaagcaataccgcgagcttaagccccagacatgtaccatctgcgaaacgacaccggtcaatgctatcgatgcggagatgcacgacctgaactgctcttataacatttgtccttactgcgcctcccggcccaccagcgatggactcgctagacatgtgatgcagtgtcctaaacgcaaggagaaaatcgaagagaccgccctgtacctgaatcttgaacggattccctgggttgtgagaaagctcctgcaggtctctgagtccacaggcgtggccctgaaacgcagctcctggctcgttgtgctgcttgtcctgctcaccgtgagcctgtctccggttcaaagcgctcctatcgggcacggaaagacggtggaaacatatcagacccgggagggctacacatccatttgcctgttcgtccttgggtctatcctctttatcgtgagctgtctgatgaaaggcctggtggactccgtcggaaactctttctttcccggcctcagcatttgcaagacctgttccatcgggtctgttaatggattcgaaattgagagccacaagtgctattgttccctgttttgctgtccttactgcagacattgcagcgccgatcgggagatccaccgccttcatctgtctatttgtaaaaagagaaaaacaggctccaacgtgatgctcgcggtgtgcaagcggatgtgtttcagagctaccgtcgaagtgagcaataaagccctgctgatccgcaacatcattaatacgaccttcgttctttgcatcctgattctcgccgtgtgtgtcgtgtctacatccgctgttgagatggaaagcctgcccgccgggacctgggagcgggaagaggacctcacaaacttttgccaccaggagtgtcaagtgaccgaaacggagtgcctgtgtccctatgaagctcttgtcctgagaaagcctctcttctccgattctatcgtgaagggaatgaaaaatctgctgaacagcacatcccttgagaccagcctgtctattgaggccccgtggggcgcgatcaatgttcagtccacatttaagcccaccgtgagcgccgctaacattgccctctcttggagctccgtcgaacaccgcgggaataaaatcctggtgtctggcagaagcgagtccatcatgaagctcgaagaacggaccggaatttcttgggacctgggcgtggaagatgctagcgagtccaaacttctgacagtcagcgttatggacctctctcagatgtactcccctgtgttcgagtatctgagcggggatcgccaggtggaagagtggcccaaggccacgtgcaccggagactgtcctgaaagatgcggctgcacatcctctacctgtctgcataaggagtggccccacagccggaactggcgctgcaatcctacatggtgttggggagtcgggaccggctgcacgtgttgcggccttgatgtgaaagacctgtttacagactacatgttcatcaagtggaaagttgaatacattaagaccgaggcgatcgtgtgtgtcgagctcacctcccaagaaagacagtgcacactgattgaggccgggacccggtttaacctcggaccggtgacaatcacgctgtctgaaccccgcaacatccagcagaaacttcctcccgagattgttaccctgcatcctagaatcgaagagggcttctttgatctgatgcacgtgcaaaaggtcctcagcgcttccacagtgtgtaagctgcagagctgcacccatggggtccccggagaccttcaggtgtatcacattggcaatctgctcaaaggggataaggttaacggacacctgatccataaaattgagccgcacttcaatacatcttggatgtcctgggacggctgtgatctccattactattgcaacatgggcgactggcctagctgcacctacacgggggtgacccagcacaatcatgccgcttttgtcaacatgctgaatatcgaaacagattataccaagaacttccactttcactctaaacgggtgacagcccatggagacacaccccaacttgatctgaaggcccgccccacctacggcgctggggagatcacggttctggtggaagtcgcggacatggagctccacaccaaaaagattgagatctccggactgaagttcgccagccttacatgtaccggctgctatgcttgttctagcgggatttcctgcaaagtgagaatccatgtggatgaacctgacgagctgaccgttcacgtcaagtctgaagatcccgacattgtggccgccagctccagcctcatggctcggaaactggagttcggaacagactccacgtttaaggccttctctgcgatgcctaaaaccagcctctgtttttacatcgtggaaagagagtactgcgagtcctgttctaaggaagatacacagaagtgcgtcaataccaaactggagcagccgcaaagcattcttatcgaacacaagggcacaatcattggcaaacagtccaacacctgtacggctaaggcctcttgctggctggagagcgtgaaatccttcttttatgggctgaagaatatgctcagcggaatcttcggcaacgtttttattggggtgttcctgtttttcgccccctttatccttctgattctcttcttcatgtttggatggcgcatcctgttctgttttaagtgctgccggagaacacgcggcctcttcaaataccggcatctgaaggacgatgaagagaccgggtatagaaaaatcattgagcgccttaataacaagaaaggaaagaataagctgctggacggcgaacggctcgctgatagaaaaatcgccgagctgttttctaccaagacacacattggctga

SEQ ID NO: 13571 - RNA, 5070 nt, synthetic construct
  misc_feature 1..5070: note = derived and/or modified CDS sequence (opt5) from CCHFV(BA66019)__AF350448.1__GP
  source 1..5070: mol_type = other RNA
atgcccgccaacatcatgtacaccctgctcgtgtgcgctgtcctgtgtcctcagctttggagcctggagggcacacacgttccgcataatgaaacgaagcacaacgggaccggaattacagccgcgcccggcgagtcccaagggcctatgtctcccgctagcaccgccgtgcctctcacacccgaacctccgaataccaaacccgccgcttccgcctctgagctggaaagctccggagagggccatacatctcttctggctaccacgcaggggctcaccagccctgaggccacacccgaactgcctaccacaaccgacacgggagtgtccagcacatctgtcgtggatatcggcacccagatggcgaaggacacacccacctccaccgcccacacaagcctgccgtctaacccttccgctcccagcacggcccagggcacccatcacacaattagagggctcctgtctgttacctccacaaaacctgaggaagctagcacccccacggatcccggaaaggccggcgcggagacagggtcccctcggccggccatctctcgcaaacccacccttagccctaccgctgaggcccccacagaaattaataactccagcacccctaagcaacccgagccgtctatccagcctgctacaccctccctggtgatcagccctgcccagcccgccttccctcagtctgctacgagcaccgcggcccaagacatttattcctctcccacaaatagaagcaagcggaacctcaaaatggaaatcattctgaccctttcccagggactgaagaaatactatggcaagatccagaaaacactcgggctgaccctggaggaagatacggagggactcctggagtggtgcaagcgcaatcttggcctgacctgtgacgataactttttccagaagagaattgaagagtttttcctcacaggcgaagggtactttaatgaggtcctgcaattcaaaaccccgagcacacctggatctaccgaacccacgcacgctgaggcccccacagtgaagccttttaaatcctatttcgcccggggctttcttaccatcaacagcgggtacttctctgctaagtgctattcctggacaagcaattccggactgcagctcattaacgttacccagcatccggcccgcatcgcggacacccccggccctaaaatcacaaatctgaagacgattaactgtatcaacctgaaagctagcgtgtttaaggagcacagagaaattgagatcaatgtcctcctgccccaagtggccgtgaaccttagcaattgccatgtcctgattaagtcccacgtttgtgattactctctcgacatcgatgggaccatccggctgcctcgcatttaccacgaaggaacattcatccccggcacctataaaattgtgatcgacaagagagataaacagaacgaccggtgcacacttgtgaccaattgtgtcattaagggccgcgaggtgagaaaagggcagagcgccctgcggcagtaccgcacggaaatcagaatcggaaaggcttccgccggcagccggagactcctgtctgaggagtccggggacgattgcattagccgcacacaactgctccggaccgaaaccgctgaggttcatggagacaactatggcgggcctggcgataagatcacaatttgtaatggatctaccatcgtggaccagagactgggctccgaacttgggtgctacacaattaaccgcgtcaagagctttaagctgtgcgaaaattctggaacgggcaaaagctgtaagatcgataaacaccccgtgaagtgccggcaggggttctgtctcaagattacccaggagggaagaggccatgttaaactgtcccgcgggagcgaagtggtcctggacgcctgcgattcttcctgtgagatcatgatcccgaagggcacaggagacattcttgtggattgcagcggcgggcaacagcacttcctcaaagacaacctggtcgatctgggatgtcctaatatccccctcctgggcaagatggcgatttatatctgccggatgtccaaccatcctaaaaccacaatggcctttcttttctggttttctttcgggtacgtgattacctgtatcttttgcaagatcattttctatctgctcatcgttgtgggaacgctgggcaagaaatttaagcagtacagagaactgaaaccccagacctgtacaatttgcgagaccacaccgaccaatgctatcgacgccgaaatgcacgaccttaagtgcagctacaacatttgtccttattgcgcttcccgcctcacatctgatgggctggcccggcacgtcacccaatgtcccaaaagaaaggagaaagtggaggaaacggagctgtacctcaatctggaacgcatcccttggatcgttcggaaacttctccaggtgagcgagtccacaggcgtcgcgctgaagagatctagctggctgattgtgctgcttgtgctcctgaccgtttccctgagccccgtccagtctgcccccatcggacatggcaaaaccattgaggcttatcagacacgggaggggtacacctccgtgtgcctcttcatgctgggaggcatcctttttgtggtcagctgtctgatgaaggggctcgtggactctgtttccaacagcttctttcctggactgtctatttgcaaaacgtgttccatcggcagcgtgaacgggttcgagatcgaatcccacaagtgctattgtagcctgctttgctgtctctactgccgccattgctctgccgatagagagattcaccaactgcacctgagcatctgtaaaaagcggagagctggcggaaatgtcatgctcgccgtgtgcaagcgcatgtgtctgcgggccacaatggaagtttccaacaaagtgctttttattagatctatcattaataccacattcgtcatctgcattctggtgctcgctgtttgtatcgtgagcacctccgcggtcgagatggaatctctgccggccggcacatgggagcgcgaggaagacctgaccaacttctgccatcaggagtgtcaggtgacggaaaccgagtgcctttgtccctatgaggctctggtgctcagaaagcctctgtttagcgattccatcgtcaaagggatgaagaatctcctgaactctacaagccttgaaacctccctgagcattgaggccccctggggagccatcaatgttcaatctacattcaaacctaccgtgtccacggctaacattgccctcagctggtcttccgtggaacaccggggcaataagatcctggtcagcgggcgctccgagtctattatgaagctggaagagagaacaggaatcagctgggaccttggcgtggaggatgcgtccgaaagcaaactgctcaccgtttctgtgatggacctgtcccagatgtacagccccgtctttgagtacctctctggcgatcgccaggtggaagagtggcctaaggctacatgcaccggggactgtccggatcggtgcggatgcaccagctccacatgtctgcataaagaatggccccactctagaaactggcggtgcaatcctacgtggtgttggggcgttgggaccggatgcacatgttgcggccttgacgtgaaggatctgttcaccgactatatgtttgtcaaatggaaggtggagtacatcaagacagaggccattgtttgtgtggaactcaacagccaggagcgccaatgctccctgatcgaagccgggaccagattcaatctgggacccgtcacgattacactttctgagcctcggaacatccagcagaaactgcccccggaaattatcaccctccatcctcgcatcgaggagggctttttcgacctgatgcacgtgcagaaggtgctcagcgcttccaccgtctgtaaactgcaaagctgcacacacggcgttcccggggatcttcagatttatcatatcggaaatctgctgaagggcgacagagtgaacgggcacctcattcataaaatcgaaccccactttaacacctcttggatgtcctgggatggatgtgacctggattactattgcaatatgggcgactggcctagctgcacatacacgggggtgacccagcataaccacgccgcgttcgtcaatcttctgaacattgagacagattataccaagaattttcacttccattccaaacgggtgacagctcacggagacacgccccagctcgatctgaaggccagacctacctacggcgccggcgaaatcaccgttctcgtggaggtcgctgacatggagctgcatacaaagaaaattgccatctctgggcttaagtttgctagcctgacctgtacaggatgctacgcctgttcctctggcatcagctgcaaagtgcgcattcacgttgatgaaccggacgagctgaccgtgcacgtcaagtccgaagatcccgacatcgtggcggcctcttcttccctcatggctcggaaactggagttcgggacagacagcacgttcaaggccttttctgctatgcctaagacctccctttgtttctatattgtcgaaagagagtactgcgagagctgttctaaagaagatacacaaaagtgcgtgaacaccaaactggagcagccccagagcatcctcattgaacataagggaaccatcatcggcaaacaaaatgacacatgtacggccaaggcctcctgctggctggagtctgttaagagctttttctatgggctcaaaaacatgctgtccggaatttttggcaatgtgttcatcggcatttttcttttcctggctccttttatcctgctcattctgttctttatgttcgggtggcgcatccttttctgttttaagtgctgccggagaacccgcggactgttcaaataccggtatctcaaggatgacgaagagagcggctacagacgcatcattgagcggctgaacaataaaaaggggaagaacaaactcctggatggagaaagacttgcggaccggcgcatcgccgagctgttttccacaaagacccacattggctga

SEQ ID NO: 13572 - RNA, 5070 nt, synthetic construct
  misc_feature 1..5070: note = derived and/or modified CDS sequence (opt5) from CCHFV(BA88166)__AF338470.1__GP
  source 1..5070: mol_type = other RNA
atgagcttctccgtgatgtacacacccctgctctgcgccgtcctgtgtcttcagctgtggtctctcgagggcagccacgggctgtccaacaagacccaacattctaatacgagcaccacaaaagctcctgaagtttcccaggagcttggactgccggtgtctaccgtgagcacaatcacctccgatccccctagcattacatctgccgtctccgtgagcggctctgaagggtccggagacaccaacacgagcccctctgttaccacacagggccctaccctccccgagacaaccctggaacctctgacgacaaccgacacagatgcgtccagcaccgtggtcgtggacgtttccacccagacagtgaaggatacgccgatctctaccacatataccagcctcccctccacacctagcgagcccaccacgcctcaagggacacaccataccgctagaggactgctttctgtcacctccacaaaacccgaggaagccagcacccaggccaatccgggcaagatttctatggagacaaacagccctcggctggctatctccgaaacgccctcttttagccctaccacacaggcccccaccgagaatagcaaccccattacaagcaaacagctcatgctgtctgctcaacctgtgaccccgaatcccatgacgtcccctgtgcagcccgcccttagccagtctgacacctccacagcgatccaggatatccaccctagccccaccggccgctccaagagaaacctggagatggaaattatcctcacactgtctcaagggctgaagaaatactatggaaagattctcaaactgcttgacctgaccctcgaggaagatacggagggcctgcttgaatggtgcaagcggaatctggggctcgtctgtgacgataacttctttcagaaacgcatcgaggagttctttctgacaggaaagggccatttcaatgaagttctgcagtttaagaccccgagcacactctcccctaccgggcccgccagaaccggatctcctacagtggagcccttcaaaagctactttgctaagggcttcctgtccatggacagcggctatttttctgccaaatgctaccctcgggcttccaacagcgggcttcaactgattaatgtgacgcagcactctacccgcatcacagatacccccggaccgaagattacaaacctcaaaaccatcaattgtatcaacctgaaggcctccgtcttcaaagaacacagagagattgaaatcaacgtgcttctgcctcaggttgcggtgaatctcagctcttgccatgtcctgattaagagccacgtgtgtgactattccctggacatcgatggccccgttcggctcccccgcattcatcacgaggggacgtttatccctggaacatacaagatcgtgattgacaaaaagaacaaacagaatgatagatgcaccctggtcaccaactgtgtgatcaagggccgggagattcgcaaagggcaaagcgtccttagacagtaccggacagaaatcaagattggaaaggcctcttccggcagccgcagactgctctccgaggaatctggcgacgattgcatcagccggacccagctgctgagaacagagacggctgaaatccactccgacaattatgggggaccgggcgataaaattaccatctgtaacgggtctacagtggttgaccagcgccttggaagcgagctcggctgctacaccattaatcgggtgaagtccttcaaactgtgcgagaactctgccacaggcaagagctgtgaaatcgattccacccccgtcaaatgcagacaagggttctgtctgaagattacgcaggagggacgcggccatgtgaagctcagccgggggtctgaagttgtgctggacgcttgcgattccagctgtgagatcatgattcctaaaggaaccggcgacatccttgtcgactgctctgggggacagcagcactttctgaaggataatctcatcgacctgggctgtcccaacattcctctgcttgggaaaatggccatctatatttgcagaatgtccaatcatcccaagacaaccatgggcttcctcttttggttcagctttggatacgtggtgacatgtatcctgtgcaaaggcattttctatctgctcatcgttgtcgggaccctgggaaagaagtttaaacaataccgcgagcttaagcctcagacatgtaccatctgcgaaacgacacccgtgaacgccattgatgctgagatgcacgacctgaattgctcttataacatctgtccgtactgcgcgtcccggctcaccagcgatggcctggccagacatgtgatgcagtgtcctaaacgcaaggaaaagattgaggaaaccgagctgtaccttaatctcgagcggatcccctgggtcgtgagaaagctgctgcaggtttccgaaagcacaggggtggctctcaaacgctctagctggctggtcgtgcttctggttctcctgaccgtgtccctgtctcctgtccaaagcgcccccattggacacggcaagacggtggagacatatcagacccgggaagggtacacatccatctgccttttcgttctcggctctatcctgtttattgtgagctgtctgatgaagggactcgtcgactccgtgggcaactctttctttccggggctgagcatctgcaaaacctgttccattggaagcgtgaacggcttcgagatcgaatctcacaagtgctattgttcccttttctgctgtccttactgcagacattgcagcgccgatcgggagattcaccgcctgcatctctctatctgtaaaaagagaaaaacatggtccaatgtcatgctggctgtttgcaagcggatgtgtttcagagccaccgtggaggtgagcaacaaggcgctgcttatccgcaatattatcaacacgaccttcgtcctgtgcattctcatcctggctgtgtgtgttgtgtccacatctgccgtcgaaatggagagcctccccgccgggacctgggaacgggaggaagacctgacaaatttttgccaccaggagtgtcaagtgaccgagacggaatgcctttgtccttatgaggctctggttctcagaaaacccctgtacctggattccattgtgaagggaatgaaaaaccttctgaatagcacatctctcgaaacctccctgagcatcgaggccccctggggcgctattaacgtccagtctacattcaagcctaccatgagcgccgcgaatatcgccctctcctggtctagcgtggagcaccgcgggaacaaaatcctggtttccggcagatctgaaagcattatgaaacttgaggaacggaccggaatctcctggaatctgggcgtggaggacgctagcgaatctaagctcctgacagtctccgtgatggatctgagccagatgtattccccggtgtttgagtacctttctggggaccgccaggtcgaggaatggcccaaagccacgtgcaccggagattgtcctgagagatgcggctgcacaagctccacctgtctgcataaggaatggccccactctcggaactggcgctgcaatcctacatggtgttggggagttgggaccggctgcacgtgttgcggcctcgacgtgaaagacctgttcacagattacatgtttattaagtggaaagtggagtatatcaagaccgaagctattgtctgtgtggagctcaccagccaagagagacagtgcacactgatcgaagccgggacccggttcaaccttggacccgttatcattacactgtccgagcctcgcaatatccagcagaagctgccgcccgaaattgtgacgctccatcctagaatcgaggaaggctttttcgacctgatgcacgtccaaaaagtgcttagcgcgtctaccgtttgtaagctgcagtcctgcacacatggggtgcccggagatctccaggtctaccacattggcaacctgctcaaaggggacaaggtgaacggacacctgatccataaaatcgagcctcactttaataccagctggatgtcttgggatggctgtgaccttgattattactgcaacatgggcgactggccctcctgcacatataccggggtcacgcagcataatcacgccgctttcgtgaacatgctgaatattgagaccgattacacaaagaactttcatttccacagcaaacgggttaccgcccacggagacacaccgcaactggatctcaaggctcgccctacctatggcgccggggaaatcacagtgctggtcgaggtggccgacatggaacttcatacgaagaaaattgagatctctggactgaagtttgctagcctcacctgtacaggctgctacgcgtgttcctctgggattagctgcaaagttagaatccacgtggatgagcccgacgaactgaccgtccatgtgaagtccgaggaccccgatattgtggccgctagctcctctctcatggcccggaaactggaatttggaaccgacagcacattcaaggccttttccgctatgcctaagacgtctctttgtttctacatcgttgagagagaatattgcaaaagctgttccaaggaggatacccagaaatgcgtcaatacaaagctggagcagccccaatctatcctgattgaacacaaaggcaccatcattggcaagcagaacaatacatgtaccgccaaggcgagctgctggctcgagtccgtgaaatcctttttctacgggctgaagaacatgctttctggaatctttggcaatgtgttcattggggtctttctgttctttgctcctttcatcctcctgatcctctttttcatgttcggatggcgcattctgttttgtttcaaatgctgccggagaacgcgcggcctttttaagtatcggcacctgaaagacgatgaagagacagggtacagaaagatcattgaacgcctgaacaataagaaaggaaagaacaaactcctggacggcgagcggcttgccgatagaaagatcgccgagctgttctccaccaaaacccatattggctga

SEQ ID NO: 13573 - RNA, 5070 nt, synthetic construct
  misc_feature 1..5070: note = derived and/or modified CDS sequence (opt5) from CCHFV(UCCR4459)__KY484032.1__GP
  source 1..5070: mol_type = other RNA
atgagcttctccatcatgtacacacccctgctctgcgccgtgctgtgtcttcagctgtggtctctcgagggcagccacgggctgtccaacaagacccaacattctaatacgagcaccacaaaagctcctgaagtctcccaggagtttggacttccggtttctaccgtgagcacaattacctccgatccccctagcatcacatctgccgtgtccgtcagcggctctgaagggtccggagacaccaacacgagcccctctgtgaccacacagggcctgaccctccctgagacaaccctggaactgctcacgacaaccgacacagatgcgtccagcaccgttgtggtcgacgtgtccacccagacagttaaggatacgcccatttctaccacacacaccagcctgccttccacaccgagcgctaccacgacaccccaagggacccatcacaccgccagaggacttctgtctgtgacatccaccaaacctgagggcgccagcacacaggctaatcccgagaagatctctatggaaacgaacagccctcggctcgccatttccgagaccccctctttcagcccgacaacccaggctcctacagaaaattccaaccccatcaccagcaaacagctgatcttttctgcccaacctgtcacgcccaatcccgtgacccctccggtgcagcccgcgctttcccagagcgacacatctaccgccattcaggatatccatccttcccccacaagccgctccaagagaaacctggagatggagattatcctcaccctgtctcaaggcctgaagaaatattacgggaagattctcaaactgcttgacctgacgctcgaagaggatacagaaggactgcttgagtggtgcaagcggaatctgggcctcgtctgtgacgatgacttctttcagaaacgcatcgaagagttctttctgaccggggagggacacttcaacgaagttctgcagtttaagacacctagcaccctctcccccaccggcccggctagaacagggtctcctacggtggagcccttcaagagctattttgccaaaggattcctgtccatggatagcggctacttttctgctaagtgctatcctcgggcctccaatagcggccttcaactgattaacgtgacccagcactctacacgcatcaccgacacacccgggcctaaagtcaccaatctcaagacgatcaactgtattaatctgaaagcgtccgtgttcaaggaacatagagagatcgaaattaacgttcttctgccccaggtggccgtcaacctcagctcttgccacgtgctgatcaaaagccatgtttgtgactactccctggatattgacggaccggtgcggctccctcgcatccaccacgagggcacattcatccccgggacctataagctggtcattgataagaaaaataagcagaacgacagatgcacccttatcacaaattgtgtgattaaaggacgggagatccgcaagggccaaagcgtcctgagacagtaccggaccgaaattaaaatcgggaaggcttcttccggaagccgcagactcctgtccgaggaatctggcgatgactgcatcagccggacacagctgtccagaacggagaccgccgaaattcattctgataactacggcgggcccggagacaagatcacaatttgtaatggcagcaccatcgtggatcagcgccttgggtccgagctcggatgctatacaattaaccgggttaaatcttttaagctgtgcgagaatagcgctaccggcaaatcctgtgaaatcgacagcacgcctattaagtgcagacaagggttctgtctgaaaatcacccaggagggccgcggacacgtgaagctctctcggggctccgaagtcgtgctggatgcctgcgacagctcttgtgagatcatgattccgaaggggacaggagacatccttgttgattgctccggcgggcagcagcattttctgaaagacaacctcattgatctgggatgtcccaatatccctctgcttggcaagatggccatttacatctgcagaatgagcaaccaccccaaaaccacaatggctttcctcttttggttctcttttgggtatgtgatcacctgtattctgtgcaaggtcatcttctacctgctcattgtggtgggcacactggggaaaaagtttaagcaatatcgcgagcttaaacctcagacctgtacgatctgcgaaacaacccccgttaatgcgattgacgccgagatgcatgatctgaactgctcctacaatatctgtccttattgcgctagccggctcacctccgacggcctggccagacacgtcatgcagtgtcccaagcgcaaagaaaaggtggaggaaacagagctgtaccttaacctcgagcggatcccgtgggtggtcagaaaactgcttcaggtgagcgaatctaccggggttgccctcaagcgcagctcctggctggtggtccttctggtgctcctgacggtttctctgagccctgtgcaatccgctcccattggacacggcaaaacagtcgagacctaccagacacgggaagggtatacctctatctgccttttcgtgctcggaagcattctgtttatcgtttcctgtctgatgaagggcctcgtggattctgtcgggaatagcttctttcctggcctgtccatttgcaagacatgtagcatcggatctatcaacggcttcgagattgaatcccataaatgctactgtagccttttctgctgtccctattgcagacactgctctgccgaccgggagatccataagctgcacctctccatttgtaaaaagcgcaaaaccgggagcaacgtgatgctggcggtgtgcaagagaatgtgttttcgggctacggtcgaggtttccaataaggccctgcttatcagaaacattatcaataccacattcgtggtgtgcattctgatcctcgccgtctgtgtggtttctaccagcgctgtggaaatggagtccctgccggccggaacatgggaacgcgaggaagatctcaccaacttttgccaccaggagtgtcaagtcacggagacagaatgcctgtgtccttacgaggctcttgtgctgcggaaacccctcttcagcgactctatcgttaagggcatgaaaaatctgctgaactccaccagccttgaaacatctctgagcattgaggccccttggggagcgatcaatgtgcagtccacctttaagcccaccgtctctgccgctaacattgccctcagctggtcctctgtggagcatagaggaaataaaatcctggttagcggccgctccgaaagcattatgaagctcgaggaaagaacagggatctcttgggatctgggcgtggaggacgcttccgaaagcaagctgctgacggtctccatcatggatctctctcagatgtatagccccgtgttcgagtacctgtccggagaccgccaggtggaggaatggcctaaagcgacctgcacaggcgactgtccggagcggtgcgggtgcacctctagcacatgtctgcacaaggaatggccccattccagaaactggcggtgcaatcctacctggtgttggggagtcggcacggggtgcacatgttgcggacttgatgttaaagacctgtttaccgattatatgttcgtgaagtggaaagtggagtacattaagaccgaagccatcgtctgtgtggagctcacaagccaagagcgccagtgctctctgattgaagccggcaccagatttaacctcggccccgttacaatcacgctgtccgagcctcggaatattcagcagaaacttccccctgaaatcgtgaccctgcacccgcgcatcgaggaagggttctttgacctgatgcatgtcaagaaggtgctcagcgcttctacagtttgtaaactgcaatcctgcacccacggagtgcccggcgatcttcaggtctaccacattgggaacctgctcaagggagacaaagtgaatggccatctgatccacaagattgagcctcatttcaacacaagctggatgtcttgggatgggtgtgacctcgattattactgcaacatgggagactggcccagctgctcctataccggcgtcacgcagcacaatcatgccgcttttgtgaacatgctgaatatcgagaccgattacacaaaaattttccacttccactctaagagagttaccgcccatggcgacacacctcagcttgatctgaaggcccggcccacctatggggctggagaaatcacagtgctggtcgaggtggcggacatggaactccacacgaaaaagattgagatcagcggcctgaaatttgcctcccttacctgtacagggtgctacgcttgtagctccggaatctcttgcaaggttcgcattcatgtggacgagccggatgaactgaccgtccacgtgaaaagcgaggaccctgatatcgtggccgcctcctctagcctcatggctagaaagctggagttcggcaccgactccacatttaaggccttctctgcgatgcccaaaacgagcctctgtttttatattgttgaacgggaatactgcaagtcctgtagcaaagaggatacccaaaagtgcgtcaacacaaaactggagcagccccagtctatccttattgaacacaaggggaccatcatcggaaagcaaaatgacacatgtacctccaaagctggctgctggctggagagcgtgaagtctttcttttacggcctgaaaaacatgctctccgggattttcggaaatgtgtttatcggcattttcctgtttcttgcccctttcatcctgctcattctgttctttatgttcgggtggagaatcctcttttgtttcaagtgctgccgccggacgagaggactgtttaaatatcgccatcttaaggatgacgaagagacaggctaccggaagatcattgaaagactgaacaataaaaaggggaaaaacaagctgctcgatggagagcgcctggccgaccggaaaatcgctgagcttttcagcaccaagacccacattggctga

SEQ ID NO: 13574 - RNA, 5070 nt, synthetic construct
  misc_feature 1..5070: note = derived and/or modified CDS sequence (opt5) from CCHFV(K168_125)__KX013460.1__GP
  source 1..5070: mol_type = other RNA
atgcccatcagcaccatgcacatttccctgatgtgcgccgtgctctgtctgcagctttacggccttgggggaacacatggcctccacaacgggacggagcataataagaccaacgctgtcacaacctctagcaattcccaatctagcgaatcccctgccagaacagcgccgcccgttacccctgactctcccacagtgacccctacgacccccgctagcgcccctgagggatccggcgaagcccacagctctccgcccaacaatacagaggggccttccctgcccgaaagcacctctgagcctcccgctgccacatccaccggaatcccgagcgcttctgatgtgaactccagcacgcaggccgcgcgggacacatccacccctacagtccgcacctctccccctaatagcccctccacaccccctaccccgcaggagacgcatcaccccgtgagaaaccttctgagcgttacctctcacaaacctgaagagacatccgcccccagcgaatctggcaaggagagccctgctgccaattctccccatccggtggcttcccggcctcccacccctagcacaaccgcccagggccccacggagaacaataactataatacaaccgggcaactcgaatccctgacccagagcacaaccctgggacctatgacatctctcacgcagaccgatctgccccagtccgtcacaagcattgcggtgcaagacacccacccgtctcctacaaaccgctccaaaagaaatcttgagatggaaatcattctgaccctcccccagggcctgaagaaatactatgggaaggttcttcggctgctccagctgacgctggaggaagataccgagggactcctggagtggtgcaagcgcaaccttggcctggactgtgatgacacattctttcagaaaagaatcgaagagttctttatcaccggggaaggacatttcaacgaggtgctccaatttcggacacccggcaccctgagcacgacagaatccacccacgccggccttcctacagctgagccgttcaagtcttactttgccaaagggttcctgagcattgattccggatatttttctgctaagtgctacagccgcacctccaatagcggcctccagctgatcaacgtcaccagacactctacacggattgccgacacgcccgggctgaaaatcaccaatctcaagacaatttcctgtatcaacctgaaggccagcgtgttcaaagagcatcgcgaagtggagattaatgtccttctgcctcaggttgctgtgaacctctctaattgccacgtgaccatcaagtcccatgtctgtgattatagcctggacatcgatggaacagtgagacttccccacattcatcacgacggcacctttatccctgggacgtacaaaattgttatcgaccggaagaacaaactgaatgatcgctgcacactcttcaccaactgtgtgattaagggaagagaagtccggaaaggccaatctgtgctgagacagtacaagaccgagatccgcatcggcaaggcgagcacagggtcccggagactgctcagcgacgaatctggagatgactgcatttcccgcacccagctgcttcggacagagacggccgagatccacggcgataattatgggggacccggcgacaaaattaccatctgtaacgggagcacaattgttgatcagagactgggctccgaactcggatgctacaccatcaatcgcgtgaagtcttttaaactgtgcgagaacagcgctacaggcaagtcctgtgaagtcgactctatccctgtgaaatgccggcaagggtattgtctgaagattacccaggagggaagaggccatgtcaagctgagccgcgggtccgaggtggttctcgatgcctgcgactctagctgtgaagtgatgatccccaaaggaacgggcgatattctggtcgactgctccgggggccagcagcacttcctgaaggacaatctcatcgatctgggatgtccgaaagtgcctcttctgggcaagatggccatttacatctgccggatgagcaaccatcccaaaaccacaatggctttcctcttttggttctcttttgggtatgttattacctgtatcgtgtgcaaggccatcttctacctgctgattatcgtcggaacacttggcaagagatttaaacaatatcgcgagctcaagcctcagacctgtacaatttgcgaaaccacgcccacaaacgcgatcgacgctgagatgcacgatctgaattgctcctacaacatttgtccgtactgcgccagccggctgacctctgacgggctcgccagacacgtgacccattgtcctaaacggaaggaaaaagtggaggagacagaactgtatcttaatctggagcgcatcccctgggttgtcagaaagctccttcaggtgtccgaaagcaccggagtggctctgaagcggtcttcctggcttatcgtcctcctggtgctgttcgccgttagcctctcccctgtgcagagcgctcccattggccacgggaaaacgatcgagacataccaagtcagagaagagtatacctctatttgcctgtttgtgcttggcagcatcctgttcattgtttcctgtctcatgaagggactggtgaactctgtcggcaatatctttttccccgggctgagcatctgcaaaacatgttccattggatctatcaacggctttgagattgaaagccataagtgctactgttcccttctctgctgtccttattgccgccactgctctgccgatcgggagatccatcagctgcacctgagcatttgtaaaaagagaaaaaccgggtccaatgtgatgctcgcggtttgcaagcgcatgtgtttcagagccacagtggaagtcagcaacaaggctctgtctatccggtccatcattaataccacgtttgtggtgtgcatccttattctggccgtctgtgttgtgagcacctctgctgtggagatggaatccctcccggccggaacatgggagcgcgaggaagacctgaccaacttctgccaccaggagtgtcaggtcacagaaaccgagtgcctgtgtccctacgaggcgcttgtgctgagacggcctctcttcctggatagcatcgttaaaggcaagaaaaatctcctgaactccacgtctcttgaaacaagcctgtccattgaggccccctggggcgctatcaatgtgcaaagcacctataagcctacagtctctgccgctaacattgccctctcctggagctctgtggaacatcgcgggaataaaatcctggttagcggaagatccgagtctatcatgaagctggaggaacggaccggcattagctgggaccttggggtggaggatgcctccgaatctaagctgctcaccgtcagcgtgatggacctgtcccagatgtacagccccgtttttgagtacctctctggagatcgccaggtggaagagtggcctaaagctacatgcacgggcgactgtccggaaagatgcgggtgcacctccagcacatgtctgcacaaggagtggccccattcccggaactggcgctgcaaccctacctggtgttggggagtcggcacaggctgcacctgttgcgggcttgatgtgaaagacctgttcacggactatatgtttgtgaagtggaaagtcgagtacatcaagacagaagcgattgtttgtgtggagctcacctctcaagaaagacagtgcagcctgatcgaggccggaacccggttcaatctgggccccgtgacaattaccctttccgaacctagaaacatccagcagaagctgcccccggagatcattacactccaccctcgcatcgaggaagggtttttcgatctgatgcatgtccaaaaagtgctctctgctagcacggtttgtaagctgcagtcctgcacccacggagtgcccggcgaccttcaggtctatcacattgggaatctgctgaaaggagataaggtgaacggccatctcatccacaaaattgagccccattttaatacaagctggatgtcttgggacggctgtgatctggactactattgcaacatgggggattggccttcctgcacctacacaggagttacccagcacaatcacgccagcttcatcaaccttctgaatatcgaaacggactataccaagtcttttcatttccactccaagcgggtgacagcccatggcgatacaccccaactcgacctgaaagctagacctaactacggggccggagagattaccgtcctcgtggaggtcgcggatatggaactgcacaccaagaaaatcgagattagcggccttaagtttgcttctctgacatgtacggggtgctacgcctgtagctccggaatctcttgcaaagtgcgcattcatgttgacgaaccggatgagctgaccgtgcacgtcaagagcgacgaccccgatgtggttgccgcttccagctccctcatggcccggaaactggagttcggcacagactctacctttaaggcgttcagcgctatgcctaagacctccctttgtttctatatcgtggaaagagagtactgcaaatcttgtagcaaggaagatacacagaaatgcgtcaatacgaagctggagcacccccagtccattctcatcgaacataaaggcaccatcattgggaagcagaacaatacatgtaccgccaagacatcttgctggctggagagcgtgaaatcctttttctatggactcaagaacatgctgagcggcatctttgggaatgtgttcgttggaatttttcttttcctggccccttttatcctgctcattctgttctttatgttcggctggcgcatcctgttttgtttcaaatgctgccggagaacccgcgggctgttccggtacaagcacctcgaagacgatgaggagacgggatatagacggatcattgaacgcctgaacaacaaaaagggcaagaataaactcctggacggcgagagacttgctgatcggcgcatcgccgaactgttttctacaaagacccatattgggtga

SEQ ID NO: 13575 - RNA, 5070 nt, synthetic construct
  misc_feature 1..5070: note = derived and/or modified CDS sequence (opt5) from CCHFV(K168_40)__KX013457.1__GP
  source 1..5070: mol_type = other RNA
atgcccatcagcaccatgcacatttccctgatgtgcgccgtgctctgtctgcagctttacggccttgggggaacacatggcctccacaacgggacggagcataataagaccaacgctgtcacaacctctagcaattcccaatctagcgaatcccctgccagaacagcgccgcccgttacccctgactctcccacagtgacccctacgacccccgctagcgcccctgagggatccggcgaagcccacagctctccgcccaacaatacagaggggccttccctgcccgaaagcacctctgagcctcccgctgccacatccaccggaatcccgagcgcttctgatgtgaactccagcacgcaggccgcgcgggacacatccacccctacagtccgcacctctccccctaatagcccctccacaccccctaccccgcaggagacgcatcaccccgtgagaaaccttctgagcgttacctctcacaaacctgaagagacatccgcccccagcgaatctggcaaggagagccctgctgccaatagcccccatccggtggcttctcggcctcccacccctagcacaaccgcccagggccccacggagaacaataactataatacaaccgggcaactcgaatccctgacccagagcacaaccctgggacctatgacatctctcacgcagaccgatctgccccagtccgtcacaagcattgcggtgcaagacacccacccgtctcctacaaaccgctccaaaagaaatcttgagatggaaatcattctgaccctcccccagggcctgaagaaatactatgggaaggttcttcggctgctccagctgacgctggaggaagataccgagggactcctggagtggtgcaagcgcaaccttggcctggactgtgatgacacattctttcagaaaagaatcgaagagttctttatcaccggggaaggacatttcaacgaggtgctccaatttcggacacccggcaccctgagcacgacagaatccacccacgccggccttcctacagctgagccgttcaagtcttactttgccaaagggttcctgagcattgattccggatatttttctgctaagtgctacagccgcacctccaatagcggcctccagctgatcaacgtcaccagacactctacacggattgccgacacgcccgggcctaaaatcaccaatctgaagacaatttcctgtatcaacctcaaggccagcgtgttcaaagagcatcgcgaagtggagattaatgtcctgcttccccaggttgctgtgaacctgtctaattgccacgtgaccatcaagtcccatgtctgtgattatagcctcgacatcgatggaacagtgagactgcctcacattcatcacgacggcacctttatccccgggacgtacaaaattgttatcgaccggaagaacaaacttaatgatcgctgcacactgttcaccaactgtgtgattaagggaagagaagtccggaaaggccaatctgtgctcagacagtacaagaccgagatccgcatcggcaaggcgagcacagggtcccggagactgctgagcgacgaatctggagatgactgcatttcccgcacccagctcctgcggacagagacggccgagatccacggcgataattatgggggacctggcgacaaaattaccatctgtaacgggagcacaattgttgatcagagacttggctccgaactgggatgctacaccatcaatcgcgtgaagtcttttaaactctgcgagaacagcgctacaggcaagtcctgtgaagtcgactctatccccgtgaaatgccggcaagggtattgtctgaagattacccaggagggaagaggccatgtcaagctgagccgcgggtccgaggtggttcttgatgcctgcgactctagctgtgaagtgatgatcccgaaaggaacgggcgatattctcgtcgactgctccgggggccagcagcacttcctgaaggacaatctgatcgatctcggatgtcctaaaattcccctgcttggcaagatggccatctacatttgccggatgagcaaccatcctaaaaccacaatggctttcctgttttggttctcttttgggtatgtgatcacctgtatcgtttgcaaggccattttctacctcctgatcattgtgggaacactgggcaagagatttaaacaatatcgcgagcttaagccccagacctgtacaatctgcgaaaccacgccgacaaacgcgattgacgctgagatgcacgatctcaattgctcctacaacatctgtccttactgcgccagccggctgacctctgacgggctggccagacacgtcacccattgtcccaaacggaaggaaaaagtggaggagacagaactctatctgaatcttgagcgcatcccttgggtggttagaaagctgctccaggtctccgaaagcaccggagtggctctgaagcggtcttcctggctgattgtgcttctcgtcctgttcgccgtgagcctgtcccccgttcagagcgctcccatcggccacgggaaaacgattgagacataccaagtgagagaagagtatacctctatctgcctctttgtcctgggcagcattcttttcatcgtgtcctgtctgatgaagggactcgttaactctgtgggcaatatctttttccctgggctgagcatttgcaaaacatgttccatcggatctattaacggctttgagatcgaaagccataagtgctactgttccctgctttgctgtccgtattgccgccactgctctgccgatcgggagattcatcagctccacctgagcatctgtaaaaagagaaaaaccgggtccaatgtcatgctggcggtgtgcaagcgcatgtgtttcagagccacagttgaagtgagcaacaaggctctctctatccggtccattatcaataccacgtttgtcgtgtgcattctgatccttgccgtgtgtgtcgttagcacctctgctgtggagatggaatccctgcccgccggaacatgggagcgcgaggaagacctcaccaacttctgccaccaggagtgtcaggtgacagaaaccgagtgcctgtgtccttacgaggcgctggtccttagacggcccctgttcctcgatggcattgtgaaagggatgaagaatctgctcaacagcacgtccctggaaacatctcttagcatcgaggccccttggggcgctattaatgttcaatccacctataaacccacagtgagcgccgctaacatcgccctgtcttggtccagcgtcgaacatcgcggaaataagatcctcgtgtctggcagaagcgagtccattatgaaactggaggaacggaccgggatctcttgggacctgggagttgaggatgccagcgaatccaagctgctgaccgtgtctgtcatggacctcagccagatgtactcccctgtgtttgagtacctgagcggcgatcgccaggttgaagagtggccgaaggctacatgcacgggggactgtcccgaaagatgcggatgcacctcttccacatgtctccacaaagagtggcctcatagccggaactggcgctgcaaccccacctggtgttggggcgtgggcacagggtgcacctgttgcggactggatgtcaaggaccttttcacggactatatgtttgtgaaatggaaggtggagtacattaaaacagaagcgatcgtctgtgttgagctgacctcccaagaaagacagtgctctctcattgaggccggcacccggttcaatctggggcctgtgacaatcaccctgagcgaacccagaaacatccagcagaagctgccgcctgagattatcacactgcacccccgcattgaggaaggatttttcgatctcatgcatgtgcaaaaggtcctgtccgcttctacggtgtgtaaactccagagctgcacccacggcgttcccggggaccttcaggtgtatcacatcggaaatcttctgaagggcgataaagtcaacggccatctgattcacaagatcgagcctcattttaatacatcctggatgagctgggacgggtgtgatctcgactactattgcaacatgggagattggccctcttgcacctacacaggcgtgacccagcacaatcacgcctccttcatcaacctgcttaatattgaaacggactataccaaatcctttcatttccactctaagcgggttacagcccatggggatacccctcaactggacctcaaggctagaccgaactacggagccggcgagatcacagtgctggtcgaggtggcggatatggaactccacaccaaaaagattgagatctccgggctgaaatttgctagccttacatgtacgggatgctacgcctgttctagcggcatttcctgcaaggtccgcatccatgtggacgaacccgatgagctgaccgttcacgtgaaatctgacgaccctgatgtcgtggccgctagctccagcctgatggcccggaagctcgagttcggcacagactccacctttaaagcgttctctgctatgcccaagaccagcctgtgtttctatattgttgaaagagagtactgcaagtcctgttctaaagaagatacacagaagtgcgtgaatacgaaacttgagcaccctcagagcatcctgatcgaacataaggggaccattatcggaaaacagaacaatacatgtaccgccaagacatcctgctggctcgagtctgtcaagagctttttctatggcctgaaaaacatgctctccgggatttttggaaatgtgttcgtgggcatctttctgttccttgccccctttattctgctgatcctcttctttatgttcgggtggcgcatcctgttttgtttcaagtgctgccggagaacccgcggacttttccggtacaaacacctggaagacgatgaggagacgggctatagacggattatcgaacgcctcaacaacaagaaaggcaagaataagctgctcgacggggagagactggctgatcggcgcattgccgaactttttagcacaaaaacccatatcggatga

SEQ ID NO: 13576 - RNA, 5070 nt, synthetic construct
  misc_feature 1..5070: note = derived and/or modified CDS sequence (opt5) from CCHFV(K128_76)__KX013454.1__GP
  source 1..5070: mol_type = other RNA
atgcccatcagcgtgatgcacatttccctgatgtgcgccgtcctctgtctgcagctttacggcctcgggggaacccatggctctcacaacgagacagaacataataagacgaacgctgttaccacaagctccgactctcaaagccctgagccgcccaccagaacaaccctgcctgtgacacccgattcccctaccgtgacgcccaccacccctgcctctgcgccggaagggagcggagaggtccacacatccccgcctaatacaaccgaaggccccagcctgcctgagtctacgcccgagccgcctacagctacctccacagggatccccagcgcctctgacgtgaactccagcacccaggccgctcgggatacctctacacctacggttcatacctcccctcccaatagcccctccacaccgcccacccttcaggaaacacaccaccctatgcgcaacctgctctctgtgaccagccataaacccgaggaaacgtccgcccctagcgagtctggaaaggagtcccccgctgccaatagcccgcaccctgtcgcggacagaccctctacaagctccaccaccgcccagggccctacagaaaacaattcttataacaccacagagcaactggaaagcctgacgcagtccaccacactcggccccatgaccagcctgacacagaccgtgctttctcagtccgttacgagcattgctgtgcaagatacccatctgtctcctacaaatcggtccaaacgcaacctcgagatggaaatcattctgacccttccccaggggctgaagaaatactatggaaaggtcctcagactgctgcagctcacactggaggaggacaccgaaggccttctggagtggtgcaagcggaatctcgatctggactgtgatgacacgttctttcagaaacgcatcgaagagttctttatcacaggggaaggatacttcaacgaggtgcttcaatttagaaccccgggcacactgagcaccaccgagtccacacacgccgggctccctacggctgaacccttcaagtcttattttgccaaaggattcctgagcattgattccggctacttttctgcgaagtgctatagccggacctccaatagcggcctgcagctcatcaacgtgacacgccactctaccagaattgccgacacacccgggcctaaaatcaccaacctgaagacgatttcctgtatcaatcttaaggctagcgtcttcaaagagcatcgggaagttgagattaacgtgctgctcccccaggtggccgtcaatctgtctaactgccacgtgacaatcaagtcccatgtttgtgattacagccttgacatcgacggaaccgtgaaactgccccacattcatcacgatggcacctttatccctgggacatacaagattgtcatcgaccgcaaaaataagctcaacgatagatgcaccctgttcacaaattgtgtgattaaaggacgggaagttcgcaagggccaatctgtgctgagacagtataagacggagatccggatcgggaaagctagcaccggatccagacgcctcctgagcgacgagtctggcgatgactgcatttcccggacacagcttctgagaaccgaaacagccgagatccacggcgataactacgggggacccggcgacaagattaccatctgtaatgggagcacgattgtcgatcagcgcctcggatccgaactgggctgctataccatcaaccgggtgaaatcttttaagctgtgcgagaatagcgccacagggaaatcctgtgagatcgactctattcctgtcaagtgcagacaaggctactgtcttaagatcacccaggaaggacgcggccatgtgaaactcagccgggggtccgaggttgtgctggatgcttgcgactctagctgtgaagtcatgattcccaagggaacaggcgacatcctggtggattgctccgggggacagcagcacttcctcaaagacaacctgattgatcttggctgtcctaagatccccctgctcgggaaaatggcgatttatatctgcagaatgagcaatcatccgaagaccacaatggccttcctgttttggttctcttttggctacgttatcacctgtattgtgtgcaaggctatcttctatctgcttattatcgtcggaacgctcggcaaacgctttaagcaataccgggagctgaaacctcagacatgtaccatttgcgaaaccacacccaccaacgccatcgacgccgagatgcacgatctgaattgctcctacaacatctgtccttattgcgctagcagactcacgtctgacgggctggcccgccacgtgacacattgtcccaagcggaaagagaaggtggaagagaccgaactttacctgaacctcgagcgcattccgtgggttgtccggaagctgcttcaggtgtccgaaagcacaggagtggcgctgaaaagatcttcctggctcatcgtcctgctggttctcttcgctgtgagcctgtcccctgtgcagagcgcccccatttctcacggcaagaccatcgagacatatcaagtcagagaggaatacaccagcatttgcctttttgtgctggggtccatcctcttcatcgtttcttgtctgatgaaaggactggtgaatagcgtcggcaacatctttttccctgggctttccatttgcaagacgtgttctattggcagcatcaatggatttgagattgaatcccataaatgctattgttctctcctgtgctgtccctactgccggcactgcagcgccgatagagagatccatcagctgcacctctccatctgtaagaaacgcaagaccggcagcaacgtgatgctggctgtttgcaagcggatgtgtttcagagccacaatggaagtgtctaataaagctctttttattcgctccatcattaacaccacattcgtcgtgtgcatcctgattctcgccgtgtgtgtcgttagcacctctgcggtggagatggagtccctgcccgccgggacgtgggaaagagaggaagacctgacaaatttctgccaccaggagtgtcaggtgaccgagacagaatgcctttgtccttatgaggctctggtcctccggcgcccgctgtttcaagatagcatcgtgaagggaatgaaaaacctccttaattccacctctctggaaaccagcctgtccattgaggccccctggggcgctatcaacgttcagagcacatacaagcctgccgtgtctgcggccaatatcgctctctcctggagctctgtcgaacatagagggagcaaaattctggtgtccggacggtctgagagcatcatgaagctggaggaacgcacgggcatttcctgggaccttggggttgaggatgcctctgaaagcaagctgctcaccgtgtccgtcatggacctgagccagatgtactctcccgtgttcgagtatctctccggcgatagacaagttgaagagtggcctaaagctacatgcaccggagactgtcccgagcggtgcggctgcacaagctccacctgtctgcacaaggaatggcctcattctcgcaactggagatgcaatccgacgtggtgttggggagtggggacaggctgcacctgttgcgggcttgacgtcaaagatctgtttaccgactacatgttcgtgaagtggaaagtggagtatatcaagacagaagccattgtctgtgttgagctcaccagccaggaacggcagtgctccctgatcgaggccggaacacgctttaacctgggccccgtgacgatcaccctttctgagcctagaaatattcagcaaaagctgccccctgaaatcattacactccacccccggatcgaggaaggcttctttgatctgatgcatgtgcagaaagtcctcagcgcttccaccgtgtgtaagctgcagagctgcacacacggggttccgggagaccttcaggtgtaccacattggcaacctgctgaaaggggatagagtcaacggacatctcatccacaagatcgagcctcatttcaatacctcttggatgtcctgggacggctgtgatctggactattactgcaacatgggggattggcccagctgcacgtataccggagtgacacaacacaatcacgcgtcttttgttaaccttctgaatattgagaccgactacacaaaatccttccattttcacagcaagcgcgtgaccgcccatggcgatacaccccagctcgacctgaaggctcggcctaactacggcgccggggaaatcacggtcctcgtggaggtcgccgatatggaactgcacaccaaaaagattgagatctctggacttaaattcgctagcctgacatgtaccggctgctatgcctgttcctctgggattagctgcaaggtgagaatccatgttgacgaacccgacgagctgaccgtgcacgtcaaatccgatgaccctgatgtggttgcggctagctcctctctcatggcccgcaagctggagtttggaacagacagcacgttcaaagccttctccgctatgccgaagacctctctttgtttttacattgtggaacgggagtattgcaagagctgttccaaagaagatacacagaagtgcgtcaataccaaactggagcagccccaatctatcctcatcgaacacaagggcacaattatcgggaaacagaacaatacctgtacggccaagacaagctgctggctggagtccgttaagagcttcttttacggactcaaaaacatgctgtctggcattttcggcaatgtgtttgtggggatcttcctttttctggcgcctttcattctgctcatcctgtttttcatgtttggatggagaatccttttctgtttcaagtgctgccgccggaccagaggcctgtttcgctataaacatctcgagaacgacgaagagaccgggtaccggagaattatcgaacggctgaataacaagaaaggaaagaataagctcctggatggcgagcgccttgctgacagacggattgccgaactgttctccacaaaaacccacatcgggtga

SEQ ID NO: 13577 - RNA, 5070 nt, synthetic construct
  misc_feature 1..5070: note = derived and/or modified CDS sequence (opt5) from CCHFV(Hodzha)__KX013448.1__GP
  source 1..5070: mol_type = other RNA
atgcccgtgagcatcatgcacattctgctcatgtgcgccgtcctgtgtcttcagcaatacggcctgggggagacccatagacctaacaatggaacagaacacaacaagacgaatgttctcaccacaccgtccgacaaactgtctcccgagcctcccgtgagcaccgctctttccgtgacacctgattctagcaccgtcacacccaccacgcctgtgtccggcctggaagggtctggagaggtttataccagcccgcccgtgacaaccaagggcctctcccctagcaaagccacatctgaactgcccgcgaccacggggatcgacacatccagcgcttctgatgtcgactccagcacccaggccgcccgggatacatctaccctgaccgtgcgcacatcccctcccagctccccgtctacgcctcccaccagccaggacacataccatctcgttagaaacctgctttccgtgaccagccctcggcccgaggagacaaccgctccctctaagtccggaaaagaaagccctgtcgccaattctccgcaccccgtgacgagccgcccttcctctccccctattacagtgcagggccccaccgagaacagctcccataataccacaggccaactggaaagcatggctcagtctaccacactcgtcccgatggcctcccctacgcagaccgttctgagccagtctgtgacatcccttgcggtgcaagatgcccaccccagccctaccaacagatccaagcggaatctggagatggagatcattctcacactgccccaggggctgaagaaatattacggaaaggtcctccgcctgcttcagctgaccctcgaagaggacacggaaggcctgcttgagtggtgcaaaagaaacctggggctcgattgtgacgataccttctttcagaagcggatcgaagagttctttatcacaggagagggccacttcaatgaagtgctgcaatttaaaaccccttctacactgagcaccacggagtccacacatgctgtttctcccaccgccgaaccgttcaagagctattttgctaaggggttcctctccattgacagcggatacttttctgccaaatgctattccaagacaagcaactctggcctgcagcttatcaatgtgacccgccactccaccagaattgcggatacacctggccccaaaatcacgaacctgaagaccattagctgtatcaatctcaaagcctctgtcttcaaggagcatcgggaagtggagattaacgttctgcttccccaggtggctgtcaacctgagcaattgccacgtgacaatcaaatcccacgtctgtgactacagcctcgacgtggatgggaccgttcgcctgcctcatatccaccatggaggcacatttattccggggacctacaagatcgtgattgacaagaaaaacaagctgaatgatagatgcacgctctatacaaactgtgtcatcaaaggacgggaggtgcgcaagggccaatctattctgagacagtacaaaaccgaaatccggatcgggaaggcctccaccggaagcagacgccttctgtccgaggaatctggcgacgattgcattagccggacacagctcctgagaaccgagacagctgaaatccacggcgacgattatgggggacccggcgacaagattacgatctgtaatgggtccaccattgttgatcagcgcctgggatctgagcttggctgctacacaatcaaccgggtgaaatccttcaagctctgcgagaatagcgccaccgggaaatcttgtgaaatcgacagcacacctgtcaagtgcagacaaggctattgtctgaaaattacccaggagggacgcggccatgtgaagctgtcccgggggagcgaagtggttctcgatgcctgcgactcttcctgtgaggtcatgatccccaagggaacgggcgacattctggtggattgcagcgggggacagcagcactttcttaaagacaacctgatcgatctcggctgtcctcgcattcccctgctggggaagatggctatctacatttgcagaatgtctaatcaccctgagaccacaatggcgttccttttctggttttccttcggctatgtgatcacctgtatcctctgcaaagccatcttttacctgctgattattgtcggaacactcggcaagcggttcaaacaatacagagaactgaagccccagacctgtacaatctgcgagaccacgccggctaacgccattgacgccgaaatgcatgatcttaattgcagctataacatctgtccttactgcgcttctcgcctgacatccgacgggctcgcccggcacgtgacccagtgtcccaagagaaaagagaaggttgaagagaccgagctgtatctgaatcttgaacggatcccttggattgtgcgcaaactcctgcaggtcagcgagtccacaggagtggcgctgaagagaagctcttggctcatcgttctgcttgtgctgtttgctgtcagcctctcccccgtgcaatctgccccgattggccatgggaaaaccatcgaaacgtaccaggcccgggaggaatatacaagcatttgcctgttcgttctgggatccatcctttttatcgtgtcttgtctcatgaagggcctggtcgatagcattgggaacatcttctttcctggcctgaccatttgcaaaacatgttccatcggatctattaatggcttcgagatcgagagccacaagtgctactgttccctcctgtgctgtccctattgcagacactgccctgctgaccgcgaaatccatcagcttcacctgagcatttgtaagaaacggaagaccgggtctaacgtgatgctcgccgtgtgcaaaagaatgtgttttcgcgctacaatggaggtctccaacaaggccctgctgatcagaagcattatcaataccacgttcgttgtgtgcattcttatcctggcggtgtgtgtcgtgtctacctccgccgttgaaatggagagcctccccgctggaacatgggaacgggaggaggatctgaccaacttttgccatcaggaatgtcaagtgacagagaccgaatgcctctgtccctacgaggccctggtccttcgcagacctctgttcctcgactccattgtgaaaggcaagaagaatctgctgaactctacgagccttgagacatccctgagcatcgaagctccgtggggagccatcaatgttcagtctacctacaaacccacagtgtccaccgcgaacattgccctcagctggtctagcgtcgagcaccgggggaataagatcctggtgtccggccgctctgaaagcattatgaaactcgaggaaagaaccgggatctcctgggatctgggcgttgaggacgcttctgagagcaaacttctgacagtgtccgtcatggatctcagccagatgtattctcctgtgttcgaatacctgtccggagaccggcaagtggaggaatggcccaaagccacgtgcaccggcgactgtagcgagcgctgcgggtgcacatcctctacctgtctgcataaggaatggcctcacagcagaaactggcggtgcaatcccacatggtgttggggagtcggcaccgggtgcacgtgttgcggacttgatgttaaggacctgtttacagattatatgttcgtgaaatggaaggtggactacattaaaaccgaggctatcgtctgtgtggagctcacctcccaggaacgccagtgctctctggttgaggccggcacaagatttaacctcggccctgtgaccatcacactgagcgaaccgcggaatattcagcaaaaacttccccctgagatcattacgctgcaccccagaatcgaagaggggttctttgatctgatgcatgtccagaaggtgctctccgccagcaccgtttgtaagctgcagtcttgcacacacggagtgcctggcgaccttcaggtctatcatattgggaacctgctcaagggagataaagtgaatggccacctgatccataagatcgagccccacttcaacacctcctggatgagctgggacgggtgtgatctcgactactattgcaatatgggagattggccgtcttgcacatacaccggcgtcacgcaacacaaccatgcttcctttgtgaacctgcttaatattgaaaccgactacacaaagagcttccactttcattctaagcgcgttaccgcgcacggcgatacacctcagctggacctgaaagcccggcccacctatggggctggagagatcacagtgctcgtcgaagtggccgacatggagctgcacacgaagaaaattgagatcaccggccttaagttcgccagcctgacatgtaccgggtgctacgcttgttcctctggaattagctgcaaggttagaatccatgtggatgaacccgacgagctcaccgtccacgtgaaatccgatgaccctgatgtggttgccgcgagctcctctctgatggctcgcaagctcgaatttggcacagacagcacgttcaaagccttttccgccatgcccaagacctctctgtgtttctatattgtcgagcgggaatactgcaaaagctgttccaaggaggatacacagaagtgcgtgaacaccaaacttgagcagcctcaatctatcctgatcgaacagaaggggacaattatcggaaaacagaataacacctgtacggctaaggccagctgctggctggagtccgtgaaatctttcttttatggcctcaagaatatgctgagcggcattttcgggaacgtctttgtgggaatcttcctttttctggcgccgttcattctcctgatcctctttttcatgtttggctggagaatcctgttctgttttaagtgctgccgccggacaagagggcttttcaaatacaagcatctgaaagacgatgaagagaccggatatcgccggattatcgaaagactgaataacaagaaaggcaagaataagctcctggacggggagcggcttgctgatcgcagaattgccgagctgttctccaccaaaacacacatcggatga

SEQ ID NO: 13578 - RNA, 5070 nt, synthetic construct
  misc_feature 1..5070: note = derived and/or modified CDS sequence (opt5) from CCHFV(Hy13)__AY900145.1__GP
  source 1..5070: mol_type = other RNA
atgagcttctccatcatgtacacacccctgctctgcgccgtgctgtgtcttcagctgtggtctctcgagggcagccacgggctgtccaacaagacccaacattctaatacgagcaccacaaaagctcctgaagtctcccaggagtttggacttccggtttctaccgtgagcacaattacctccgatccccctagcatcacatctgccgtgtccgtcagcggctctgaagggtccggagacaccaacacgagcccctctgtgaccacacagggcctgaccctccctgagacaaccctggaactgctcacgacaaccgacacagatgcgtccagcaccgttgtggtcgacgtgtccacccagacagttaaggatacgcccatttctaccacacacaccagcctgccttccacaccgagcgctaccacgacaccccaagggacccatcacaccgccagaggacttctgtctgtgacatccaccaaacctgagggcgccagcacacaggctaatcccgagaagatctctatggaaacgaacagccctcggctcgccatttccgagaccccctctttcagcccgacaacccaggctcctacagaaaattccaaccccatcaccagcaaacagctgatcttttctgcccaacctgtcacgcccaatcccgtgacccctccggtgcagcccgcgctttcccagagcgacacatctaccgccattcaggatatccatccttcccccacaagccgctccaagagaaacctggagatggagattatcctcaccctgtctcaaggcctgaagaaatattacgggaagattctcaaactgcttgacctgacgctcgaagaggatacagaaggactgcttgagtggtgcaagcggaatctgggcctcgtctgtgacgctgatttctttcagaaacgcatcgaagagttctttctgaccggggagggacacttcaacgaagttctgcagtttaagacacctagcaccctctcccccaccggcccggccagaacagggtctcctacggtggagcccttcaagagctattttgctaaaggattcctgtccatggacagcggctacttttctgccaagtgctatcctcgggcgtccaatagcggccttcaactgattaacgtgacccagcactctacacgcatcaccgatacacccgggcctaaagtcaccaatctcaagacgatcaactgtattaatctgaaagcctccgtgttcaaggaacatagagagatcgaaattaacgttcttctgccccaggtggctgtcaacctcagctcttgccacgtgctgatcaaaagccatgtttgtgactactccctggacattgatggaccggtgcggctccctcgcatccaccacgagggcacattcatccccgggacctataagctggtcattgacaagaaaaataagcagaacgatagatgcacccttatcacaaattgtgtgattaaaggacgggagatccgcaagggccaaagcgtcctgagacagtaccggaccgaaattaaaatcgggaaggcctcttccggaagccgcagactcctgtccgaggaatctggcgacgattgcatcagccggacacagctgtccagaacggagaccgctgaaattcattctgacaactacggcgggcccggagataagatcacaatttgtaatggcagcaccatcgtggaccagcgccttgggtccgagctcggatgctatacaattaaccgggttaaatcttttaagctgtgcgagaatagcgccaccggcaaatcctgtgaaatcgatagcacgcctattaagtgcagacaagggttctgtctgaaaatcacccaggagggccgcggacacgtgaagctctctcggggctccgaagtcgtgctggacgcctgcgatagctcttgtgagatcatgattccgaaggggacaggagacatccttgttgactgctccggcgggcagcagcattttctgaaagataacctcattgacctgggatgtcccaatatccctctgcttggcaagatggctatttacatctgcagaatgagcaaccaccccaaaaccacaatggcgttcctcttttggttctcttttgggtatgtgatcacctgtattctgtgcaaggtcatcttctacctgctcattgtggtgggcacactggggaaaaagtttaagcaatatcgcgagcttaaacctcagacctgtacgatctgcgaaacaacccccgttaatgccattgatgctgagatgcatgacctgaactgctcctacaatatctgtccttattgcgccagccggctcacctccgatggcctggccagacacgtcatgcagtgtcccaagcgcaaagaaaaggtggaggaaacagagctgtaccttaacctcgagcggatcccgtgggtggtcagaaaactgcttcaggtgagcgaatctaccggggttgctctcaagcgcagctcctggctggtggtccttctggtgctcctgacggtttctctgagccctgtgcaatccgcccccattggacacggcaaaacagtcgagacctaccagacacgggaagggtatacctctatctgccttttcgtgctcggaagcattctgtttatcgtttcctgtctgatgaagggcctcgtggactctgtcgggaatagcttctttcctggctccagcatttgcaagacatgttctatcggatccatcaacggcttcgagattgaaagccataaatgctactgttctctgttctgctgtccctattgcagacactgctccgcggatcgggagatccataagctgcacctgagcatttgtaaaaagcgcaaaaccgggtccaacgtgatgctcgctgtgtgcaagagaatgtgttttcgggccacggtcgaggtttctaataaggccctgctgatcagaaacattatcaataccacattcgtggtgtgcattcttatcctggctgtctgtgtggttagcacctccgccgtggaaatggagagcctcccggctggaacatgggaacgcgaggaagacctgaccaacttttgccaccaggagtgtcaagccacggagacagaatgcctctgtccttacgaggcgctggtccttcggaaacccctgttctctgattccatcgtgaagggcatgaaaaatctcctgaacagcacctctctggaaacaagcctttccattgaggccccttggggagctatcaatgttcagtctacctttaagcccaccgtgagcgccgctaacattgccctgtcctggtctagcgtcgagcatagaggaaataaaatcctcgtgtccggccgcagcgaatctattatgaagctggaggaaagaacagggatctcctgggacctcggcgttgaggatgcgagcgaatccaagctgcttacggtgtctatcatggacctgagccagatgtattcccccgtcttcgagtacctctctggagatcgccaggtggaggaatggcctaaagctacctgcacaggcgactgtccggagcggtgcgggtgcaccagctccacatgtctgcacaaggaatggccccatagcagaaactggcggtgcaatcctacctggtgttggggagtgggcacggggtgcacatgttgcggactggacgtcaaagatctttttaccgaccacatgttcgttaagtggaaagtggagtatattaagaccgaagccatcgtgtgtgtcgagctgacatctcaagagcgccagtgctccctcattgaagccggcaccagatttaacctgggccccgtgacaatcacgctcagcgagcctcggaatattcagcagaagctgccccctgaaatcgttacccttcatccgcgcatcgaggaagggttctttgatctgatgcacgtgaaaaaggtcctgtctgcttccacagtgtgtaaactccaaagctgcacccacggagttcccggcgaccttcaggtgtaccatattgggaacctgctgaagggagataaagtcaatggccacctcatccataagattgagcctcacttcaacacatcttggatgagctgggacgggtgtgatctggactactattgcaacatgggagattggccctcctgctcttacaccggcgtgacgcagcataatcacgccgcctttgtcaacatgctcaatatcgagaccgactatacaaaaattttccacttccatagcaagagagtgaccgctcacggcgatacacctcagctggaccttaaggcgcggcccacctacggggccggagaaatcacagttctggtggaggtcgctgatatggaactgcatacgaaaaagattgagatctccggcctcaaatttgccagcctgacctgtacagggtgctatgcctgttcctctggaatcagctgcaaggtgcgcattcacgttgacgagccggacgaacttaccgtgcacgtcaaatccgaggatcctgacatcgtggctgcctctagctccctgatggcgagaaagctcgagttcggcaccgattctacatttaaggctttcagcgccatgcccaaaacgtccctgtgtttttacattgtggaacgggaatattgcaagagctgttctaaagaggacacccaaaagtgcgttaacacaaaactcgagcagccccagtccatcctgattgaacataaggggaccatcatcggaaagcaaaatgatacatgtaccagcaaagccggctgctggcttgagtctgtcaagtccttcttttacggcctgaaaaacatgctgagcgggattttcggaaatgtgtttatcggcattttcctctttctggctcctttcatccttctgattctcttctttatgttcgggtggagaatcctgttttgtttcaagtgctgccgccggacgagaggactctttaaataccgccacctgaaggacgatgaagagacaggctatcggaagatcattgaaagacttaacaataaaaaggggaaaaacaagctgctggacggagagcgcctcgccgatcggaaaatcgcggagctgttctctaccaagacccatattggctga

SEQ ID NO: 13579 - RNA, 5070 nt, synthetic construct
  misc_feature 1..5070: note = derived and/or modified CDS sequence (opt5) from CCHFV(SPU415/85)__DQ211635.1__GP
  source 1..5070: mol_type = other RNA
atgcccgtgaacatcatgtacacccctctggtctgcgccgttatttgtctccagctgtggaatcttggcgggacactggtgttcatcaacagaacgcaacacaatgagaccggaacagtggctaccccggaaggcacactccggccccgcctgcctgtcagcaccgcccttcccacaaagtccgacagaccttctgtggggcccgcggctagctcctctggactggagggcagcggggaacctaacacctccccgtctattacgaccaaaggactcacaccccctgagaccacacccgccctgcctaccgccacggatacagacgctagctccaccggcgttgtggatgtcagcacacagatgaccaaggacatccccatgtctaccgcctatacaaatccgccttccacgcccagcgctccttctacgccccagggcacacatcacaccgcccgggggctgctctccgtggcgagcacaaaatctgaagaggtttccatgagcacctcccccgccaagacgtctacagagaccagctcccctccgcccgctaccagcgaaacacctaccccctctcctacaacccaggtgcccaccggaaacaataacccgaatacatcccgccaacctacccccagcgcccagcctgctatgtctaaccccgccacaagccctgcgcagcccaatctgtcccagtctgccccgcctaccgctgatcaaggcgtccatcccagccccacgaacagatccaaacggaatcttgagattgaaatcatcctgaccctcagccaggggctgcgcaagtactatggaaagattcttaaactgctcgacctgacactggaggaggataccgaaggcctcctggagtggtgcaagagaaaccttgggctgacatgtgacgataactttttccagaaacggatcgaagagtttttcctcaccggagaaggctactttaatgaggtgctgcagttcaaggtgccttctacgctttccagcacagagccgacccacacaagaccccctaccgtcgaaccctttaaatcttatttcgccaagggctttctgtccatgaacagcgggtacttctccgctaagtgctatcctcgcacctctaatagcggactccaactgattaacgttacaaaacattccgccaagatcgccgacacgcccggccctaaaattaccaatctgaagacaatcaactgtattaatctccgggcttctgtgtttaaagagcaccgcgaagtggagatcaacgtcctgcttccccaggtggcggttaatctgagcaactgccacgcccagatcaagtcccatgtgtgtgattacagcctcgctaccgacgggatggtcagactgccgcacattcatcacgaaggaacattcatccctggcacctacaaaattgtgatcgataagaagaataaacaaaacgaccggtgcacgcttgttacaaattgtgtgattaaggggcgcgaggtcagaaaaggacagtctgccctgcggcagtataagaccgagatcagaatcggcaaagcctccagcggctctcgccggctcctgtccgaagagagcgacggggattgcatttctagaacccagctgctccgcacagaaaccacagagatccacagcgacaactacggaggccccggggataagattacgatctgtaatggatccaccattgtggaccaacggctgggcagcgaacttgggtgctatacaatcaacagagtcaagtcttttaaactgtgcgaaaattccgctaccggcaagagctgtgagatcgattccacacctgtgaaatgccgccagggattctgtctcaagattacccaggaaggccgggggcatgttaaactgtctagaggaagcgagatcgtgctggacgcctgcgattccaactgtgaaattatgatccccaagggcacgggggacattcttgtcgattgctctggaggccagcaacacttcctcaaggacaacctgatcgatctggggtgtccgaatattcctctcctgggcaaaatggcgatctacatctgccgcatgagcaaccatcccaagaccacaatggcttttcttttctggttttccttcggatatgtgattacctgtatcctgtgcaaagttatcttttacctcctgattgtggccggcacagtcgggaagaaattcaagcagtatcgggagctgagacctcagacctgtacaatttgcgagaccatccccgtgaatgccatcgacgctgaaatgcacgaccttaactgctcttacaatatttgtccctactgcgccagccgcctcacgtccgatggactggctcggcatgtgatgcagtgtcctaagagaaaagagaaggttgaagagacagaactgtatctcaacctggagcggatcccgtgggtcgtgcgcaaacttctgcaagtgagcgagtctaccggcgtcgccctcaagagatccagctggctgaccgtgctgcttgttctcctgattgtgtctctgtcccccgtccagagcgcgcctatcgggcacggaaaaacaattgaaacctaccaggcccgggagggctatacgtctttttgcctcttcatcctggggtccatcctttttgtggttagctgtctggtgaagggcctcattgactccgtcggaaatagcttctttcccggcctgtctatctgcaaaacatgtagcattgggtccatcaacggattcgaaattgagtctcacaagtgctactgtagcctgttttgctgtccttattgcagacattgctccgctgatcgcgaaatccacaagctgcatctctctatctgtaaaaagcggaaaaccggcagcaatgtgatgctggccgtttgcaagagaatgtgtttccgcgctacaattgaggtgtccaacagagccctgctcatccggaatattatcaacaccacattcgtcgtgtgcattctgacccttgcggtgtgtgtcgtttctacgagcgccgtggagatggaatccctgcccgctgggacctgggagaaagaagaggacctcacaaatttttgccaccaggaatgtcaagtgaccgagacagagtgcctgtgtccttacgaagccctggtccttcgcaagccgctgttcctcgatagcatcgtgaagggaatgaaaaacctgctcaattctacctccctggagacgagcctttctattgaagctccctggggcgccatcaacgttcagtccacatttaagcctaccgtgagcgccgctaacatcgcgctgtcctggtctagcgtcgagcacagagggaataaaattctcgtgtccggccggagcgagtctatcatgaagctggaggagcgcacaggaatttcctgggacctgggcgttgaagatgccagcgagtctaaacttctgaccgtgagcgtcatggacctctcccagatgtattctcccgtgttcgaatacctgagcggggatagacaagttgaggagtggcctaaggctacctgcacaggagactgtcccgaacggtgcggctgcacgtcctctacctgtctccataaggagtggccgcacagccgcaactggagatgcaatcctacatggtgttggggagtggggaccggctgcacatgttgcggcctggatgtcaaagacctttttaccgattacatgttcgtgaagtggaaagtggaatatatcaagacggaggccattgtctgtgttgaactgacatcccaggagcggcagtgcagcctcatcgaggccgggacccgctttaacctgggacccgtgaccatcacactgtctgaacccagaaatattcagcaaaaacttcctcccgagatcattaccctgcatcctcggatcgaagagggcttctttgacctcatgcacgtgcagagagtcctgtccgctagcacagtgtgtaagctccagtcctgcacgcatggggttccgggagaccttcaggtgtaccacattggcaaccttctgaagggggataaagtcaatggacacctgatccataagatcgaaccccacttcaacacctcttggatgagctgggacggctgtgatctcgactattactgcaatatgggcgattggccttcctgcacatataccggggtgacacaacataaccacgccgcgtttgttaatctgcttaacattgagaccgactacacgaaaaatttccattttcactctaagcgcgtgaccgctcacggagatacaccccagctggacctcaaagcccggcctacctatggcgccggggaggtcacagtgctggtcgaagtggctgatatggagctccataccaagaaaatcgaaattagcggactgaagttcgcctcccttacatgtacgggctgctacgcgtgtagctctgggatctcctgcaaggttaaaattcacgtggacgagcccgatgagctgaccgtccatgttaagagcgaagacccggatatcgtggctgccggatcttccctgatggccagaaaactcgagttcggcgctgacagcacatttaaggccttctctgctatgcctaaaaccagcctgtgtttttacattgtggaacgcgagtattgcaagtcctgttctcgggaagacaccagaaagtgcgtcaacacaaaacttgatcgcccccagagcatcctgatcgagcacaagggcacgattatcgggaaacagaataacacctgtacagccaaggcgtcctgctggctcgagagcgtgaaatccttcttttacggactgaagaacatgctctctggcattttcgggaatgtgtttatcggaattttcctgtttatcgcccctttcgttcttctgatcctgtttttcatgttcggctggcggattctcttttgtttcaagtgctgcagacgcacccgggggctgtttaaatatagacaccttaaggacgatgaagagacaggataccggaaaatcattgaacgcctgaacaataagaaaggcaagaacaagctcctggacggcgagagactcgctgatcggaaaatcgccgaactgttcagcaccaagtcccatattgggtga

SEQ ID NO: 13580 - RNA, 5070 nt, synthetic construct
  misc_feature 1..5070: note = derived and/or modified CDS sequence (opt5) from CCHFV(SPU97/85)__DQ211633.1__GP
  source 1..5070: mol_type = other RNA
atgaccgtgaacacagtctgcacgcccctggtttgtgccgtgttctgcctccagctgtggaatcttggcgggaccctggtgcctacaaacagaacccaacacaataagacaggaaccatggctacaccggagggcaccctcgggccccggctgcctgtcagcacggcccttcccaccaaatccgaccgcccttctgtgggacccgcggctcctagctccggcctggaagggtctggagagccgaacacaagcccctccatcaccacaaagggcctcgccctgcctgaaaccacgcccgcccctcccacagctaccgatacagacgcctctagcaccggcgttgtgaatgtctccacccagatgacaaaagatattccgatgagcacggcttacaccaaccctccctctacaccttccgcccccagcacgccccaggggacacatcacaccgcgagaggactgctctctgtggcctccaccaagagcgaggaagtttctatgtccacaagccctggcaaaacctccaccgagacatctagcccgccccctgctacctccgagacacccgcccctagccccacgacccaggctccgacagggaataacaatcctaacacctctcggcaacccacaccttccgcccagcccgcgatgagcaatcctaccacgtctcccgcccagccgaacctgcttcagaatgctcctcccaccgccgaccaaggagtgcatcccggccctacaaaccgcagcaagagaaatctggaaatggagatcattctcaccctgtcccaggggcttcggaagtattacggaaaaatcctgaagtttctcgatctgacactggaagaggacaccgagggcctcctggaatggtgtaaacgcaaccttggcctgacgtgcgatgacaacttctttcagaagagaattgaggagttctttctcacaggggaaggatatttcaatgaagtcctgcagtttaaagtgccgtctacccttagctccacagagcccacccacaccggcagccctacagtggagcccttcaagtcttactttgctaaggggttcctgtccatgaacagcggatatttttctgccaaatgttaccctcggacgtccaatagcggcctccaactgatcaacgtcaccaagcattccgccaaaatcgctgatacacccgggcctaagattaccaatctgaaaacaatcaactgcattaatctccgcgcgtctgttttcaaggaacacagagaggtggaaatcaacgtgctgcttccccaggtcgccgtgaatctgagcaactgtcacgctcagattaaatcccatgtttgcgactattctctcgccaccgatggaatggtgcggctgccgcgcatccaccatgagggcacgtttattcctggcacatacaagatcgtcatcgacaagaaaaataagcaaaacgatagatgtacccttgtgaccaattgcgttattaaagggcgggaagtgcgcaagggacagagcgccctgagacagtacaaaacagagatccggattggcaaggcttccagcgggtctagacgcctcctgtccgaggaaagcgacggagactgtatctctcggacccagctgctcagaacagagacggccgaaattcactccgataactatggcgggcccggcgacaagatcaccatctgcaatggaagcacaattgtcgatcaacgcctgggctctgagcttgggtgctacaccatcaaccgggtgaaatccttcaagctgtgtgaaaacagcgcgacaggaaaaagctgcgagattgactctacccctgtcaagtgtagacagggcttctgcctcaaaatcacgcaggaggggcgcggacacgtgaagctgtcccggggcagcgaaattgttctggatgcttgtgactcctcttgcgagatcatgatccccaaggggaccggcgatattcttgtggactgtagcggaggccagcaacattttctcaaagataatctgatcgacctggggtgcccgaacattcctctcctgggaagaatggccatctatatttgtcgcatgtccaatcaccccaagacaaccatggccttcctgttttggttctcttttggctacgtcatcacatgcattctttgtaaagtgatcttctatctcctgatcgttgctgggaccgtgggaaagaaatttaagcagtaccgggaactgagacctcagacatgcaccatttgcgagacgacacccgtcaacgccatcgatgctgagatgcatgaccttaattgtagctataacatttgcccctactgtgcctcccgcctcacctctgacggcctggcgcggcacgtgatgcagtgccctaagagaaaagaaaagatcgaggaaaccgagctgtacctcaatctggaacggattccgtgggtggttcgcaaacttctgcaagtcagcgagtccacaggggtggccctcaagagaagctcttggctgaccgtgctgcttgtcctcctgatcgtgtccctgagccccgttcagtctgctcctatcggccatggaaaaacgattgagacatatcaggcccgggaaggctacacctccttctgtctctttatcctggggagcattcttttcatcgtgtcttgcctggtcaagggactcattgattccgtgggcaacagctttttccccgggctgtccatctgtaaaacatgcagcatcggatctgttaatggctttgagattgaaagccacaagtgttattgctccctgttctgttgcccttactgcagacactgttctgctgaccgcgagatccataaacttcacctcagcatttgcaagaagcggaaaaccgggtccaacgtgatgctggccgtctgtaagagaatgtgcttccgcgcgacaatcgaagtgtctaatagagccctgctcattcggagcatcatcaacaccacgtttgctgtttgtattctgacccttgccgtgtgcgtcgtgtccacatctgctgtggagatggagagcctgcccgccggcacctgggaacgcgaggaagatctcacaaatttctgtcatcaggagtgccaagtcaccgaaacggagtgtctgtgcccttatgaggccctggttcttagaaaaccgctgtttctcgactccatcgtgaagggaaagaaaaacctgctcaatagcacatctctggaaacctcccttagcattgaggctccctggggcgcgatcaacgtgcagtctacattcaagcctaccgtctccgccgctaacattgccctgagctggtcctctgtggaacaccgggggaataaaatcctcgttagcggacgctccgagagcattatgaagctggaggaaagaaccggcatctcttgggatctgggggtggaggacgcctccgaaagcaaacttctgacagtctctgtgatggatctcagccagatgtactcccccgtttttgagtatctgtctggagaccggcaagtggaagagtggcctaaggctacgtgtaccggcgattgccccgagcgctgcggctgtacaagctccacatgcctccacaaggaatggccgcattctagaaactggcggtgtaatcctacctggtgctggggagtcgggaccggctgtacgtgctgtgggctggacgtgaaagatcttttcacagactacatgtttgttaagtggaaagtggagtacatcaagaccgaagccattgtctgcgtggagctgaccagccaggaacgccagtgttccctcatcgaggcgggaacaagattcaacctgggccccgtgaccattacactgagcgagccccggaatatccagcaaaaacttcctcccgaaattatcacgctgcaccctagaatcgaggaagggtttttcgatctcatgcatgtccagaaggttctgtctgcttccaccgtgtgcaagctccagagctgtacacacggagtgccgggcgacctgcaggtctatcatattggcaaccttctgaaaggggacaaggtgaatggacacctgatccacaaaattgagccccattttaacacctcctggatgtcttgggatggctgcgacctcgattactattgcaatatgggggactggcctagctgtacatacaccggagttacgcaacacaaccatgccgccttcgtgaatctgcttaacatcgaaaccgattatacaaagaattttcacttccattccaaacgcgtcaccgctcacggcgacacaccccagctggatctcaaggcccggcctacctacggggcgggagaggtgacagttctggtggaggtcgctgacatggaactccacacgaaaaagattgagatctctggcctgaagttcgccagcctttcctgcaccggctgttatgcctgcagctctgggatctcctgtaaagtgcgcattcatgtcgatgaacccgacgagctgacagtgcacgttaagagcgaggatccggacatcgtggctgccggatcttccctgatggctagaaaactcgaatttggcgccgatagcaccttcaaggcgttttctgccatgcctaaaaccagcctgtgcttctacattgtcgagcgggaatactgtaagtcctgctctagagaggacacacagaagtgtgtgaacacgaaacttgaacgcccccagagcatcctgattgagcataaggggaccatcattggaaaacaaaatgacacatgcaccgctaaggcctcctgttggctcgagagcgttaaatcctttttctatggcctgaagtctatgctcagcgggatctttggaaacgtgttcatcggcatttttctgttcatcgctccttttgtccttctgattctgttcttcatgtttggctggcggatcctcttctgctttaagtgctgtagacgcacacgggggctgttcaaatacagacaccttaaggatgacgaagagaccggatatcggaaaattatcgaacgcctgaacaataagaaaggcaagaacaagctcctggatggggagagactcgccgaccggaaaatcgccgaactgttttccacgaagtctcacattggatga

SEQ ID NO: 13581 - RNA, 5070 nt, synthetic construct
  misc_feature 1..5070: note = derived and/or modified CDS sequence (opt5) from CCHFV(C-68031)__DQ211629.1__GP
  source 1..5070: mol_type = other RNA
atgagcttctccatcatgtacaccccgctgctctgcgccgtgctgtgtcttcagctgtggtctctcgagggcagccacgggctgtccaacaagacacaacattctaatacgagcaccacaaaagctcctgaagtctcccaggagtttggacttccggtttctaccgtgagcacaattacctccgatccccctagcatcacatctgccgtgtccgtcagcggctctgaagggtccggagacaccaacacgagcccctctgtgaccacacagggcctgaccctccctgagacaaccctggaactgctcacgacaaccgacacagatgcgtccagcaccgttgtggtcgacgtgtccacccagacagttaaggatacgcccatttctaccacacacaccagcctgccttccacaccgagcgctcccaccacgcctcaagggacacatcacaccgccagaggacttctgtctgtgacctccacaaaacccgagggcgccagcacccaggctaatcctgagaagatctctatggaaacaaacagcccccggctcgccatttccgagacgccgtctttcagccctaccacacaggctcccaccgaaaattccaaccctatcacaagcaaacagctgatcctttctgcccaacccgtcacccccaatcctgtgacgccgcccgtgcagcctgcgctgtcccagagcgacacctctacagccattcaggatatccatccctcccctaccagccgctccaagagaaacctcgagatggagattatcctgacactgtctcaaggcctcaagaaatattacgggaagattctgaaacttctggacctcaccctggaagaggatacggaaggacttctggagtggtgcaagcggaatctcggcctggtctgtgacgatgactttttccagaaacgcatcgaagagtttttcctgacaggggagggacactttaacgaagttctccagttcaagacccccagcacactgtccccgaccggccctgctagaaccgggtctcccacagtggagccttttaagagctatttcgccaaaggatttctttccatggatagcggctacttctctgctaagtgctatccccgggcctccaatagcggcctgcaactcattaacgtgacgcagcactctacccgcatcacagacacccctgggcccaaagtcacaaatctgaagaccatcaactgtattaatcttaaagcgtccgtgtttaaggaacatagagagatcgaaattaacgttctgctcccccaggtggccgtcaacctgagctcttgccacgtgctgatcaaaagccatgtttgtgactactccctcgatattgacggacctgtgcggctgccccgcatccaccacgagggcacgttcatccccgggacatataaacttgtcattgataagaagaataagcagaacgacagatgcaccctgatcaccaattgtgtgattaaaggacgggagatccgcaagggccaaagcgtcctcagacagtaccggacagaaattaaaatcgggaaggcttcttccggaagccgcagactgctgtccgaggaatctggcgatgactgcatcagccggacccagctttccagaacagagacggccgaaattcattctgataactacggcgggcctggagacaagatcaccatttgtaatggcagcacaatcgtggatcagcgcctcgggtccgagctgggatgctataccattaaccgggttaaatctttcaagctgtgcgagaatagcgctacaggcaaatcctgtgaaatcgacagcaccccgattaagtgcagacaagggttttgtctcaaaatcacgcaggagggccgcggacacgtgaagctgtctcggggctccgaagtcgtgcttgatgcctgcgacagctcttgtgagatcatgattcccaaggggaccggagacatcctggttgattgctccggcgggcagcagcatttcctcaaagacaacctgattgatctgggatgtcctaatatcccccttctcggcaagatggccatttacatctgcagaatgagcaaccaccctaaaacaaccatggcttttctgttctggttttctttcgggtatgtgatcacatgtattctgtgcaaggtcatcttttacctcctgattgtggtgggcacccttgggaaaaagttcaagcaatatcgcgagctgaaaccccagacatgtaccatctgcgaaacgacacctgttaatgcgattgacgccgagatgcatgatctcaactgctcctacaatatctgtccctattgcgctagccggctgacctccgacggcctggccagacacgtcatgcagtgtccgaagcgcaaagaaaaggtggaggaaaccgagctttacctcaacctggagcggatcccttgggtggtcagaaaactgctccaggtgagcgaatctacaggggttgccctgaagcgcagctcctggcttgtggtcctgctcgtgctgctgaccgtttctcttagccccgtgcaatccgctcctattggacacggcaaaacggtcgagacataccagacccgggaagggtatacatctatctgcctctttgtgctgggaagcattctgttcatcgtttcctgtctcatgaagggcctggtggattctgtcgggaatagctttttccccggcctttccatttgcaagacctgtagcatcggatctatcaacggctttgagacagaatcccataaatgctactgtagcctgttctgctgtccgtattgcagacactgctctgccgaccgggagattcataagctccacctgtccatctgtaaaaagcgcaaaaccgggagcaacgtgatgctggcggtgtgcaagagaatgtgtttccgggctacggtcgaggtttccaataaggcccttctgattagaaacatcattaataccacatttgtggtgtgcatcctcattctggccgtctgtgtggtttctaccagcgctgtggaaatggagtccctccctgccggaacatgggaacgcgaggaagatctgaccaacttctgccaccaggagtgtcaagtcacggagacagaatgcctttgtccctacgaggctctggtgctccggaaacctctgtttagcgactctatcgttaagggcatgaaaaatctgcttaactccaccagcctggaaacatctctcagcatcgaggccccctggggagcgattaatgtgcagtccaccttcaagcccaccgtctctgccgctaacatcgccctgagctggtcctctgtggagcatagaggaaataaaattctcgttagcggccgctccgaaagcatcatgaagctggaggaaagaacagggatttcttgggatcttggcgtggaggacgcttccgaaagcaagctgctcacggtctccatcatggatctgtctcagatgtatagccctgtgtttgagtacctgtccggagacagacaggtggaggaatggccgaaagcgacctgcacaggcgactgtcccgagcgctgcgggtgcacctctagcacatgtcttcacaaggaatggcctcattccagaaactggcggtgcaatcccacctggtgttggggagtcggcacggggtgcacatgttgcggactggatgttaaagacctcttcaccgattatatgtttgtgaagtggaaagtggagtacatcaagaccgaagccattgtctgtgtggagctgacaagccaagagcgccagtgctctctcatcgaagccggcaccagattcaacctgggccctgttacaattacgctttccgagccccggaatatccagcagaagctgcctccggaaattgtgaccctgcacccccgcatcgaggaagggtttttcgacctcatgcatgtcaaaaaggtgctgagcgcttctacagtttgtaaacttcaatcctgcacccacggagtgcctggcgatctgcaggtctaccacatcgggaacctcctgaagggagacaaagtgaatggccatctcattcacaagatcgagccccattttaacacaagctggatgtcttgggatgggtgtgacctggattattactgcaacatgggagactggcctagctgctcctataccggcgtcacgcagcacaatcatgccgctttcgtgaacatgcttaatattgagaccgattacacaaaaatctttcacttccactctaagagagttaccgcccatggcgacacaccccagctggatctgaaggcccggccgacctatggggctggagaaattacagtgctcgtcgaggtggcggacatggaactgcacacgaaaaagatcgagattagcggccttaaattcgcctccctgacctgtacagggtgctacgcttgtagctccggaatctcttgcaaggttcgcatccatgtggacgagcctgatgaactcaccgtccacgtgaaaagcgaggaccccgatattgtggccgcctcctctagcctgatggctagaaagctcgaatttggcaccgactccacattcaaggccttttctgcgatgcccaaaacgagcctgtgtttctatatcgttgagcgggaatactgcaagtcctgtagcaaagaggatacccaaaagtgcgtcaacacaaaacttgagcagcctcagtctattctgatcgaacacaaggggaccattatcggaaagcaaaatgacacatgtacctccaaagctggctgctggctggagagcgtgaagtcctttttctacggcctcaaaaacatgctgtctgggatctttggaaatgtgttcattggcatctttcttttcctggccccctttattctcctgatcctcttcttcatgtttgggtggcggattctgttctgttttaagtgctgccgccggacgagaggacttttcaaatatcgccatctgaaggatgacgaagagacaggctaccggaagatcatcgaaagactgaacaataaaaaggggaaaaacaagctcctggatggagagcgccttgccgaccggaaaattgctgagctgtttagcaccaagacccacatcggctga

SEQ ID NO: 13582 - RNA, 5070 nt, synthetic construct
  misc_feature 1..5070: note = derived and/or modified CDS sequence (opt5) from CCHFV(Baghdad 12)__AJ538197.2__GP
  source 1..5070: mol_type = other RNA
atgcccgtgagcatcatgcacatttccctgatctacgccgtcctctgcctgcagctttatggcctgggggagacccatggatctagctccggcacagaacacaacagaacgaatgttgtggctacccctgggggatctcaaagcccggagcccctcgtgtccacaaccctgcctgtcacacttgactctagcaccgtgacacccgccacccaggcgtccggccctgaagggagcggagaggtttacacgtctccccctaccacaaccgaaggcctgtccccgagcgatgctacatctgagctccccaccacgacaggcattgggatctccagctcctccgacgtgaacagctccacccaggccgccggagatacatctacccctaccgctcggacaagcctgcccgactcccctagcacgcccccgacctctcaggatacacatcaccctatgcgcaatctgctctccgtcaccagcctgaagcccgaggaaacgcctgccccctctaaaagcggcaaggagtcccccgctgcctctagccctcatccggtggcgtccagaccccctacccccagcacgacagcccaagggcctaccgaaaacaattctcggaacaccacagttcagcttaaatccgtgacccagagcgctacactgggacccatggcctctccgacgcagaccgtcctcctgcaatccgtgacaagcattgctatccaggacacccacccttcccccacaaatcgctctagacggaaccttgagatggagatcattctgaccctccctcagggcctgaagaaatattacgggaaggtgctgcgcctcctgcagcttacgctggaagaggataccgaaggactcctggagtggtgtaagagaaatcttggcctggactgcgatgacacattctttcaaaaacggatcgaagagttctttattaccggcgaggggcacttcaacgaagtcctccagtttcgcacacccggaaccctgagcacgacagagtccacccatgccggctctcctacagttgaacccttcaagagctattttgcgaaagggttcctgctcatcgattccggatactttagcgccaagtgttattctagaacctccaatagcggcctgcagcttattaacgtgacccggcactctacaaaaatcgctgacacgccggggcctaagattaccaatctgaagacaatctcctgcatcaacctcaaagccagcattttcaaggagcatcgcgaaatcgagattaatgtgctgcttccccaagtcgctgtgaacctgtctaactgtcacgttaccatcaaaagccacgtgtgcgattactccctcaatattgacggaacagtcaagctgccccatatccaccatgagggcatctttattcctggcacctacaaaatcgtgattgacaagaaaaacaagctgaatgatagatgtacactcttcacaaactgcgttatcaaggggcgggaagtgcgcaaaggacagagcgtcctgagacagtataagaccgagattcggatcggcaaagcctctaccgggtccagacgccttctgagcgaagagtccggagacgattgtatctctcggacaagactcctgcgcaccgaaacagccgagattcacggcgacagctacgggggcccgggagataagatcacgatttgcaatggctccaccatcgtggaccagcggctggggtctgagatgggatgttatacaattaacagagtcaagagctttaaactttgcgaaaattccgctaccggcaagtcttgcaaaatcgatagcattcccgtgaagtgtcgccaagggtactgcctcaaaatcacacaggagggacggggccatgttaagctgtccagagggagcgaagtggtcctggacgcgtgtgattcttcctgcgaggtgatgatccctaaaggcaccggagacattctcgttgattgtagcggcgggcagcagcacttcctgaaggacaaccttatcgacctgggatgccccaatattcctctcctgggcaagatggccatctatatttgtcgcatgtctaaccaccccaaaacgaccatggctttcctgttttggttctcctttgggtacgtgatcacatgcatcctttgtaaggccattttctatctcctgatcattgtcggaaccctgggcaaacggtttaagcaatacagagagctcaaacctcagacatgcaccatctgtgaaacaacccccgtgaatgccattgatgctgagatgcatgacctgaactgcagctacaatatctgcccgtattgtgcctctcgccttacgtccgatgggctggcgcggcacgtgacacagtgccctaagagaaaggaaaaagttgaggaaaccgagctctacctgaacctggagcggatcccctgggtcgtgcgcaaacttctccaggtgagcgaatccaccggcgtcgctctgaaaagaagctcttggctgattgtgctcctggttcttctggccgtgagctcctctcctgtccaaagcgcccccatcggatatggcaagacaattgagacctaccaggctcgggaagggtatacgtccatctgtctcttcgtgctgggatctattctgtttatcgttagctgccttacaaaaggcctcgtggactccatcgggaatattttctttccgggactgtctatctgtaagacctgcagcattggctccatcaacgggttcgaggtcgaaagccataaatgttactgctctctgctctgttgcccttattgtagacactgctccgccgatcgcgagattcaccagctgcatcttagcatctgcaagaagcggaaaacagggtcttccgtgatgctggctgtttgtaagagaatgtgctttcgcgccaccatggaggtgagcaacaaagcgctcctgattagatccatcatcaatacaaccttcgtcgtgtgtattctgacgcttgccgtgtgcgtcgtttctaccagcgctgtggaaatggagtccctgcccgccggaacatgggaacgggaggaagacctcaccaacttttgtcaccaggagtgccaagtgacagagaccgaatgtctgtgcccttacgaggctctcgtcctgcgcaagccccttttcctggatagcatcgtgaaaggcacgaagaatctcctgaactctacatccctggaaaccagcctttctattgaggccccctggggcgcgatcaatgttcagagcacatacaagcctaccgtgtccaccgccaacattgctctgtcttggagctccgtcgagcatagaggaaataaaatcctcgtgtctggccggagcgaatccatcatgaagctggaggaacgcacagggattagctgggacctcggagttgaggatgcctctgaatccaaactgcttacggtgagcgtcatggacctgtcccagatgtattctccggtgttcgagtacctcagcggcgatagacaagttgaggaatggcccaaggctacctgtacaggcgactgccctgagcggtgtgggtgcaccacatctacctgcctgcacaaagaatggccccattctcgcaactggagatgtaatcctacgtggtgctggggagtgggcacagggtgtacctgctgtggactggatgtcaaggacctttttaccgactatatgttcgtgaagtggaaagtggagtacatcaagacagatgccattgtctgcgttgaactgaccagccaggagcggcagtgttccctcatcgaggccggcacacgctttaacctggggagcgtgacgattaccctctctgaacccagaaatatccagcaaaaactgcctccggagatcattacacttcacccccggatcgaagagggattctttgacctgatgcacgtgcagaaggtcctgtccgctagcaccgtgtgcaaactccagtcttgtacacatggcgttcctggcgatcttcaggtgtatcacattgggaacctgctgaagggagacaaggtcaatggccatctcatccacaaaattgaaccccatttcaacacctcctggatgagctgggatgggtgcgacctggattactattgtaatatgggagactggccttcttgcacgtacaccggcgtgacacaacacaaccacgcgagctttgttaacctcctgaatatcgagaccgattacacaaagtccttccattttcactctaaaagagtgaccgcccatggggacacaccccagcttgatctgaaggtccgcccgacgtatggagctggcgagattaccgtgctggtcgaagtggccgacatggagctccacacaaagaagatcgaaatcagcggcctgaaattcgcctcccttacctgcaccgggtgttacgcttgcagctccggaatttcttgtaaggttcggatccacgtggatgagcctgacgagctgacagtccatgttaagagcgacgatcccgacgtggtggccgcgtcctctagcctcatggctagaaaactggaatttggcacggattccaccttcaaggccttttctgccatgcccaaaacaagcctctgcttctatattgtcgagcgcgaatactgtaagtcctgcagcaaagaggacacccagaagtgtgtgaacacaaagctggaacagcctcaatctatccttattgagcacaaagggaccatcatcggaaagcagaataacacgtgcacagctaaaacctcctgttggctggagagcgtgaagtctttcttttatggcctgaaaaatatgctctccgggattttcggaaactttttcatgggcatctttctgttccttgccccctttattctgctcatcctgttctttatgttcggctggcggattctcttttgcttcaagtgttgcagacgcacccgggggctgttcaagtacagacatcttaaagatgacgaagagacaggatatcgccggatcatcgaaagactgaataacaagaaaggcaagaataaactgctcgatggggagcggctggcggaccgcagaattgctgaactttttagcaccaagacacacatcggatga

SEQ ID NO: 13583 - RNA, 5070 nt, synthetic construct
  misc_feature 1..5070: note = derived and/or modified CDS sequence (opt5) from CCHFV(Hodzha)__AY223476.1__GP
  source 1..5070: mol_type = other RNA
atgcccgtgagcatcatgcacattctgctcatgtgcgccgtcctgtgtcttcagcaatacggcctgggggagacccatagacctaacaatggaacagaacacaacaagacgaatgttctcaccacaccgggcgacaaactgtcccccgagcttcctgtgtctaccgctctgagcgtgacacccgattcctctaccgtcacacctaccacgcccgtgagcgggctcgaaggatccggcgacgtttatacctctcctccggtgacaaccaaggggctgagcccctccaaagccacaagcgagctgcctgcgtcttccggaatcgataccagctctgcttccgacgtcgatagctctacgcaggccgcccgggacacatccaccctcacagtgcgcaccagccctccctcctctcccagcaccccgcctacatcccaggatacgtaccatctggttagaaaccttctgagcgtgacctctccctggcctgaagagacaaccgctccctccaagagcggcaaagagtctcccgtcgccaatagccctcacccggtgacatcccggccctctagccctcccattaccgtgcagggccctacggaaaactccagccataatacaaccgggcaactcgagtctatggctcagtccaccacactggtccccatggccagcccgacccagacagttctttctcagtccgtgacgagcctggcggtgcaagacgcccacccttcccccaccaaccgctctaagagaaatctcgaaatggtcatcattctgacactgcctcagggactcaagaaatattacggcaaggtgctgcggcttctgcagctcaccctggaggaggatacagaagggcttctggagtggtgcaaacgcaacctcggactggactgtgatgacaccttctttcagaagagaatcgaagagttctttatcacgggcgaagggcacttcaatgaggttctgcaatttaaaacccccagcacactctccaccacagagtctacccatgctgtgagccctacggccgaacccttcaagtcctattttgctaagggattcctgagcattgattctggctacttttccgccaaatgctatagcaagacatctaactccggccttcagctgatcaatgtcacccggcacagcacacgcattgcggacaccccggggcctaaaatcaccaacctcaagacaatttcttgtatcaatctgaaagccagcgtgttcaaggagcatagagaagttgagattaacgtgcttctgccccaggtcgctgtgaacctctccaattgccacgtcacgatcaaaagccacgtgtgtgactactctctggatgttgacggaaccgtgcggctgccccatatccaccatggcgggacatttattcctggaacctacaagatcgtcattgataagaaaaacaagctcaatgaccgctgcacactgtataccaactgtgtgatcaaaggcagagaagttcggaaggggcaatccattcttcgccagtacaaaacggagatcagaatcggaaaggccagcacaggctcccggagactgctctctgaggaaagcggcgatgactgcatttcccgcacccagctgctgcggaccgagacagctgaaatccacggggatgactatggaggcccgggggataagattaccatctgtaatggatctacaattgtggaccagagacttggcagcgagctcgggtgctacacgatcaaccgcgtcaaatccttcaagctgtgcaaaaattctgccaccggcaagagctgtgaaatcgattccacacccgtgaaatgccggcaaggatattgtctgaagattacccaggagggcagagggcatgtgaagctcagccgcggatctgaggttgtcctggacgcctgcgactccagctgtgaagtgatgatccctaaaggcacaggggatattcttgtggactgctctggaggccagcagcactttctgaaggataacctcatcgacctggggtgtccccggattcctctgcttggcaaaatggctatctacatttgcagaatgtccaatcaccccaagaccacgatggcgttcctcttctggtttagcttcggatatgtcatcacctgtatcctgtgcaaagccatcttttacctgctcattattgtgggcacactggggaagcgcttcaagcaataccgggagcttaaacctcagacctgtacaatctgcgaaaccacacccgctaacgccattgatgccgagatgcatgacctgaattgctcttataacatctgtccgtactgcgcttccagactcaccagcgatggactggcccgccacgttacgcagtgtcctaagcggaaagagaaggtggaagagacagaactgtatcttaatctcgagagaatcccctggattgtccggaaactgctccaggtgtccgaaagcaccggcgttgcgctcaagcgctctagctggctgatcgtgcttctggtcctctttgctgtgtccctgtctcctgttcaaagcgcccccattgggcatggaaaaaccatcgagacataccaggccagagaggactatacctccatttgcctgttcgtgcttggctctatcctctttatcgtcagctgtctgatgaaggggctggtggattccattggcaacatcttctttccgggactcacgatttgcaagacatgttctatcggcagcattaatgggttcgaaatcgagtcccacaaatgctactgtagcctgctttgctgtccttattgccggcactgctctgctgacagagaaatccatcagctgcacctctccatttgtaagaaacgcaagaccggaagcaacgtgatgctggccgtctgcaaacggatgtgttttagagctacaatggaggtttctaacaaggccctgcttatccgctccattatcaataccacattcgtggtgtgcattctgatcctcgcggtctgtgtggttagcacctccgccgtggaaatggagtctctgcccgctggcacgtgggagagagaagaggatctcaccaacttttgccatcaggaatgtcaagtcacagagaccgaatgcctgtgtccttacgaggcccttgtgctgcggcgccccctcttcctggacagcattgttaaggggacaaagaatctgcttaactccaccagcctggagacgtctctctccatcgaagctccctggggagccatcaatgtgcagagcacatacaagcctaccgtctctacagcgaacattgccctgagctggtcctctgtggagcacagaggcaataaaatcctcgttagcgggcggtccgaatctattatgaagctggaggagcgcaccggcatcagctgggatcttggagtggaagacgcttccgagagcaaactgctcaccgtctctgtgatggacctgtcccagatgtatagcccggtgttcgaatacctgtccggcgatagacaagtcgaggaatggcccaaggccacatgcacgggggactgtcctgagcggtgcggatgcacctctagcacatgtcttcataaggagtggccccactcccgcaactggagatgcaatcctacctggtgttggggcgttgggacaggatgcacctgttgcggcctggatgtgaaagacctctttacggattatatgttcgtgaagtggaaagtcgactacattaagacagaagctatcgtgtgtgttgagctgacctctcaggaacggcagtgcagcctcgtggaggccggcacccgctttaacctggggcccgtcacaatcaccctttccgaacctagaaatattcagcaaaaactgccgcccgagatcattacactgcaccctcggatcgaggaaggattctttgatctcatgcatgtgcagaaggttctgagcgcctctacggtgtgtaaacttcagtcctgcacccacggcgtccccggggacctccaggtgtatcatattggaaacctgctgaaaggcgataaggtcaatgggcacctcatccataaaatcgagcctcacttcaacacaagctggatgtcttgggacggatgtgatctggactactattgcaatatgggcgattggccctcctgcacctacacaggcgtgacccaacacaaccatgctagctttgttaaccttctgaatattgaaacggactacaccaagtctttccactttcatagcaaaagagtgacagcgcacggggacaccccgcagctggatctcaaggcccgccctacatatggagctggcgagatcaccgtcctggtggaagttgccgacatggagcttcacacaaagaagattgagatcacggggctgaagttcgcctccctcacctgtacaggatgctacgcttgttctagcggcatttcctgcaaagtgcggatccatgtcgatgaacccgacgagctgaccgtgcacgtgaaaagcgatgaccccgatgttgtcgccgcgtcctctagcctcatggctagaaaactggaatttgggaccgactccacattcaaggccttttctgccatgcctaaaacgagcctttgtttctatattgtggagcgcgagtactgcaagtcctgttctaaggaagatacccagaaatgcgtgaacacaaagctggagcagccccaaagcatcctgatcgaacggaaaggaaccattatcggcaagcagaataacacatgtaccgctaaagcctcctgctggctcgagagcgtcaagtctttcttttatggcctgaagaatatgctttccgggattttcggaaacgtgtttgttggcatcttcctgtttctcgcgcctttcattctgctcatcctgtttttcatgtttgggtggagaatccttttctgttttaaatgctgccgccggacgagaggactgttcaagtacaaacatctgaaggacgatgaagagacaggctatcgccggattatcgagagactcaataacaaaaaggggaagaataaactgcttgacggagaacggctggctgaccgcagaattgccgagctgttcagcaccaagacccacatcggctga

SEQ ID NO: 13584 - RNA, 5067 nt, synthetic construct
  misc_feature 1..5067: note = derived and/or modified CDS sequence (opt5) from CCHFV(Kosovo/9553/2001)__AY675511.1__GP
  source 1..5067: mol_type = other RNA
atgcccatcaacattatgcacaccctgctcgtgtgcttcatcctgtaccttcagctgctcggcctgggaggagcccatggccaaagcaatgctacagagcacaacgggacgaataccacaaccgcccctggaacatcccagtctccgaagccccctgcgagcaccacaccctcccatgctcctgaatctagcaccattaaacttacgacccccacatccgagaccgaaggctctggggagacaacccctccgacgagcacaacccagggatctccccctctggaaacaacccccgagagaagcaccacaacggccacctctacatccggcaccgacaacatgaatagcacaacccagatgacggataacacacctaccctcaccgcctctacatcccccagctcctccccgagcaccccttccacatctcaaggcctgcactatcccgtccggagcctgctctccgttagctctcctaagacggtgaccacacccacccccatgtcccctggggagatgagctctgaaacaagctcccagcattctgctatgagccgcaccccgacgccccacaccgccacacaggtgtccaccgagaatgctaacagaagcacatctcggcagtccgaaagctctgcccaacctgcgacccagtcccccgtcacgagccctgcccagtccatcctgcttatgtctgctacacccaccacaattcagaatatccacccgagccctaccaaccgctccaaaagaaatctggagatggagatcattctcaccctgtctcaaggacttaagaaatactatggcaagatcctgaagctcctgcatctgacactcgaagaggacacggaagggctgcttgagtggtgtaaacggaacctgggaagcaattgcgatgacgactttttccagaagcgcattgaagagtttttcatcaccggcgaggggtactttaacgaagtgctccagttcaaaacactgtccacccccagccctacagagccctctcacgccagacttcctaccgctgaaccctttaagtcctatttcgccaaaggatttctgagcattgattctggctacttctccgcgaagtgttatccgcggagctctacgagcggcctccaactgatcaatgttacacagcatcctgcccgcattgctgagacccccgggcccaagatcacctccctgaaaacaatcaactgcattaacctcagagccagcgtgtttaaggaacaccgggaggtcgagatcaatgtgctgcttcctcagattgctgttaacctgtctaattgtcacgtggtcatcaactcccatgtgtgcgattacagcctcgacaccgatggaccggtgcgcctgcccagaatttaccacgaaggcacattcatgcctgggacgtataaaatcgtcatcgaccggaagaataaacttaacgatcgctgtaccctggttacaaattgcgtgattaagggaagagaggtgcggaaaggccagtccgtcctcagacaatacaagaccgaaatcaagattgggaaagcccccacaggatctcgcaagctgctgagcgaggaacctggcgacgattgtatctcccggacccagctcctgagaacggagaccgccgagattcatgacgacaactatggcgggcccggagataaaatcacaatctgcaatggctctaccattgtggaccagcgccttgggagcgaactgggatgttacacaatcaaccgggttaagtcctttaaactctgcgaaaattctgctaccggcaagacatgcgagattgatagcacccctgtgaagtgtagacaggggttctgcctgaaaatcacgcaagagggccgcggacacgtcaagctgtcccggggcagcgaggtggttcttgacgcgtgtgattcttcctgcgaagtgatgattcccaaagggacaggagacatcctcgtcgattgtagcggcgggcagcagcatttcctgaaggacaacctgattgatctcggatgcccgcacatccctctgcttggcaaaatggccatctatattgctagaatgtctaatcaccccaagaccaccatggcctttctgttctggttttccctcgggtacgtgatcacatgtattctgtgcaaggccctgttctatagccttatcattatcggcaccctcgggaaaaagatcaaacagtaccgcgagctgaagcctcaaacgtgtacaatttgcgaaaccgctcccgtcaacgccatcgacgcggagatgcatgatctgaattgttcttacaacatttgcccgtattgcgcttcccggctcacaagcgacggcctggccagacacgtgaaacagtgtcctaagcgcaaggaaaaagttgaggagaccgaactttacctgaacctcgagcggatcccctgggtggtcagaaagctgcttcaggtgtccgaaagcacaggggttgcccttaaacggtctagctggctcattgtgctgctggtcctcctgaccgtgtccctttctcctgtgcagagcgctcccgttggacatggcaagacgatcgagacctatcaaacacgcgaagggtttacctccatctgcctgttcatgctcggatctattctgtttatcgtcagctgtctggtgaaaggccttgtggactccgtctctgatagcttctttcccgggctctccgtgtgcaagacatgtagcattggctctatcaatggattcgagattgagtcccacaaatgctactgtagcctgttttgctgtccttattgcagacactgttctgccgaccgggaaatccatcagctgcacctctccatctgcaagaagagaaaaaccggcagcaacgttatgctggctgtgtgcaagcgcatgtgtttccgggccacgattgaggcgtccagacgcgcccttctgatcagatctattatcaatacaacctttgtcatttgcatcctcacactgaccatttgtgtggctagcacctccgccgttgaaatggagacactgccggctgccacgtgggaacgggaggaggatcttaccaacttctgccatcaggaatgtcaagtgcccgagacagaatgcctgtgtccttacgaggcgctcgtcctgcgcaaacccctcttcctggacagcatcgtgaaggggatgaaaaatcttctgaactctacctccctcgagacaagcctgtctatcgaagccccttggggagctattaatgttcagagcacctttaagcccacggtgtccacagccaacatcgctctgtcttggagctccgtcgagcacagaggcaataagattcttgtgaccgggcggtctgaaagcatcatgaaactggaggaacgcaccggagtgtcctgggatctcggcgtcgaggacgccagcgagtctaagctgctcacagtttccattatggatctgagccagatgtattcccctgtgttcgaatacctttctggggacagacaggtggaggaatggccgaaagctacctgcacaggcgattgtcccgagcggtgcggatgtacgagctctacctgcctgcataaggaatggcctcactcccgcaactggagatgcaatcccacatggtgttggggcgtcgggaccggatgcacatgttgcggcgtggacgttaaagatctctttaccgaccacatgttcgtgaagtggaaggtcgagtacatcaaaacggaggctatcgtgtgtgttgaactgaccagccaagagcggcagtgctccctgattgaagcggggacacgctttaaccttggacctgtgaccatcacactgagcgagcccagaaatattcagcagaagctcccgcctgaaatcattaccctgcatcccaaaatcgaggagggcttctttgatctcatgcacgtccaaaaggtgctgtctgcctccacagtttgtaaacttcagagctgcacgcatggcatccccggggacctccaggtgtatcacattggaaacctgctgaagggcgaccgggtcaatgggcatctgatccacaagattgaacctcacttcaacacctcttggatgtcctgggatggatgtgaccttgattactattgcaacatgggcgactggcccagctgtacatacaccggggtgacccagcataatcacgctgcctttgtgaacctgctcaatatcgagacagattatacgaaaaccttccattttcactctaagagagtcacagcccacggagacacccctcaactggatctcaaagctcgcccgacatacggcgccggcgaaattaccgttctggtggaggtggcggacatggagcttcatacgaagaaagtcgaaatcagcgggctgaagttcgcttccctggcctgcacaggatgctatgcctgttctagcggcatttcctgcaaagtgcggatccacgttgatgagcccgacgaactcaccgtgcatgtcaagagctccgatcctgacgtggttgctgcctctaccagcctgatggcgagaaagctggagtttgggacagattccaccttcaaagccttctctgccatgcccaagacaagcctgtgtttttacatcgtggaaaaagagtactgcaagtcctgttctgaggacgacaccaaaaagtgcgtcgatacgaagctcgaacagcctcagagcattctgatcgagcaccgcggaacaattatcggcaaacccaacgacacctgtccggccaagacatcctgctggctcgaaagcgtgaaatctttcttttatgggctgaagaatatgcttggatccgtcttcggcaactttttcattggcatcctgctgtttctcgctcctttctttctgtggatgcttagcttcatgtttgggtggaaaatcctgttctgtttcaagtgctgtcggagaacccgcggactctttaagtaccggcatctgaaagatgacgaggaaacgggctatagacgcattatcgagcggctcaataacaagaaagggaagaatagactgcttgatggagagcggctggccgaccgcaaaattgctgaactgttctctaccaagacacacatcggctga

SEQ ID NO: 13585 - RNA, 5067 nt, synthetic construct
  misc_feature 1..5067: note = derived and/or modified CDS sequence (opt5) from CCHFV(200406546-Turkey)__KR864902.1__GP
  source 1..5067: mol_type = other RNA
atgcccaccaacatcacacacacgctgctcgtgtgcttcattctgtaccttcagctgctcggcagagggggagcccatggccaaagcaatgctaccgagcacaacgggacaaataccacaaccgcccctggaacatcccagtctcataagccgctggtgagcaccacgccccctcacacccttgaatcctctacaatcaaacataccacacccaccagcgagacggaaggctccggggagacaacccctccccctaacacaacccagggaccgtctccccctgaagcgacccccgagcggcctgctacaacggccaccagcacaccctccaccgacaatacaaacagcaccacgcagatgaatgataacaatccgacatctaccatttccaccagcccttcttccagcccctctacacctcccacaccccaaggcatccaccaccctgcccgctccctgctcagcgtttcctctctgaagaccgctacgaccccgacacccaccagccctggcgagatttccagcgaaacatcttcccagcatagcgccatgtctagaacccccacgctgcacaccacaacccaggtgagcacagagtccaccaaccattctacgcctcggcagagcgaatccagcgctcaacccacaaccccgtctcctatgacatcccccgcccagagcatcctccctatgtctgcggcccccaccgctatccagaatattcacccttcccccaccaaccgcagcaaaagaaatctggaggtggagatcattcttacactgtcccaggggctcaagaaatattacggaaagatcctgaagctgctgcacctcacgctggaagaggacaccgaaggcctgctcgagtggtgtaaacggaacctggggtctagctgcgatgacgactttttccaaaagcgcattgaagagtttttcgtcacaggagagggctattttaatgaagtgcttcagttcaaaaccctgtccacactctctccgaccgagcctagccatgccaagctgcccacggttgaaccctttaaatcctacttcgctaaggggtttcttagcatcgactctggatatttctccgccaagtgttaccctagaagctctacatccggcctgcagctcattaacgtgacccaacacccggcgcggatcgccgagacccccggccctaaaacaaccagcctgaagacaatcaactgcattaatctgcgcgcttctgtctttaaagaacatagagagatcgagattaacgtgctcctgccccagatcgccgttaatcttagcaactgtcacgctgtgattaagtcccatgtctgcgattatagcctggacacggatgggcctgtgcggctcccccacatctaccacgaaggaaccttcatccctggcacatacaaaattgtgatcgacaagaaaaataagctgaacgatcgctgtattcttgtcaccaattgcgttatcaaggggagagaggtgcggaaaggacagtctgtgctgcgccagtataagacagaaattaaaatcggcaaggcctccaccgggagcagaaaactcctgtccgaggaacccggagacgattgtatctctcggacgcaactgctcagaaccgagacagccgagattcatgacgacaactacggcggcccgggggataagatcaccatttgcaatggaagcacaatcgtcgaccagcgcctgggctccgaacttgggtgttataccattaaccgggtgaagtcttttaaactgtgcgagaatagcgctacaggaaagacctgcgaaatcgattccacgcctgttaaatgtagacagggcttctgcctcaagattacacaggaggggcgcggccacgtgaaactgtctcggggaagcgaggtcgtgctggacgtttgtgattccagctgcgaagtgatgatccccaagggcaccggggacatccttgtcgattgttctggaggccaacagcatttcctcaaggacaacctgattgatctggggtgccctcacgtgcccctcctgggaagaatggcgatctacatttgtcgcatgtccaatcacccgcggaccacaatggcctttcttttctggtttagcttcggctatgtcattacctgcatcttttgtaaagctctgttctactctctcatcatcattgggacgctgggcaagaaatttaagcagtatagagagctgaaacctcagacatgcaccatctgtgaaacagcccccgtgaacgccattgacgctgagatgcatgatcttaattgctcctacaacatctgcccttactgtgccagccgcctcacctctgacggactggcgcggcacgttccccaatgccccaagagaaaggaaaaagtggaggagacagaactgtatctcaacctggagcgcattccttggatcgtccggaaacttcttcaggtgtccgaaagcaccggcgttgctctcaaaagatccagctggctgatcgtgctgcttgtcctcctgacggtgtctctgagcccggtgcagtccgcccccgttgggcatggaaagaccattgagacataccagacccgggaaggcttcacatctatctgtctctttatgctggggagcattcttttcatcgtctcctgcctggtgaaaggactcgtggactctgtcagcgattcctttttccctggcctgtctgtgtgtaagacctgcagcattgggtccatcaatggctttgagatcgagagccacaaatgttattgctctctgttctgttgcccctactgtcgccattgctccgccgacagagaaattcaccaacttcacctcagcatctgcaagaagcggaaaacgggatctaacgttatgctggctgtgtgtaagagaatgtgcttccgcgccacaattgaggcttcccggagagccctgctcatccgcagcattatcaataccacatttgtcatttgtatcctgacccttaccatctgcgtggtttccacatctgcggtggaaatggagaacctgcctgccggcacgtgggaaagagaggaggatctcaccaatttctgtcatcaggaatgccaggtcacagagaccgaatgtctgtgcccctatgaggctctggtgcttcggaaacctctgtttctcgacagcattgttaaggggatgaaaaacctgctcaattccacaagcctggagacctctctttccatcgaagccccgtggggagctattaacgtgcaaagcacgttcaagcccacagtctctaccgccaatatcgcgctgagctggtcctctattgagcaccgcggcaacaagatcctcgtgaccgggagaagcgaatccatcatgaaactggaggaacggacaggagtgtcttgggatctgggcgtcgaggacgccagcgagtccaaacttctgaccgttagcattatggatctctctcagatgtactcccctgtgtttgaatatctgagcggggaccgccaggtggaggaatggcccaaggctacatgtacgggcgattgccctgagagatgtggatgcacctcctctacatgcctccataaggaatggccccacagccggaattggcgctgtaacccgacctggtgctggggcgtcgggacaggatgtacctgctgtggcgtggacgttaaagatctgttcacggaccatatgtttgtgaagtggaaggtcgagtacatcaaaaccgaggccattgtgtgcgttgaacttacatcccaggagagacaatgttctctgatcgaagctgggacccggttcaatctcggacctgtgacaattaccctgagcgagccccgcaacatccagcagaagctgccccctgaaatcattacacttcaccccaaagtcgaggagggctttttcgatctgatgcacgtgcagaaggttctctccgccagcacggtgtgcaaactgcaatcttgtacccatggcatccctggggacctccaggtctaccacattggaaatctgcttaagggcgacagagtgaacgggcatctgatccacaagattgaaccgcactttaacacatcctggatgagctgggatggatgcgacctggattattactgtaatatgggcgactggccctcttgcacctataccggggtgacacagcataaccacgccgctttcgtcaatctcctgaacatcgagacggattacaccaaaacatttcatttccactccaagcgggttaccgcgcatggagacacacctcagcttgatctgaaagccagacccacctatggcgctggcgaaattacggtgctcgtggaggtcgccgacatggagctgcacacaaagaaagtggaaatcagcgggctcaagttcgcctctctggcttgcaccggatgttacgcctgcagctccggcatctcttgtaaagttcgcattcacgtggatgagcctgacgaacttaccgtccatgttaagagctccgatcccgacgtggtggcggctagcacatccctgaccgcccggaagctggagtttgggacagattctaccttcaaagcctttagcgctatgccgaagacgtccctctgcttctatatcgtcgaaaaagagtactgtaagtcttgcaatgaggacgacacacaaaaatgtgtggataccaagctggaacagcctcagagcattcttatcgagcacaagggaacaattatcggcaaacaaaacgatacctgcacggccaaggcgtcctgttggctggaatctgtcaagagctttttctacgggctcaagaatatgctgggatccgtgtttggcaacttctttatcggcattctcctgttccttgctccctttgttctgctggtcctcttcttcatgtttgggtggaaaatcctgttctgctttaagtgttgcagacgcacccggggacttttcaagtatagacatctgaaagatgacgaggaaacaggctacaagcgcattatcgagcggctcaataacaaaaaggggaaaaatagactgctcgatggagagcgcctggccgaccggaagattgccgaactttttagcaccaagacacacatcggctga

SEQ ID NO: 13586 - RNA, 5067 nt, synthetic construct
  misc_feature 1..5067: note = derived and/or modified CDS sequence (opt5) from CCHFV(Haskovo-V46/13)__KR092379.1__GP
  source 1..5067: mol_type = other RNA
atgcccaccaacattatgcacaccctgctggtgtgcttcattctgtaccttcagctgctcggactcggaggggcccatgggcaaagcaatacgaccgagcacaacgggaccaataacaccacagctcctggaacctcccagtctccgaagccccatatgagcacaacccctccccacgcccctgaatcctctacgatcaaacccaccacacctaccagcgagacagaaggctccggggagaccacgccgccctctaatacaacccagggaccttcccctcccgaaacaacctccgagagacccgcgaccacagctattagcacgtcttccaccgataacatgaatccgacaagccagatgaccgataacacacctacctctacggtgtccatcagcccctcttccagcccttccacaccctctacaccccaaggcatgcatcaccctgcccggagccttctgtccgttagctctccgaagaccgccacaacccccacacctacgtcccccgtggaggtgggcagcgaaacctctagccagcactccgctatgtctagcacacctacaccccatacagccacccaggtctccacggagaataccaaccacagcacaccgcgccagtctgaaccttccgctcaacagaccacacccagccctatgccctctcctgcccagtccaccctcctgatgagcgcggcccccacggctgtgcagaatacacatccgtcccctaccaacagatctaaacggaatctggagatggagattatcctcacactgagccaagggcttaagaaatattacggaaagatcctgaagctcctgcaccttaccctggaagaggacaccgaaggcctcctggagtggtgtaaacgcaacctggggtccaattgcgatgacgactttttccagaagagaattgaagagtttttcatgacaggagagggctattttaacgaagttctccagttcaaaacgctgtctacccttagccccatggagccctcccacgccgaactgcctacagctgagccgtttaagagctacttcgccaaagggtttctctctatcgactccggatatttcagcgcgaagtgttacccccggtcttccaccagcggcctgcaacttattaacgtgacacagcatcctgcccgcatcgctgaaacccccggccctaagacgacatctctgaaagccattaattgcatcaacctcagagctagcgtctttaaggagcaccgggagattgaaatcaatgtgctgctgccccagatcgccgttaacctctccaattgtcatgtggtcattaacagccacgtgtgcgattattctctggacaccgatgggcctgtgcgccttccccatatctaccacgagggaaccttcattccgggcacatacaaaatcgtcattgacaagaaaaataagctgaacgatagatgtaccctcgttacaaattgcgtgatcaaagggcgggaagtgcgcaagggacagtccgtcctgagacaatataagacggagatcaaaattggcaaggccagcaccgggtcccggaaacttctgtctgaagaactgggagacgattgtatcagccgcacacagctgctgagaaccgagacagctgaaattcacgacgacaactacggcggccctggggataagatcaccatttgcaatggatccacgatcgtggaccagcggctcggctctgagctggggtgttataccatcaacagaggaaagagctttaaactttgcgaaaattccgcgacaggcaagacctgcgagattgattctacacccgttaaatgtcgccaggggttctgcctgaagatcacccaagagggccggggacatgtgaaactcagcagaggctccgaagtcgtgctggacgcctgtgatagctcttgcgaggttatgattcctaaggggacaggagacatcctggtggattgttccggcgggcagcagcacttccttaaagacaacctcattgatctgggatgcccccatatcccgctgctcggcaagatggctatttacatctgtcgcatgagcaatcaccctcggaccacgatggcctttctgttctggttttctttcgggtatgtcatcacatgcatcttttgtaaggcccttttctactccctgatcattatcggcaccctcggcaaaaagattaaacagtatagagaactgaagccccaaacctgcacaatctgtgagaccacgcctgtgaacgctatcgacgccgaaatgcacgatctgaactgcagctacaatatttgcccctactgtgcgtctcgccttacatccgacggcctcgctcggcatgtcacccagtgccccaaaagaaaggagaaggtggaggaaacagagctgtatctgaacctcgaacgcatcccttggattgttcggaaactgcttcaggtgagcgagtccaccggggtcgccctgaagagaagctcttggctcatcgtgctgctggttcttctcccggtgagcctgtcccccgtccagtctgcccctgtgggacacggcaaaacaattgaaacctaccaaacgcgcgaggggtttaccagcatctgtctgttcatgctcggatccatcctgtttattgtgtcttgccttgttaagggcctggtcgacagcgtgggggattccttctttcccggcctctctgtgtgtaaaacatgcagcatcggatccattaatggcttcgagatcgaaagccataagtgttattgctctctgttttgttgcccttactgtcggcactgctccgctgacagagagattcatcagctgcaccttagcatctgcaaaaagcggaagaccgggtctaacgtcatgctcgccgtgtgtaaacgcatgtgcttcagagctacaatcgaagcctcccggagagcgctgctgattcgcagcatcattaataccacgttcgccatgtgtatcctcacactgaccatttgcgttgtgtccacatctgctgtcgagatggaaaaccttcccgccggaacctgggagcgggaggaagatctgaccaatttttgtcaccaggagtgccaagtgacagaaacggagtgtctctgcccttatgaggctctggttctgagaaagccgcttttcctggacagcatcgtgaaaggcatgaagaacctcctgaatagcaccagcctcgaaacatctctgtccattgaggccccctggggagcgatcaacgtccagagcacctttaaacctacagtgtctaccgccaatatcgctcttagctggtcctctgttgaacatcgcggaaacaagattctggtgacgggcagaagcgagtccatcatgaagctcgaggaacggacaggggtctcttgggatctgggcgtggaggacgccagcgaatccaaactgcttaccgtgagcattatggatctgtctcagatgtactcccccgtcttcgagtatctcagcggagaccgccaggttgaagagtggcctaaggctacctgtacaggcgattgccccgaaagatgtgggtgcacctcctctacatgcctgcacaaagagtggccgcatagccggaattggcgctgtaaccctacgtggtgctggggagtgggcaccgggtgtacatgctgtggagtggacgtcaaggatctctttaccgaccacatgttcgtgaaatggaaggttgagtacatcaagacagaagccattgtgtgcgtcgagctgacctcccaagaaagacagtgttctcttatcgaggccggcacgcggtttaatctgggccccgtgaccatcacactcagcgaaccccgcaacattcagcagaaactgcctcccgagatcattaccctgcatcctaagatcgaggaagggttctttgatcttatgcacgttcaaaaagtgctgtccgctagcacagtctgcaagctccagtcttgtacccacggcattccgggcgacctccaggtgtaccatatcgggaacctcctgaaaggagacagagttaatggccaccttatccataagattgagccccacttcaacacatcctggatgagctgggatgggtgcgacctggattattactgtaatatgggagactggccttcttgcacgtataccggcgtgacacagcacaaccatgcggcctttgtcaatctgctcaacatcgaaaccgattacaccaagacattccactttcattccaaacgggtgacggctcacggcgacacaccccaactggatcttaaggcccgccctacatatggggccggagagattaccgtgctggtcgaggttgctgacatggaactccataccaaaaaggtggagatcagcggcctgaaattcgcctctcttacctgcacggggtgttacgcgtgcagctccggaatttcttgtaaggtgagaatccacgtcgatgaacccgacgagctgacagtgcacgttaaaagctccgatccggacgtggtcgctgccggcaccagccttatggcccggaagctggagttcgggaccgattccacatttaaggctttctctgccatgcctaaaaccagcctgtgcttttatattgtggagagagagtactgtaagtcctgctctgaagacgacacacagaaatgtgttgataccaagctcgagcagccccaaagcatcctgatcgaacataaaggaacgattatcggcaagcagaatgacacatgcaccgcgcgcgcttcctgttggcttgagtctgtcaagagcttcttttacggcctgaaaaacatgctcgggtccgtcttcggaaattttctgattggcatcctcctgttccttgccccttttgtgctgctggtcctcttctttatgttcgggtggaagattctgttctgctttaaatgttgccggagaacacgcggacttttcaagtatcggcacctgaaagatgacgaagagaccggctacagacgcatcatcgagcggctcaacagcaagaaggggaaaaatagactgctcgatggagaacgcctggccgaccggaagattgctgagctcttttctacgaaaacccatatcggctga

SEQ ID NO: 13587 - RNA, 5067 nt, synthetic construct
  misc_feature 1..5067: note = derived and/or modified CDS sequence (opt5) from CCHFV(VLG/TI29414)__AY179961.1__GP
  source 1..5067: mol_type = other RNA
atgcccaccaacatcatgcacacactgctcgtgtgcttcattctgtaccttcagctgctcggccttgggggagcccatatccaaagcaatgctacggagcacaacggcaccaatacaaccacagccccttccacctctcagagcccgaagccccttgtctccacagcgcctccccatgctctggaatctagcaccattaaacctacgacccccgtttccgagacagaagggtctggaggcaccacacctccgcccaacaccacgcaggggcctagccctcccgaggccacacccgaaagaccggccaccacagctacctccacccctagcacagacaatacgaactctaccacacacgtgaccgataataaccccacatccaccatcagcacgtctccttccagctctccctccacacccagcacccctcaggggattcatcacccggcccggaatctcctgtccgtgtctagccccaagaccgctacaacccctacacccacgtcccctggcgacatcagctctgagacctccagcctgcactctgccatgagccgcacatccaccctctatacagcgacccaagtctctacggagaacgccaatcatagcgctcccagacagtccgaaagctctgcccagcagaccacaacctccccgatgacaagccctgctcaacccatcctggtgatgtctgccgcgcctaccgccattcagaacatccacccctcccctacgaatcggagcaaacgcaaccttgagatggaaattatcctgacactctcccagggcctgaagaaatactatgggaagattcttaagctgctccatctgaccctggaggaggatacagaaggactcctggagtggtgtaaaagatctcttggcagcaattgcgacgatgactttttccagaagcggatcgaagagtttttcatgaccggggaaggatactttaacgaggttctgcaattcaaaaccctctccacactgtctcccacggagccgagccacgctcgccctcccaccgtggaaccctttaagtcctatttcgccaaaggctttcttagcattgattctgggtacttctccgctaagtgttatcctagactgagcacatctggactccagctgatcaacgtcacccagcacccggcccggatcgccgagacacccggccctaagaccacgtccctgaaaacaattaattgcatcaacctccgcgctagcgtgtttaaggaacatagagagattgaaatcaatgttctgcttccccaaattgcggtgaacctgtctaattgtcacgtcgtgatcaacagccatgtgtgcgactactccctcgataccgacggccctgtccggctgccccacatctaccatgaggggaccttcattcctggaacatataaaatcgttattgataagaaaaataaacttaacgaccgctgtaccctggtgacaaattgcgtgatcaagggcagagaggtccggaaggggcagagcgtgctccgccagtacaagacggaaattaaaatcggaaaggcctctaccggctccagaaaactgctgagcgaggaacccggggatgactgtatctcccggacacagctcctgagagctgagccggccgaaattcacgacgataactatggaggccctggcgacaagatcaccatttgcaatgggtctacaatcgttgatcaacgccttggaagcgagctgggctgttacaccattaaccgggtgaaatcctttaagctctgcgaaaattctgccacggggaagacctgcgaaatcgacagcacacccgtcaaatgtagacagggattctgcctgaagattacccaggagggccgcgggcacgtgaaactgtcccggggctctgaagttgtgcttgatgcttgtgacagctcctgcgaggtcatgatccctaagggaacaggcgatatcctcgtggactgtagcgggggacagcaacatttcctgaaagataacctgattgacctcggctgcccccacatcccgctgcttgggaagatggccatttatatctgtagaatgtctaatcatcctcgcaccacaatggcgtttctgttctggttttccttcggatacgtcattacctgcatcttttgtaaggctctcttctatagcctgatcattatcggcacgctggggaaaaagattaaacagtaccgggagcttaagccccagacatgcaccatctgtgaaaccgcccctgtgaacgccattgatgctgagatgcacgacctcaactgctcttacaatatctgcccctattgtgcctccagactgacaagcgacggcctggctcgccacgttccccagtgccctaaacggaaggaaaaggtggaggaaaccgagctctacctgaaccttgagagaatcccgtggaatgtccgcaaactgctccaagtgtctgaatccacgggagttgccctgaagcggagctcctggctgattgtgcttctcgtcctgctgacagtgagcctctctcccgtgcagagcgcgcctgttggccatgggaaaaccatcgagacatatcagaccagagaaggatttacatccatttgtctgttcatgcttggctctatcctgtttctcgtcagctgcctggtgaaggggctggtggattccgtctctgacagcttctttcccggactttccgtgtgtaaaacctgctctattggcagcatcaacgggttcgagatcgaatcccacaagtgttactgcagcctcttttgttgcccttattgtcggcattgctctgccgatcgcgagattcaccagctgcatctgtccatctgcaaaaagagaaagatgggcagcaatgttatgctcgctgtgtgtaaacggatgtgcttcagagccacgattgaggcttctcgccgggccctgcttatcagatccattatcaacaccacattcgtcatttgtatcctgaccctcacaatctgcgtggttagcacctccgcggtggaaatggagaatctgccctctggaacgtgggaacgcgaggaagacctgacaaacttttgtcaccaagagtgccaggtcaccgagacagaatgtctttgcccttacgaggccctggtgctcagaaagccgctgttcctcgatagcattgttaaaggcatgaagaatctgcttaactccaccaatctggaaaccagcctctctatcgaggctccctggggagccattaacgtgcagtccacatttaaacctacggtcagcaccgctaatatcgccctgtcttggagctccgtggagcaccggggaaacaagattctggtgacaggccgctctgaaagcatcatgaaacttgaggaaagaaccggggtctcctgggacctgggagttgaggatgcctctgaaagcaagctcctgacagtgtccatcatggacctcagccaaatgtattctcccgtgttcgagtacctgtccggcgatcggcaggtcgaggaatggcctaaggctacctgtacgggggactgccccgagcgctgtggctgcacaagctctacctgccttcataaagaatggccgcactccagaaattggcggtgtaaccctacctggtgctgggaggtgggaacaggctgtacctgctgtgggtggaacgttaaggatctgtttacagaccatatgttcgtgaaatggaaggtcgaatacattaagacggaggcgatcgtgtgcgttgagctcaccagccaggaacgccagtgttccctgattgaggccggaacaagatttaatctgggccccgtgaccatcacactttctgaaccccggaacattcaacagaaactgcctcccgagatcatcaccctccaccctaaggtcgaagaggggttctttgatctgatgcatgtgcagaaagttctcagcgcttccacggtgtgcaagctgcagagctgtacccacggcattccgggagaccttcaagtctatcacatcggcaatctgctgaaaggggaccgcgtgaacggacatctcattcacaagatcgagccccatttcaatacatcttggatgtcctgggatggctgcgacctggattactattgtaacatgggggactggcctagctgcacctacacaggaatgacccagcacaatcacgccgcctttgtgaaccttctgaatattgaaacagattatacgaagaccttccattttcactctaaaagagtcacagctcatggcgacacaccccagctcgatctgaaggcccggcctacctacggggcgggagagatcaccgttctcgtggaagtggctgacatggagctgcacacgaaaaaggtcgagatttccggccttaaattcgccagcctggcctgcaccggctgttatgcttgctctagcgggatctcctgtaaggtgagaatccatgttgatgaacccgacgagctgacagtgcacgtcaaatctaacgatccggacgtgattgccgcgagcacctccctcatggctcgcaagctggagttcggaacagatagcacctttaaggccttctccgccatgcctaaaacgtctctttgcttttacatcgctgagcgggaatactgtaagagctgctccgaggaggacacacagaaatgtgttgacaccaagctggaacaaccccagtctattctcatcgagcacaaaggcaccattatcgggaagcagaatgatacatgcaccgccaaggctagctgttggctggaatccgtgaaatctttcttttatggactcaagaacatgctgggcagcgtcttcgggaactttttcatcggcattcttctgtttctggcccctttcgtgctcctggtcctgtttttcatgttcggatggaaaatcctgttttgcttcaagtgttgcagacgcacacggggcctcctgaaatacagactcctgaaggacgatgaggaaaccgggtatcgccggattatcgagagacttaataataagaaaggaaagaaccgcctgctggacggcgagcggctcgcggatagaaaaattgccgaactgttttccacgaagacacatatcgggtga

SEQ ID NO: 13588 - RNA, 5067 nt, synthetic construct
  misc_feature 1..5067: note = derived and/or modified CDS sequence (opt5) from CCHFV(UCCR4405)__KY484029.1__GP
  source 1..5067: mol_type = other RNA
atgcccatcaacattatgcacgccctgctcgtgtgcttcatcctgtaccttcagctgagcggcctcgggggagctcatagacaatccaatgccaccgagcacaacggcacaaatacgaccacagcgcctgggacctctcagagcccgaagccccctgtctccacaaccctgccccatacacctgaagcctctaccattaaacttacgacccccacaagcgagaccgaaggatccggcgagacaacccctccgcccaacacgacacaggggctgcctctccccggaaccacacctgaacggtctgccaccaccgccacaagcacgtccagcaccgacgatatgaactctacaacccagatgacagacaatacccccacgtccacagttagcatcggcctgtcttccagcccgtctatgccttccaccagccaaggcattcactatcccgtgcgctccctgctctctgtgagctcccctaagaccgctacaacccccacacccatgagccctggggaggtctctccggagacgtccagccagcattctgccatgagcagaatccccaccctgtacacagctacccaggtgtccacagaaaataccaaccggtctatccctcgccagagcgagtccagcgttcaacccgccacgcagtctcctattacctcccccgcgcagacaatccttctgatgagcgccgctccgaccgccattcaggatatgcacccttctcccaaaaatagatccaagcggaacctcgaagtggagatcattctgacacttagccaaggactgaaaaagtattacggcaagatcctcaaactgctgcacctcaccctggaggaagacacggaggggcttctggaatggtgtaagcgcaatctcggatccaactgcgatgacgactttttccagaaaagaattgaggaatttttcatcacaggcgaggggtattttaatgaggtcctgcagttcaagaccccttctacacttagccccaccgaaccttcccatgtgcggctgcccaccgctgagccgtttaaatcttacttcgccaagggatttctcagcatcgattccggctatttcagcgcgaagtgttaccctagatcttccacaagcggcctgcaactgattaacgttacgcagcaccccgcccgcatcgctgaaacccccgggcctaaaacaacctctctcaagacaattaattgcatcaacctgcgggcctccgtgtttaaagagcatcgcgaagtcgagattaacgtgcttctgccgcagatcgctgtgaatctcagcaactgtcacgtcgttatcaattctcacgtgtgcgattacagcctggacaccgatggacccgtgagacttcctcggattcatcacgagggcgccttcatccccgggacgtataagattgtcatcgacaaaaagaacaaactgaatgatcgctgttccctcgtgacaaactgcgttattaagggaagagaagtgcggaagggccagagcgtcctgagacaatacaaaaccgagatcaagatcgggaaagcctctaccggatcccgcaagctgctcagcgaggaacctggcgacgactgtatttcccggacacagctgcttaaaaccgaaacagctgagatccatgatgacaattatggcgggcccggagataagattacgatctgcaacggctctaccattgtggaccagagactggggagcgagctcggatgttacacaatcaatcgcgttaagtcctttaaactgtgcgaaaactctgcgaccggcaagacatgcgagattgatagcacccctgtgaaatgtcggcaggggttctgcctgaagatcacgcaagaaggcagaggacacgtcaaactttcccgcggctctgaggtggtcctcgacgcctgtgatagctcctgcgaggtgatgatccccaaggggaccggagacattctggttgattgtagcggcgggcagcagcatttcctgaaggacaatctcatcgatctgggatgcccgcacattcctcttctgggcaaaatggctatctatatttgtcggatgtctaaccaccccagaacaaccatggcctttctcttctggttttccttcgggtacgtgatcacatgcatcttttgtaaggccctgttctatagcctgattatcattggcacccttgggaaaaagatcaaacagtaccgcgaactcaagcctcaaacatgcaccatttgtgagacggctcccgtcaatgccatcgacgcggaaatgcatgacctgaagtgctcttacaacatctgcccgtattgtgcttcccggctgacaagcgatggcctcgccagacacgtgacccagtgccctaaacgcaaggagaaagttgaagagaccgagctgtaccttaatctggaacggattccctggatcgtgagaaagctcctgcaggtctctgagtccacaggggtggccctgaaacggagctcctggcttattgtgctcctggttctgctcaccgtcagcctgtctcctgtgcagagcgctcccgtgggacatggcaagacgatcgaaacatatcaaacccgcgaggggtttacatccatttgtcttttcatgctgggatctatcctctttatcgtcagctgcctggtgaaaggcctggttgactccgtgtctgatagcttctttcccgggctttccgtctgtaagacctgctctattggcagcatcaacggattcgaaattgagtcccacaagtgttactgcagcctcttttgttgcccttattgtagacactactctgccgaccgggagatccatcagctgcacctgtccatttgcaaaaagagaaaaacaggcagcaacgtgatgctcgctgtttgcaagcgcatgtgtttcaaagccaccatcgaagcgtctcggagagccctgcttattcgctccatcatcaatacgaccttcgtgatttgcatcctgattctcgctatctgtgtcgtgagcacatccgccgttgagatggaaaacctgccggctgggacctgggagagagaagaggatctgacaaatttttgccatcaggagtgtcaagtgaccgaaacggagtgcctttgtccctatgaagccctggtcctccggaagcctctgttcctcgactctacagtgaagggaatgaaaaacctgcttaatagcacctccctggagacaagcctctctattgaggcgccctggggcgccatcaacgtgcagtccacctttaagcctaccgtcagcacagctaatatcgccctgtcttggagctccgttgaacaccgcgggaacaaaattctggtgacgggaagatctgagagcatcatgaaacttgaggaacggaccggcgtgtcctgggatctgggggtcgaagacgcttctgagagcaagctcctgacagtgtccattatggatctcagccagatgtactctcccgttttcgagtacctgtccggcgaccgccaggtggaagagtggcctaaggctacctgcacaggagattgtccggaaagatgcggctgtaccagctccacgtgccttcataaggagtggccccactctcggaattggcgctgcaaccctacatggtgttggggagtcggaaccggctgcacctgttgcggggtggacgttaaagatctgtttacagaccacatgttcgtgaagtggaaagtcgaatatatcaagaccgaggccattgtgtgtgttgagctcacaagccaagaaagacagtgctccctgatcgaggctggaacgcggtttaatctgggccccgtgaccatcacactttctgaacctcgcaacattcagcagaaactgcccccggagatcattaccctccatcctaagatcgaagagggcttctttgacctgatgcacgtccaaaaggtgctcagcgcgtccacagtgtgtaaactgcagagctgcacccatgggattcccggagatcttcagatctaccacattggcaatctgctgaagggggacagagtcaacggacatctcatccacaaaatcgagccccacttcaatacgtcttggatgtcctgggatggctgtgacctggattattactgcaacatggggaactggcctagctgtacctatacaggagttacccagcataatcacgccgcttttgtgaaccttctgaatattgaaacagactacaccaagacattccattttcactctaaacgggtgacggcccacggcgatacaccccaactcgacctgaaggccagacctacctatggcgctggggagatcaccgtcctcgtggaagttgccgatatggagctgcataccaaaaaggtggagatttccggacttaagttcgcgagcctggtctgcacaggctgctacgcttgttctagcgggatctcctgcaaagtgcgcattcacgttgacgaaccggatgagctgacggtgcatgtcaagtctagcgaccccgatgtggtcgccgcctccaccagcctcatggctcggaaactggaatttggaacagactccatctttaaggccttctctgcgatgcctaaaaccagcctttgtttttacatcgtggagagagaatattgcaagtcctgttctgaggacgatacaaagaaatgcgttgacaccaagctggagcagccccagagcattctcatcgaacacaaaggcacgattatcgggaagcaaaacgatacatgtaccgctaaagcctcctgctggctggagtctgtcaagagcttcttttacggactcaagaatatgctgggctccgtgttcggcaactttttcgtggggattcttctgtttctggcccctttcgttctcctggtgcttttcttcatgttcggatggaaaatcctgttttgtttcaagtgctgtcgccggaccagaggcctctttaaatatcgccatctgaaggacgatgaagagacagggtaccggagaatcattgaacgcctcaatagcaaaaagggaaagaaccggctgcttgacggcgagagactggctgatcggaaaatcgccgagctgttctctaccaagacacacattgggtga

SEQ ID NO: 13589 - RNA, 5067 nt, synthetic construct
  misc_feature 1..5067: note = derived and/or modified CDS sequence (opt5) from CCHFV(Ast133)__KX056060.1__GP
  source 1..5067: mol_type = other RNA
atgcccatcaacattaagcacaccctgctcgtgtgcttcatcctgtaccttcagctgagcggcctcgggggagcccatggccaatccaatgctacagagcacaacgggacgaataccacaaccgtccctggaacatctcagagcccgaaaccccctgcctccaccacaccccctcatacccccgaatctagcacggttaagctgaccacacctacctccgagacagaaggctctggggagaccacgccgccccctaacacaacccagggacttcccctgcctggcacaacccccgaaagaagcgcgaccacagctacgtccaccagctctacagacaatatgaactccaccacacaggtgaccgataatacgccgacaagcaccgtgtctatttccccttcctcttcccccagcatgccttccacctctcaaggcatccaccatcccgtccggagcctcctgtccgtgagctctcccaaaacagttaccacacctacgccgatgtcccccggggagatgagccctgagacctctagccagcactttgccatgtcccgcattcccacactgtataccgccacacaggtgtctaccgaaaacacggacagaagcacccctcggcagtccgagagctctgtccaacccgctacacagtccccgatcaccagccctgcccagacaatcctcctgatgtctgctgcccccaaggcgattcaggatatgcacccttcccccaccaatcgcagcaaaagaaaccttgaagtggagatcattctgacgctctcccaaggactgaagaagtactatggcaaaatccttaagctgctccatctgacactggaggaagacaccgaggggctcctggaatggtgtaaacggaatcttggatctaactgcgatgacgatttctttcagaagcgcattgaggagttctttatcacaggcgaagggtacttcaatgaggttctgcagtttaaaaccctcagcaccctgtcccctacagaaccctctcacgtgagacttccgacggccgagcctttcaagagctattttgctaagggattcctgtccattgacagcggctacttttctgccaaatgttatccccggtccagcacctctggcctccaactgatcaacgtcacacagcatcccgctcgcatcgccgaaacccctgggccgaagacaacctccctgaaaacgattaattgcatcaacctcagagcgagcgtgttcaaggagcaccgggaagtggagattaacgtcctgcttccccagatcgccgttaatctgtctaactgtcacgtggtgattaatagccatgtctgcgattactccctcgacacagatggacctgtgcgcctgcccagaatccaccatgagggcacctttatccctgggacctacaaaattgttatcgaccggaagaacaaacttaatgatcgctgtagcctggtgacaaactgcgtcattaagggaagagaagtgcggaagggccagtctgttctcagacaatataaaaccgagatcaagattgggaaagctagcacaggaagccgcaagctgctgtccgaggaacccgacgacgattgtatctctcggacgcagctcctgaaaaccgaaacagccgagatccacgacgataattacggcggccctggggacaagattaccatctgcaacggaagcacaattgtggatcagagacttggctccgagctggggtgttataccatcaatcgcgtcaagtctttcaaactctgcgaaaacagcgctacgggaaagacctgcgagattgactccacacccgtgaaatgtcggcagggcttctgcctgaagatcacccaagaagggagaggccatgtcaaactgtctcgcggaagcgaggtggttcttgatgcctgtgactccagctgcgagattatgatcccgaagggcacaggggatatcctcgtggactgttctggaggccagcagcactttctgaaggataatctgattgacctcgggtgccctcacatccccctgcttggaaaaatggccatttacatctgtcggatgtccaaccatcctagaaccacaatggctttcctgttttggttcagctttggctatgtcattacctgcatcttctgtaaggcgctcttttacctgctgatcattatcgggacgcttggcaaaaagattaaacagtatcgcgaactcaagccccaaacatgcaccatctgtgagaccgccccggtgaatgctattgacgccgaaatgcacgatctgaactgctcttacaatatctgcccttactgtgcctcccggctgacaagcgacggactcgctagacatgttacccagtgccccaagcgcaaagagaaggtggaagagacggagctgtatcttaacctggaacggatcccttggattgtcagaaaactccttcaggtgtctgagtccacaggcgtggccctgaagcggagctcctggctgatcgttctcctggtcctgctcaccgtgagcctgtctcccgtgcagagcgcgcccgtcgggcacggaaaaacaattgaaacctaccaaacacgcgagggcttcacctccatctgtctttttatgctggggtctattctcttcatcgtgagctgcctggttaagggactggtggattccgtctctgacagctttttccctggcctttccgtgtgtaaaacgtgctctatcgggagcattaacggctttgaaatcgagtcccacaagtgttattgcagcctcttctgttgcccgtactgtagacattgctctgctgatcgggagattcaccagctgcatctgtccatctgcaagaaaagaaagaccggaagcaatgttatgctcgccgtgtgtaaacgcatgtgcttcaaggccacaattgaggcttctcggagagccctgcttatccgctccattatcaacaccacatttgtcatgtgtatcctgaccctcgctatttgcgtggttagcacgtccgccgtggaaatggaagacctgcccgcgggcacatgggagagagaagaggatctgaccaatttctgtcaccaggagtgccaagtcacagaaaccgagtgtctttgcccttatgaagccctggtgctccggaaacccctgttttctgacagcatcgtgaaggggatgaagaacctccttaattccaccagcctggagacatctctgtccattgaggctccttggggagccatcaacgtccagagcacgttcaaacccaccgtttctacagctaatattgccctcagctggtcctctgtggaacatcgcggcaacaagatcctggtgaccgggagaagcgagtccatcatgaaactggaggaacggacaggagtctcttgggatcttggcgtggaagacgcgagcgagtccaagctgctcaccgttagcattatggatctgtctcagatgtactcccctgtgtttgagtatctcagcggggaccgccaggtcgaagagtggccgaaagccacgtgtacaggcgattgccccgaaagatgtggatgcacctcctctacctgcctgcacaaggagtggcctcacagccggaattggcgctgtaaccccacatggtgctggggcgtggggaccggatgtacatgctgtggcgttgacgtgaaggaccttttcacggatcatatgtttatcaaatggaaggtcgaatacattaaaaccgaggctatcgtgtgcgttgagctgacatcccaagaaagacagtgttctctcattgaggccgggacccggttcaatctgggacctgtgacaatcaccctgagcgaaccccgcaacatccagcagaaacttccgcctgagattatcacgctgcaccccaaaattgaagagggctttttcgacctcatgcatgtccaaaaggtgctgtccgctagcaccgtgtgcaagctccagtcttgtacacacggcatccccggggatctgcagatttaccatatcggaaatcttctgaaaggcgacagagtcaacgggcacctgattcacaagatcgagcctcattttaatacctcctggatgagctgggatggatgcgacctcgattattactgtaacatgggcgactggccctcttgcacatataccggggttacacagcacaaccatgccgccttcgtgaatctgcttaacatcgaaacggattacaccaaaacatttcacttccactccaagcgggtgaccgctcatggagacacccctcaactggatctcaaagcgagaccgacatatggcgccggcgagattacggtcctggtggaagttgctgacatggagctccacaccaagaaagtggagatcagcgggctgaagttcgcctctcttacatgcaccggatgttacgcctgcagctccggcatttcttgtaaggtccgcatccatgtggatgaacccgacgagctgacagttcacgtgaaaagctccgaccctgatgtcgtggctgccagcacctccctgatggcgcggaagctcgaatttgggacggactctacattcaaggcttttagcgccatgcccaagacctccctgtgcttctatattgtcgagagagaatactgtaaatcttgcagcgaggatgacaccaagaagtgtgtggatacaaaacttgagcagcctcagtccatcctgatcgaacataagggaaccattatcggcaaacaaaatgacacatgcaccgccaaggcttcttgttggctcgagagcgttaaatcctttttctacgggctgaagaacatgctcggaagcgtgtttggctctttctttgtcggcattctgcttttcctggccccctttgtgctgctcgttctgttcttcatgtttgggtggaagatccttttctgctttaaatgttgccgccggacgagaggactgttcaagtatcgccacctcaaagatgacgaagagacaggctaccggagaattatcgaacgcctcaattccaagaaagggaagaaccggctgctggatggagagagacttgcggaccggaagatcgctgagctgtttagctctaaaacccacattggctga

SEQ ID NO: 13590 - RNA, 5067 nt, synthetic construct
  misc_feature 1..5067: note = derived and/or modified CDS sequence (opt5) from CCHFV(Ast137)__KX056057.1__GP
  source 1..5067: mol_type = other RNA
atgcccatcaacattatgcacaccctgctcgtgtgcttcatcctgtaccttcagctgagcggcctcgggggagcccatggccaatccaatgctacagagcacaacgggacgaataccacaaccgtccctggaacatctcagagcccgaagccccctgcctccaccacactgccccatacccctgaatctagcacggttaaacttaccacacccacctccgagacagaaggctctggggagaccacgcctccgcccaacacaacccagggactgcctccccctggcacaacccccgaaagaccggcgaccacagctacgagcacctccagcacagacaatatgaactctaccacacaggtgaccgataatacgcctacatccaccgtgagcatttctccctccagctctccttccatgcccagcacctcccaaggcatccactatcccgtccggtctctcctgagcgtgtccagccctaagacagttaccacaccgacgcccatgtctcctggggagatgtcccccgagaccagctctcagcatagcgccatgtcccgcattcctacactgtacaccgccgctcaggtgtctacagaaaacaccaatagaagcacgccccggcagtccgagagctctgcccaaccggctacccagtcccctacaacctttcccgcccagacaatcctcctgatgagcgcggcccctaaagctatccaggacatgcacccctctcctaccaaccgctccaagagaaatcttgaagtcgagattatcctgacgctcagccaaggactgaaaaagtattacggcaagattcttaaactgctccacctgacactggaggaagataccgaggggctcctggaatggtgtaagcggaaccttggatccaattgcgacgatgacttctttcagaaacgcatcgaggagttctttattacaggcgaagggtatttcaacgaggtgctgcagtttaagaccctctctaccctgagccccacagaaccgtcccatgttagacttcctacggccgagcccttcaaatcttactttgctaagggattcctgagcatcgattccggctattttagcgccaagtgttacccccggtcttccaccagcggcctccaactgattaatgtgacacagcaccctgcgcgcatcgccgaaaccccggggcccaaaacaacctctctgaagacgatcaactgcattaacctcagagcttccgtcttcaaagagcatcgggaagtggagatcaatgtgctgcttcctcagattgccgtcaacctgagcaattgtcacgttgtgatcaactctcacgtgtgcgactacagcctcgatacagacggacccgtccgcctgcctagaatccatcacgagggcacctttatccccgggacctataagatcgtgattgataaaaagaataaacttaacgaccggtgttccctggttacaaattgcgtgatcaagggacgcgaagtcagaaagggccagagcgtgctccggcaatacaaaaccgagattaagatcgggaaggcttctacaggatccagaaagctgctgagcgaggaacctggcgatgactgtatttcccgcacgcagctcctgaaaaccgaaacagccgagatccatgacgataactatggcgggcccggagacaagatcaccatttgcaatggctctacaatcgttgatcagcggcttgggagcgagctgggatgttacaccattaacagagtgaagtccttcaaactctgcgaaaattctgccacgggcaagacctgcgagatcgacagcacaccggtcaaatgtcgccaggggttctgcctgaagattacccaagaaggccggggacacgtgaaactgtccagaggctctgaggtcgtgcttgatgcttgtgacagctcctgcgagatcatgattcctaaggggacaggagatatcctcgttgactgtagcggcgggcagcagcattttctgaaggataacctgatcgacctcggatgcccccacattcctctgcttggcaaaatggcgatccacatttgtcgcatgtctaatcatccccggaccacaatggccttcctgttttggttctcctttgggtatgtgattacctgcattttctgtaaggctctcttttacagcctgatcatcattggcacgctggggaaaaagatcaaacagtatagagaacttaagccgcaaacatgcaccatttgtgagaccgcccctgtcaacgccatcgatgctgaaatgcacgacctcaattgctcttacaacatttgcccctactgtgcctcccgcctgacaagcgacggcctggcgcggcatgtgacccagtgccctaagagaaaagagaaggttgaagagacggagctctatctgaaccttgaacgcatcccctggatcgtgcggaaactgctccaggtctctgagtccacaggggtggctctgaagagaagctcctggctgattgtgcttctcgttctgctgaccgtcagcctctctcccgtgcagagcgcccctgtgggacacggcaaaacaatcgaaacctaccaaacacgggaggggttcaccaatatttgtctgtttatgcttggatccatcctgttcattgtctcttatctcgtgaagggcctggttgatagcgtgtccgacagctttttcccggggctgtctgtctgcaaaacgtgttccatcggctctatcaacggatttgaaattgagagccacaagtgctactgttcccttttctgctgtccctattgccgccattgtagcgccgatagagagatccaccagctccatctgggcatttgcaagaaacggaagaccgggtctaatgtgatgctggctgtttgcaaaagaatgtgtttcaaggccacaatcgaggcttcccgccgggccctcctgattagaagcatcattaacaccacatttgtgatctgcatccttaccctggcgatttgtgtcgtgtctacgtccgccgttgaaatggaaaatctccctgctggaacatgggagcgcgaagaggacctgaccaacttctgccaccaggagtgtcaagtgacagaaaccgagtgcctgtgtccctacgaagcccttgtcctgagaaaacctctctttctggatagcatcgtgaagggcaccaagaatctcctgaactccacatctcttgagacgagcctgtccattgaggctccctggggagccatcaatgtgcagagcaccttcaaacctacagtctctaccgcgaacattgccctctcctggagctctgttgaacatcggggaaataagatcctggtgacaggccgcagcgagtccatcatgaaactggaagagagaaccggggtgtcttgggaccttggcgtcgaagatgctagcgagtccaagctgctcacggtgtctattatggacctgagccagatgtattccccggtttttgagtacctcagcggagatagacaggtggaagagtggcccaaagccacatgcaccggcgactgtcctgaacgctgcgggtgtacctcttccacatgcctgcacaaggagtggccccacagcagaaactggcggtgcaatcctacctggtgttggggagtcggcacagggtgcacgtgttgcggagtggatgttaaggaccttttcaccgatcatatgtttatcaaatggaaggtggaatacattaaaacagaggctatcgtctgtgtggagctgacctcccaagaacgccagtgctctctcattgaggccggcacaagattcaacctgggccccgttaccatcacgctgagcgaaccgcggaatatccagcagaaacttcctcccgagattatcaccctgcaccccaaaattgaagaggggtttttcgacctcatgcatgtgcaaaaggtcctgtccgcctctacagtgtgtaagctccagagctgcacccacggaatccctggcgacctgcagatttatcatatcgggaaccttctgaaaggagatcgcctgaacggccacctcattcacaagatcgagccccattttaatacatcctggatgagctgggacgggtgtgatctggactactattgcaacatgggagattggccttcttgtacctacacaggcgtgacgcagcacaatcatgctgcgttcgtcaaccttctgaatatcgaaaccgactatacaaaaacctttcacttccactccaagagagttaccgcccatggcgatacaccgcaactcgacctgaaagctcggcccacgtacggggccggagagattaccgtgctcgtggaagtcgccgatatggagctgcacacaaagaaagtggaggttagcggccttaagttcgcttctctggcctgcaccgggtgctatgcgtgttccagcggaatctcttgcaaggtgcggattcatgtcgacgaacctgatgagctgacagtgcacgttaaaagctccgaccccgatgtggtcgctgcctctaccagcctcatggcccgcaagctggaatttggcacggactccacattcaaggcttttagcgccatgcctaaaacctccctttgtttctacatcgtggagcgggaatactgcaaatcttgtagcgaggacgataccaagaagtgcgtcgacacaaaactggagcagccccagtccattctcatcgaacataaggggaccatcattggaaaacaaaacgatacatgtaccgcgaaggcttcttgctggctggagagcgtgaaatcctttttctatggcctcaagaatatgctgggctctgtttttgggaacttctttgtgggaatccttctgttcctggccccgtttgtcctcctggtgcttttcttcatttttggctggaagatcctgttctgttttaaatgctgtagacgcacgcggggactcttcaagtacagacacctgaaagacgatgaagagacagggtatcgcaagattatcgaacggctcaatagcaaaaagggcaagaacagactgcttgacggggagcgcctggccgatcggaaaatcgctgagctgttttccaccaagacacacattggatga

SEQ ID NO: 13591 - RNA, 5067 nt, synthetic construct
  misc_feature 1..5067: note = derived and/or modified CDS sequence (opt5) from CCHFV(Ast149)__KX056054.1__GP
  source 1..5067: mol_type = other RNA
atgcccatcaacattatgcacaccctgctcgtgtgcttcatcctgtaccttcagctgagcggcctcgggggagcccatggccaatccaatgctacagagcacaacgggacgaataccacaaccgcccctggaacatctcagagcccgaagccccctgcgtccaccacaccccctcatacccccgaatctagcacggtcaaactgaccacacctacctccgagacagaaggctctggggagaccacgccgccccctaacacaacccagggacttccccctcccggcacaaccccggaaagacctgctaccacagccacgagcacctccagcacagacaatatgaactctaccacacaggttaccgataatacgcccacatccaccgtgagcacctctccttccagctctccctccatgcccagcacatcccaaggcattcactatcctgtgcggtctctgctcagcgtctccagcccgaagaccgtgacaacgcccacccctatgtctcccggggagatgtcccctgagacaagctctcagcatagcgccatgtcccgcatccccaccctgtacacagctgcccaggtttctaccgaaaacgctaatagaagcacgccgcggcagtccgagagctctgcccaacctgcgacccagtcccccacaacctttcctgcccagacaattctgctcatgagcgctgcccccaaagctatccaggacatgcacccttctcccaccaaccgctccaagagaaatctggaagtggagatcattcttacgctgagccaaggactcaaaaagtattacggcaagatcctgaaacttctgcacctcacactggaggaagataccgaggggctgctcgaatggtgtaagcggaacctgggatccaattgcgacgatgacttctttcagaaacgcattgaggagttctttatcacaggcgaggggtatttcaacgaggtccttcagtttaagaccctgtctaccctcagcccgacagaaccttcccatgtgagactgcccacggccgagcccttcaaatcttactttgcgaagggattccttagcattgattccggctattttagcgccaagtgttaccctcggtcttccaccagcggcctgcaactcatcaatgttacacagcacccggctcgcattgccgaaacccccgggcctaaaacaacctctctgaagacgatcaactgcatcaacctgagagcttccgtgttcaaagagcatcgggaagtcgagattaatgtgctcctgccccagatcgccgtgaaccttagcaattgtcacgtcgttatttactctcacgtgtgcgactatagcctggatacagacggacctgtgcgcctccccagaatccatcacgagggcacctttattcctgggacctacaagatcgtcatcgataaaaagaacaaactgaatgaccggtgttcccttgtgacaaactgcgttattaagggacgcgaagtgagaaagggccagagcgtcctgcggcaatataaaaccgagatcaagattgggaaagcctctacaggatccagaaagctcctgagcgaagaacccggcgatgactgtatctcccgcacgcagctgctcaaaaccgaaacagctgagattcatgacgataattacggcgggccgggagacaagatcaccatctgcaacggctctacaattgtggatcagcggctggggagcgagcttggatgttataccatcaatagagttaagtccttcaaactgtgcgaaaactctgcgacgggcaagacctgcgagattgacagcacacctgtgaaatgtcgccaggggttctgcctcaagatcacccaagaaggccggggacacgtcaaactgtccagaggctctgaggtggtcctggatgcctgtgacagctcctgcgagattatgatccccaaggggacaggagatattcttgtggactgtagcggcgggcagcagcattttctcaaggataatctgatcgacctgggatgccctcacatccccctcctgggcaaaatggctatttacatctgtcgcatgtctaaccacccgcggaccacaatggccttcctgttttggttctcctttgggtatgttattacctgcatcttctgtaaggccctgttttacagcctcattatcatcggcacgctggggaaaaagattaaacagtacagagaactgaagcctcaaacatgcaccatctgtgagaccgctcccgtgaatgccattgatgcggaaatgcatgaccttaactgctcttataatatctgcccttactgtgcttcccgcctcacaagcgacggcctggcccggcacgtcacccagtgccccaagagaaaagagaaggtggaagagacggagctgtatctcaacctggaacgcattccctggatcgttcggaaacttcttcaggtgtctgagtccacaggggtcgccctcaagagaagctcctggctgatcgtgctgcttgtgctcctgaccgttagcctgtctcctgtccagagcgctccggtgggacatggcaaaacaattgaaacctaccaaacacgggaggggttcaccaacatctgtctctttatgctgggatccattcttttcatcgtgtcttgcctggtcaagggcctcgtggatagcgtttccgactcctttttccccgggctgagcgtgtgtaaaacgtgctccattggctctatcaatggatttgaaatcgagagccacaagtgttattgctccctgttctgttgcccttactgtcgccactgcagcgccgatagagagattcatcagcttcacctcggcatctgcaagaaacggaagaccgggtctaacgtcatgctggctgtgtgtaaaagaatgtgcttcaaggccacaattgaagcgtcccgccgggccctgcccatcagaagcattatcaataccacatttgttatttgtatcctcaccctggctatctgcgtggtctctacgtccgccgtggagatggaaaaccttcctgctggaacatgggagcgcgaagaggacctgaccaatttctgtcatcaggagtgccaagttacagaaaccgagtgtctctgcccctatgaagccctggtgctgagaaaacctctttttctggatagcattgtcaagggcatgaagaacctccttaattccacctctctcgagacaagcctgtccatcgaggcgccgtggggagccattaacgtgcagagcacgttcaaacccaccgtgtctacagctaatatcgccctttcctggagctctgtcgaacaccggggaaacaagattctggttaccggccgcagcgagtccatcatgaaactcgaagagagaacaggggtgtcttgggacctgggcgtggaagatgctagcgagtccaagctgcttaccgtctctatcatggacctgagccagatgtactcccctgtgtttgagtacctcagcggagatcggcaggttgaagagtggcccaaagccacgtgtacaggcgactgccctgaacgctgtgggtgcacctcttctacctgcctgcataaggagtggccccacagcagaaattggcggtgtaacccgacatggtgctggggagtgggcaccgggtgtacatgctgtggagtcgatgtgaaggacctcttcacggatcacatgtttattaaatggaaggttgaatatatcaaaaccgaggccattgtgtgcgtcgagctgacatcccaagaacgccagtgttctcttatcgaggctggcaccagattcaatctgggccctgtgacaattaccctcagcgaaccccggaacatccagcagaagctgccccctgagatcattacgctgcatcccaaaatcgaagaggggtttttcgaccttatgcacgttcaaaaggtgctgtccgcgtctaccgtctgcaagctccagagctgtacacatggcattcctggagacctgcagatctaccacattgggaatctcctgaaaggagatcgccttaacggccatctgatccacaagattgagccgcactttaacacctcctggatgagctgggacgggtgcgatctggactattactgtaatatgggagattggccctcttgcacatataccggcgtgacacagcataaccacgccgctttcgtgaatctcctgaacatcgaaacggactacaccaaaacatttcatttccactccaagagagtcaccgcccacggcgatacccctcaacttgacctgaaagcccggcccacatatggggctggagagatcacggttctcgtggaagtggccgatatggagctgcataccaagaaagtcgaggtgagcggcctcaagttcgcgtctctggcttgcacagggtgttacgcctgctccagcggaatttcttgtaaggttagaatccacgtggacgaacctgatgagcttaccgtccatgtgaaaagctccgaccccgatgttgtggccgcttctacaagcctgatggcccgcaagctggaatttggcaccgactccacgttcaaagcgtttagcgctatgccgaagacatccctctgcttctacattgtcgagcgggaatattgtaaatcttgcagcgaggacgataccaagaagtgtgtggacaccaaactggagcagcctcagtccatccttattgaacacaaggggacaatcatcggaaaacaaaatgatacctgcacagccaaggcctcttgttggctggagagcgtcaaatcctttttctacggcctcaagaacatgctgggctctgtgtttgggaatttctttgttggcattctcctgttccttgctccctttgtgctgctggccctcttcttcatctttggatggaagattctgttctgctttaaatgttgcagacgcacccgggggcttttcaagtatagacatctgaaagacgatgaagagacgggataccgcaagatcattgaacggctcaacagcaaaaagggcaagaatagactgctcgacggggagcgcctggctgatcggaaaatcgccgagctgttttccacaaagacccacatcggatga

SEQ ID NO: 13592 - RNA, 5067 nt, synthetic construct
  misc_feature 1..5067: note = derived and/or modified CDS sequence (opt5) from CCHFV(Ast199)__KX056051.1__GP
  source 1..5067: mol_type = other RNA
atgcccatcaacattatgcacacccttctcgtgtgcttcatcctgtaccttcagctgagcggcctcgggggagcccatgtccaatccaatgctacagagcacaacggcacgaataccacaaccgttcctgggacatctcagagcccgaagccccctgcctccaccacactgccccatacccctgaatctagcacggtgaaacttaccacacccacctccgagacagaaggatctggcgagaccacgcctccgcccaacacaacccaggggctgcctccccctggaacaacccccgaaagaccggcgaccacagctacgaccacaagctccaccgacaatatgaacagcacaacccaggtgacggataatacacctacctctaccgtctccattagcccctcttccaaccctagcatgccctctacatcccaaggcatccactatcccgtgcggagcctcctgtccgtttctagccctaagaccgtgacaacgccgacccccatgtcccctggcgagatgagccccgagacatcttcccagcatagcgccatgtctcgcattcctaccctgtacacagccgctcaggtcagcaccgaaaatacgaacagatccacccccagacagtctgagagctccgcccaaccggctacacagagccctaccacatttcccgcccagaccatccctctcatgtctgcggcccccaaagctatccaggacatgcacccttcccccacgaatcgcagcaagagaaacctggaagtggagattatccttacactgtctcaagggctcaaaaagtattacggaaagattctgaaacttctgcacctcaccctggaggaagatacagagggcctgctcgaatggtgtaagcggaatctggggtccaactgcgacgatgacttctttcagaaacgcatcgaggagttctttattaccggagaaggctatttcaatgaggttcttcagtttaagaccccgagcacactgtcccctacggaaccctctcatgtgagactccccaccgccgagcctttcaaaagctactttgctaaggggttcctgtccatcgattctggatattttagcgccaagtgttacccgcggtccagcacatctggccttcaactgattaacgtcacccagcaccccgcgcgcatcgccgaaacacctggccccaaaaccacgtccctcaagacaatcaactgcattaatctgagagctagcgtgttcaaagagcatcgggaagtggagatcaacgtcctgctccctcagattgccgttaatctgtctaactgtcacgtggtgatcaattcccacgtctgcgactacagccttgataccgacgggcccgtgcgcctgcctcggattcatcacgagggaacctttatccccggcacatataagatcgttattgataaaaagaacaaactcaatgaccggtgttctctggtgaccaactgcgtcatcaaggggcgcgaagtgagaaagggacagagcgttcttcggcaatacaaaacagagattaagatcggcaaggcttccacggggagcagaaaactgctctctgaggaaccgggagatgactgtatttcccgcacccagctgctgaaaacagaaaccgccgagatccatgacgataattatggcggccctggggacaagatcacaatttgcaacggaagcaccatcgtggatcagcggctcggctccgagctggggtgttacacgattaatagagtcaagtctttcaaactttgcgaaaacagcgccaccggaaagacatgcgagatcgactccacccccgtgaaatgtcgccagggcttctgcctgaagattacacaagaagggcggggccacgtcaaactctctagaggaagcgaggtggttctggatgcttgtgactcctcttgcgagatcatgattcctaagggcaccggggatatcctggtggactgtagcggaggccagcagcattttcttaaggataatctcatcgacctggggtgcccccacattccgctgctcggaaaaatggcgatctatatttgtcgcatgtccaaccaccctcggacaaccatggccttcctgttttggttcagctttggctacgtcatcacgtgcattttctgtaaggctctgttttattctctgatcatcattgggacactcggcaaaaagatcaaacagtacagagaactgaagccccaaacctgcaccatttgtgagacagcccctgtgaatgccatcgatgctgaaatgcatgacctgaactgctcctacaacatttgcccctattgtgccagccgccttacctctgacggactcgcgcggcacgttacgcagtgccccaagagaaaagagaaggtggaagagacagagctgtacctgaatctcgaacgcatcccttggatcgtccggaaactgcttcaggtgtccgagagcaccggcgtggctctgaagagatgttcttggctcattgttctgctggtccttctcacagtgtccctgagcccggtgcagtccgcccccgtcgggcatggaaaaaccatcgaaacatatcaaacccgggagggcttcacgaacatttgcctgtttatgctcgggagcatcctgttcattgtgtcttgtcttgttaagggactggtggatagcgtctccgacagctttttccctggcctctctgtgtgcaaaacctgttccatcgggtctatcaatggctttgaaattgagagccacaagtgctactgttccctgttctgctgtccctattgccgccactgctctgccgatagagagatccatcagctgcaccttggaatttgtaagaaacggaagacaggcagcaacgttatgctcgctgtgtgcaaaagaatgtgtttcaaggccaccatcgaggcttcccgccgggccctgctgattagaagcatcattaatacaacctttgtcatctgcatcctcacgctggcgatttgtgtggtttctacatccgccgtggaaatggaaaaccttcctgctgggacctgggagcgcgaagaggacctgacaaatttctgccatcaggagtgtcaagtcaccgaaaccgagtgcctctgtccctacgaagccctggtgctgagaaaacctctttttctggatagcatcgtgaagggaatgaagaacctccttaattctacatccctcgagacgagcctgtccattgaggctccgtggggcgccatcaacgtccagtctaccttcaaacccacagttagcaccgcgaatattgccctttcctggagctctgtggaacaccgggggaacaagatcctggtgacaggacgctccgagagcatcatgaaactcgaagagagaaccggcgtctcttgggacctgggggtggaagatgctagcgagtccaagctgcttacggtttctattatggacctgagccagatgtattcccctgtgtttgagtacctctctggcgatcggcaggtcgaagagtggcccaaagccacatgcaccggagactgtcctgaacgctgcggctgcaccagctccacatgtctgcataaggagtggccccacagcagaaattggcggtgcaacccgacctggtgttggggagtggggacaggctgcacgtgttgcggggttgatgtgaaggacctcttcaccgatcacatgtttatcaaatggaaggtcgaatacattaaaacagaggctatcgtgtgtgttgagctgacctctcaagaacgccagtgctcccttattgaggccggaacaagattcaatctgggccctgtgaccatcacgctcagcgaaccccggaacatccagcagaagctgccccctgagattatcaccctgcatcccaaaattgaagagggctttttcgaccttatgcacgtccaaaaggtgctgtccgcctctacagtgtgtaagctccagagctgcacccatgggatccctggagacctgcagatttatcacatcggcaacctcctgaaaggggatcgccttaatggacatctgattcacaagatcgagccgcactttaacacatcctggatgtcttgggacggctgtgatctggactactattgcaatatgggggattggcccagctgcacctacacaggagtcacgcagcataaccacgctgcgttcgttaatctcctgaacatcgaaaccgactatacaaaaacctttcatttccactccaagagagtgaccgcccacggcgatacacctcaacttgacctgaaagctcggcccacgtacggcgccggggagattaccgtgctcgtcgaagtggccgatatggagctgcatacaaagaaagttgaggtgagcggactcaagttcgcttctctggcctgtaccggctgctatgcgtgttccagcgggatctcttgcaaggtccgcattcacgtggacgaacctgatgagcttacagttcatgtgaaatccagcgaccccgatgtcgtggctgcctctaccagcctgatggccagaaagctggaatttggaacggactccacattcaaggctttttctgccatgccgaaaaccagcctctgtttctacatcgtcgagcgggaatactgcaaatcctgtagcgaggacgataccaagaagtgcgtggacacaaaactggagcagcctcagtccattcttatcgaacacaagggcaccatcattgggaaacaaaatgatacatgtaccgcgaaggcttcttgctggctggagagcgttaaatcctttttctatggactcaagaacatgctgggctctgtgtttggcaatttctttgtcgggatcctcctgttccttgccccctttgtgctgctggttctcttcttcatttttggatggaagatcctgttctgttttaaatgctgcagacgcacgcggggccttttcaagtacagacatctgaaagacgatgaagagacagggtatcgcaagattatcgaacggctcaacagcaaaaagggaaagaatagactgctcgacggcgagcgcctggccgatcggaaaatcgctgagctgttttccaccaagacacacattgggtga

SEQ ID NO: 13593 - RNA, 5067 nt, synthetic construct
  misc_feature 1..5067: note = derived and/or modified CDS sequence (opt5) from CCHFV(Saf)__KX013487.1__GP
  source 1..5067: mol_type = other RNA
atgcccaccaacatcatgcacacactgctcgtgtgcttcattctgtaccttcagctgctcggccttgggggagcccatggccaaagcaatgctacggagcacaacgggaccaatacaaccacagccccttccacctctcagagcccgaagccccttgtctccacagcgcctccccatgctctggaatctagcaccatcaaacctacgacccccgcctccgagacagaaggatctggcgagaccacacctccgcccaacaccacgcaggggcctagccctcccgaaacaacccccgagagaccggccacaaccgctacctccacacctagcacggacaataccaactctacaacccacgttacagataataaccccacctccacgattagcacatctccttccagctctccctccacccccagcacccctcagggaatccatcacccggcccggaatctcctgtccgtgtctagccccaagacagctaccacacctacgcccacctcccctggcgagattagctctgaaacatccagcctgcactctgccatgagccgcacctccacactctataccgcgacgcaagtgtctaccgagaacgccaatcatagcgctcccagacagtccgaaagctctgcccagccgacaaccacatcccctatgaccagccccgctcagtctatcctggtcatgtccgccgcgcctacggccatccaaaacattcaccccagccctacaaatcggtccaaacgcaaccttgagatggagatcattctgaccctctctcagggcctgaagaaatactatgggaagatccttaagctgctccatctgacactggaagaggacaccgaaggactcctggagtggtgtaaaagaaatcttggcagcaactgcgatgacgatttcttccagaagcggattgaagagtttttcatgaccggggagggatactttaacgaagtgctgcagttcaaaacactctccacgctgtctcccaccgagccgagccacgctcgccctcccacagttgaaccctttaagtcctatttcgccaaaggctttcttagcatcgactctgggtacttctccgctaagtgttatcctagaagctctacctccggactgcaactcattaatgtgacacagcacccggcccggatcgccgagacccccggccctaagacgacaagcctgaaaaccatcaactgcattaatctgcgcgcttctgtctttaaggaacatagagagatcgagattaacgtgctcctgccccagatcgcggttaatcttagcaactgtcacgtggtcattaattcccatgtgtgcgattacagcctggacaccgatggccctgtgcggctcccccacatccatcacgaagggacattcatccctggaacctacaaaattgtcatcgacaaggagaacaaactgaatgatcgctgtacacttgttacgaactgcgtgattaagggcagagaagtgcggaaagggcaatctgtcctgcgccagtataagaccgagatcaagattggaaaagcctccacaggcagcagaaagctcctgtccgaggaacccggggacgattgtatctctcggacccagctgctcagaacagagaccgctgaaatccacgacgacaattacggaggcccgggcgataaaattacgatctgcaacgggagcaccattgtggaccagcgcctgggatccgagcttggctgttatacaatcaatcgggttaagtcttttaaactgtgcgaaaacagcgccaccgggaagacatgcgagattgattccacccctgtgaagtgtagacaaggattctgcctcaaaatcacacaggagggccgcgggcatgtcaagctgtctcggggcagcgaagtggttctggacgcctgtgattccagctgcgaggtgatgattcccaaaggaaccggcgacatccttgtcgattgttctgggggacagcagcactacctcaaggacaatctgatcgatctgggctgccctcatattcccctcctggggaaaatggctatctatatttgtagaatgtccaaccacccgcgcacgacaatggccttcctgttttggttcagctttggatacgtgattacctgcatcttctgtaaggcgctgttttattctctcatcatcattggcaccctggggaagaaaatcaagcaataccgggaactgaaacctcagacatgcaccatttgtgagacggctcccgtcaacgccatcgacgccgaaatgcacgatcttaattgctcctacaacatttgcccttattgtgctagcagactcacatctgacggcctggcccgccatgtgccccagtgccccaagcggaaagagaaggttgaggaaaccgagctgtacctcaatctggaaagaatcccttggatcgtgcgcaaacttctgcaggtctccgagagcacaggagtggctctcaagcggtccagctggctgattgttctgcttgtgctcctgaccgtctctctgagcccggtgcaatccgcccccgtgggccacgggaagacaatcgaaacctatcagacgagagagggattcacctctatttgtctctttatgctgggcagcatccttttcctggtttcctgcctcgtcaaagggctggtggactctgtgagcgattcctttttccctggactgtctgtctgtaagacatgcagcattggctccatcaacgggtttgagatcgaaagccataaatgttactgctctcttttctgttgcccctattgtcggcactgctccgcggaccgcgagattcatcagctccacctgagcatctgcaagaaaagaaagaccggctctaatgtgatgctggccgtttgtaagcggatgtgctttagagctacaattgaagcctcccgccgggctctcctgatcagaagcattatcaacaccacgttcgtgatttgtatccttacactgaccatctgcgtcgtgtccacatctgccgttgagatggaaaatctccctagcggaacctgggagcgcgaggaagatctgaccaacttctgtcaccaggagtgccaagtgacagaaacggagtgtctgtgcccctacgaggcgcttgtcctgagaaaacctctcttttccgacagcattgtgaagggcatgaaaaatctgctcaactctacctccctggaaacaagcctttctatcgaggccccgtggggagctattaatgttcagagcaccttcaagcccacagtgtccaccgccaacatcgctctgtcttggagctccgtcgaacatcgggggaataaaattctcgtgacgggccgctctgagagcatcatgaagctggaagagagaacaggggtgtcctgggatctgggagtcgaggacgccagcgaatctaaacttctgaccgtttccatcatggatctcagccagatgtattcccctgtgtttgagtacctgtctggcgaccggcaagtggaagagtggcccaaggccacctgtacaggggattgccctgaacgctgtggctgcaccagctccacatgcctccacaaggagtggccccattctagaaactggcggtgtaatccgacgtggtgctggggagtcggcaccgggtgtacatgctgtggagtggacgttaaagatctgttcaccgaccacatgtttgtgaagtggaaagtcgagtacattaagacagaagctatcgtgtgcgttgagcttaccagccaggaacgccagtgttccctgattgaggcgggcacgagattcaacctcgggcctgtgaccatcacactgagcgaaccccggaacattcagcaaaagctgccccctgagatcatcacccttcatcccaaagtcgaggaaggatttttcgatctgatgcacgtgcagaaggttctctctgcctccacagtgtgcaaactgcagagctgtacccacggcattcctggcgacctccaggtctatcatatcgggaatctgcttaagggagaccgcgtgaacggccacctgattcataaaatcgagccgcactttaatacatcttggatgtcctgggatgggtgcgacctggattactattgtaacatgggagactggcccagctgcacgtacaccggcgtgacacaacacaatcatgctgccttcgtcaacctcctgaatattgaaaccgattatatgaagacctttcacttccattctaagagagttacagcccacggggacacgcctcagcttgatctgaaagctcggcccacctacggagccggcgagatcacagtgctcgtggaggtcgcggacatggaactgcataccaagaaagtggagattagcggcctcaagtttgtttccctggcttgcacagggtgttatgcctgctctagcggaatctcctgtaaagtgagaatccacgtcgatgaacctgacgagcttaccgtgcacgttaagagctccgatcccgacgtggtcgccgcttctacgagcctgatggcccgcaaactggaatttggcacagattccaccttcaaggcgttttctgctatgccgaagaccagcctctgcttctacattgtggagcgggagtactgtaaatcctgctctgaagaggacacacagaagtgtgtcgacaccaaactggaacagcctcaaagcatccttattgagcataaggggacaatcattggaaaacagaacgatacctgcacggccaaggcctcctgttggctggaaagcgtgaagtcctttttctatggcctcaaaaatatgctggggtctgtttttggaaacttctttatcggcatcctcctgttccttgctccctttgtgctgctggtcctcttctttatgttcggctggaagattctgttctgctttaaatgttgcagacgcacacgggggcttctgaagtacagacacctcaaagacgatgaggagaccggatatcgccggatcattgaaagactgaataacaagaagggcaaaaatcgcctcctggacggggagcggcttgccgatagaaagatcgctgaactgttcagcacaaaaacccatattggatga

SEQ ID NO: 13594 - RNA, 5067 nt, synthetic construct
  misc_feature 1..5067: note = derived and/or modified CDS sequence (opt5) from CCHFV(Min)__KX013481.1__GP
  source 1..5067: mol_type = other RNA
atgcccaccaacatcatgcacacactgctcgtgtgcttcattctgtaccttcagctgctcggccttgggggagcccatggccaaagcaatgctacggagcacaacgggaccaatacaaccacagccccttccacctctcagagcccgaagccccttgtctccacagcgcctccccatgctctggaatctagcaccatcaaacctacgacccccgcctccgagacagaaggatctggcgagaccacacctccgcccaacaccacgcaggggcctagccctcccgaaacaacccccgagagaccggccacaaccgctacctccacacctagcacggacaataccaactctacaacccacgttacagataataaccccacctccacgattagcacatctccttccagctctccctccacccccagcacccctcagggaatccatcacccggcccggaatctcctgtccgtgtctagcctgaagacagctaccacacccacgcctacctcccccggcgagattagctctgaaacatccagcctccactctgccatgagccgcacctccacactgtataccgcgacgcaagtgtctaccgagaacgccaatcatagcgctcctagacagtccgaaagctctgcccagcccacaaccacatccccgatgaccagccctgctcagtctatccttgtcatgtccgccgcgcccatcgccattcaaaacatccaccctagccccacgaatcggtccaaacgcaacctggagatggagattatcctcacactgtctcagggccttaagaaatactatgggaagattctgaagctcctgcatctgaccctcgaagaggacacagaaggactgcttgagtggtgtaaaagaaatctgggcagcaactgcgatgacgatttcttccagaagcggatcgaagagtttttcatgaccggggagggatactttaacgaagtgctccagttcaaaaccctgtccacactttctcctacggagcccagccacgctcgcccgcctaccgttgaaccctttaagtcctatttcgccaaaggctttctgagcattgactctgggtacttctccgctaagtgttatcccagaagctctacatccggactccaactgatcaatgtgacccagcaccctgcccggatcgccgagacaccgggccccaagaccacgagcctgaaaacaattaactgcatcaatctccgcgcttctgtctttaaggaacatagagagattgagatcaacgtgctgcttcctcagattgcggttaatctgagcaactgtcacgtggtcatcaattcccatgtgtgcgattacagcctcgacaccgatggccccgtgcggctgcctcacatctaccatgaagggaccttcattcccggaacatataaaatcgtcattgacaagaaaaacaaacttaatgatcgctgtaccctggttacaaactgcgtgatcaagggcagagaggtgcggaaggggcaatctgtcctccgccagtacaagacggaaattaaaatcggaaaggcctccaccggcagcagaaaactgctgtccgaggaacctggggacgattgtatctctcggacacagctcctgagaaccgagacagctgagattcacgacgacaattatggaggccccggcgataagatcaccatttgcaacgggagcacgatcgtggaccagcgccttggatccgaactgggctgttacaccattaatcgggttaaatcttttaagctctgcgagaacagcgccacagggaagacctgcgaaatcgattccacaccggtgaaatgtagacaaggattctgcctgaagattacccaggagggccgcgggcacgtcaaactgtctcggggcagcgaggtggttcttgacgcctgtgattccagctgcgaagtgatgatccctaagggaacaggcgacatcctcgtcgattgttctgggggacagcagcatttcctgaaagacaatctgattgatctcggctgcccccacatccctctgcttgggaagatggctatttatatctgtagaatgtccaaccatccccgcaccacgatggcctttctgttctggtttagcttcggatacgtgattacatgcatcttttgtaaggcgctcttttattctctgatcattatcggcaccctggggaaaaagattaaacaataccgggagcttaagccgcagacctgcacaatctgtgaaaccgctcctgtcaacgccattgacgccgagatgcacgatctcaattgctcctacaacatctgcccctattgtgctagcagactgacgtctgacggcctggcccgccacgtgcctcagtgccccaaacggaaggaaaaggttgaggagacagaactctacctgaatcttgagagaatcccctggattgtgcgcaaactgctccaggtctccgaaagcaccggagtggctctgaagcggtccagctggctgatcgttcttctcgtgctgctgacagtctctctcagccctgtgcaatccgccccggtgggccatgggaaaaccattgagacatatcagaccagagaaggatttacgtctatctgtctgttcatgcttggcagcattctgtttctcgtttcctgcctggtcaaggggctggtggactctgtgagcgattccttctttcccggactttctgtctgtaaaacctgcacaatcggcagcatcaacgggttcgagattgagtcccacaagtgttactgcagcctcttttgttgcccttattgtcggcattgctctgcggaccgcgaaatccaccagctgcatctgtccatttgcaaaaagagaaagaccggcagcaatgtgatgctcgccgtttgtaaacggatgtgcttcagagctacaatcgaggcctctcgccgggctctgcttattagatccatcattaacaccacgttcgtgatctgtatcctgacactcaccatttgcgtcgtgagcacatccgccgttgaaatggagaatctgccctctggaacctgggaacgcgaggaggatctgaccaacttttgtcaccaggaatgccaagtgacagagacggaatgtctttgcccttacgaggcgctggtcctcagaaagcccctgttcctcgacagcatcgtgaaaggcaccaagaatctgcttaactccacaagcctggagacctctctctccattgaagccccttggggagctatcaatgttcagagcacatttaaaccgaccgtgtctacggccaacattgctctgagctggtcctctgtcgagcaccgggggaataagatcctggtgacaggccgcagcgaatccatcatgaaacttgaggaaagaaccggggtgtcttgggatctgggagtcgaggacgccagcgagtccaagctcctgaccgttagcattatggatctctctcagatgtattcccccgtgttcgaatacctgagcggcgaccggcaagtggaggaatggcctaaggccacatgtaccggggattgccccgagcgctgtggctgcacatcctctacgtgccttcataaagaatggcctcacagcagaaactggcggtgtaatcccacctggtgctggggagtcggcacagggtgtacctgctgtggagtggacgttaaggatctgtttacagaccatatgttcgtgaaatggaaggtcgagtacatcaagaccgaggctattgtgtgcgttgaactcacgtcccaggagcgccagtgttctctgatcgaagcgggcaccagatttaacctggggccggtgacaattacccttagcgagcctcggaacatccagcaaaaactgcctcccgaaatcattacactccaccccaaggtcgaggagggattctttgatctgatgcatgtgcagaaagttctctccgccagcaccgtgtgcaagctgcagtcttgtacacacggcatccccggcgaccttcaggtctatcacattgggaatctgctgaaaggagaccgcatcaacggccatctcattcacaagatcgaacctcatttcaatacgtcctggatgagctgggatgggtgcgacctggattactattgtaacatgggagactggccgtcttgcacctacacaggcgtgacccaacacaatcacgctgcctttgtgaaccttctgaatattgagaccgattatacaaagacgttccattttcactccaaaagagtcaccgcccatggggacacaccccagctcgatctgaaggctcggcctacctacggagccggcgaaatcacagttctcgtggaggtggcggacatggagctgcacaccaaaaaggtcgaaatcagcggccttaaattcgcttctctggcctgcacggggtgttatgcctgcagctccggaatttcttgtaaggtgagaatccatgttgatgagcccgacgaactgacagtgcacgtcaaaagctccgatcctgacgtggttgctgccagcacctccctcatggcgcgcaagctggagttcggcaccgattctacatttaaggctttcagcgccatgcccaaaacctccctttgcttttacattgtggaacgggagtactgtaagtcttgcagcgaggaagacacacagaaatgtgtcgacaccaagctggagcagccgcaatccatcctcattgaacacaaagggacgatcatcggaaagcagaacgatacatgcaccgccaaggcttcttgttggctggagagcgtgaaatccttcttttatggcctcaagaatatgctggggagcgtcttcggaaactttttcattggcatccttctgtttctggcccctttcgtgctcctggttctgtttttcatgttcggctggaaaattctgttttgcttcaagtgttgcagacgcacacgggggctcctgaaatacagacatctcaaggacgatgaagagaccggatatcgccggatcattgagagactgaataacaagaaaggcaagaatcgccttctggacggggaacggctggctgatagaaaaatcgccgagctcttttctacgaagacccacatcggatga

SEQ ID NO: 13595 - RNA, 5067 nt, synthetic construct
  misc_feature 1..5067: note = derived and/or modified CDS sequence (opt5) from CCHFV(Mamon)__KX013478.1__GP
  source 1..5067: mol_type = other RNA
atgcccaccaacatcatgcacacactgctcgtgtgcttcattctgtaccttcagctgctcggccttgggggagcccatggccaaagcaatacgaccgagcacaacgggacaaataccacaaccgctccttccacatctcagagcccgaagccccttgtctccaccgcccctccccatgcgctggaatctagcacgatcaaacctaccacacccgcttccgagaccgaaggatctggcgagacaacccctccgcccaacattacgcaggggcctagccctcccgaaacaacccccgagagaccggccacaaccgccacctccacacctagcacggacaataccaactctacaacccacgttacagataataaccccacctccacgatcagcacatctccttccagctctccctccacccccagcacccctcaggggattcatcacccggctcggaatctcctgtccgtgtctagccccaagacagccaccacacctacgcccacctcccctggcgagatcagctctaaaacatccagcctgcactctgctatgagccgcacctccacactctataccgccacgcaagtgtctaccgaaaacgcgaatcatagcgcccccagacagtccgagagctctgctcagccgacaaccacatcccctatgaccagccccgcccagtctatcctggtcatgtccgctgcccctacggcgattcaaaacatccaccccagccctacaaatcggtccaagcgcaaccttgaaatggagattatcctgaccctctctcagggcctgaaaaagtactatgggaagattcttaaactgctccatctgacactggaggaagacaccgagggactcctggaatggtgtaagagaaatcttggcagcaactgcgatgacgatttcttccagaaacggatcgaggaatttttcatgaccggggagggatactttaacgaggtgctgcagttcaagacactctccacgctgtctcccaccgaaccgagccacgcccgccctcccacagttgagccctttaaatcctatttcgctaagggctttcttagcattgactctgggtacttctccgccaagtgttatcctagaagctctacctccggactgcaactcatcaatgtgacacagcacccggctcggatcgccgaaacccccggccctaaaacgacaagcctgaagaccattaactgcatcaatctgcgcgcctctgtctttaaagagcatagagaaattgagatcaacgtgctcctgccccagattgctgttaatcttagcaactgtcacgtggtcatcaattcccatgtgtgcgattacagcctggacaccgatggccctgtgcggctcccccacatctaccatgaggggacattcattcctggaacctataagatcgtcattgacaaaaagaacaaactgaatgatcgctgtacacttgttacgaactgcgtgatcaagggcagagaagtgcggaaggggcaatctgtcctgcgccagtacaaaaccgagattaagatcggaaaagcgtccacaggcagcagaaagctcctgtccgaggaacccggggacgattgtatctctcggacccagctgctcagaacagaaaccgccgagattcacgacgacaattatggaggcccgggcgataaaatcacgatttgcaacgggagcaccatcgtggaccagcgcctgggatccgagcttggctgttacacaattaatcgggttaagtcttttaagctgtgcgaaaacagcgctaccgggaaaacatgcgagatcgattccacccctgtgaagtgtagacaaggattctgcctcaaaattacacaggaaggccgcgggcacgtcaagctgtctcggggcagcgaggtggtttccgacgcctgtgatagctcttgcgaggtgatgatccccaaaggaaccggcgacatcctggtcgattgttccgggggacagcagcatttccttaaggacaatctcattgatctgggctgccctcacatccccctgctcgggaagatggccatttatatctgtagaatgagcaaccatccgcgcacgacagtggcttttctgttctggttttctttcggatacgtcattacctgcatcttttgtaaagcccttttctattccctgatcattatcggcaccctcgggaagaaaattaagcaataccgggaactgaaacctcagacatgcaccatctgtgagacggcgcccgtgaacgctattgacgccgaaatgcacgatctgaattgcagctacaacatctgcccttattgtgcctctagacttacatccgacggcctcgctcgccacgttccccagtgccccaagcggaaggagaaagtggaagagaccgagctgtacctgaatctcgaaagaatcccttggattgtccgcaagctgcttcaggtgagcgagtccacaggagttgccctgaaacggagctcttggctcatcgtgctgctggtccttctcaccgtgagcctgtccccggtgcaatctgctcccgttggccatgggaagacaattgaaacctatcagacgagagagggatttaccagcatctgtctgttcatgctcggctccattctgtttcttgtctcttgcctggtgaaagggctcgtggacagcgtctccgattctttctttcctggactgagcgtgtgtaagacatgctccatcggcagcatcaacgggttcgaaattgagtctcacaaatgttactgctccctgttttgttgcccctattgtcggcattgcagcgccgaccgcgagatccaccagcttcatctctctatttgcaagaagagaaaaaccggctccaatgttatgctggcggtgtgtaagcggatgtgcttcagagccacaatcgaagctagccgccgggccctgctcattagatccatcattaacaccacgttcgtcatctgtatcctgacacttaccatttgcgtggtttctacaagcgctgtggagatggaaaatctgccttccggaacctgggagcgcgaagaggatctcaccaacttttgtcaccaggagtgccaagtcacagaaacggagtgtctgtgcccctacgaagccctggtgcttagaaaacctctgttcctcgacagcatcgttaagggcatgaaaaatctgctcaactctacctccctggagacaagcctttctattgaggcgccgtggggagccatcaatgtgcagagcacctttaagcccacagtctccaccgctaacattgccctgtcttggagctccgtggaacaccggggaaataagatcctcgtgacgggccgctctgagagcatcatgaaactggaagagagaacaggggtctcctgggatctgggagttgaagacgctagcgagtctaagctgctgaccgtgtccattatggatctcagccagatgtattcccctgtgttcgagtacctgtctggcgaccggcaagtcgaagagtggcccaaagccacctgtacaggggattgccctgaacgctgtggctgcaccagctccacatgcctccataaggagtggccccactctagaaactggcggtgtaatccgacgtggtgctggggagtgggcaccgggtgtacatgctgtggagttgacgtgaaagatctgtttaccgaccatatgttcgtcaagtggaaggtggaatacatcaaaacagaggccattgtttgcgtggagcttaccagccaggaacgccagtgttccctgatcgaggctggcacgagatttaacctcgggcctgtcaccattacactgagcgaaccccggaacatccagcaaaagctgccccctgagatcattacccttcaccccaaagtggaagagggattctttgatctgatgcatgttcagaaggtgctctctgcgtccacagtctgcaaactgcagagctgtacccacggcatccctggcgacctccaggtgtatcacattgggaatctgcttaagggagaccgcgtgaacggccatctgatccacaagattgagccgcatttcaatacatcttggatgtcctgggatgggtgcgacctggattactattgtaacatgggagactggcccagctgcacgtacaccggcgtcacacaacacaatcacgccgcttttgttaacctcctgaatatcgaaaccgattataccaaaacattccattttcactctaagagagtgacggcccatggggacacccctcagcttgatctgaaagcccggcccacatacggagctggcgagattaccgtgctcgtcgaagtggccgacatggagctgcacacaaagaaagttgagatcagcggcctcaagttcgcgtccctggcttgcaccgggtgttatgcctgctctagcggaatctcctgtaaagtgcgcattcatgtcgatgaacctgacgagcttacggtgcacgttaagagctccgatcccgacgtggtcgccgcttctacaagcctgatggccagaaagctggaatttggcaccgattccacctttaaagcgttctctgctatgccgaagacaagcctctgcttttacatcgtggagcgggaatactgtaaatcctgctctgaggaggacacccagaagtgtgtcgacacaaaactggaacagcctcaaagcattcttatcgagcacaaggggaccattatcggaaagcagaacgatacgtgcacagccaaaacctcctgttggctggaaagcgtgaagtctttcttttatggcctcaaaaatatgctggggtccgttttcggaaactttttcatcggcattctcctgtttcttgcccccttcgtgctgctggtcctctttttcatgttcggctggaagatcctgttttgcttcaaatgttgcagacgcacacgggggcttctgaagtacagacatctcaaggacgatgaggaaaccggatatcgccggattatcgagagactgaataacaaaaagggcaaaaatcgcctcctggacggggagcggcttgctgatagaaagattgccgaactgtttagcacgaaaacccacatcggatga

SEQ ID NO: 13596 - RNA, 5067 nt, synthetic construct
  misc_feature 1..5067: note = derived and/or modified CDS sequence (opt5) from CCHFV(K340_6)__KX013475.1__GP
  source 1..5067: mol_type = other RNA
atgcccatcaacattatgcacaccctgctcgtgtgcttcatcctgtaccttcagctgagcggcctcgggggagcccatgtccaatccaatgctacagagcacaacggcacgaataccacaaccgcccctgggacatctcagagcccgaagccccctgcgtccaccacactgccccatacccctgaatctagcacggttaaacccaccacacctacctccgagacagaaggatctggcgagaccacgccgccccctaacacaacccaggggcttccccctacaggaaccacccccgaaagaagcgctacaacggccacctccacaagctctaccgacaatatgaactccacaacccaggtgacggatagcacaccgacctctaccgtgtccacaagcccttcttccagctcctctatgcccagcacctcccaaggcattcaccatcctgtccggagcctgctctctgtgtccagccccaagacagttacgacccccacacctatgtctccgggcgagatgagccccgagacctcctctcagcacagcgccatgtcccgcgtgcctacactgtataccgctacgcaggtcagcaccgaaaatacagacagatctacaccccggcagtccgagagctctgtgcaacctgccacccagtcccccatcaccagcccggctcagacgattctgctcatgtccgccgcgcctaaagccatccaggatatgcacccctctcctacaaaccgcagcaagagaaatctggaagttgagatcattcttaccctgtcccaagggctcaaaaagtactatggaaagatcctgaaacttctgcatctcacactggaggaagacaccgagggcctgctcgaatggtgtaagcggaacctggggtctaattgcgatgacgatttcttccagaaacgcattgaggaatttttcatcaccggagagggctactttaacgaggtgcttcagttcaagacactgagcacgctctcccccaccgaacctagccacgtcagactgcccacagctgagccgtttaaatcttatttcgccaaggggtttctttccattgacagcggatacttctctgctaagtgttatcctcggtccagcacctctggcctgcaactcatcaatgtgacacagcatcccgcccgcattgcggaaacccccggccctaaaacgacaagcctgaagaccatcaactgcatcaatctgagagcctccgtgtttaaagagcaccgggaagtcgagattaacgttctcctgccgcagatcgctgtgaaccttagcaattgtcacgtggtcattaactctcatgtgtgcgattactccctggacaccgatgggcccgttcgcctccctagaatccaccatgagggaacattcattcccggcacctacaagatcgtgatcgaccggaaaaataagctgaacgatcgctgtagccttgtcacaaattgcgtgattaaagggagagaagttcggaagggacagtccgtgctgagacaatataagacggagatcaaaattggcaaggcctctaccgggagccgcaaactcctgtccgaggagcctggagacgactgtatctctcggacacagctgctcaagaccgaaacagctgagattcacgatgacaactacggcggccccggggataaaatcaccatctgcaatggaagcacgattgtcgaccagagactgggctccgagcttgggtgttataccatcaaccgcgtgaagtcttttaagctgtgcgaaaatagcacaaccggaaaaacatgcgagattgattccacccctgtcaagtgtcggcagggcttctgcctcaaaatcacacaagaagggagaggccatgtgaagctgagccgcggatctgaggttgtgctggacgcctgtgattccagctgcgagattatgatccccaaaggcaccggggacattcttgtcgattgttctggaggccagcagcacttcctcaaggacaacctgatcgatctggggtgcccgcacatccctcccctcggaaagatggccatttacatctgtcggatgtccaatcatcctagaacgacaatggcttttctgttctggtttagcttcggctatgtgattacctgcatcttttgtaaagcgcttttctactctctgattatcatcgggaccctcggcaagaaaattaagcagtatcgcgaactgaaaccccaaacatgcaccatctgtgagacggccccggttaacgctattgacgccgaaatgcacgacctgaattgctcctacaacatctgcccttactgtgccagccggcttacatccgatggactcgctagacatgtgacccagtgccccaagcgcaaggagaaagtcgaagagacagagctgtatctgaatctcgaacggattccttggatcgtgagaaagctgcttcaggtgagcgagtctaccggcgttgccctgaaacggagctcctggctcatcgtcctgctggtgcttctcacagtgtctctgagccccgtccagtccgcgcccgtggggcacggaaagaccattgaaacgtaccaaacccgcgagggctttacatctatctgtctgttcatgctcgggagcattctgtttatcgtttcctgccttgtgaaaggactggtcgactctgtgagcgattccttctttcctggcctcagcgtttgtaagacctgctctattgggtccatcaacggcttcgaaatcgagagccacaaatgttattgctctctgttttgttgcccgtactgtagacattgctccgctgaccgggagattcaccagctgcatcttagcatctgcaagaagagaaaaacaggatccaacgtgatgctcgccgtctgtaagcgcatgtgcttcaaagccaccattgaggcttctcggagagccctgctgatccgcagcattatcaatacgacattcgtgatgtgtattctcaccctggctatctgcgttgtgtccacaagcgccgtcgaaatggaagatcttcccgcgggcacctgggagagagaagaggacctgaccaacttttgtcaccaggagtgccaagtgacagaaacggagtgtctctgcccttatgaagccctggtgctgcggaagcccctttctctggattccatcgtcaaagggatgaagaatctcctgaacagcacctctctcgagacaagcctgtccattgaggctccttggggagccatcaatgttcagtctaccttcaagcccacagtgagcaccgctaacattgccctttcctggtctagcgtggaacatcgcggcaataaaatcctggtcacggggagatccgagagcattatgaagctcgaggaacggacaggagtgtcttgggacctgggcgttgaagatgcgtccgagagcaaactgcttaccgtgtccatcatggacctgtctcagatgtacagccctgtctttgagtatctctccggggatcgccaggtggaagagtggccgaaggccacctgtacaggcgactgccccgaaagatgtggatgcacctctagcacatgcctgcacaaagagtggcctcactcccggaactggcgctgtaatcccacgtggtgctggggcgttgggaccggatgtacatgctgtggcgtggatgtcaaggacctcttcaccgaccatatgtttatcaagtggaaagtggaatacattaagacagaggctatcgtttgcgtggagctgaccagccaagaaagacagtgttctcttattgaggccgggacgcggttcaacctgggacctgtcaccatcacactctccgaaccccgcaatattcagcagaaactgccgcctgagatcatcaccctgcaccccaagattgaagagggctttttcgatcttatgcatgtgcaaaaagtgctgagcgcttctacagtctgcaagctccagtcctgtacccacggcatccccggggacctgcagatttaccatatcggaaacctcctgaagggcgatagagttaatgggcaccttattcacaaaatcgagcctcattttaacacaagctggatgtcttgggacggatgcgatctggactattactgtaatatgggcgattggcccagctgcacgtataccggggtgacacagcacaaccatgccgccttcgtgaacctgctcaatattgaaaccgactacaccaagacatttcacttccactccaaacgggtcacggctcatggagatacccctcaactggaccttaaggcgagaccgacatatggcgccggcgagatcaccgtgctggttgaagtgacagatatggagctccacaccaaaaaggtcgagatctctgggctgaaatttgctagcctcacgtgcacaggatgttacgcctgctccagcggcatttcctgtaaggtgcgcatccatgttgacgaacccgatgagctgaccgtgcacgtcaagtctagcgaccctgacgtggtcgccgcttccacctctcttatggcccggaaactggaatttgggacagatagcaccttcaaggcgttttccgctatgcccaaaacatctctgtgcttctatattgtggagagagaatactgtaagagctgctccgaggacgataccaaaaagtgtgttgacacgaagctcgagcagcctcagagcatcctgattgaacataaaggaacaatcatcggcaagcaaaacgatacctgcacagccaaagcctcttgttggcttgagtccgtcaagagctttttctacgggctgaaaaatatgctcggatctgtgtttggctccttctttgtgggcattctcctgttcctggctccctttgttcttctggtgctgttctttatgttcgggtggaagatcctcttctgctttaagtgttgccgccggaccagaggactgttcaaatatcgccactttaaggacgatgaagagacgggctaccggagaattatcgaacgccttaacagcaaaaaggggaaaaatcggctgctcgacggagagagactggccgatcggaagattgcggaactcttctctaccaagacacacatcggctga

SEQ ID NO: 13597 - RNA, 5067 nt, synthetic construct
  misc_feature 1..5067: note = derived and/or modified CDS sequence (opt5) from CCHFV(K323_27)__KX013472.1__GP
  source 1..5067: mol_type = other RNA
atgcccatcaacattatgcacaccctgctcgtgtgcttcatcctgtaccttcagctgagcggcctcgggggagcccatggccaatccaatgctacagagcacaacgggacgaataccacaaccgtccctggaacatctcagagcccgaagccccctgcctccaccacactgccccatacccctgaatctagcacggttaaacttaccacacccacctccgagacagaaggctctggggagaccacgcctccgcccaacacaacccagggactgcctctccccggcacaacccctgaaagaagcgcgaccacagctacgtccaccagctctacagacaatatgaactccaccacacaggtgaccgataatacgcccacaagcaccgtgtctatttccccgtcctcttcccctagcatgccctccacctctcaaggcatccaccatcctgtccggagcctgctgtccgtgagctctcccaagacagttaccacacccacgcctatgtccccgggggagatgagccccgagacctctagccagcactccgccatgtctcgcattcctacactctataccgccacacaggtgagcaccgaaaacacggacagatccacaccccggcagagcgagtcttccgtccaacctgctacccagagccccatcacctctccggcccagacaatcctgcttatgtccgctgcccctaaagcgattcaggatatgcaccccagccctaccaatcgctccaagagaaacctggaagtggagatcattctcacgctgtctcaaggacttaaaaagtactatggcaagatcctgaaactcctgcatctgacactcgaggaagacaccgaggggctgcttgaatggtgtaagcggaatctgggaagcaactgcgatgacgactttttccagaaacgcattgaggaatttttcatcacaggcgaggggtactttaatgaggttctccagttcaagaccctgtccaccctttctcccacagaaagctcccacgtgagactgcctacggccgagccctttaaaagctatttcgctaagggatttctctctattgattccggctacttcagcgccaagtgttatccgcggtcttccaccagcggcctgcaactgatcaacgtcacacagcatcctgctcgcatcgccgaaacccccgggcccaaaacaacctctctcaagacgattaattgcatcaacctgagagcgagcgtgtttaaagagcaccgggaagtggagattaacgtccttctgcctcagatcgccgttaatctctccaactgtcacgtggtgattagctctcatgtctgcgattactccctggacacagatggaccggtgcgccttcccagaatccaccatgagggcaccttcatccctgggacctacaagattgttatcgaccggaaagataagctgaatgaccgctgtagcctcgtgacaaactgcgtcattaaaggaagagaagtgcggaagggccagtccgttctgagacaatataagaccgagatcaaaattgggaaggcttctacaggaagccgcaaactgctctccgaggagcccggcgacgattgtatctctcggacgcagctgcttaagaccgaaacagccgagatccacgacgataattacggcgggcctggagacaaaattaccatctgcaacggcagcacaattgtggatcagagactggggtccgagctcggatgttataccatcaatcgcgtcaagtcttttaagctgtgcgaaaacagcgctacgggcaaaacctgcgagattgactccacacccgtgaagtgtcggcaggggttctgcctgaaaatcacccaagaaggcagaggacatgtcaagctgagccgcggctctgaggtggttctcgatgcctgtgactccagctgcgagattatgatccctaaagggacaggagatatcctggtggactgttctggcgggcagcagcacttcctgaaggataatctcattgacctgggatgcccccacatcccgcttctgggcaagatggccatttacatctgtcggatgtccaaccatcctagaaccacaatggcttttctcttctggtttagcttcgggtatgtcattacctgcatcttttgtaaagcgctgttctacctgcttatcattatcggcacgctcggaaagaaaattaagcagtatcgcgaactgaaaccccaaacatgcaccatctgtgagaccgcccctgtgaatgctattgacgccgaaatgcacgatctgaactgctcttacaatatctgcccctactgtgcctcccggctcacaagcgacggcctggctagacatgttacccagtgcccgaagcgcaaggagaaagtggaagagacggagctttatctgaacctcgaacggatcccttggattgtcagaaagctgcttcaggtgtccgagagcacaggggtggcccttaaacggtctagctggctcaccgttctgctggtcctcctgacagtgtccctttctcccgtgcagagcgcgcctgtcggacacggcaataccatcgaaacataccaaacccgcgaggggtttacgtccatttgtctgttcatgctcggatctatcctgtttattgtgagctgcctggttaagggccttgtggattccgtctctgacagcttctttcccgggctctccgtgtgtaaaacctgcagcatcggctctatcaacggattcgaaattgagtcccacaagtgttattgcagcctgttttgttgcccccattgtagacaccggtctgctgatagagagatccatcagctgcacctctccatttgcaaaaagcgcaagacaggcagcaacgttatgctggccgtgtgcaaacggatgtgtcctaaggccaccatcgaagctagcagacgcgcccttccgattagatctatcattaatacaaccctggtcatgtgcatcctcacgctggctatctgtgtggttagcacatccgccgtggagatggaagacctgcccgcggggacctgggagcgggaagaggatcttacaaacttctgccatcaggagtgtcaagtcaccgaaaccgagtgcctgtgtccttacgaagccctcgtgctgcgcaaacccctcttcctggacagcattgctaagggaatgaaaaatcttctgaactctacatccctcgagacgagcctgtctatcgaggccccttggggcgctattaatgtgcagagcacctttaagcccacagtctccaccgccaacatcgcgctgtcttggagctccgttgaacacagagggaataagattcttgtgacaggacggtctgagagcatcatgaaactggaggaacgcaccggcgtgtcctgggatctcggggtcgaagacgccagcgagtctaagctgctcacggtgtccatcatggatctgagccagatgtattcccctgttttcgagtacctttctggcgacagacaggtggaagagtggccgaaagctacatgcaccggagattgtcccgaacggtgcggctgtaccagctccacatgcctgcacaaggagtggcctcattctcgcaactggagatgcaatcccacctggtgttggggagtcggaacaggctgcacgtgttgcggggtggacgttaaagacctctttaccgatcacatgttcattaagtggaaggtggaatatatcaaaacagaggccattgtctgtgtggagctgaccggacaagaacggcagtgcagcctgatcgaggctggcacacgctttaaccttggccctgttaccattacgctgtccgaacccagaaatatccagcagaagctcccgcctgagatcattaccctgcatcccaaaatcgaagaggggttctttgacctcatgcacgtgcaaaaggtcctgagcgcctctacagtgtgtaaacttcagtcctgcacccatgggattcccggcgatctgcagatctaccacattgggaacctgctcaagggagaccgggtgaatggccacctgatccataagattgagcctcacttcaacacaagctggatgtcttgggatgggtgtgaccttgattactattgcaatatgggagactggccctcctgtacctacacaggcgtcacgcagcataaccacgccgcttttgttaacctgctcaatatcgaaaccgattatacaaaaaccttccactttcatagcaagagagtgaccgcgcacggcgacacacctcaactggatctcaaagcccgcccgacgtacggggctggagagatcaccgtgctggtcgaagtggccgacatggagcttcatacaaagaaagttgagatttctggcctgaagttcgccagcctgacctgcacagggtgctatgcttgttcctctggaatcagctgcaaagtgcggattcacgtcgatgaacccgacgagctcaccgtgcatgttaagtccagcgaccctgatgtggtcgccgcgtccacgtctctgatggctagaaaacttgaatttggcacagacagcaccttcaaggccttctccgccatgcccaagacctctctgtgtttttacatcgtggagcgcgaatattgcaaaagctgttccgaggatgacacaaagaaatgcgtcgataccaagctcgagcagcctcagtctattctgatcgaacacaaggggacaatcattggaaaacaaaacgacacctgtacggctaaggccagctgctggctcgagtccgtgaaatctttcttttacggcctgaagaatatgcttggcagcgttttcgggtcctttttcgtgggaatcctgctgtttctcgcgcccttcgtcctgcttgtgctgtttttcatgtttggctggaaaattctcttctgtttcaagtgctgtcggagaacacgcgggctgtttaagtaccggcacctcaacgatgacgaagagaccggatatagacgcatcattgaacggctgaatagcaaaaagggcaaaaacagacttctggatggggagcggctggctgaccgcaagatcgccgaactcttctctacaaaaacccatatcggatga

SEQ ID NO: 13598 - RNA, 5067 nt, synthetic construct
  misc_feature 1..5067: note = derived and/or modified CDS sequence (opt5) from CCHFV(K315_14)__KX013469.1__GP
  source 1..5067: mol_type = other RNA
atgcccttcaacatcatgcacaccctgctcgtgtgctttattctgtaccttcagctgagcggcctcgggggagcccatggccaatccaatgagacagaacacaacgggacgaataccacaaccgtccctggaacatctcagagcccgaagccccctgcttccaccacactgcagcatacccccgagtctagcacggttaaacttaccacacctacctccgaaacagagggctctggggaaaccacgccccctccgaacacaacccagggactgccccctcccggcacaacccctgagagaagcgccaccacagcgacgtccaccagctctacagacaatatgaactccaccacacaagtgaccgataatacgcccacaagcaccgtgtctatctccccgagcagctcccctagcatgccctccacctctcagggcattcactatcctatccggagcctcctgtccgtcagctctcccaagacagtgaccacacccacgcctatttccccgggggagatgagccccgaaacctctagccagcattccgctatgtctcgcatccctacactgtacaccgccacacaggttagcaccgagaacacgaatagatccacaccccggcaaagcgaatcttccgtgcagcctgccacccagagccccatcacctctccggctcagacaattctcctgatgtccgccgctcctaaagccatccaagacatgcaccccagccctaccaaccgctccaagagaaatcttgaggtcgagattatcctgacgctctctcagggactgaaaaagtattacggcaagattcttaaactgctccacctgacactggaagaggataccgaagggctcctggagtggtgtaagcggaaccttggaagcaattgcgacgatgacttctttcagaaacgcatcgaagagttctttattacaggcgaggggtatttcaacgaagtgctgcaatttaagaccctctccaccctgtctcccacagagcctagccatgttagacttcccacggcggaaccgttcaaatcctactttgccaagggattcctgagcatcgattctggctatttttccgctaagtgttaccctcggagctctacctccggcctccagctgatcaatgtgacacagcaccccgcccgcattgctgagacccccgggcctaaaacaaccagcctgaagacgatcaactgcattaacctcagagcctctgtcttcaaagaacatcgggaggtggagatcaatgtgctgcttccgcagattgcggtcaacctgagcaattgtcacgttgtgatcaactcccacgtgtgcgactacagcctcgatacagacggacccgtccgcctgcctagaatccatcacgaaggcacctttattcccgggacctataagatcgtgattgataaaaagaataaacttaacgaccggtgttctctggttacaaattgcgtgatcaagggacgcgaggtcagaaagggccaatccgtgctccggcagtacaaaaccgaaattagaatcgggaaggccagcacaggatcccgcaaactgctgtctgaggaacctggcgatgactgtatcagccggacgcagctcctgaagaccgagacagctgagattcatgacgataactatggcgggcccggagacaaaatcaccatttgcaatggctccacagttgtggatcagagacttgggtctgaactgggatgttacaccatcaaccgcgtcaagagcttcaagctctgcaaaaattccgccacgggcaagacctgcgagattgactctacacctgtgaaatgtcggcaagggttctgcctgaagatcacccaggaaggcagaggacacgtcaaactgagccgcggctccgaggtggttcttgatgtgtgtgacagctcttgcgagattatgatccccaaggggacaggagatatcctcgtcgactgttccggcgggcagcagcattttctgaaggataacctgattgacctcggatgcccgcacatccctctgcttggcaaaatggctatttatatctgtcggatgagcaatcaccccagaaccacaatggccttcctgttttggttctcttttgggtacgtgattacctgcatcttctgtaaggccctcttttattccctgatcattatcggcacgctggggaaaaagattaaacaataccgcgaacttaagcctcagacatgcaccatctgtgagaccgctcccgttaacgcgattgatgccgaaatgcatgacctcaattgcagctacaacatctgcccgtattgtgcttctcggctgacatccgagggcctggccagacacgtgacccagtgccctaagcgcaaagaaaaggtcgaggagacggaactctacctgaaccttgagcggatcccctggattgtgagaaaactgctccaggtgagcgaatccacaggggttgccctgaagcggagctcttggctgatcgtccttctcgtgctgctgaccgtgagcctctcccctgtccaatctgctcccgtgggacatggcaaaacaattgagacctatcagacacgcgaagggttcaccagcatctgtctgtttatgcttggatccattctgttcatcgtttcttgcctcgtgaagggcctggtctacagcgtgtccgacagctttttccccgggctgtctgtttgtaaaacgtgctccatcggcagcattaatggatttgagatcgagtctcacaagtgttattgctcccttttctgttgcccttactgtagacactgcagcgccgatcgggaaattcatcagctccacctgtctatctgcaagaaaagaaagaccggctccaacgtgatgctggcggtctgtaaacgcatgtgcttcaaggctacaattgaggccagccggagagccctcctgatccgctccattatcaataccacatttgtgatctgtattcttaccctggctatctgcgttgtgtctacgagcgccgtcgaaatggaggacctcccggctgggacatgggaaagagaggaggatctgaccaacttctgtcatcaagaatgccaggtgacagagaccgaatgtctgtgcccctatgaggcccttgtgctgcggaaacctctctttctggactccattgtcaagggaatgaagaaactcctgaatagcacctctcttgagacatccctgagcatcgaagcgccctggggcgccattaacgttcagtctacgttcaagcctaccgtgagcacagctaatatcgccctctcctggtctagcgtggagcaccgcgggaacaaaatcctggtcaccggaagatccgaatctattatgaagctggaggaacggacaggcgtgagctgggatcttggggttgaggacgcttccgagagcaaactgctcaccgtgtctatcatggatctgtcccagatgtacagccccgtctttgaatacctctccggcgaccgccaagtggaggaatggcctaaggccacgtgtacaggagattgcccggagagatgtggctgcacctcttctacctgcctgcataaggaatggccccactcccggaattggcgctgtaaccctacatggtgctggggagttggaaccggctgtacatgctgtggggtggacgtcaaagatcttttcacggaccacatgtttattaagtggaaagtggagtatatcaagaccgaggcgattgtttgcgtggaactgacatctcaggagagacagtgtagcctcatcgaagccggaacccggttcaatctgggccccgtcacaatcaccctgtccgagcctcgcaacattcagcaaaaacttcccccggaaatcattacgctgcatcctaagatcgaggagggctttttcgatctcatgcacgtgcagaaggtgctgagcgcttctaccgtctgcaaactccagtcctgtacacatgggattcccggagacctgcagatctaccacattggcaatcttctgaagggggacagagttaacggacatctgatccacaaaatcgaaccccactttaataccagctggatgtcttgggatggctgcgacctcgattattactgtaacatgggggactggccttcctgcacatataccggagtgacacaacataaccacgccgctttcgtgaatctgcttaacattgagacggattacaccaagacatttcatttccacagcaaacgggtcaccgcccacggcgacacaccccagctggatctcaaggccagacctacctatggcgctggggaaatcacggtgctggttgaggtggcggacatggagctccataccaaaaaggtcgaaatttctggactgaagttcgccagccttacatgcaccggctgttacgcttgctcctctgggatcagctgtaaagtgcgcattcacgttgatgagccggacgaactgacagtgcatgtcaagtccagcgatcccgacgtggtcgccgcctccacctctctgatggctcggaaactcgagtttggaacggatagcacattcaaggccttttccgcgatgcctaaaacctctctgtgcttctacatcgtggaaagagagtattgtaagagctgctccgaggacgacaccaagaaatgtgttgatacaaaacttgaacagccccaatctatcctgattgagcacaagggcaccatcattgggaagcagaatgacacatgcaccgctaaagccagctgttggctcgaatccgtcaagagctttttctacggactgaagaacatgctcggctctgtgtttggctccttctttgtggggatcctgcttttcctggccccttttgttctgctcgtgctgttcttcatgtttggatggaaaattcttttctgctttaagtgttgccgccggacgagaggcctgttcaaatatcgccatctcaaggatgacgaggaaacagggtaccggagaatcatcgagcgcctgaatagcaaaaagggaaagaaccggctcctggatggcgagagacttgctgaccggaaaattgccgaactgttttctaccaagacacacatcgggtga

SEQ ID NO: 13599 - RNA, 5067 nt, synthetic construct
  misc_feature 1..5067: note = derived and/or modified CDS sequence (opt5) from CCHFV(K229_243)__KX013466.1__GP
  source 1..5067: mol_type = other RNA
atgcccaccaacatcatgcacacactgctcgtgtgcttcattctgtaccttcagctgctcggccttgggggagcccaaggccagagcaatgctacggagcataacgaaaccaatacaaccacagccccttccacctctcagagcccgaagccccctgtctccacaacaccccctcacgcgcttgagtctagcacgatcaaacccaccacccctgctagagaaaccgaggggtccggagaaacaaccccgccccctaacacgacacagggcccctctcctcccgaggccaccccggagcggcctgccacaaccgctaccagcacaccctccacggacaataccaacagcacaacccatgttacagataataaccctacctctacgatttccacaagcccctcttccagcccctctaccccttttaccccgcaagggatccaccatcccgcccgcaatctgctctccgtgagctcccctaagacagctaccacacccacgcctacctctcccagagaactgagctccgagacaagctctctgcactccgccattagccggacctctacactctataccgcgacccaggtgagcacggaaaacgccaatcactccgctccgcgccagtctgagagctccgcccagcctacaaccacaagccccatgacctctcctgctcaatccatcctggtcatgagcgccgcgcccacggccatccagaacattcatccttctcccacaaatagatccaaacggaaccttgagatggaaatcattctgaccctcagccagggactgaagaaatactatggcaagatccttaagctgctccacctgacactggaggaagacaccgagggcctcctggaatggtgtaaacgcaatcttgggtccaactgcgatgacgatttctttcagaagagaattgaggagttctttatgaccggagaaggctacttcaacgaggtgctgcaatttaaaacactctctacgctgagcccgaccgaaccttcccatgctcggcctcccgccgttgagcccttcaagtcttattttgctaaagggttccttagcatcgactccggatactttagcgccaagtgttatccgagatcttccacaagcggcctgcagctcattaatgtgacccagcaccccgcccgcatcgctgaaacacctgggcccaagaccacgtctctgaaaacaatcaactgcattaatctgcgggcgtccgtcttcaaggagcaccgcgagatcgaaattaacgtgctcctgcctcaaatcgccgttaatcttagcaactgtcatgtggtcattaattctcacgtgtgcgattacagcctggacaccgatggacccgtgagactccctcatatctaccacgagggcacctttatccccggcacatataaaattgtcatcgacaagaaaaacaagctgaatgatcggtgtacccttgttacaaactgcgtgattaaagggcgcgaagtgagaaagggacagtccgtcctgcggcagtacaagacggagatcaaaattggcaaggctagcaccgggtctagaaaactcctgtccgaggaaccgggagacgattgtatcagccgcacacagctgctccggaccgagacagccgaaatccatgacgacaattatggcgggcctggagataagattaccatctgcaacggctccacgattgtggaccaaagactgggctctgagcttgggtgttacaccatcaatcgcgttaaatctttcaagctgtgcgaaaactccgccacaggaaagacctgcgagattgattctacacccgtgaaatgtcggcagggcttctgcctcaagatcacccaggaggggagaggacacgtcaaactgagccgcggctccgaagtggttctggacgcttgtgattctagctgcgaggtgatgattcctaaggggacaggcgacatccttgtcgattgttccggaggccagcaacactttctcaaagacaatctgatcgatctggggtgcccccatattccgctcctgggaaagatggccatctatatttgtcggatgagcaaccaccctagaaccacgatggcgttcctgttttggttctcttttggctacgtgatcacatgcattttctgtaaggctctgttttattccctcatcatcattgggaccctggggaaaaagatcaaacagtaccgcgaactgaagccccagacctgcacaatttgtgagaccgcccctgtcaacgccatcgacgctgaaatgcatgatcttaattgcagctacaacatttgcccctattgtgcctctcggctcacgtccgacggcctggctagacacgtgccccagtgccctaaacgcaaggagaaggttgaggaaacagagctgtacctcaatctggaacggatcccgtggatcgtgagaaaacttctgcaagtcagcgagtctaccggggtggccctcaagcggtccagctggctgattgttctgcttgtgctcctgacagtctccctgagccccgtgcagtctgcgcctgtgggccacggaaaaaccatcgaaacatatcagacccgcgagggcttcacgagcatttgtctctttatgctggggtccatccttttcctggtttcttgcctcgtcaagggactggtggacagcgtgtccgatagctttttccccggcctgagcgtctgtaaaacctgctccattgggtctatcaacggatttgagatcgaaagccataagtgttactgctcccttttctgttgcccttattgtagacactgcagcgccgaccgggagattcatcagctccacctgtctatctgcaaaaagagaaagacaggctccaatgtgatgctggctgtttgtaaacgcatgtgcttccgggccaccattgaagctagcagacgcgccctcctgatcagatctattatcaacacaacctttgtgatttgtatccttacgctgacaatctgcgtcgtgtccaccagcgcggttgagatggaaaatctccccgccgggacatgggagcgggaggaagatctgaccaacttctgtcatcaagagtgccaggtgaccgaaacagagtgtctgtgcccttacgaggctcttgtcctgcgcaagccgctctttctggactccattgtgaaaggcatgaagaatctcctgaactctacgagccttgaaacctccctgagcatcgaggccccctggggagctattaatgttcagtctacattcaaacctaccgtgtccacagccaacatcgccctcagctggtctagcgtcgaacacagaggcaataagattctggtgaccgggcggtccgagtctatcatgaagctggaggaacgcacgggagtgagctgggatcttggcgtcgaggacgcttccgaatctaaactgctcacagttagcatcatggatctgtcccaaatgtatagccccgtgtttgagtacctctctggggacagacaggtggaagagtggcctaaggcgacctgtaccggagattgccccgaacggtgtggctgcacatcctctacctgcctgcacaaagagtggccgcattcccgcaactggagatgtaatcctacatggtgctggggagtcggcacgggatgtacctgctgtggcgtggacgttaaggatcttttcacagaccacatgtttgtgaaatggaaggtcgagtacattaagaccgaagccatcgtgtgcgttgagctgacatctcaggaacggcagtgtagcctcattgaggctgggacccgcttcaacctgggacccgtgacgatcaccctgtccgaacccagaaacattcaacagaaacttcctcccgagatcatcacactgcatcctaaggtcgaggaaggctttttcgatctcatgcacgtgcagaaagttctgtctgccagcaccgtgtgcaagctccagtcctgtacacatgggattccgggagacctgcaagtctatcacatcggcaatcttctgaaaggcgaccgggtgaacgggcacctgattcataagatcgagccccactttaataccagctggatgtcttgggatggatgcgacctcgattactattgtaacatgggcgactggccttcctgcacatacacgggggtgacccagcataatcacgccgctttcgtcaacctgcttaatattgaaacagattataccaagacctttcacttccatagcaaaagagttacagcccacggagacacgccccagctggatctcaaggcgcgccctacctacggcgctggggagatcacagtgctggtggaggtcgccgacatggaactccataccaaaaaggtggagatttctggactgaaattcgcctcccttgcttgcacaggctgttatgcctgcagctctggcatcagctgtaaggttcggatccacgtggatgaacccgacgagctgaccgtccatgtgaaatcctctgatccggacgttgtggcggctagcacgtccctgatggccagaaagctcgaatttgggacagatagcaccttcaaggccttttccgctatgcctaaaacctctctgtgcttctacattgtcgagaaggagtactgtaaaagctgctccgaagaggacacacagaagtgtgtggacaccaaacttgaacaaccccagtctatcctgattgagcacaagggaacaatcattggcaagcagaacgatacctgcacggccaaagctagctgttggctcgaatccgtcaagagctttttctatgggctgaaaaatatgctcggaagcgtgtttggcaacttctttatcgggatcctgcttttcctgacaccttttgttctgctcgtgctgttcttcatgtttggatggaagattcttttctgctttaaatgttgccgccggaccagaggcctgctcaagtaccgccacctgaaggacgatgaggagacaggctatcggagaatcattgaacgcctcaataacaaaaaggggaaaaatcggctgcttgacggagagagactggccgatcggaagatcgcggaactgttctccaccaaaacgcatattggctga

SEQ ID NO: 13600 - RNA, 5067 nt, synthetic construct
  misc_feature 1..5067: note = derived and/or modified CDS sequence (opt5) from CCHFV(K229_194)__KX013463.1__GP
  source 1..5067: mol_type = other RNA
atgcccatcaacattatgcacaccctgctcgtgtgcttcatcctgtaccttcagctgagcggcctcgggggagcccatggccaatccaatgctacagagcacaacgggacgaataccacaaccgtccctggaacatctcagagcccgaagccccctgcctccaccacactgccccatacccctgaatctagcacggttaaacttaccacacccacctccgagacagaaggctctggggagaccacgcctccgcccaacacaacccagggactgcctccccctggcacaacccccgaaagaccggcgaccacagctacgagcacctccagcacagacaatatgaactctaccacacaggtgaccgataatacgcctatttccacagtgagcatctctccctccagctctccttccatgcccagcacctcccaaggcattcactatcccgtccggtctctcctgagcgtgtccagccctaagaccgttacaaccccgacacccatgtctcctggggagatgtcccccgagacgagctctcagcatagcgccatgtcccgcatccctaccctgtacacagccacccaggtgtctacagaaaacaccaatagaagcacgccccggcagtccgagagctctgctcaaccggccacccagtcccctacaaccagccccacacagaccatcctcctgatgtctgctgcccctaaagcgattcaggacatgcacccctcccctacgaaccgcagcaagagaaatcttgaagtcgagatcattctgacactctcccaaggactgaaaaagtattacggcaagatccttaaactgctccacctgaccctggaggaagatacagaggggctcctggaatggtgtaagcggaaccttggatctaattgcgacgatgactttttccagaaacgcattgaggaatttttcatcaccggcgaggggtattttaacgaggtgctgcagttcaagaccctcaatacactgagccccacggaaccgtcccatgttagacttcctaccgccgagccctttaaatcttacttcgctaagggatttctgagcgtggattccggctatttcagcgccaagtgttacccccggtcttccacaagcggcctccaactgattaacgtcacccagcaccctgctcgcatcgccgaaacaccggggcccaaaaccacgtctctgaagacaatcaactgcattaatctcagagcgtccgtgtttaaagagcatcgggaagtggagatcaacgtcctgcttcctcagattgccgttaatctgagcaactgtcacgtggtgatcaattctcacgtctgcgactacagcctcgataccgacggacccgtgcgcctgcctcggattcatcacgagggcaccttcatccccgggacatataagatcgttattgataaaaagaacaaacttaatgacagatgttccctggtgaccaactgcgtcatcaagggacgcgaagtgagaaagggccagagcgttctccggcaatacaaaacagagattaagatcgggaaagctagcacgggatccagaaagctgctgagcgaggaacctggcgatgactgtatttcccgcacccagctcctgaaaacagaaaccgccgagatccatgacgataattatggcgggcccggagacaagatcacaatttgcaacggctctaccatcgtggatcagcggcttgggagcgagctgggatgttacacgattaatagagtcaagtcctttaaactctgcgaaaactctgctaccggcaagacatgcgagatcgacagcaccccggtgaaatgtcgccaggggttctgcctgaagattacacaagaaggccggggacacgtcaaactgtccagaggctctgaggtggttcttgatgcctgtgacagctcctgcgagatcatgattcctaaggggaccggagatatcctcgtggactgtagcggcgggcagcagcatttcctgaagggaaatctgatcgatctcggctgcccccacattcctctgcttgggaaaatggccatctatatttgtcgcatgtctaaccacccccggacaaccatggcttttctgttctggttttccttcggctacgtcatcacgtgcatcttttgtaaggctctcttctatagcctgattatcattggaacactgggcaaaaagatcaaacagtacagagaacttaagccgcaaacctgcaccatttgtgagacagcccctgtgaatgctatcgacgccgaaatgcatgatctcaactgctcttacaacatttgcccctattgtgcctcccgcctgaccagcgacgggctggctcggcacgttacgcagtgccctaagagaaaagagaaggtggaagagacagagctctacctgaatcttgaacgcatcccctggatcgtccggaaactgctccaggtgtctgagtccaccggagtggccctgaagagaagctcctggctgattgttcttctcgtcctgctgacagtgagcctctctcccgtgcagagcgcgcctgtcggccatgggaaaaccatcgaaacatatcaaacccgggagggatttacgaacatttgtctgttcatgcttggctccatcctgtttattgtgtcttgcctcgttaaggggctggtggacagcgtctccgattctttctttccgggcctgagcgtgtgtaaaacctgctccatcggatctatcaatggcttcgaaattgagagccacaagtgttactgctccctcttttgttgcccctattgtcgccactgcagcgctgacagagagatccatcagcttcacctggggatttgcaagaaacggaagacaggatctaacgttatgctggccgtgtgtaaaagaatgtgcttcaaggccaccatcgaggcttcccgccgggccctcctgattagaagcatcattaatacaaccttcgtcatctgtatccttacgctggctatttgcgtggtttctacatccgccgtggaaatggaaaacctccctgcgggcacctgggagcgcgaagaggatctgacatctttttgtcatcaggagtgccaagtcaccgaaaccgagtgtctgtgcccctacgaagcccttgtgctgagaaaacctctcttcctggactccatcgtgaaggggaagaaaaatctcctgaactctacaagccttgagacgtccctgagcattgaggctccctggggagccatcaatgtccagtctacctttaagcctacagtttccaccgctaacattgccctcagctggtctagcgtggaacaccggggcaataaaatcctggtgacagggcgctccgagtctatcatgaagctggaagagagaaccggcgtcagctgggatcttggagtggaagacgcgtccgagtctaaactgctcacggttagcattatggatctgtcccagatgtatagcccggtgttcgagtacctctctggcgaccggcaggtcgaagagtggcccaaggccacatgtaccggggattgccctgaacgctgtggatgcacctccagcacatgcctgcataaggagtggccccactccagaaactggcggtgtaatcctacctggtgctggggcgtggggacaggatgtacgtgctgtggcgttgacgtgaaagatctttttaccgaccacatgttcatcaagtggaaagtcgaatacattaagacagaggctatcgtgtgcgttgagctgacctctcaagaacgccagtgtagcctcattgaggccggcacaagatttaacctggggcccgtgaccatcacgctgtccgaaccgcggaatatccagcagaaacttcctcccgagattatcaccctgcatcccaagattgaagagggattctttgatctcatgcacgtccaaaaggtgctgtctgctagcacagtgtgcaaactccagtcctgtacccatggcatccctggggacctgcagatttatcacatcggaaaccttctgaagggcgaccgcctgaacgggcatctcattcacaaaatcgagccccacttcaatacaagctggatgtcttgggatggatgcgacctggattactattgtaacatgggcgactggccttcctgcacctacacaggcgtcacgcagcataatcacgccgcctttgttaaccttctgaatatcgaaaccgattatacaaagaccttccattttcacagcaaaagagtgaccgctcacggggacacaccgcaactcgatctgaaggcgcggcccacgtacggagccggcgagattaccgtgctcgtcgaagtggctgacatggagctgcataccaaaaaggttgagatctctgggcttaagttcgcctccctggcctgcacaggatgttatagctgctctagcggcatttcctgtaaagtgagaatccacgtcgatgaacctgacgagctgacagtgcatgttaagtctagcgatcccgacgtggtcgctgcctccaccagcctcatggcgcgcaaactggagttcgggacggattccacatttaaggctttctctgccatgcctaaaaccagcctttgcttttacattgtggaacgggaatactgtaagtcctgctctgaggacgacaccaagaaatgtgtcgatacaaagctggagcagccccagagcatcctcatcgaacacaaaggaaccattatcggcaagcaaaacgacacatgcaccgccaaagcgtcctgttggctggagtctgttaagagcttcttttatggcctcaagaatatgctggggtccgtgttcggaaactttttcgtgggcattcttctgtttctggccccgttcgtcctcctggtgcttttctttatgttcgggtggaaaatcctgttttgcttcaagtgttgcagacgcacgcggggactctttaaatacagacatctgaaggatgacgaagagacaggctatcgcaaaattatcgaacggctcaatagcaagaaggggaaaaacagactgcttgatggagagcgcctggcggaccggaagatcgctgagctgttctctaccaaaacacacattggctga

SEQ ID NO: 13601 - RNA, 5067 nt, synthetic construct
  misc_feature 1..5067: note = derived and/or modified CDS sequence (opt5) from CCHFV(Gaib)__KX013445.1__GP
  source 1..5067: mol_type = other RNA
atgcccgtgagcatcatgtacattcctctggtctatgccgttatctacctccagctgtatggccttgggggagctcacggcctgctcaacaagaccgagcaaaatgaaacagggattacggccacccatggaagagtgcagggcccgccctccgcgtctatcacactgcctgtgacccccgaccctcttagcgctacatccgccgcctctaccagcgggcccgagggatccggcgaagtccctacatctccgagcaccattacgcagggcctgacctccagcgagaacacaccccagctccctaccgctacagataccgggatctcttccacgagcatcattgacgtgtctacacaaaccgccggagatacatccacccccaccgctcacacaagcctgcctaattctccctccgccccgttcacgagccaggacacccggcatacagttcgcggcctgctcaccgtgacatccaccaaatctgatgaagcgagcacgctgacagaccctaaggaggcctccaccgaggctagaagcccctctccttccatcagccggacccccacaccctctcctaccgtccaggccagcacagaaaacaatacgccgtccacccccagacagcctgagcccacaaccagacctgcccttccctctccgacaaccagccctacgcaaccctccctgagccagtctgctacctccgcggccattcaggatatgcaccctagccccacaaaccggtctcgcagaaatctcgaaatggagatcattctgaccctttcccaggggctgaaaaagtactatggaaaaatcctcaagctgctggacctcacactggaggaagataccgagggccttctggaatggtgcaagcggaacctcgacctgacgtgtgatgagaactttttccttaaacgcattgaagagtttttcctgagcggggagggacattttaatgaagtgctccaattcaaggctccttccacaatgtctagcaccgagcccacacacgccggcccgcctaccgttgaaccctttaaatcctacttcgctaagggctttctgtctatcgacagcgggtatttctccgccaaatgctaccccagaaccagcaattctggactgcagctcatcaacgtgacacagcacacggcccggattgctgatacccctggcccgaagatcacaaatgtcaagaccattaactgtatcaatctgaaagcgtccgtgtttaagaaacatcgcgaggtggaaattaacgtccttctgccccaaatcgccgttaacctcagcaattgccacgtgctgatcaagtctcatgtgtgtgactactcccttaacttcgacgggatggtcagactgcctcggattcaccacgagggaacatttatccccggcacctataaaattgtgatcgatcgcaagaataaacagaacgacagatgcacgctcgttacaaattgtgtgattaaggggcgggaggtcagaaagggacagagcgctctgcgccagtaccggaccgaaatcaaaatcggcgaggcctctattggcagcagacgcctgctctccgaagagagctctgatgactgcatctcccggacccaactgcttagaacagaaaccgccgagattcataacgataattatgggggacctggcgacaagatcacaatttgtaacgggagcacgatcgtggatcagcgcctgggatccgagctcggctgctacaccattaatcgggttaaatctttcaagctgtgtgaaaacagcgctacagggaaatcctgcgagatcgactctatccccgtgaagtgcagacagggcttctgtctgaagattacccaggaaggacgcggccacgtcaaacttagccgggggtccgaggtggtcctcgatgcctgcgactctagctgtgagatcatgattcctaagggaacaggcgatatcctggtggactgctccgggggacaacagcattttctgaaagacaatctcattgatctgggctgtcccaacatcccgcttctggggaagatggcgatctatatttgcagaatgagcaatcaccctaaaaccacgatggctttcctcttttggttctcttttggctacgttatcacctgtattttctgcaaggccatcttttatctgctgattatcgtgggaacacttggcaagaaattcaagcagtaccgcgaactcaaaccccagacctgtacaatctgcgagaccacacctgtcaacgccattgacgctgaaatgcatgatctgaattgttcctacaacatctgcccctattgcgccagccggctgacctctgacgggctcgctagacacgtggttcactgtccgaagcggaaagagaagattgaagagacggagctgtaccttaacctggaacgcgtgccttgggtcgtgagaaagctcctgcaagtgtccgagagcacaggagttgccctgaaacggtcttcctggcttatcgtcctcctggtgctgctcaccgtgagcctgtcccccgtccagagcgcgcctattggccatgggaagaccatcgaaacatatcagaccagagagggatacacgtctatctgcctttttgtgctgggcgggattctcttcatcgttagctgtctgatgaaaggcctggtggattccgtcggaaataactttttccccggccttacaatttgcaagacctgttctatcagctccattaatgggtttgaaatcgagtctcacaaatgctattgtagcctcctgtgctgtccctactgccgccattgttccgccgaccgggagattcaccagctgcacctctctatctgcaagaaaagaaagacaggaagcaacgtgatgctggctgtttgcaagcgcatgtgtcttagagtgaccacagaagtctccaatcgggccctgttcatccgcagcattatcaacaccacgttcgtgatttgcatcctcattctggctgtttgtgtgatctctacctccgccgtcgagatggaaaatctgcctgcgggcacatgggagagagaagaggatcttaccaacttttgccatcaagagtgtcaggtgacagaaaccgagtgcctgtgtccgtatgaagccctcgtgctgcggaaacccctcttcagcgactctatcgtcaaggggatgaaaaatctgcttaactccacgagcctggagacatccctctctattgaggctccttggggagccatcaatgttcagagcacctttaagcccacagtgtccaccgctaacattgccctgagctggtcttccatcgaacaccgcggcaataaaattctggtgagcgggagatctgagagcatcatgaaacttgaggaacggaccggcatctcctgggatctgggagtcgaagacgcctctgagagccgcctcctgacagtgtccgttatggatctctctcaaatgtacagccctgtgttcgagtacctgtccggcgacagacaggtcgaagagtggcccaaggctacgtgcaccggggattgtcctgaacggtgcggatgtacaagctctacctgccttcataaagagtggccgcactcccgcaactggagatgcaatcccacatggtgttggggcgtggggaccggatgcacgtgttgcggcctggacgttaaggacctctttacagattatatgttcgtgaaatggaaggtcgaatacattaaaaccgaggcgatcgtgtgtgttgagctgaccagccaggaacggcagtgctccctgattgaggccggcacaagatttaaccttgggcctgtgaccatcacactgtctgaaccccgcaacattcaacagaagctccctcccgagatcattacgctgcatccgcggatcgaagagggattctttgacctcatgcacgtccagaaggtgctgagcgcttccaccgtgtgtaaacttcagtcttgcacacacggcgtccctggggatctgcaagtttatcatatcggaaatctgctcaagggcgacaaagtgaacgggcacctgattcataagatcgagccccacttcaataccagctggatgtcctgggatggatgtgaccttgattactattgcaacatgggcgactggcccagctgtacatacaccggcgtgacgcagcataatcacgccgcctttgtcaacctgctcaatattgaaaccgattatacaaagaacttccactttcattctaagagagtgaccgctcacggggacacacctcagctggatctcaaggcccgccccacctacggagcgggcgagatcacagttctggtggaagtcgctgacatggagcttcatacgaaaaagattgagatctccgggctgaaattcgccagcctgacctgcacaggatgctacgcctgttcttccggcatcagctgcaaggtgcggattcacgttgatgaacctgacgagctcaccgtgcacgtcaaatctgaagacccggatatcgtggctgccagctcctctctgatggcgagaaaacttgagttcgggaccgacagcacatttaaggctttctccgccatgcccaagacgagcctgtgtttttatattgtcgaacgcgagtactgcaagtcctgttctcgggaggatacccagaaatgcgtgagcacaaagctcgaacaacctcagtccatcctgattgagcataaaggaaccatcatcggcaagcagaataacacatgtaccacgaaaacaacctgctggctcgaatctgttaagagcttcttttatggcctgaagaatatgctttcctctattttcgggaacgtgtttgtcggaatcttcagctttctggcccccttcattctgctcatcctgtttttcatgttcggctggcgcattctgttttgtttcaaatgctgtcgccggaccagagggctttttaagtaccggcacctcaaagacgatgaggaaacaggatatcgcagaatcattgagcggctgaataacaagaaaggcaagtccaagctcctggacggggagcgccttgctgatagaaaaatcgccgaactgttcagcaccaagacacatatcggatga

SEQ ID NO: 13602 - RNA, 5067 nt, synthetic construct
  misc_feature 1..5067: note = derived and/or modified CDS sequence (opt5) from CCHFV(Kosova Hoti)__EU037902.1__GP
  source 1..5067: mol_type = other RNA
atgcccatcaacattatgcacaccctgctcgtgtgcttcatcctgtaccttcagctgctcggcctgggaggagcccatggccaaagcaatgctacagagcacaacgggacgaataccacaaccgcccctggaacatcccagtctccgaagccccctgcgagcaccacaccctcccatgctcctgaaccctctaccattaaacttacgacccctacaagcgagaccgaaggctccggggagacaaccccgcccacgaacacaacccaggactctcctcccctggaaacaacccctgagagaagcgccaccacagccacgtccaccagcggaacagataatatgaactctaccacacagatgaccgacaatacgcccacatccaccgtcagcacctctctctccagctctccgtccacacctagcacctcccaaggcatgcaccatcccgttcggtctctgctgagcgtgtccagccctaagacagctacgacccccacacccatgtctcctggcgagatgtccagcgaaacctctagccagcactccgccatgtctcgcacaccgacgccccacaccgctacccaggtgagcacagagaacgccaatagatccaccagccggcagtctgaatccagcgcgcaacctgccacacagtctcccgtcacctcccctgctcagagcatcctcctgatgtccgccacgcccacaaccattcagaacatccatccgtctcctacaaatcgcagcaaaagaaaccttgagatggagatcattctgaccctctcccaagggctgaagaaatattacggaaagatccttaagctgctccacctgaccctggaagaggatacagaaggcctcctggagtggtgtaaacggaatcttgggtctaactgcgacgatgactttttccagaagcgcattgaagagtttttcatcacgggagagggctattttaatgaagtgctgcagttcaaaaccctcagcacaccctccagcaccgagccttctcatgctagactgcccacagccgaaccttttaagtcctacttcgcgaaagggtttcttagcattgattctggatatttctccgccaagtgttacccccggagctctaccagcggcctgcaactcatcaacgttacgcagcacccggctcgcattgccgagacacctggccccaagaccacctccctgaaaacaatcaactgcatcaatctgagagctagcgtgtttaaggaacaccgggaggtcgagattaacgtgctcctgccccagatcgccgttaatctttctaactgtcatgtggtcattaattcccacgtgtgcgactatagcctggataccgacgggcctgtgcgcctcccgagaatctaccatgaaggaacattcatgcccggcacgtacaaaattgtcatcgatcggaagaacaaactgaatgaccgctgtacccttgttacaaactgcgtgatcaaggggagagaggtgcggaaaggacagtccgtcctgagacaatataagaccgaaattaagatcggcaaagcccctacagggtctcgcaagctcctgagcgaggaacccggagatgactgtatttcccggacccagctgctcagaacggagaccgctgagatccacgacgataattacggcggccctggggacaaaattacaatctgcaacggatctaccatcgtggatcagcgcctgggcagcgaacttgggtgttatacaattaatcgggttaagtcctttaaactgtgcgagaactctgcgaccggaaagacatgcgaaatcgacagcacccccgtgaagtgtagacagggcttctgcctcaaaattacgcaaaaggggcgcggccatgtcaaactgtcccggggaagcgaggtggttctggatgcctgtgactctaattgcgaggtgatgatccctaagggcacaggggatattcttgtcgactgttccggaggccagcagcacttcctcaaagataacctgatcgacctggggtgcccccacattccgctcctgggaaagatggctatctacatctgtagaatgagcaatcatcctaagaccaccatggcctttcttttctggttttctttcggctatgtgattacatgcatcttttgtaaagccctgttctactccctcattatcattgggaccctgggcaagaaaatcaagcagtatcgcgaactgaaaccccaaacgtgcacaatctgtgagaccgctcctgtcaacgccattgatgcggaaatgcacgaccttaactgcagctacaatatctgcccctactgtgcttctcggctcacatccgacggactggccagacatgtgaagcagtgcccgaagcgcaaagagaaggttgaagagaccgagctgtatctcaacctggaacggattccttgggtggtcagaaaacttctccaggtgagcgagtccacaggcgttgccctgaagcggagctcttggctgatcgtgctgcttgtcctcctgaccgtgagcctgtcccccgtgcagtctgctcctgttgggcacggaaaaacgattgaaacctaccaaacacgcgagggctttaccagcatctgtctcttcatgctggggtccatcctttttattgtctcttgcctggtgaagggactcgtggatagcgtctccgactctttctttcccggcctgagcgtgtgtaaaacatgctccatcgggagcattaatggcttcgaaatcgagtctcacaagtgttattgctccctgttttgttgcccctactgtagacattgcagcgccgatcgggagattcaccagcttcatctcaacatctgcaagaaaagaaagaccggatctaatgttatgctggctgtgtgtaaacgcatgtgcttccgggccacgatcgaagcgtccagacgcgccctgctcattagaagcatcattaacacaaccttcgtcatctgtattctgacacttaccatctgcgtggtttccacctctgctgtggagatggaaaatctgcctgccggcacatgggagcgggaagaggacctcacgaacttttgtcaccaggagtgccaagtcaccgaaacagagtgtctgtgcccgtatgaagctctggtgcttcgcaagcccctgttcctcgatagcattgttaaagggatgaagaatctgctcaactccaccagcctggagacatctctttccatcgaggccccttggggagcgatcaatgtgcagagcacctttaagcccacggtctctacagccaacattgctctgagctggtcctctgtggaacatagaggcaataaaatcctcgtgaccgggcggagcgagtccattatgaagctggaggaacgcaccggaatctcttgggacctgggcgtcgaagatgccagcgagtccaaacttctgacagttagcattatggacctctctcagatgtactcccctgtgttcgagtatctgagcggggatagacaggtggaagagtggcccaaggctacctgtacaggcgactgccctcaacggtgtggatgcacgtcctctacctgcctccacaaagaatggccgcacagccgcaactggagatgtaatcccacatggtgctggggcgtcgggaccggatgtacatgctgtggcgtggatgttaaggacctgtttaccgatcatatgttcgtgaagtggaaagtcgagtacatcaagacggaagccatcgtgtgcgttgagcttacctcccaggagcggcagtgttctctgattgaagccgggacacgctttaacctcggacctgtgaccatcacactgagcgagcccagaaacattcagcaaaaactgcctcccgaaatcattacccttcacccgaagatcgaggaaggcttctttgacctgatgcatgtccagaaagtgctctccgctagcacagtttgcaagctgcagtcttgtacgcacggcatccctggggacctccaggtgtaccatattggaaatctgcttaagggcgatcgggtcaacgggcacctgatccacaaaattgagccccatttcaatacctcctggatgagctgggacggatgcgatctggactattactgtaacatgggcgattggccctcttgcacatataccggggtgacccaacacaatcatgcggcctttgtgaacctcctgaatatcgagacagactacacgaagaccttccactttcactccaaaagagtcacagctcatggagatacccctcagcttgacctgaaggcccgccccacatatggcgccggcgaaattaccgttctcgtggaggtggctgatatggaactgcacacgaaaaaggtcgagatcagcgggctcaaattcgcctctctggcgtgcacaggatgttacgcttgcagctccggcatttcttgtaaggtgcggatccatgttgacgagcctgatgaacttaccgtgcacgtcaagagctccgacccggatgtggttgccgccgggaccagcctgatggctagaaaactggagttcggaacagactccacctttaaggccttctctgcgatgcccaaaacaagcctctgcttttatatcgtggaaaaggagtactgtaaatcctgctctgaagacgataccaagaagtgtgtcgacacgaaactggagcagcctcaaagcattcttatcgagcatcgcggcacaattatcgggaagcagaacgatacctgcacagctaaagcctcctgttggctggaatctgtcaagagcttcttttacggactcaaaaatatgctgggctccgtgttcggcaactttttcattgggatcctcctgtttcttgcccccttcgtgctgctggttctctttttcatgttcggatggaagatcctgttttgcttcaagtgttgccggagaacccgcggcctttttaaatatcggcacctgaaggacgatgaggaaacggggtacagacgcattatcgagcggctcaataacaaaaaggggaaaaatagactgctcgacggcgaacggctggctgatcgcaagattgccgagcttttcagcaccaagacacacatcgggtga

SEQ ID NO: 13603 - RNA, 5067 nt, synthetic construct
  misc_feature 1..5067: note = derived and/or modified CDS sequence (opt5) from CCHFV(Turkey200310849)__DQ211636.1__GP
  source 1..5067: mol_type = other RNA
atgcccaccaacatcatgcacacactgctcgtgtgcttcattctgtaccttcagctgctctgtctgggcggggcccatggacaacttaatacgaccgagcacaacggcacaaataacaccacagctcctggggccagccagtccccgaagccccctatgtctaccacaccccctcatgcgcccgaaagctccaccatcaaacctacgaccccgatttctgaggctgaaggaagcggcgagacaacctccacacccaataccacgcaggggctgtctagccctgaaacaacctccgagagacccgccacaaccgccatcagcacctcttccacagacagcacgaaccctaccacacagatgaccgataatacacccaccctcacggtctctacatccccgtctagctcccctagcaccccctccacccctcaaggaatttatcaccccgctcggtctctgctgagcgtttccagccccaagacagtgaccacacctacgccgacctctcccggcgagatgtccagcgaaacatctagccagcattccgccatgtctcgcatccctacaccccacacagctaccagagtgagcacggagaacaccaatcactccacacctcggcagagcgaatcttccgcccagcaaaccacacccagcccgatgacctctcctgcgcagtccatcctcctgatgagcgccgctcccacggccgtccaggacattcatccttcccccacaaaccgctctaaaagaaatcttgagaccgagatcattctgacactcagccagggcctgaagaaatactatgggaagatccttaagctgctccacctgaccctggaagaggataccgaaggactcctggagtggtgcaaacggaaccttggctccaattgtgacgatgactttttccaaaagcgcattgaagagtttttcatgacaggggagggatactttaacgaagtgctgcagttcaaaacgctctctaccctgagccctacagagccctcccatgctagacttccgaccgccgaaccttttaagagctatttcgcgaaaggctttctgtctatcgattccgggtacttcagcgccaagtgctatccccggtcttccgctagcggactccagctgattaatgttacacaacaccccgcccgcatcgctgagacccctggcccgaagacgacatctctgaaaaccatcaactgtattaacctcagagccagcgtgtttaaggaacaccgggagatcgagattaatgtcctgcttccccagatcgccgtgaacctgtccaattgccatgttgtgattaacagccacgtctgtgactactctctcgataccgacggccctgtgcgcctgcccagaatctaccatgaagggacattcatccctggaacctataaaattgtgatcgataagaaaaataaacttaacgaccggtgcacactggtcacgaattgtgttattaagggccgcgaggtgagaaaggggcagtccgtgctccggcagtacaagaccgaaatcaaaattggaaaggctagcacaggctttagaaaactgctgtccgaggaacccggggatgactgcatctctcgcacccaactcctgcggacagagaccgcggagatccacgacgataactatggaggccctggcgacaagattacgatctgtaatgggagcaccattgtcgatcagagacttggatccgaactgggctgctacacaatcaaccgcgtgaaatctttcaagctctgcgagaatagcgccaccgggaagacatgtgaagttgactccacccccgtgaaatgccggcagggattctgtctgaagattacacaggagggcagagggcatgtcaaactgtctcgcggcagcgaggtggttcttgatgcttgcgactccagctgtgaagtgatgatcccgaagggaaccggcgatattctcgtcgactgctctgggggacaacagcactttctgaaagataacctgatcgacctcggctgtcctcacatccccctgcttgggaagatggccatttatatctgccggatgtccaatcatcctagaacgacaatggccttcctgttttggttcagctttggatacgtgattacctgtatctcttgcaaggctctcttctattccctgattatcatcggcaccctggggaaaaagattaaacagtaccgcgagcttaagccccagacatgtaccatctgcgaaacggccccggtcaacgcgattgatgctgagatgcacgacctcaattgcagctacaacatctgtccttattgcgcctctcggctgacatccgacggcctggccagacatgtgacccaatgtcccaaacgcaaggaaaaggttgaggagacagaactctacctgaaccttgagcggattccttggatcgtgagaaaactgctccaggtcagcgaatccaccggagtggctctgaagcggagctcttggctgatcgttcttctcgtgctgctgacagtcagcctctcccccgtgcagtctgcccccgtgggccacgggaaaaccattgagatctatcagacgcgcgaaggatttgctagcatttgcctgttcatgcttggctccatcctgtttattgtttcttgtctcgtcaaggggctggtggatagcgtgtccgactctttctttcctggactgagcgtctgcaaaacctgttccatcggcagcgtgaatgggttcgagatcgagtctcacaagtgctactgttccctcttttgctgtccgtattgcagacattgcagcgccgatcgggaaattcaccaactccatctgtctatctgtaaaaagagaaagacaggctccaacgttatgctggcggtgtgcaaacgcatgtgtttccgggccaccattgaggctagcagacgcgccctcctgatcagatccattatcaatacaaccttcgtcatttgcatccttacgctgacaatctgtgtggtttctaccagcgctgtggaaatggagaacctccccgccggaacatgggaacgggaggaggacctgaccaatttttgccaccaggaatgtcaggtcaccgagacagaatgcctgtgtccttacgaggcgcttgtgctgcgcaagcccctcttcctggattccattgttaaaggcatgaagaacctcctgaatagcacgtctcttgagacctccctgagcatcgaagccccttggggagctattaacgtgcaatctacatttaaacccgccgtcagcaccgctaatatcgccctctcctggtctagcgtggagcatagagggaacaagattctggtgacaggccggtccgaatctatcatgaagctggaggaacgcaccggggtcagctgggaccttggagttgaggatgcctccgagagcaaactgctcacggtgtctatcatggacctgtcccagatgtatagccctgtgttcgaatacctctccggcgatagacaggtcgaggaatggccgaaggctacatgcaccggggactgtcccgagcggtgcggctgcacctctagcacatgtctgcacaaagaatggcctcactcccgcaattggagatgcaaccccacctggtgttggggagtgggcacagggtgcacgtgttgcggagttgatgtgaaggacctttttaccgatcatatgttcgtcaaatggaaggtggagtacattaagacagaggcgatcgtttgtgtggaactgacctctcaggagcggcaatgcagcctcattgaagccggcacacgctttaatctggggcctgtcaccatcacgctgtccgagcccagaaacattcagcagaaacttccgcctgaaatcatcaccctgcaccccaagattgaggagggattctttgacctcatgcatgtgcagaaagttctgagcgcttctacagtgtgtaagctccaatcctgcacccacggcatccccggcgacctgcaggtctatcatattgggaatcttctgaaaggagatcgggtgaacggccacctgatccacaagattgaaagccatttcaacacatcttggatgtcctgggacgggtgtgatctcgactactattgcaatatgggagattggcctagctgcacctacacaggcgtgacgcagcacaaccatgccgcctttgtcaatctgcttaacatcgagaccgactatacaaagaccttccactttcactctaaaagagttaccgctcatggggatacaccccagctggacctcaaggcccgccctacgtacggagcgggcgaaattaccgtgctggtggaggtcgctgatatggagctccacaccaaaaaggtggaaatcagcggcctgaaattcgcctcccttgcctgtaccgggtgctatgcttgttctagcggaatctcctgcaaggttcggattcatgtggacgagccggatgaactgacagtccacgtgaaaagctccgaccccgatgttgtggccgcgtctaccagcctgatggctagaaagctcgagttcggcacggactccacatttaaggccttctctgccatgcctaaaaccagcctgtgtttttacatcgtcgaacgcgagtactgcaagtcctgttctgaggacgatacccaaaaatgcgtggacacacggcttgaacagccccagagcattctgatcgagcataaggggaccattatcggaaaacaaaatgatacatgtaccgctaaggcctcctgctggctcgaaagcgtcaagtctttcttttatggcctgaaaaacatgctcgggtccgtgttcggaaatctgtttatcggcattcttctgttcctggctccttttgttctcctggtgcttttctttatgttcggctggaagatcctgttctgttttaaatgctgcagacgcacgcgggggcttttcaagtacagacacctgaaagacgatgaggaaacaggatatcgccggattatcgagagactcaacagcaagaagggcaaaaatcggctgcttgacggggatcgcctggccgacagaaagattgcggagctgttttctaccaaaacacacatcggatga

SEQ ID NO: 13604 - RNA, 5067 nt, synthetic construct
  misc_feature 1..5067: note = derived and/or modified CDS sequence (opt5) from CCHFV(Kashmanov)__DQ211631.1__GP
  source 1..5067: mol_type = other RNA
atgcccaccaacatcatgcacacactgctcgtgtgcttcattctgtaccttcagctgctcggccttgggggagcccatggccaaagcaatgctacggagcacaacgggaccaatacaaccacagccccttccacctctcagagcccgaagccccttgtctccacagcgcctccccatgctctggaatctagcaccatcaaacctacgacccccgcctccgagacagaaggatctggcgagaccacacctccgcccaacaccacgcaggggcctagccctcccgaaacaacccccgagagaccggccacaaccgctacctccacacctagcacggacaataccaactctacaacccacgttacagataataaccccacctccacgattagcacatctccttccagctctccctccacccccagcacccctcagggaatccatcacccggcccggaatctcctgtccgtgtctagccccaagacagctaccacacctacgcccacctcccctggcgagattagctctgaagcctccagcctgcactctgcgatgagccgcacatccaccctctatacagccacccaagtgtctacggagaacgctaatcatagcgcccccagacagtccgaaagctctgctcagccgaccacaacctcccctatgacaagccccgcccagtctatcctggtcatgtccgcggcccctatcgctattcaaaacatccaccccagccctaccaatcggtccaaacgcaaccttgagatggagattatcctgacgctctctcagggcctgaagaaatactatgggaagattcttaagctgctccatctgacactggaagaggacaccgaaggactcctggagtggtgtaaaagaaatcttggcagcaactgcgatgacgactttttccagaagcggatcgaagagtttttcatgacaggggagggatactttaacgaagtgctgcagttcaaaaccctctccaccctgtctcccacagagccgagccacgccggccctcccacggttgaaccctttaagtcctatttcgctaaagggtttcttagcattgattctggatacttctccgccaagtgttatcctcgcagctctacctccggcctgcaactcatcaatgtgacacagcacccggccagaatcgctgagacccccggccctaagacaaccagcctgaaaacgattaactgcatcaatctgcgggcgtctgtctttaaggaacatcgcgagattgagatcaacgtgctcctgccccagattgccgttaatcttagcaactgtcacgtggtcatcaattcccatgtgtgcgattacagcctggacacagatgggcctgtgagactcccccacatctaccatgaaggaaccttcattcctggcacctataaaatcgtcattgacaagaaaaacaagctgaatgatcggtgtacacttgttaccaactgcgtgatcaaagggcgcgaggtgagaaagggacaatctgtcctgcggcagtacaagacagaaattaaaatcggcaaggcttccacggggagccgcaaactcctgtccgaggaacccggagacgattgtatctctagaacccagctgctccggacagagaccgccgagattcacgacgacaattatggcggcccgggggataagatcacaatttgcaacggaagcaccatcgtggaccagagactgggctccgaacttgggtgttacacgattaatcgcgttaaatcttttaagctgtgcgagaacagcgccaccggaaagacatgcgaaatcgattccacccctgtgaaatgtcggcaaggcttctgcctcaagattacacaggaggggagaggccacgtcaaactgtctcgcggaagcgaggtggttctggacgcttgtgattccagctgcgaagtgatgatccccaagggcaccggggacatccttgtcgattgttctggaggccagcagcatttcctcaaagacaatctgattgatctggggtgccctcacatccccctcctgggaaagatggccatttatatctgtcggatgtccaaccatccgagaacaaccatggcgtttcttttctggtttagcttcggctacgtgattacgtgcatcttttgtaaggctctgttctattctctcatcattatcgggacactgggcaaaaagattaaacaataccgcgagctgaagcctcagacctgcaccatctgtgaaacagcccccgtcaacgccattgacgctgagatgcacgatcttaattgctcctacaacatctgcccttattgtgccagccggctcacctctgacggactggctagacacgtgccccagtgccccaaacgcaaggaaaaggttgaggagacggaactgtacctcaatctggagcggatcccttggattgtgagaaaacttctgcaggtctccgaaagcacaggcgtggccctcaagcgctccagctggctgatcgttctgcttgtgctcctgaccgtctctctgagcccggtgcaatccgcgcccgtggggcatggaaaaacaattgagacctatcagacacgggaaggctttacctctatctgtctcttcatgctggggagcattctttttctggtttcctgcctcgtcaagggactggtggactctgtgagcgattccttctttcctggcctgtctgtctgtaaaacgtgcaccatcgggagcatcaacggcttcgagattgagtcccacaagtgttactgcagcctgttttgttgcccctattgtagacattgctctgccgaccgggaaatccaccagctccatctgtccatttgcaaaaagcgcaagacaggaagcaatgtgatgctggctgtttgtaaaagaatgtgcttccgggccaccatcgaggcttctagacgcgccctcctgattcggtccatcattaacacaaccttcgtgatctgtatccttacgctgacaatttgcgtcgtgagcacctccgcggttgaaatggagaatctcccttctggcacatgggaaagagaggaggatctgaccaacttttgtcaccaggaatgccaagtgaccgagacagaatgtctgtgcccctacgaggcccttgtcctgcgcaagcctctcttcctggacagcatcgtgaaagggatgaagaatagcctcaacagcacgtctctggagacctcccttagcattgaagctccgtggggagccatcaatgttcagtctacatttaaacccaccgtgagcacagctaacattgccctgtcctggtctagcgtcgagcacagaggcaataagatcctcgtgaccgggcggtccgaatctatcatgaagctggaggaacgcacgggagtgagctgggatctgggcgtcgaggacgcctccgagagcaaacttctgacagtttctattatggatctctcccagatgtatagccctgtgttcgaatacctgtccggggacagacaagtggaggaatggcccaaggctacctgtaccggcgattgccctgagcggtgtggatgcacatctagcacatgcctccataaagaatggccccactcccgcaactggagatgtaatccgacctggtgctggggcgtcgggacgggatgtacctgctgtggcgtggacgttaaggatctgtttacagaccatatgttcgtgaaatggaaggtcgagtacatcaagaccgaggcgattgtgtgcgttgaacttacatctcaggagcggcagtgtagcctgatcgaagccgggacccgctttaacctcggacctgtgacgattaccctgtccgagcccagaaacatccagcaaaaactgccccctgaaatcattacacttcaccccaaggtcgaggagggcttctttgatctgatgcatgtgcagaaagttctcagcgcttctaccgtgtgcaagctgcagtcctgtacacacggcatccctggggacctccaggtctatcacattggaaatctgcttaaaggcgaccggatcaacgggcatctgattcacaagatcgaaccgcatttcaataccagctggatgtcttgggatggatgcgacctggattactattgtaacatgggcgactggccctcctgcacatacacgggggtgacccaacacaatcacgccgcctttgtgaacctcctgaatattgagacagattataccaagaccttccattttcacagcaaacgcgtcacagctcatggagacacgcctcagcttgatctgaaggccagacccacctacggcgcgggcgaaatcacagttctcgtggaggtggctgacatggagctgcacaccaaaaaggtcgaaatctctgggctcaaattcgccagcctggcctgcacaggatgttatgcttgctcctctggcattagctgtaaggtgcggatccatgttgatgagcctgacgaacttaccgtgcacgtcaaatccagcgatcccgacgtggttgccgcgtccacgtctctgatggctagaaagctggagttcgggacagatagcacctttaaggccttctccgccatgccgaaaacctctctctgcttttacattgtggaacgcgagtactgtaagagctgctccgaggaagacacacagaaatgtgtcgacaccaagctggagcagcctcaatctatccttattgaacacaaaggaacaatcatcggcaagcagaacgatacctgcacggctaaggccagctgttggctggagtccgtgaaatccttcttttatgggctcaagaatatgctgggatctgtcttcggcaactttttcattggcatcctcctgtttcttgctcccttcgtgctgctggttctctttttcatgttcgggtggaaaattctgttttgcttcaagtgttgccggagaacacgcggacttctgaaataccggcatctcaaggacgatgaagagaccggctatagacgcatcattgagcggctgaataacaagaaagggaagaatagactcctggacggagaacgccttgccgatcggaaaatcgcggagctgttttccacaaagacccacatcggctga

SEQ ID NO: 13605 - RNA, 5067 nt, synthetic construct
  misc_feature 1..5067: note = derived and/or modified CDS sequence (opt5) from CCHFV(Drosdov)__DQ211630.1__GP
  source 1..5067: mol_type = other RNA
atgcccatcaacattatgcacgccctgctcgtgtgcttcatcctgtaccttcagctgagcggcctcgggggagctcatagacaatccaatgccaccgagcacaacggcacaaatacgaccacagcgcctgggacctctcagagcccgaagccccctgtctccacaaccctgccccatacacctgaagcctctaccattaaacttacgacccccacaagcgagaccgaaggatccggcgagacaacccctccgcccaacacgacacaggggctgcctctccccggaaccacacctgaacggtctgccaccaccgccacaagcacgtccagcaccgacgatatgaactctacaacccagatgacagacaatacccccacgtccacagttagcatcggcctgtcttccagcccgtctatgccttccaccagccaaggcattcactatcccgtgcgctccctgctctctgtgagctcccctaagaccgctacaacccccacacccatgagccctggggaggtctctccggagacgtccagccagcattctgccatgagcagaatccccaccctgtacacagctacccaggtgtccacagaaaataccaaccggtctatccctcgccagagcgagtccagcgttcaacccgccacgcagtctcctattacctcccccgcgcagacaatccttctgatgagcgccgctccgaccgccattcaggatatgcacccttctcccaaaaatagatccaagcggaacctcgaagtggagatcattctgacacttagccaaggactgaaaaagtattacggcaagatcctcaaactgctgcacctcaccctggaggaagacacggaggggcttctggaatggtgtaagcgcaatctcggatccaactgcgatgacgactttttccagaaaagaattgaggaatttttcatcacaggcgaggggtattttaatgaggtcctgcagttcaagaccccttctacacttagccccaccgaaccttcccatgtgcggctgcccaccgctgagccgtttaaatcttacttcgccaagggatttctcagcatcgattccggctatttcagcgcgaagtgttaccctagatcttccacaagcggcctgcaactgattaacgttacgcagcaccccgcccgcatcgctgaaacccccgggcctaaaacaacctctctcaagacaattaattgcatcaacctgcgggcctccgtgtttaaagagcatcgcgaagtcgagattaacgtgcttctgccgcagatcgctgtgaatctcagcaactgtcacgtcgttatcaattctcacgtgtgcgattacagcctggacaccgatggacccgtgagacttcctcggattcatcacgagggcgccttcatccccgggacgtataagattgtcatcgacaaaaagaacaaactgaatgatcgctgttccctcgtgacaaactgcgttattaagggaagagaagtgcggaagggccagagcgtcctgagacaatacaaaaccgagatcaagatcgggaaagcctctaccggatcccgcaagctgctcagcgaggaacctggcgacgactgtatttcccggacacagctgcttaaaaccgaaacagctgagatccatgatgacaattatggcgggcccggagataagattacgatctgcaacggctctaccattgtggaccagagactggggagcgagctcggatgttacacaatcaatcgcgttaagtcctttaaactgtgcgaaaactctgcgaccggcaagacatgcgagattgatagcacccctgtgaaatgtcggcaggggttctgcctgaagatcacgcaagaaggcagaggacacgtcaaactttcccgcggctctgaggtggtcctcgacgcctgtgatagctcctgcgaggtgatgatccccaaggggaccggagacattctggttgattgtagcggcgggcagcagcatttcctgaaggacaatctcatcgatctgggatgcccgcacattcctcttctgggcaaaatggctatctatatttgtcggatgtctaaccaccccagaacaaccatggcctttctcttctggttttccttcgggtacgtgatcacatgcatcttttgtaaggccctgttctatagcctgattatcattggcacccttgggaaaaagatcaaacagtaccgcgaactcaagcctcaaacatgcaccatttgtgagacggctcccgtcaatgccatcgacgcggaaatgcatgacctgaagtgctcttacaacatctgcccgtattgtgcttcccggctgacaagcgatggcctcgccagacacgtgacccagtgccctaaacgcaaggagaaagttgaagagaccgagctgtaccttaatctggaacggattccctggatcgtgagaaagctcctgcaggtctctgagtccacaggggtggccctgaaacggagctcctggcttattgtgctcctggttctgctcaccgtcagcctgtctcctgtgcagagcgctcccgtgggacatggcaagacgatcgaaacatatcaaacccgcgaggggtttacatccatttgtcttttcatgctgggatctatcctctttatcgtcagctgcctggtgaaaggcctggttgactccgtgtctgatagcttctttcccgggctttccgtctgtaagacctgctctattggcagcatcaacggattcgaaattgagtcccacaagtgttactgcagcctcttttgttgcccttattgtagacactactctgccgaccgggagatccatcagctgcacctgtccatttgcaaaaagagaaaaacaggcagcaacgtgatgctcgctgtttgcaagcgcatgtgtttcaaagccaccatcgaagcgtctcggagagccctgcttattcgctccatcatcaatacgaccttcgtgatttgcatcctgattctcgctatctgtgtcgtgagcacatccgccgttgagatggaaaacctgccggctgggacctgggagagagaagaggatctgacaaatttttgccatcaggagtgtcaagtgaccgaaacggagtgcctttgtccctatgaagccctggtcctccggaagcctctgttcctcgactctacagtgaagggaatgaaaaacctgcttaatagcacctccctggagacaagcctctctattgaggcgccctggggcgccatcaacgtgcagtccacctttaagcctaccgtcagcacagctaatatcgccctgtcttggagctccgttgaacaccgcgggaacaaaattctggtgacgggaagatctgagagcatcatgaaacttgaggaacggaccggcgtgtcctgggatctgggggtcgaagacgcttctgagagcaagctcctgacagtgtccattatggatctcagccagatgtactctcccgttttcgagtacctgtccggcgaccgccaggtggaagagtggcctaaggctacctgcacaggagattgtccggaaagatgcggctgtaccagctccacgtgccttcataaggagtggccccactctcggaattggcgctgcaaccctacatggtgttggggagtcggaaccggctgcacctgttgcggggtggacgttaaagatctgtttacagaccacatgttcgtgaagtggaaagtcgaatatatgaagaccgaggccatcgtgtgtgttgagctcacaagccaagaaagacagtgctccctgattgaggctggaacgcggtttaatctgggccccgtgaccatcacactttctgaacctcgcaacatccagcagaaactgcccccggagattatcaccctccatcctaagattgaagagggcttctttgacctgatgcacgtccaaaaggtgctcagcgcgtccacagtgtgtaaactgcagagctgcacccatgggatccccggagatcttcagatttaccacatcggcaatctgctgaagggggacagagtcaacggacatctcattcacaaaatcgagccccacttcaatacgtcttggatgtcctgggatggctgtgacctggattattactgcaacatggggaactggcctagctgtacctatacaggagttacccagcataatcacgccgcttttgtgaaccttctgaatatcgaaacagactacaccaagacattccattttcactctaaacgggtgacggcccacggcgatacaccccaactcgacctgaaggccagacctacctatggcgctggggagattaccgtcctcgtggaagttgccgatatggagctgcataccaaaaaggtggagatctccggacttaagttcgcgagcctggtctgcacaggctgctacgcttgttctagcgggatttcctgcaaagtgcgcatccacgttgacgaaccggatgagctgacggtgcatgtcaagtctagcgaccccgatgtggtcgccgcctccaccagcctcatggctcggaaactggaatttggaacagactccatttttaaggccttctctgcgatgcctaaaaccagcctttgtttttacatcgtggagagagaatattgcaagtcctgttctgaggacgatacaaagaaatgcgttgacaccaagctggagcagccccagagcatcctcattgaacacaaaggcacgatcattgggaagcaaaacgatacatgtaccgctaaagcctcctgctggctggagtctgtcaagagcttcttttacggactcaagaatatgctgggctccgtgttcggcaactttttcgtggggatccttctgtttctggcccctttcgttctcctggtgcttttcttcatgttcggatggaaaattctgttttgtttcaagtgctgtcgccggaccagaggcctctttaaatatcgccatctgaaggacgatgaagagacagggtaccggagaatcatcgaacgcctcaatagcaaaaagggaaagaaccggctgcttgacggcgagagactggctgatcggaaaattgccgagctgttctctaccaagacacacatcgggtga

SEQ ID NO: 13606 - RNA, 5067 nt, synthetic construct
  misc_feature 1..5067: note = derived and/or modified CDS sequence (opt5) from CCHFV(1231-CR/TI-2015)__KU161585.1__GP
  source 1..5067: mol_type = other RNA
atgcccatcaacattatgcacaccctgctcgtgtgcttcatcctgtaccttcagctgctcggccttgggggagcccatgagcaaagcaatgctacagaccacaacagaacgaataccattacagccccttccacctctcagaacccgaagccccctgcgagcacaaccccgcctcatacacccgaatcctctaccatcaaacttattacgagcaccggcgaggctgaagggtccggagagacaacccctccgctgaatacaacccagggcccctttcctcccgaaacgacatctgagcaccctgccagcaccgccacaaacacctccagcaccaattctatgaactccacaacgcagatgaccgataagacactcaccagcacagtctctacctccctgagcatctctccctccacgccgagcacatcccaagggatccattatcctattcggtctctgctcagcgtttccagcccccgcaccgctgccacccctacacccatgtctaccagagagatgtccagcgaaacaaattctcagcacagcgctgtgtcccggacgcccaccttccacacagccacccaggtgtctacagagaacgacaatcgcagcacccctagacagtccgaaagctctgcgcaaccggccacgcagtcccccatgaccagccctgctcagtctatcctgcttgtctccgccgctcccacaaccattcagaacatccatcctagccccacaaatcggtccaaacgcaacctggagatggagattatcctcaccctgccgcaaggacttaagaaatactatggcaagattctgaagctcctgcacctgacgctcgaagaggatacagaaggcctgcttgagtggtgtaaaagaaatctggggtctaactgcgacgatgaatttttccagaagcggatcgaggagtttttcatcaccggagaaggctactttaacgaggtgctccagttcaaaacactgagcaccctttcccctatggaaccctctcatgcccgccctcccaccgcggagccttttaagagctatttcgccaaagggtttctgtccattgacagcggatacttctctgctaagtgttatcccagatcctctagctccggcctccaactgatcaatattacacagcacccggcccggatcgctgaaacgcctgggcccaagaccacaagcctgaaaaccattaactgcatcaatctccgcgcctctgtttttaaggagcacagagaggtggaaatcaacgtcctgcttccccagattgccgtgaatctgagcaactgtcatgttgtgatcaattcccacgtctgcgattacagcctcgacacagatggacctgtgcggctgccgcgcatttaccatgagggcaccttcatccccggcacgtataaaattgtgatcgacaagaaaaacaaacttaatgatagatgtacactggtcaccaactgcgttaccaaggggcgggaagtgagaaagggacagtctgtgctccgccaatacaagacagagatcaaaattggcaaggcttccaccgggagccggaaactgctgtccgaggaacctggagacgattgtatctctagaacacagctcctgcgcacggagaccgcggaaattcacgacgacaattatggcgggcccggagataagatcacaatttgcaacggcagcaccatcgtcgaccagcggcttggctccgagctggggtgttacacaattaatagagtgaaatctttcaagctctgcgaaaacagcgccaccggaaagacgtgcgagatcgattccacccctgttaaatgtcgccagggcttttgcctgaagatcacacaagaggggcggggacatgtgaaactgtctagaggcagcgaagtcgtgcttgacgcttgtgattccagctgcgaggttatgattcccaaggggaccggcgacatcctcgtggattgttctggaggccagcagcacttcctgaaagacaatctgattgatctcgggtgccctcacatccccctgcttggaaagatggccatttatatctgtcgcatgtccaaccatccgcggacaaccatggcctttctgttctggtttagcttcggctacgtcatcacatgcatcttttgtaaggctctcttctattctctgattattatcgggaccctggggaaaaagattaaacagtacagagaacttaagcctcaaacgtgcacaatctgtgagaccgcccccgtgaacgcgatcgacgctgaaatgcacgatctcaattgctcctacaacatttgcccttattgtgccagccgcctgacctctgacggcctggcccggcatgtcacacagtgccccaaaagaaaggagaaggtggaggaaaccgagctctacctgaatcttgaacggatcccgtggattgttcgcaaactgctccaggtgtccgagagcacgggggtcgctctgaagagatccagctggctgatcgtgcttctcgttctgctgacagtgtctctcagccctgtccagtccgcccccgtgggccacggaaaaaccattgaaacatatcaaacccgggagggctttacatctatctgtctgttcatgcttgggagcatcctgtttattgtgtcctgcctcgttaagggactggtcgagtctgtgagcgactccttctttcctggcctgtctgtgtgtagaacctgcagcatcgggtccattaacggattcgaaatcgagagccacaaatgttactgctctcttttctgttgcccctattgtcgccattgctccgctgatcgggaaattcaccagctccatctgagcatctgcaagaaaagaaagacgggctctaatgtcatgctggccgtgtgtaagcgcatgtgctttagagcgaccatggaggcctcccggcgcgctctcctgattagaagcatcatcaacacaaccttcgttatttgtatccttacactgaccatttgcgtggtctccacgtctgccgtggaaatggagaatctccccgctgggacatgggagcgggaagaggacctgaccaacttttgtcaccaggaatgccaagttacagagaccgagtgtctgtgcccttacgaagcccttgtgctgcgcaaacccctcttcctggatagcatcgtcaagggcatgaaaaatctcctgaactccaccagccttgagacatctctgtccattgaagcgccctggggagccatcaatgtgcagagcacgtttaagcctaccgtttctacagctaacatcgccctcagctggtcctctgtggagcatagaggcaataaaattctggtcaccgggcggagcgaatccatcatgaagctggaggagcgcacaggagtgtcttgggaccttggcgtggaagatgctagcgagtccaagctgctcaccgtcagcattatggacctgtctcagatgtattcccccgttttcgaatacctcagcggggatagacaggtggaggaatggcctaaagccacgtgtacaggagactgccccgagcggtgtggctgcacctcctctacctgcctgcacaaggagtggcctcacagccgcaactggagatgtaatccgacatggtgctggggagtgggcaccggatgtacatgctgtggcgtcgatgtgaaagacctttttacggatcatatgttcgttaagtggaaagtggaatacatcaagaccgaggccattgtctgcgtggaactgacatcccaagagcggcagtgttctctcatcgaagctgggaccagatttaacctgggacccgttacaatcaccctgagcgagcctcgcaacattcagcagaaacttccccctgagatcattacgctgcaccccaagatcgaagagggcttctttgacctcatgcatgtgcaaaaggtcctgtccgcgagcaccgtgtgcaaactccagtcttgtacacacgggattccgggagatctgcaggtttatcatatcggcaatcttctgaagggcgaccgggtgaacgggcacctgattcacaaaatcgaacctcatttcaatacctcctggatgagctgggacggatgcgatctcgactactattgtaacatgggcgattggccctcttgcacatacaccggggtcacacagcacaatcatgccgcttttgtgaacctgcttaatatcgagacggactataccaagacattccacttccactccaagagagtgaccgcccatggagatacaccccaactggacctcaaagcccgccctacctacggcgctggggagattacggtcctggttgaagtggccgatatggagctccacaccaagaaagtggaaatcagcggactgaagtttgcgtctcttgcttgcacaggctgttatgcctgcagctccggcatttcttgtaaagtccggatccatgtggacgagcccgatgaactgaccgttcacgtcaagagctccgaccctgatgtggtggccgctagcacatccctgatggccagaaaactcgagttcgggaccgactctacgtttaaggcgttcagcgctatgccgaagacatccctgtgcttttacattgttgagcgcgaatactgtaaatcttgcagcgaggatgacaccaagaaatgtgtggacaccaaacttgaacagccccagtccatcctgatcgagcataagggaacaattatcggcaagcaaaacgatacctgcacagccaaggcctcttgttggctcgaaagcgtcaaatccttcttttatgggctgaagaatatgctcggaagcgtgttcggcaactttttcattgggatcctgctttttctggctcctttcgtcctgctcgtgctgttctttatgttcggatggaaaattctgttttgcttcaagtgttgccggagaacccgcggcctgtttaaataccggcacctcaaggacgatgaggagacgggctatagacggatcatcgaacgcctgaataacaagaaagggaagaatagactcctggacggagagcggcttgccgatcgcaaaattgctgaactgttctctacaaagacccacatcggctga

SEQ ID NO: 13607 - RNA, 5067 nt, synthetic construct
  misc_feature 1..5067: note = derived and/or modified CDS sequence (opt5) from CCHFV(1-CR/HU-2015)__KU161584.1__GP
  source 1..5067: mol_type = other RNA
atgcccatcaacattatgcacaccctgctcgtgtgcttcatcctgtaccttcagctgctcggccttgggggagcccatgagcaaagcaatgctacagaccacaacagaacgaataccattacagccccttccacctctcagaacccgaagccccctgcgagcacaacaccccctcatacccccgaatcctctaccatcaaacttattacgagcaccggcgaggctgaagggtccggagagacaacccctccgctgaatacaacccagggcccctttcctcccgaaacgacatctgagcaccctgccagcaccgccacaaacacctccagcaccaattctatgaactccacaacgcagatgaccgataatacactcaccagcacagtctctacctccctgagcatctctccctccacgccgagcacatcccaagggatccattatcctgttcggtctctgctcagcgtgtccagccccaagaccgctgccacccctacacccatgtctacccgcgagatgtccagcgaaacatctagccagcactccgctatgtctagaacgcccaccttccacacagccacccaggtgagcacagagaacgcgaatcggtccacccctcgccagagcgaatcttccgcccaaccggctacgcagagccccatgacctctcctgcccagtccatttttctggtcagcgctgcccccacaaccatccagaacattcatccttcccccacaaatagatctaaacggaaccttgagatggagatcattctgaccctcccgcaaggactgaagaaatactatggcaagatccttaagctgctccacctgacgctggaagaggacacagaaggcctcctggagtggtgtaaacgcaatcttgggagcaactgcgatgacgagttctttcagaagagaattgaagagttctttatcaccggagaaggctacttcaacgaggtgctgcagtttaaaacactctccaccctgtctcctaccgaacccagccatgcgcggcctcccacagccgagcctttcaagtcctattttgctaaagggttccttagcatcgattctggatacttttccgccaagtgttatccccgcagctctacgtccggcctgcaactcattaatatcacccagcacccggctagaattgccgaaacacctgggcccaagaccacaagcctgaaaaccatcaactgcattaatctgcgggcctctgttttcaaggagcaccgcgaggtggaaatcaacgtcctcctgccccagatcgctgtgaatcttagcaactgtcatgttgtgattaattcccacgtctgcgactacagcctggatacggacggacctgtgagactcccgcggatctaccatgagggcacattcattcccggcacctataaaatcgtgattgataagaaaaacaagctgaatgaccgctgtacccttgtcacaaactgcgttatcaaagggagagaagtgcggaagggacagtctgtgctgagacaatacaagaccgagatcaaaattggcaaggcgtccacagggagccgcaaactcctgtccgaggaacctggagatgactgtatctctcggacgcagctgctcagaaccgagacagccgaaattcacgatgacaattatggcgggcccggagacaagatcaccatttgcaacggcagcacaatcgtcgatcagcgcctgggctccgagcttgggtgttacaccattaatcgggtgaaatcttttaagctgtgcgaaaacagcgctacgggaaagacctgcgagatcgactccacacctgttaaatgtagacagggcttctgcctcaagatcacccaagaggggcgcggacatgtgaaactgtctcggggcagcgaagtcgtgctggatgcctgtgactccagctgcgaggttatgattcccaaggggacaggcgatatccttgtggactgttctggaggccagcagcactttctcaaagataatctgattgacctggggtgccctcacatccccctcctgggaaagatggccatttatatctgtagaatgtccaaccatccgcgcaccacaatggctttcctgttttggttcagctttggctacgtcattacctgcatcttctgtaaggccctgttttattctctcatcattatcgggacgctggggaaaaagattaaacagtaccgggaactgaagcctcaaacatgcaccatctgtgagaccgcgcccgtgaacgctatcgatgccgaaatgcacgaccttaattgctcctacaacatttgcccttattgtgccagcagactcacatctgatggcctggctcgccatgtcacccagtgccccaaacggaaggagaaggtggaggaaacggagctgtacctcaatctggaaagaatcccgtggattgttcggaaacttcttcaggtgtccgagagcacaggggtcgccctcaagcgctccagctggctgatcgtgctgcttgttctcctgaccgtgtctctgagccctgtccagtccgctcccgtgggccacggaaaaacaattgaaacctatcaaacaagagagggcttcacctctatctgtctctttatgctggggagcatccttttcattgtgtcctgcctggttaagggactcgtcgactctgtgagcgactcctttttccctggcctgtctgtgtgtcggacgtgcagcatcgggtccattaacggattcgagatcgaaagccacaaatgttactgctctctgttttgttgcccctattgtagacattgctccgccgatcgcgagattcaccagcttcatctcagcatctgcaagaaacggaagaccggctctaatgtcatgctggcggtgtgtaagagaatgtgcttccgcgccacaatggaggcttccagacgggccctgctcattcgcagcatcatcaacaccacatttgttatttgtatcctgacccttacgatttgcgtggtctccacatctgctgtggaaatggaaaatctgcccgccgggacctgggagagagaggaagacctcacaaacttctgtcaccaggagtgccaagttaccgaaaccgagtgtctgtgcccttacgaggcgctggtgcttcggaaaccgctgtttctcgatagcatcgtcaagggcatgaaaaatctgctcaactccacaagcctggaaacgtctctttccattgaggccccctggggagctatcaatgtgcagagcaccttcaagcctacagtttctaccgccaacatcgctctgagctggtcctctgtggaacatcgcggcaataaaattctcgtcacagggagaagcgagtccatcatgaagctggaggaacggaccggagtgtcttgggacctgggcgtggaggatgccagcgaatccaaacttctgacggtcagcattatggacctctctcagatgtattcccccgtttttgagtacctgagcggggatcgccaggtggaagagtggcctaaggccacatgtaccggagactgccccgaaagatgtggctgcacctcctctacatgcctccacaaggagtggcctcacagccggaactggcgctgtaatccgacctggtgctggggagtgggcacaggatgtacgtgctgtggcgtcgatgtgaaagacctgttcaccgatcatatgtttgttaagtggaaagtggagtacatcaagacagaagctattgtctgcgtggagcttacctcccaagaaagacagtgttctctgatcgaggcggggacacggttcaacctcggacccgttaccatcacgctgagcgaacctagaaacattcagcagaagctgccccctgagatcattacccttcaccccaaaatcgaggaaggctttttcgacctgatgcatgtgcaaaaggtcctctccgccagcacagtgtgcaaactgcagtcttgtacccacgggattccgggagatctccaggtttatcatatcggcaatctgcttaagggcgaccgcgtgaacgggcacctgattcacaaaatcgagcctcattttaatacatcctggatgagctgggacggatgcgatctggactactattgtaacatgggcgattggccctcttgcacctacacaggggtcacgcagcacaatcatgctgccttcgtgaacctcctgaatatcgaaaccgactatacaaagaccttccactttcactccaagcgggtgaccgcccatggagatacaccccaacttgacctgaaagctagacctacgtacggcgccggggagattaccgtcctcgttgaggtggcggatatggaactgcacacaaagaaagtggagatcagcggactcaagttcgcttctctggcctgcaccggctgttatgcctgcagctccggcatttcttgtaaagtccgcatccatgtggacgaacccgatgagcttacagttcacgtcaagagctccgaccctgatgtggtggctgccagcacctccctgatggcgcggaaactggaatttgggacggactctacattcaaggcttttagcgccatgccgaagacctccctctgcttctacattgttgagagagagtactgtaaatcttgcagcgaagatgacaccaagaaatgtgtggacacaaagctggagcagccccagtccatccttatcgaacataaaggaaccattatcggcaagcaaaacgatacatgcaccgccaaggcttcttgttggctggagagcgtcaaatcctttttctatgggctcaagaatatgctgggaagcgtgtttggcaacttctttattgggatcctcctgttccttgcccctttcgtcctgctggtgctctttttcatgtttggatggaaaattctgttctgctttaagtgttgccgccggacgagaggccttttcaaataccgccacctgaaggacgatgaagagacaggctatcggagaatcatcgagcggctcaataacaagaaagggaagaatcgcctgctcgacggagaaagactggctgatcggaaaattgccgagctgttttctaccaagacacacatcggctga

SEQ ID NO: 13608 - RNA, 5067 nt, synthetic construct
  misc_feature 1..5067: note = derived and/or modified CDS sequence (opt5) from CCHFV(V42/81)__GU477490.1__GP
  source 1..5067: mol_type = other RNA
atgcccaccaacacaatgcacacgctgctcgtgtgcttcatcctgtaccttcagctgctcggccttgggggagcccatgtccaacctaatgctaccgagcacaacagaacaaataccacaaccgccccgggcacaagccattcccttaagcccctggtttctaccacgcctccccaggcgcctgaaagctccaccattaaacccacaacccctacatctgagaccgaagggagcggagaggctacgccgctctccaacacaatccaggccccctctagccctgaaaccacatccgagcggcccgccaccgctgtgattagcacctctggcacagactccacgaatagcaccacacagaccacagataacaatcctaccacgacagtggggacctctccctccagctctccgtccacccctagcacaccccaaggaatccaccatcacgcccgctccctgctgtctgtcaccagccctgagacagtgacgacccccaagcccacatcccctagagaaatgagctctgagacctccaaccagcacagcgctatgtctcggacaccgacccatcacacggttacccaggtgagcacagaaaatacctcccattctacaccccgccagcctgagagctccgcccaacccacctcctcttcccctatgacgagccccgcgcagtctacactcctgatgtccgccgctccgaccgccgtccagagcattcacccttcccccacaaacagatctaaacggaatcttgagaccgaaatcatcctgaccctcagccagggcctgaagaaatattacggcaagattcttaagctgctccacctgacactggaggaagacacggaggggctcctggaatggtgtaaacgcaaccttggatccaattgcgatgacgactttttccaaaagagaatcgaggagtttttcatgaccggcgaagggtattttaacgaggtgctgcagttcaaaacaccttctaccgttagccccacagaaccttcccatgctcggctccccaccgccgagccgtttaagagctacttcgcgaaaggatttctgtctattgactccggctatttcagcgccaagtgttactctcgctccagcacgtctgggcttcagctgatcaatgtgacacaacaccctgctagaattgccgaaacccccggacccaagaccacaagcctcaaaaccatcaactgcattaacctgcgggcttccgtctttaaggagaatcgcgagatcgaaatcagcgtgctgctccctcagattgccgtgaacctgtctaattgtcatgtcgttatcaactcccacgtgtgcgattatagccttgacacagatggcccggtgagactgccccggattaatcatgagggcacgttcatccctgggacctacaaaattgtcatcgacaagaaaaacaagctcaatgatcgctgtacactggtgaccaactgcgttatcaaaggaagagaagtgcggaagggccagtccgtccttagacagtacaagacagagattaaaatcgggaaggcctctaccggaagccgcaaactgctctccaaggaacccggcgacgattgtatttctcggacgcaactgatgagaaccgagacagctgagatccacgacgacaattatgggggacctggcgataaaattaccatctgcaacggcagcacaatcgtggaccagcgcctggggtccgaactcggatgttacaccattaatcgggttaagtcttttaagctgtgcgagaacagcgcgacaggcaaagcctgcgaagtggattccacccccgtcaagtgtagacaggggttctgccttaaaatcacgcaggagggacgcggccacgtgaagctgagccgggggtctgaggtcgtgctcgacgcttgtgattccagctgcgaagttatgattcctaaaggcacaggagacatcctggtggattgttctggcgggcaacagcatttcctgaaggacaatcttattgatctcgagtgcccccacatcccgctgctgggaaagctcgccatttatatctgtagaatgtccaaccatcctcgcaccaccatggcctttctgttctggtttggcttcgggtacgtcatcacatgcattctttgtaaagctctgttttatagcctcatcattatcggaaccctgggcaagaaaattaagcagtaccgggaactgaaaccccagacgtgcacaatctgtgagaccgcccctgtgaatgcgatcgacgctgaaatgcacgatcttaactgctcttataacatttgcccctactgtgcctccagactcacaagcgacgggctggcccgccacgttacccaatgcccgaagcggaaggagaaagtggaggaaacagagctgtacctcaatctggaaagaatcccttggattgtccggaagctgctccaggtgtccgagagcaccggcgtggttctgaaacgctctagctggctgatcgtcctgcttgtgctcctgacggtgtccctgtctcccgtccagagcgctcctgtgggacatggcaagaccattgaaacatatcagaccagagaggggttcacatccatctgtctctttatgctgggatctatccttttcattgttagctgcatcgtgaaaggcctggtcgactccgtgtctgatagctttttccccgggctctccgtttgtaagacctgcagcatttcttccatcaacggatttgagattgaaagccacaaatgttactgctctctgttctgttgcccctattgtcggcattgctccgccgacagagagatccaccaactgcatcttagcatctgccgcaagcggagaacgggctccaatgtgatgctcgctgtctgtaagcgcatgtgctttagagccacaattgaagtgtctcggcgcgcgctgctgatcagaagcattatcaacaccacattcgttatttgtatcctcaccctgaccatttgcgtggtctccacaagcgccgtggagatggaaaatcttcctgctgggacgtgggagcgggaggaagatctgaccaacttctgtcaccaggagtgccaggtgacagaaaccgagtgtctctgcccgtacgaggccctggtcctgcgcaaacccctttttctggactctatcgttaagggcaaaaagaatctcctgaactccacaagcctcgaaacctctctgagcatcgaggctccttggggagccattaatatccaatccacgttcaaacccacagtgtctgcggccaacattgctcttagctggtcctctgtggaacacagaggcaataagatcctggtcagcgggcggtccgagagcattatgaagctcgaggaacgcaccggagtgtcttggaacctgggcgttgaggatgcctccgaaagcaaactgcttaccgtgtccatcatggacctgtctcagatgtatagccctgtctttgagtacctctccggggatagacaggtggaagagtggcccaaggctacatgtaccggagactgccctgaacggtgtggctgcacatctagcacgtgcctgcataaagagtggccgcactcccgcaattggagatgtaaccccacctggtgctggggcgttgggacaggatgtacctgctgtggcgtggatgtcaaggacctcttcatcgatcatatgtttgtgaaatggaaggttgagtatattaagacagaagccatcgtgtgcgtcgagctgaccagccaggaacggcaatgttctcttattgaggccgggacgagattcaatctgggacctgtgaccatcacactctccgaaccccgcaacattcagcagaaactgcctcccgagatcatcaccctgcacccgaagattgaggaaggctttttcgaccttatgcatgtgcagaaagtcctgagcgcttctacagtttgcaagctccaatcctgtacccacgggatccctggagatctccaggtgtaccacattggcaacctgctgaaaggcgaccgggtgaatgggcatcttatccacaagattgagccccattttaacacaagctggatgtcttgggacggatgcgatctggactactattgtaatatgggcgattggcccagctgcacgtacaccggggtcacacagcacaaccacgcggccttcgtgaatctgctcaacatcgaaaccgactataccaagacatttcatttccactccaaaagagttacggctcatggagagacccctcagctggatcttaaggcccgccccgcctacggcgctggggagattacagtgctggtcgaagtggccgacatggagctccacaccaaaaaggttgaaatctctggactgaaatttgcgagcctcgcttgcacaggctgttatgcctgctccagcggcatctcctgtaaggtgcggattcatgtcgatgagcctgacgaactgaccgtgcacgtcaaatctaatgatccggacgtggttgccgctagcacgtcccttatggccagaaagctggagtctgggacagatagcaccttcaaggcgttctccgctatgcccaaaacctctctgtgcttttacatcgtggagcgcgaatattgtaagagctgctccgaggacgatacacaaaaatgtgtcgaaaccaagctcgagcagcctcagagcattctgatcgaacacaaaggaacaattatcggcaagcaaaacgatacctgcacggccaaggcctcttgttggcttgagtccgtgaaatctttcttttacgggctgaagaatatgctcggaagcgttttcggcaactttttcatcgggattctgctctttctggctcccttcgtgcttctggtcctgtttttcatgtttggatggaaaatcctcttctgcttcaagtgttgccggagaacacgcggcctgtttaaataccggcatcttaaggaggacgaagagaccggctatagacggattatcgaacgcctgaatagcaagaaagggaagaacagactcctggatggagagcggctcgccgaccgcaaaattgctgaactgttcagcacaaagacccacatcggctga

SEQ ID NO: 13609 - RNA, 5067 nt, synthetic construct
  misc_feature 1..5067: note = derived and/or modified CDS sequence (opt5) from CCHFV(ROS/HUVLV-100)__DQ206448.1__GP
  source 1..5067: mol_type = other RNA
atgcccaccaacatcatgcacacactgctcgtgtgcttcattctgtaccttcagctgctcggccttgggggagcccatagacaaagcaatgctacggagcacaacggcaccaatacaaccacagccccttccacctctcagagcccgaagccccttgtctccacagcgcctccccatgctctggaatctagcaccatcaaacctacgacccccgtttccgagacagaagggtctggagagaccacacctccgcccaacaccacgcagggccctagccctcccgaagccacacccgagcggccgaccacaaccgccacctccacacctagcacggacaataccaactctacaacccacgtgacagataataaccccacctccacgattagcacatctccttccagctctccctccacccccagcacccctcaggggatccatcacccggctcgcaatctcctgtccgtgtctagccccaagacagccaccacacctacgcccacctcccctggagagattagctctgaaacatccagcctgcactctgctatgagcagaacctccacactctataccgccacgcaagtctctaccgagaacgcgaatcatagcgctccccggcagtccgaaagctctgcccagcagacaaccacatccccgatgaccagccctgcccaatctatcctggtgatgtccgctgcccccacggcgatccagaacattcaccctagccccacaaatcgctccaaaagaaaccttgagatggagatcattctgaccctctctcagggcctgaagaaatactatggcaagatccttaagctgctccatctgacactggaagaggacaccgaagggctcctggagtggtgtaaacggaatcttggaagcaactgcgatgacgactttttccagaagcgcattgaagagtttttcatgaccggcgaggggtactttaacgaagttctgcaattcaaaacactctccacgctgtctcctaccgagcccagccacgccagaccgcctacagtggaaccctttaagtcctatttcgctaaaggatttcttagcatcgattctggctacttctccgccaagtgttatccccggctgagcacctctgggctccagctgattaatgtcacacagcaccctgctcgcatcgccgagaccccgggacccaagacgacatccctgaaaaccatcaactgcattaatctcagagccagcgtgtttaaggaacatcgggagatcgagattaacgttctgcttcctcaaatcgctgtgaatctgtctaactgtcacgtcgtgattaatagccatgtgtgcgattactccctcgacaccgatggccccgtccgcctgcctcacatctaccatgaaggcacattcatccccgggacctataaaattgttatcgacaagaaaaacaaacttaatgatagatgtacactggtgacgaactgcgtgattaagggacgggaggtccgcaagggccagagcgtgctcagacagtacaagaccgaaatcaaaattgggaaggcgtctacaggatcccggaaactgctgagcgaggaacctggcgacgattgtatctccagaacccagctcctgcgcacagagaccgccgagatccacgacgacaattatgggggacccggcgataagattacgatctgcaacggctctaccattgttgaccaacggcttgggagcgaactgggatgttacacaatcaatagagtgaaatcctttaagctctgcgagaactctgctaccggcaagacatgcgaaattgatagcaccccggtcaaatgtcgccaggggttctgcctgaagatcacacaggagggacggggccacgtgaaactgtccagagggtctgaggttgtgcttgacgcctgtgatagctcctgcgaagtcatgattcctaagggcaccggagacatcctcgtggattgtagcggcgggcagcaacatttcctgaaagacaatctgatcgatctcggatgcccccacattcctctgcttggcaagatggccatctatatttgtcgcatgtctaaccatccccggacgacaatggcttttctgttctggttttccttcgggtacgtcattacctgcatcttttgtaaggccctcttctatagcctgatcatcattggaaccctgggcaaaaagatcaaacagtacagagagcttaagccgcagacatgcaccatttgtgaaacggcgcctgtgaacgctatcgacgccgagatgcacgatctcaattgctcttacaacatttgcccctattgtgcctcccgcctgacaagcgacgggctggctcggcacgttcctcagtgccccaaaagaaaggaaaaggtggaggagaccgaactctacctgaatcttgagcgcatcccctggatcgtccggaaactgctccaagtgtctgaatccacaggcgttgccctgaagagaagctcctggctgattgtgcttctcgtcctgctgaccgtgagcctctctcctgtgcagagcgctccggttggacatggcaaaacaatcgagacctatcagacgcgggaagggtttacctccatttgtctgttcatgcttggatctatcctgtttctcgtcagctgcctggtgaagggcctggtggactccgtctctgatagcttctttcccgggctttccgtgtgtaaaacatgctctattggaagcatcaacggcttcgagatcgagtcccacaagtgttactgcagcctcttttgttgcccttattgtcgccattgctctgccgacagagaaattcaccagctgcatctgtccatctgcaaaaagcggaagaccgggagcaatgttatgctcgcggtgtgtaaaagaatgtgcttccgcgccacaattgaggcttctcggagagccctgcttatccgctccattatcaacaccacgttcgtcatttgtatcctgacactcaccatctgcgtggttagcacatccgctgtggaaatggagaatctgccctctggcacctgggaaagagaggaggatctgaccaacttttgtcaccaagaatgccaggtcacagagacggaatgtctttgcccttacgaggccctggtgctccggaagcccctgttcctcgacagcattgttaaaggaatgaagaatctgcttaactccaccagcctggagacatctctctccatcgaagcgccttggggcgccattaatgtgcagagcacctttaaaccgacagtctctaccgctaacatcgccctgagctggtcctctgtggagcaccgcgggaataagattctggtgacgggaagaagcgaatccatcatgaaacttgaggaacggacaggcgtctcttgggatctgggggttgaggacgctagcgagtccaagctcctgaccgtgagcatcatggatctctctcaaatgtattcccccgtgttcgaatacctgagcggagaccgccaggtcgaggaatggcctaaggccacctgtacaggcgattgccccgagagatgtgggtgcacctcctctacatgccttcataaagaatggcctcacagccggaactggcgctgtaatcccacgtggtgctggggcgtgggaaccggctgtacatgctgtggggttgacgtgaaggatctgtttaccgaccatatgttcgtcaaatggaaggtggagtacattaagacagaggccatcgtttgcgtggaactcacctcccaggagagacagtgttctctgattgaagctggaacgcggtttaacctgggcccggtcaccatcacacttagcgagcctcgcaacattcaacagaaactgcctcccgaaatcatcaccctccaccccaaggtggaggaggggttctttgatctgatgcatgttcagaaagtgctctccgcgagcacagtctgcaagctgcagtcttgtacccacggcattcccggagaccttcaagtgtatcacatcggcaatctgctgaaaggggacagagtgaacggacatctcattcacaagatcgaacctcatttcaatacatcctggatgagctgggatggctgcgacctggattactattgtaacatgggggactggccgtcttgcacgtacaccggagtcacacagcacaatcacgccgcttttgttaaccttctgaatattgagaccgattataccaagacattccattttcactccaaacgggtgacggcccatggcgacacaccccagctcgatctgaaggccagacctacatacggggctggagaaatcaccgtgctcgtcgaggtggccgacatggagctgcacaccaaaaaggttgaaattagcggccttaaattcgcgtctctggcttgcaccggctgttatgcctgcagctccgggatctcttgtaaggtgcgcatccatgtcgatgagcccgacgaactgacggtgcacgttaaaagctccgatcctgacgtggtcgccgctagcacatccctcatggcccggaagctggagttcggaaccgattctacctttaaggcgttcagcgctatgcccaaaacatccctttgcttttacattgtggaaagagagtactgtaagtcttgcagcgaggaagacacccagaaatgtgtcgacacaaagctggagcaaccgcagtccatcctcattgaacacaaaggcaccatcattgggaagcagaacgatacgtgcacagccaaggcctcttgttggctggagagcgtgaaatccttcttttatggactcaagaatatgctgggcagcgttttcgggaactttttcatcggaatccttctgtttctggctcctttcgtgctcctggtcctgtttttcatgttcggctggaaaattctgttttgcttcaagtgttgccgccggaccagaggcctcctgaaataccgcctcctgaaggacgatgaagagacagggtatcggagaatcattgagcgccttaataacaagaaaggaaagaatcggctgctggacggcgaaagactcgccgatcggaaaatcgctgagctgttttctaccaagacgcatattgggtga

SEQ ID NO: 13610 - RNA, 5067 nt, synthetic construct
  misc_feature 1..5067: note = derived and/or modified CDS sequence (opt5) from CCHFV(5180-R-2011)__KR814874.1__GP
  source 1..5067: mol_type = other RNA
atgcccaccaacatcatgcacacactgctcgtgtgcttcattctgtaccttcagctgctcggcctgggaggagcccatagacaaagcaatgctacggagcacaacggcaccaatacaaccacagccccttccacctctcagagcccgaagccccctgtctccacagcgcccccttatgctcccgaatctagcaccatcaaacctacgaccccggcctccgagacagaagggtctggagagaccacaccccctcccaacaccacgcagggccctagcccgcccgaagccacacctgagcggcccgctaccacagccacctccacccctagcacagacaatacgaactctaccacacatgctaccgataataaccccacatccaccattagcacgtctccctccagctctccttccacaccgagcacaccccaggggatccaccatcctgcccgcaatcttctgtccgtttctagccccaagaccgcgaccacccctacacccacgtccccgggagacattagctctgagacctccagcctccactctgccatgagcagaacacctaccctgcacacagctacccaagcctccacggaaaacgctaatcattctgcgccccggcagagcgagtccagcgcccagcagaccacaacctctcctatgacatcccccgcccaacctatcctggtgatgagcgctgcccccaccgctatccagaacattcacccgtctcctacgaatcgctccaaaagaaacctcgaaatggagatcattctgacacttagccagggcctgaagaaatactatggcaagatcctcaagctgcttcatctgaccctcgaggaagatacagaggggctgctggaatggtgtaaacggaatctcggatccaactgcgacgatgactttttccagaagcgcattgaggaatttttcatgaccggcgaggggtactttaacgaggtgctgcaattcaaaaccctttctacactgagccccacggaaccctcccacgccagacctccgaccgtcgagccctttaagtcttatttcgccaaaggatttctcagcatcgattccggctacttcagcgctaagtgttatcctcggctgtctacatccgggcttcagctgattaatgtgacccagcaccccgcgcgcatcgccgaaacacctggacccaagaccacgagcctcaaaacaatcaactgcattaatctgagagcttctgtttttaaggagcatcgggaaatcgagattaacgtgctgctccctcaaatcgccgtcaatctgtccaactgtcacgtggttattaatagccatgtgtgcgactactctcttgataccgacggccccgtccgcctgccgcacatctaccatgagggcaccttcatccctgggacatataaaattgtgatcgataagaaaaacaagctcaatgacagatgtaccctggtgacaaactgcgtcattaaaggacgggaaatccgcaagggccagagcgttcttagacagtacaagacggagattaaaatcgggaaggcctccaccggaagccggaaactgctctctgaggaacccggcgatgactgtatctccagaacacagctgctgcgcaccgaaacagctgagattcacgacgataattatgggggacctggcgacaagatcaccatttgcaacggcagcacgatcgtggatcaacggctcgggtccgagctgggatgttacaccattaatagagtgaaatcttttaaactttgcgaaaacagcgccacaggcaagacctgcgagatcgactccacacccgtcaaatgtcgccaggggttctgcctgaagattacccaggaaggacggggccacgtgaaactctctagagggagcgaggttgtgctggatgcgtgtgacacatcctgcgaggtcatgatcccgaagggcaccggagatatcctggtggactgttctggcgggcagcaacatttccttaaagataatctcattgacctgggatgccctcacatccccctgctcggcaagatggctatttatatctgtcgcatgagcaaccatcctcggacgacaatggcctttctgttctggttttccttcgggtacgttattacctgcatcttttgtaaggcccttttctatagcctgatcattatcggaaccctcggcaaaaagattaaacagtacagagaactgaagccccagacatgcaccatctgtgagacggctcccgtgaacgccattgatgctgaaatgcacgacctgaattgctcttacaacatctgcccttattgtgcctcccgccttacaagcgacgggctcgcgcggcacgtcccgcagtgccccaaaagaaaggagaaggtggaagagaccgagctgtacctgaatctcgaacgcatcccttggattgtccggaaactgcttcaagtgtctgagtccacaggcgttgccctgaagagaagctcttggctcatcgtgctgctggtccttctcaccgtgtccctgagccccgttcagtccgctcctgtgggacatggcaaaacaattgaaacctatcagacgcgggaggggtttaccagcgtctgtctgttcatgctcggatctatcctgtttcttgtgagctgcctggtgaagggcctcgttgattccgtctctgacagcttctttcccgggctgtccgtgtgtaaaacatgctctattggaagcatcaacggcttcgaaatcgagtcccacaagtgttactgctctctgttttgttgcccttattgtcgccattgcagcgccgatagagagattcaccagcttcatctctccatctgcaaaaagcggaagatggggagcaatgtgatgctggctgtctgtaaaagaatgtgcttccgcgccaccattgaagcgtctcggagagccctgctcatccgctccattatcaacacaaccttcgtgatttgtatcctgacgcttacaatctgcgttgtgagcacctctgctgtcgagatggaaaatctgccgtccggcacatgggagagagaagaggacctcaccaacttttgtcaccaagagtgccaggtgaccgaaacagagtgtctgtgcccctacgaagccctggttcttcggaagcctctgttcctcgatagcattgtgaaaggaatgaagaatctgctcaactccacgtctctggagaccagcctttccatcgaggctccctggggcgccattaatgtccagagcacatttaaacctaccgtgtctacagccaacatcgctctgtcctggagctctgttgaacaccgcgggaataagattctcgtgaccggaagaagcgagtccatcatgaagctggaggaacggacgggcgtctcttgggacctgggggtggaagatgcgagcgagtccaaacttctgacagtgtctatcatggacctcagccaaatgtattcccccgtcttcgagtacctgagcggagatcgccaggttgaagagtggccgaaggccacctgtaccggcgactgccctgaaagatgtgggtgcacatcttccacatgcctccataaagagtggccccacagccggaactggcgctgtaatcccacctggtgctggggcgtgggaacgggctgtacctgctgtggggtggatgtcaaggacctgtttacagatcatatgttcgtgaaatggaaggttgaatacattaagaccgaggctatcgtgtgcgtcgagcttacatcccaggaaagacagtgttctctgattgaggccggaacccggtttaacctcggccctgtgacgatcaccctgagcgaaccccgcaacattcaacagaaactgcctccggagatcatcacacttcaccccaaggttgaagaggggttctttgacctgatgcatgtgcagaaagtcctctccgcctctaccgtgtgcaagctgcagagctgtacacacgggattcctggcgacctccaagtttatcacatcggcaatctgcttaaaggggatagagtgaacggacatctgattcacaagatcgagccccatttcaatacctcctggatgagctgggacggctgcgatctggactactattgtaacatgggggattggccttcttgcacatacacgggagtcacccagcacaatcacgctgcctttgtgaacctcctgaatattgaaacagactataccaagaccttccattttcactccaaacgggtgacagcgcatggcgatacgccccagcttgacctgaaggctagaccgacctacggggccggagagatcacagtcctcgttgaagtggccgatatggagctgcacaccaaaaaggtggagattagcggcctcaaattcgcttctctggcctgcacaggctgttatgcgtgctccagcgggatctcttgtaaggtccgcatccatgtggacgaacctgatgagcttaccgttcacgtgaaaagcaacgaccccgatgtcgtggctgcctccacgtctctgatggcccggaagctggaatttggaacagacagcacctttaaggctttctccgccatgcctaaaaccagcctctgcttttacattgttgagagagaatactgtaagtcctgctctgaggaggacacacagaaatgtgtggataccaagctggaacaaccccagagcatccttattgagcacaaaggcacaatcattgggaagcagaatgatacctgcacggctaaggcctcctgttggctggaatctgtcaagagcttcttttatggactcaagaacatgctgggctccgtgttcgggaatttcttcatcggaatcctcctgtttcttgcgcctttcgtcctgctggtgctctttttcatgttcggctggaaaattctgttttgcttcaagtgttgccgccggacaagaggccttctgaaataccgcctcctgaaggacgacgaggaaaccgggtatcggagaatcattgagcgcctcaacaataagaaaggaaagaaccggctgcttgatggcgagagactggccgaccggaaaatcgctgaactgttttctacaaagacccatattgggtga

SEQ ID NO: 13611 - RNA, 5067 nt, synthetic construct
  misc_feature 1..5067: note = derived and/or modified CDS sequence (opt5) from CCHFV(5170-R-2011)__KR814873.1__GP
  source 1..5067: mol_type = other RNA
atgcccttcaacatcatgcacaccctgctcgtgtgctttattctgtaccttcagctgagcggcctcgggggagcccatggccaatccaatgagacagaacacaacgggacgaataccacaaccgtccctggaacatctcagagcccgaagccccctgcttccaccacactgcagcatacccccgagtctagcacggttaaacttaccacacctacctccgaaacagagggctctggggaaaccacgccccctccgaacacaacccagggactgccccctcccggcacaacccctgagagaagcgccaccacagcgacgtccaccagctctacagacaatatgaactccaccacacaagtgaccgataatacgcccacaagcaccgtgtctatctccccgtcctcttcccctagcatgccctccacctctcagggcattcactatcctatccggagcctcctgtccgtcagctctcccaagacagtgaccacacccacgcctatttccccgggggagatgagccccgaaacctctagccagcattccgctatgtctcgcatccctacactgtacaccgccacacaggttagcaccgagaacacgaatagatccacaccccggcaaagcgaatcttccgtgcagcctgccacccagagccccatcacctctccggctcagacaattctcctgatgtccgccgctcctaaagccatccaagacatgcaccccagccctaccaaccgctccaagagaaatcttgaggtcgagattatcctgacgctctctcagggactgaaaaagtattacggcaagattcttaaactgctccacctgacactggaagaggataccgaagggctcctggagtggtgtaagcggaaccttggaagcaattgcgacgatgacttctttcagaaacgcatcgaagagttctttattacaggcgaggggtatttcaacgaagtgctgcaatttaagaccctctccaccctgtctcccacagagcttagccatgttagactgcctacggcggaacccttcaaatcctactttgccaagggattcctcagcatcgattctggctatttttccgctaagtgttacccgcggagctctacctccggcctgcagctgatcaatgtgacacagcaccctgcccgcattgctgagacccccgggcccaaaacaaccagcctcaagacgatcaactgcattaacctgagagcctctgtcttcaaagaacatcgggaggtggagatcaatgtgcttctgcctcagattgcggtcaacctcagcaattgtcacgttgtgatcaactcccacgtgtgcgactacagcctggatacagacggaccggtccgccttcccagaatccatcacgaaggcacctttattcctgggacctataagatcgtgattgataaaaagaataaactgaacgaccggtgttctctcgttacaaattgcgtgatcaagggacgcgaggtcagaaagggccaatccgtgctgcggcagtacaaaaccgaaattaagatcgggaaagccagcacaggatccagaaagctgctctctgaggaacccggcgatgactgtatcagccgcacgcagctgcttaaaaccgagacagctgagattcatgacgataactatggcgggcctggagacaagatcaccatttgcaatggctccacaatcgttgatcagcggctggggtctgaactcggatgttacaccattaacagagtcaagagcttcaaactgtgcgagaatagcgccacgggcaagacctgcgaaatcgactctacacccgtgaaatgtcgccaagggttctgcctgaagattacccaggagggccggggacacgtgaaacttagcagaggctccgaggtcgtgctcgatgtttgtgacagctcttgcgaaatcatgatccctaaggggacaggagatattctggtggactgttccggcgggcagcagcattttctgaaggataacctcatcgacctgggatgcccccacattccgcttctgggcaaaatggctatctatatttgtcgcatgagcaatcaccctcggaccacaatggccttcctcttttggttctcttttgggtacgtcattacctgcatcttctgtaaggccctgttttattccctgatcatcattggcacgcttgggaaaaagatcaaacaatacagagagctcaagccccagacatgcaccatttgtgaaaccgctcctgtgaacgcgatcgatgccgagatgcatgacctgaattgcagctacaacatctgcccctattgtgcttctcgcctgacatccgaaggcctcgcccggcacgttacccagtgcccgaagagaaaagagaaggtggaggaaacggagctgtaccttaacctggaacgcattccttggatcgtccggaaactccttcaggtgagcgagtccacaggggtggccctgaagagaagctcttggctgattgttctcctggtcctgctcaccgtgagcctgtcccccgtgcaatctgctcctgtcggacatggcaaaacaatcgaaacctatcagacacgggaggggttcaccagcatttgtctttttatgctgggatccatcctcttcatcgtgtcttgcctggttaagggcctggtggacagcgtctccgatagctttttccccgggcttagcgtgtgtaaaacgtgctccattggcagcatcaatggatttgagattgaatctcacaagtgttactgctccctcttctgttgcccctattgtcgccactgcagcgccgacagagagatccatcagctgcacctgtctatttgcaagaaacggaagaccggctccaacgttatgctcgcggtgtgtaaaagaatgtgcttcaaggctacaatcgaagccagccgccgggccctgcttattagatccatcatcaataccacatttgtcatttgtatcctgaccctcgctatttgcgtggtttctacgagcgccgtggagatggaagatctgcctgctgggacatgggagcgcgaggaagacctgaccaacttctgtcatcaagagtgccaggtcacagaaaccgagtgtctttgcccgtacgaggccctggtgctcagaaaacccctgtttctcgattccatcgtgaagggaatgaagaatctgcttaacagcacctctctggaaacatccctcagcattgaggcgccttggggcgccatcaatgtccagtctacgttcaaacccaccgttagcacagctaacatcgccctgtcctggtctagcgtggaacaccgggggaataagattctggtgaccggacgctccgagtctatcatgaaacttgaagagagaacaggcgtcagctgggacctgggggtggaggatgcttccgaaagcaagctcctgaccgtttctattatggacctctcccagatgtatagccctgtgtttgagtacctgtccggcgatcggcaagtcgaagagtggcccaaagccacgtgtacaggagactgccctgaacgctgtggctgcacctcttctacctgccttcataaggagtggccgcactccagaaactggcggtgtaatcccacatggtgctggggagtgggaaccggctgtacatgctgtggggttgatgtgaaggacctgttcacggatcacatgtttatcaaatggaaggtcgagtacattaaaaccgaagcgatcgtgtgcgttgagctcacatctcaggaacgccagtgtagcctgatcgaggccggaaccagattcaacctgggccctgtgacaattaccctttccgaaccccggaatatccagcaaaagctgcctcccgagattatcacgctccatccgaaaattgaggaaggctttttcgacctgatgcacgtccagaaggtgctcagcgcttctaccgtgtgcaagctgcagtcctgtacacatgggatccctggagaccttcagatttatcacatcggcaacctgctgaaaggggatcgcgtcaatggacatctcatccacaagattgagccccactttaacaccagctggatgtcttgggacggctgcgatctggactactattgtaacatgggggattggccctcctgcacatacaccggagttacacaacataatcacgccgctttcgtgaaccttctgaatatcgaaacggactataccaaaacatttcatttccacagcaagagagtgaccgcccacggcgatacccctcagctcgacctgaaagcccggcccacatacggcgctggggagattacggtcctcgtggaggttgcggatatggaactgcataccaagaaagtggagatctctggacttaagttcgccagcctgacatgcaccggctgttatgcttgctcctctgggattagctgtaaggtcagaatccacgtggacgaacctgatgagctgacagttcatgtgaaatccagcgacccggatgtcgtggccgcctccacctctctcatggctcgcaagctggaatttggaacggacagcacattcaaagccttttccgcgatgcccaagacctctctttgcttctacatcgtcgagcgggagtactgtaaaagctgctccgaagacgataccaagaagtgtgtggacacaaaactggagcagcctcaatctattctcatcgaacacaagggcaccattatcgggaaacagaacgatacatgcaccgctaaggccagctgttggctggagtccgttaagagctttttctatggactcaaaaatatgctgggctctgtgtttggctccttctttgtcgggattcttctgttcctggccccctttgtgctcctggttcttttcttcatgtttggatggaagatcctgttctgctttaaatgttgcagacgcacgcggggcctcttcaagtacagacatctgaaagacgatgaagagacagggtatcgccggatcattgagagactcaacagcaagaaaggaaagaatcgcctgcttgacggcgaacggctggctgatagaaagatcgccgagctgttttctaccaaaacacacattgggtga

SEQ ID NO: 13612 - RNA, 5067 nt, synthetic construct
  misc_feature 1..5067: note = derived and/or modified CDS sequence (opt5) from CCHFV(4701-ST-2009)__KR814872.1__GP
  source 1..5067: mol_type = other RNA
atgcccatcaacattatgcacaccctgctcgtgtgcttcatcctgtaccttcagctgagcggcctcgggggagcccatggccaatccaatgctacagagcacaacgggacgaataccacaaccgcccctggaacatctcagagcccgaagccccctgcgtccaccacactgccccatacccctgaatctagcacggtcaaacttaccacacccacctccgagacagaaggctctggggagaccacgcctccgcccaacacaacccagggactgcctctcacaggcaccacccccgaaagaagcgctacaacggccacctccacaagctctaccgacaatatgaactccacaacccaggttacggataatacacctaccagcaccgtgtctatttcccccagcagctccagctccatgccgtctacacctcaaggcacccaccatcccgtgcggagcctgctgtccgtcagctctcctaagacagtgacgacccccacacccatgtcccctggggagatgagcccggagacctctagccagcactccgccatgtctcgcgttcccacactctataccgctacccaggtgagcacggaaaacacagacagatccacccctcggcagagcgagtcttccgtccaacccgccacacagagccctatcacctctcccgctcagacgattctgcttatgtccgccgcgccgaaagccatccaggatatgcaccctagccccacaaatcgctccaagagaaacctggaagtggagatcattctcaccctgtctcaaggacttaaaaagtactatggcaagatcctgaaactcctgcatctgacactcgaggaagacaccgaggggctgcttgaatggtgtaagcggaatctgggaagcaactgcgatgacgatttcttccagaaacgcattgaggaatttttcatcaccggcgaggggtactttaatgaggttctccagttcaagacactgtccacgctttctcctaccgaacccagccacgtgagactgcctacagctgagccctttaaatcctatttcgccaagggatttctcagcattgactctggctacttctccgctaagtgttatccgcggagctctacctccggcctgcaactgatcaacgtcacacagcatcctgcccgcattgcggaaacccccgggcccaaaacgacaagcctcaagaccatcaattgcatcaacctgagagcctctgtgtttaaagagcaccgggaagtggagattaacgtccttctgcctcagatcgctgttaatctcagcaactgtcacgtggtgattaattcccatgtctgcgattacagcctggacaccgatggaccggtgcgccttcccagaatccaccatgagggcacattcattcctgggacctacaagatcgttatcgaccggaaaaacaagctgaatgatcgctgttctctcgtgacaaactgcgtcattaaaggaagagaagtgcggaagggccagtccgttctgagacaatataagacggagatcaaaattgggaaggccagcaccggatcccgcaaactgctctctgaagaacccggcgacgactgtatcagccggacacagctgcttaagaccgaaacagctgagattcacgatgacaattacggcgggcctggagataaaatcaccatctgcaacggctccacggtggtcgaccagagactggggtctgagctcggatgttataccattaatcgcgtcaagagctttaagctgtgcgaaaactccgccacaggcaaaacctgcgagatcgattctacacccgtgaagtgtcggcaggggttctgcctgaaaattacccaagaaggcagaggacatgtgaaacttagccgcggctccgaggttgtgctcgacgcctgtgatagctcttgcgagatcatgattcctaaggggacaggagacatcctggtcgattgttccggcgggcagcagcacttcctgaaggacaatctcattgatctgggatgcccccacatcccgcttctgggcaagatggctatctacatttgtcggatgagcaaccatcctagaaccacgatggcgtttctcttctggttttctttcgggtatgtgatcacatgcatcttttgtaaagccctgttctactccctgattattatcggcacccttggaaagaaaatcaagcagtatcgcgaactcaaaccccaaacctgcacaatttgtgagaccgctcctgttaatgccatcgacgccgaaatgcacgacctgaactgcagctacaatatttgcccctactgtgcttctcggctgacgtccgatggcctcgccagacatgtgacacagtgcccgaagcgcaaggagaaagtcgaagagaccgagctgtatcttaacctggaacggatcccttggattgtgagaaagctccttcaggtgagcgagtccacaggggttgcgctgaaacggagctcttggcttatcgtcctcctggtgctgctcaccgtgagcctgtcccccgtccagtctgctcctgtgggacacggcaagacaatcgaaacctaccaaacgcgcgaggggtttaccagcatttgtcttttcatgctgggatccatcctctttattgtttcttgcctggtgaaaggcctggtcgacagcgtgtccgattctttctttcccgggcttagcgtttgtaagacatgctccatcggcagcattaacggattcgaaatcgagtctcacaaatgttattgctccctcttttgttgcccctactgtagacattgcagcgccgaccgggagatccaccagctgcatctgtctatttgcaagaagagaaaaaccggctccaatgtgatgctcgccgtctgtaagcgcatgtgcttcaaagctacaatcgaagccagccggagagctctgcttattcgctccatcattaacaccacgttcgtgatgtgtatcctgacactcgccatttgcgttgtgtctaccagcgcggtcgagatggaagatctgcctgccgggacatgggagagagaagaggacctgaccaatttttgtcaccaggagtgccaagtgaccgaaacagagtgtctttgcccgtatgaagctctggtgctccggaagcccctgttcctcgattccatcgtcaaaggaatgaagaacctgcttaatagcacgtctctggagacctccctcagcatcgaggccccttggggcgctattaacgttcagtctacatttaagcccaccgtgagcacagccaatatcgcgctgtcctggtctagcgtggaacatcgcgggaacaaaattctggtcaccggaagatccgagtctatcatgaaacttgaggagcggacgggcgtgagctgggacctgggggttgaagatgcctccgagagcaagctcctgacagtgtctattatggacctctcccagatgtacagccctgtcttcgagtatctgtccggcgatcgccaggtggaagagtggcccaaggctacctgtaccggagactgccctgaaagatgtggctgcacatcttctacctgccttcacaaagagtggccgcactcccggaattggcgctgtaaccccacatggtgctggggagttgggacgggctgtacctgctgtggggtggatgtcaaggacctgtttacagaccatatgttcatcaagtggaaagtggaatacatcaagaccgaggccattgtttgcgtggagctcacatctcaagaaagacagtgtagcctgatcgaggctggaacccggtttaatctgggccctgtcacgattaccctttccgaaccccgcaacatccagcagaaactgcctcccgagattatcacactccacccgaagatcgaagagggcttctttgatctgatgcatgtgcaaaaagtgctcagcgcctctaccgtctgcaagctgcagtcctgtacacacgggattcctggagaccttcagatctaccatattggcaatctgctgaagggggatagagttaacggacacctcatccacaaaattgagccccatttcaataccagctggatgtcttgggacggctgcgatctggactattactgtaacatgggggattggccctcctgcacatatacgggagtgacccagcacaaccatgccgcttttgtgaatcttctgaacatcgaaacagactacaccaagaccttccactttcacagcaaacgggtcacagcgcatggcgatacgcctcaactcgacctgaaggccagacccacctatggcgctggggagattacagtgctcgttgaagtggccgatatggagctgcacaccaaaaaggtcgagatctctggacttaaattcgccagcctgacatgcaccggctgttacgcttgctcctctgggatcagctgtaaggtgcgcattcatgttgacgaacctgatgagctgacggtgcacgtcaagtccagcgacccggacgtggtcgccgcgtccacatctctcatggctcggaaactggaatttggaaccgatagcacctttaaggccttctccgccatgcccaaaacatctctttgcttttatatcgtggagagagaatactgtaagagctgctccgaggacgataccaaaaagtgtgttgacacaaagctggagcagcctcagtctattctcatcgaacataaaggcaccattatcgggaagcaaaatgatacgtgcacagctaaagccagctgttggctggagtccgtcaagagcttcttttacggactcaaaaacatgctgggctctgtgttcggcgggtttttcgtgggaatccttctgtttctggcgcccttcgttctcctggtgctgtttttcatgttcggctggaagattctgttttgcttcaagtgttgccgccggaccagagggctctttaaatatcgccacctgaaggacgatgaagagacaggataccggagaatcattgaacgcctcaattccaaaaagggcaaaaaccggctgcttgacggggagagactggctgatcggaagatcgccgagctgttcagcaccaagacgcacattggatga

SEQ ID NO: 13613 - RNA, 5067 nt, synthetic construct
  misc_feature 1..5067: note = derived and/or modified CDS sequence (opt5) from CCHFV(4574-ST-2008)__KR814870.1__GP
  source 1..5067: mol_type = other RNA
atgcccaccaacatcatgcacacactgctcgtgtgcttcattctgtaccttcagctgctcggccctgggggagcccatggccaaccgaatgctacggagcacaacagaaccaatacaaccacagcccccagcacctcccagtctcctaagccccctgtcagcacagcgccccctcatgctctggaatccccgaccatcaaatctacgacccccacaagcgagaccgaagggtccggagagacaacctctcctcccaacacgacacagggccctagccttcccgaaaccacaccgaagcggcctgccaccaccgccacatccacgcccagcaccgacaatacaaactctaccacacacgttaccgataataaccctacgtccacaattagcacctctccctccagctctccctccacccctagcacaccgcgcgggatccatcaccccgctagaaatctgctctccgtgtctagccctaaaaccgccacaacgcccacccctacatcccccggagagattagctctgagacctccagcctgcactctgctatgagccggacatccaccctgtatacggccacccaggcgtctacagaaaacgccaatcatagcgctccgcgccaatccgagagccctgcccagcccaccacaacctctctcatgacgtcccctgctcagagcatcctggtgatgtctgccgcgcccacagccatccagaacattcacccttcccccaccaatagaagcaagcggaaccttgaaatggagatcattctgacactctcccaaggcctgaaaaagtactatggcaagatccttaaactgctccatctgaccctggaggaagacaccgaggggctcctggaatggtgtaagcgcaatcttggatctaactgcgaggatgactttttccagaaaagaattgaagagtttttcatgacaggcgaggggtactttaacgaagtcctgcagttcaagacgctcagcaccctgtccccgacagagccttctcacgctcggcctcccaccgtggaaccctttaaaagctatttcgccaagggatttctttccatcgatagcggctacttctctgctaagtgttatccgcgctccagcacatctgggctgcagctcattaatgttacccaacaccccgccagaatcgccgagacgcctggacccaaaacaacctccctgaagaccatcaactgcattaatctgcgggctagcgtgtttaaagaacatcgcgagatcgagattaacgtcctcctgcctcagatcgcggtgaatctttctaactgtcacgttgtgattaatagccatgtctgcgactactccctggatacagacggccccgtgagactccctcacatctaccatgaaggcaccttcatccccgggacatataagattgtgatcgataaaaagaacaaactgaatgaccggtgtacgcttgtcaccaactgcgttattaagggacgcgaggtgagaaagggccagagcgtgctgcggcaatacaaaacagaaatcaagattgggaaagtctctaccggatccagaaagctcctgagcgaggaatccggcgatgactgtatctctcgcacacagctgctccggaccgagacggccgagatccacgatgacaattatgggggaccgggcgacaaaattaccatctgcaacggcagcacaattgtggatcagagactggggtccgaacttggatgttacaccatcaatcgcgttaagtcttttaagctgtgcgagaacagcgctacaggcaaaacctgcgaaattgactccacacctgtgaagtgtcggcaggggttctgcctcaaaatcacccaagagggaagaggccacgtcaagctgtctcgcgggagcgaggtggttctggatgcctgtgactccagctgcgaagtgatgattcccaaaggcacgggagatatccttgtcgactgttctggcgggcagcagcatttcctcaaggataatctgatcgacctgggatgccctcacattcccctcctgggcaagatggccatctatatttgtcggatgtccaaccatccgagaacaaccatggcttttcttttctggtttagcttcgggtacgtgattacctgcctgttttgtaaagccctcttctattctctgattatcatcggaacactgggcaagaaaattaagcagtaccgcgagcttcggcctcaaacctgcacgatctgtgaaacagcgcccgtcaacgctattgatgccgagatgcacgacctcaattgctcctacaacatctgcccttattgtgccagcagactgacctctgatgggctggctcgccacgtgccccagtgccccaaacggaaggaaaaggttgaggagacagaactctacctgaatcttgagagaatcccttggatcgtgcggaaactgctccaggtctccgaaagcaccggcgtggccctgaagcgctccagctggctgatcgttcttctcgtgctgctgacagtctctctcagcccggtgcagtccgctcccgtgggacatggcaaaaccattgagacgtatcaaaccagagaagggtttacatctatctgtctgttcatgcttggaagcattctgtttctcgtttcctgcctggtcaagggcctggtggactctgtgagcgactccttctttcctgggctttctgtctgtaaaacctgcagcatcggatccattaacggcttcgagatcgagagccacaagtgttactgctctctcctgtgttgcccctattgtcggcattgctccgccgatagagaaatccaccagctgcatctcagcatttgcaaaaagcgcaagacagggtctaatgtgatgctggcggtttgtaaacggatgtgctttagagccaccatcgaggcttcccgcagagcccttctgattcggagcatcattaacacgacattcgtgatctgtattctcaccctgacaatctgcgtcgtgtccacctctgctgttgaaatggagaatctgcctagcggcacctgggaaaaggaggaggaccttacaaacttctgtcaccaggaatgccaggtgacggagaccgaatgtctgtgcccctacgaggccctcgtcctgcgcaaacctctctttctggattccatcgtgaagggaatgaaaaatcttctgaacagcacatctctcgagacctccctgagcattgaagcgccgtggggcgccatcaatgttcaatctacattcaagcccaccgtgagcacggctaacattgccctgtcctggtctagcgtcgagcacagagggaataagatccttgtgacaggacggtccgaatctattatgaaactggaggaacgcaccggcgtgagctgggacctcggggtcgaggatgcttccgagagcaagctgctcaccgtttctatcatggacctgtcccagatgtatagccctgtgtttgaatacctttccggagatagacaggtggaggaatggcccaaagccacatgtaccggcgactgccctgagcggtgtgggtgcacatctagcacgtgcctgcataaggaatggccccactcccgcaactggagatgtaatccgacctggtgctggggcgtcggaacaggctgtacctgctgtggggtggatgttaaagacctcttcacagatcatatgtttgtgaagtggaaggtcgagtacatcaaaaccgaggccattgtgtgcgttgaactgacgtctcaagagcggcagtgtagcctgatcgaagctggaacccgcttcaaccttggccctgtgacaattaccctgtccgagcccagaaacatccagcagaagctgccccctgaaattatcacactccaccccaaagtcgaggaggggtttttcgacctcatgcatgtgcaaaaggttctgagcgcgtctaccgtgtgcaaacttcagtcctgtacacacggaatccctggcgatctgcaggtctatcacattggcaatctgctcaagggggaccgggtgaacggacatctgatccacaagattgaaccgcattttaatacgagctggatgtcttgggacggctgcgatcttgactactattgtaacatgggggattggccctcctgcacctacacaggagtgacccagcacaatcacgccgctttcgtcaacctgctcaatatcgagaccgactatacaaaaacgtttcatttccacagcaagagagttaccgcccatggcgatacacctcaactggacctcaaagcccgccccacctacggggctggagaaattacagtgctggtggaggtcgccgatatggagcttcacaccaagaaagtggaaatctctggcctgaagtttgcgagcctggcttgcacgggctgttatgcctgctcctctgggattagctgtaaagttcggatccatgtggacgagcctgatgaactcacagtccacgtgaagtccagcgaccccgatgttgtggccgcttccacctctctgatggccagaaaacttgagttcggaaccgacagcacattcaaggcgttttccgctatgccgaagacctctctgtgcttctacatcgtcgaacgcgagtactgtaaaagctgctccgaggaagatacacagaagtgtgtggacaccaaactcgagcagcctcagtctattctgatcgaacacaagggcacgattatcgggaagcaaaacgacacatgcaccgccaaagccagctgttggctcgagtccgtcaagagctttttctatggactgaaaaatatgcttggctctgtgtttgggaacttctttattggaatcctgctgttcctcgctccctttgttctgcttgtgctgttctttatgttcggctggaagatcctcttctgctttaaatgttgccggagagcccgcggcctgctcaagtaccggcatctgaaggatgacgaagagacagggtatagaaaaattatcgagcgccttaataacaagaaaggaaagaatcggctgctggatggcgaaagactcgctgaccggaaaattgccgagctgttctccaccaagacgcacatcgggtga

SEQ ID NO: 13614 - RNA, 5067 nt, synthetic construct
  misc_feature 1..5067: note = derived and/or modified CDS sequence (opt5) from CCHFV(4495-ST-2008)__KR814869.1__GP
  source 1..5067: mol_type = other RNA
atgcccaccaacatcatgcacacactgctcgtgtgcttcattctgtaccttcagctgctcggccctgggggagcccatggccaaccgaatgctacggagcacaacagaaccaatacaaccacagcccccagcacctcccagtctcctaagccccctgtcagcacagcgccccctcatgctctggagtccccgaccatcaaatctacgacccccacaagcgagaccgaagggtccggagagacaacccctccccctaacacgacacagggcccctctccgcctgaaaccacacccgagcggcctgccaccaccgccacaagcacgccctccaccgacaatacaaacagcaccacacacgttaccgataataaccccacgtctacaatttccaccagcccttcttccagcccgtctaccccctccacacctcgcgggatccatcaccccgctagaaatcttctgagcgtgtcctctcctaagaccgccacaacgcccaccccgacaagccctggagagatttccagcgaaacctcttccctccacagcgctatgtctcggacaagcaccctgtatacggccacccaggcgtccacagagaacgccaatcattctacaccccgccaaagcgaatcccctgctcagcccaccaccacgagcctgatgacatctcctgcccagtccatcctcgtgatgagcgctgcccccaccgcgatccagaacattcacccgtctcctacaaatagatccaaacggaacctggagatggagatcattcttaccctgagccaaggcctcaagaaatactatggcaagatcctgaaacttctgcatctcaccctggaagaggacacagaagggctgctcgagtggtgtaagcgcaatctgggatccaactgcgatgacgactttttccagaagagaattgaagagtttttcatgacgggcgaggggtactttaacgaagtccttcagttcaaaaccctgtctacactcagccccaccgagccctcccacgcccggcctccgacagtggaaccctttaagtcttatttcgctaaaggatttctgagcatcgattccggctacttcagcgccaagtgttatcctagatcttccaccagcgggcttcagctgattaatgttacgcaacaccccgctagaatcgccgagacacctggacccaagaccacctctctcaaaacaatcaactgcattaatctgcgggcctccgtgtttaaggaacatcgcgagatcgagattaacgtcctgctccctcagatcgctgtgaatctgagcaactgtcacgttgtgattaattctcatgtctgcgattacagccttgacaccgatggccccgtgagactgccgcacatctaccatgaaggcacattcatccctgggacgtataaaattgtgatcgacaagaaaaacaagctcaatgatcggtgtaccctggtcacaaactgcgttattaaaggacgcgaggtgagaaagggccagtccgtgcttcggcaatacaagaccgaaatcaaaattgggaaggtcagcacaggatctagaaaactgctctccgaggaaagcggcgacgattgtatctcccgcacccagctgctgcggacggagaccgcggagatccacgacgacaattatgggggacccggcgataagattacaatctgcaacggctctaccattgtggaccagagactcgggagcgaactgggatgttacacaatcaatcgcgttaaatcctttaaactttgcgagaactctgccaccggcaagacatgcgaaattgatagcacccctgtgaagtgtcggcaggggttctgcctgaagatcacgcaagagggaagaggccacgtcaaactctcccgcgggtctgaggtggttctggacgcttgtgatagctcctgcgaagtgatgattcccaagggcacaggagacatcctggtcgattgtagcggcgggcagcagcatttccttaaagacaatctcatcgatctgggatgcccgcacattcctctgctcggcaagatggccatctatatttgtcggatgtctaaccatcccagaaccaccatggcctttctgttctggttttccttcgggtacgtgatcacatgcctgttttgtaaggctcttttctatagcctcattatcatcggaaccctgggcaaaaagattaaacagtaccgcgagctgcggcctcaaacgtgcacaatctgtgaaaccgcccccgtcaacgcgattgacgctgagatgcacgatcttaattgctcttacaacatctgcccctattgtgcctccagactcacaagcgacgggctggcccgccacgtgcctcagtgcccgaagcggaaagaaaaggttgaggagaccgaactgtacctcaatctggagcgcattccctggatcgtgcggaaacttctgcaggtctctgaatccacaggcgtggctctcaagcgcagctcctggctgatcgttctgcttgtgctcctgaccgtcagcctgtctcctgtgcagagcgcccccgtgggacatggcaagacgattgagacctatcaaacaagagaagggtttacctccatctgtctcttcatgctgggatctattctttttctggttagctgcctcgtcaaaggcctggtggactccgtgtctgatagcttctttcctgggctgtccgtctgtaagacatgctctatcggaagcattaacggcttcgagatcgagtcccacaaatgttactgcagccttctctgttgcccctattgtcggcattgctctgctgacagagaaatccaccagctgcatctgtccatttgcaagaaacgcaagaccgggagcaatgtgatgctcgccgtttgtaagcggatgtgctttagagcgacgatcgaggcctctcgcagagctctgcttattcggtccatcattaacacaaccttcgtgatctgtattctgacactcaccatctgcgtcgtgagcacctccgccgttgaaatggagaatctgccttctggcacatgggaaaaagaggaggatctgacgaacttctgtcaccaggaatgccaggtgaccgagacagaatgtctttgcccgtacgaggctctggtcctccgcaagcccctgtttctcgacagcatcgtgaaaggaatgaagaatctgcttaactccaccagcctggagacatctctctccattgaagccccttggggcgcgatcaatgttcaaagcaccttcaaacccacggtgtctacagccaacattgctctgagctggtcctctgtcgagcacagagggaataagatcctggtgaccggacggagcgaatccattatgaaacttgaggaacgcaccggcatctcttgggatctgggggtggaggacgccagcgagtccaagctcctgacagtcagcatcatggatctctctcagatgtattcccctgtttttgaatacctgagcggagacagacaggtggaggaatggcccaaggctacctgtacaggcgattgcccggagcggtgtgggtgcacgtcctctacctgccttcataaagaatggcctcacagccgcaactggagatgtaatcccacatggtgctggggcgtgggaaccggctgtacatgctgtggggtcgacgtgaaggatctgttcaccgaccatatgtttgttaaatggaaggtggagtacattaagacggaggccatcgtctgcgtggaactcacctcccaagagcggcagtgttctctgattgaagccggaacacgcttcaacctgggccccgttaccatcacacttagcgagcctagaaacattcagcagaaactgccccctgaaatcatcaccctccacccgaaggtggaggaggggtttttcgatctgatgcatgtccaaaaagtgctctccgctagcacagtttgcaagctgcagtcttgtacgcacggcattcccggagaccttcaggtgtatcacatcggcaatctgctgaaaggggaccgggtcaacggacatctcattcacaagatcgaacctcattttaatacctcctggatgagctgggatggctgcgacctggattactattgtaacatgggggactggccctcttgcacatacaccggagtgacccagcacaatcacgcggccttcgtgaaccttctgaatattgagacagattatacgaagacctttcatttccactccaaaagagtcacagctcatggcgacacccctcaactcgatctgaaggcccgccccacatacggggccggagaaatcaccgttctcgtggaggtggctgacatggagctgcacacgaaaaaggtcgaaattagcggccttaaatttgcctctctggcgtgcacaggctgttatgcttgcagctccgggatctcttgtaaggtgcggatccatgttgatgagccggacgaactgaccgtgcacgtcaaaagctccgatcctgacgtggttgccgccagcacctccctcatggctagaaagctggagttcggaacagattctaccttcaaggcctttagcgcgatgcccaaaacatccctttgcttctacattgtggaacgcgagtactgtaagtcttgcagcgaggaagacacccagcggtgtgtcgacacgaaactggagcagcctcagtccatcctcattgaacacaagggcacaatcattgggaaacaaaacgatacctgcacagctaaggcctcttgttggctggagagcgtgaagtcctttttctatggactcaaaaatatgctgggcagcgtctttgggaacttctttatcggaatccttctgttcctggccccctttgtgctcctggttcttttctttatgttcggctggaagattctgttctgctttaaatgttgcagacgcgctcggggcctcctgaagtacagacatctcaaagacgatgaagagaccgggtatcgcaagatcattgagcggctgaataacaagaaaggaaagaatagacttctggacggcgaacggctggccgatcgcaaaatcgctgaactcttctctacgaagacccacattgggtga

SEQ ID NO: 13615 - RNA, 5067 nt, synthetic construct
  misc_feature 1..5067: note = derived and/or modified CDS sequence (opt5) from CCHFV(3809-ST-2007)__KR814867.1__GP
  source 1..5067: mol_type = other RNA
atgcccaccaacatcatgcacacactgctcgtgtgcttcattctgtaccttcagctgctcggcctgggaggagcccaaggccagagcaatgctacggagcataacgaaaccaatacaaccacagccccttccacctctcagagcccgaagccccctgtctccacaacaccccttcacgcgctggagtctagcacgatcaaacctaccacacccgctagagaaaccgaggggtccggagaaacaacccctccgcccaacacgacacagggcccttctccccctgaggccacccccgagcggccggccacaaccgctaccagcgccccttccacagacaatacgaacagcaccacacatgttaccgataataaccccacatctaccatttccacgagcccttcttccagcccctctacaccctttacccctcaagggatccaccatccggctcgcaatctcctgtccgtgagctcccccaagaccgccacaacccctacacccacgtctcctggagaactgagctccgagaccagctctctccactccgcgattagcagaacatctaccctgtatacagccacccaggtgagcacggaaaacgctaatcactccgctccccggcagtctgagagctccgcccagccgaccacaaccagccctatgacatctcccgcccaatccatccttgtcatgagcgcggcccctaccgctatccagaacattcatccctctcctacgaatcgctccaaaagaaacctggagatggaaatcattctcacactgagccagggccttaagaaatactatggcaagatcctgaagctcctgcacctgaccctcgaggaagacacagaggggctgcttgaatggtgtaaacggaatctgggatccaactgcgatgacgatttctttcagaagcgcattgaggagttctttatgaccggcgaagggtacttcaacgaggtgctccaatttaaaaccctgtctacacttagccccacggaaccgtcccatgccagacctcccgctgttgagcccttcaagtcttattttgccaaaggattcctgagcatcgactccggctactttagcgccaagtgttatcctcggtcttccaccagcgggctccagctgattaatgtgacacagcacccggctcgcatcgcggaaacccccggacctaagacaacctctctgaaaacgatcaactgcattaatctcagagcctccgtcttcaaggagcaccgggagatcgaaattaacgtgctgcttccccaaatcgctgttaatctgagcaactgtcatgtggtcattaattctcacgtgtgcgattacagcctcgacacagatggccctgtgcgcctgccccatatctaccacgagggcacctttatccctgggacctataaaattgtcatcgacaagaaaaacaaacttaatgatagatgtacactggttaccaactgcgtgattaaaggacgggaagtgcgcaagggccagtccgtcctcagacagtacaagacagagatcaaaattgggaaggccagcacgggatctcggaaactgctgtccgaggaacccggcgacgattgtatcagcagaacccagctcctgcgcacagagaccgccgaaatccatgacgacaattatgggggaccgggcgataagattacaatctgcaacggctccaccattgtggaccaacggcttgggtctgagctgggatgttacacgatcaatagagttaagagcttcaagctctgcgaaaactccgctaccggcaagacatgcgagattgattctacccctgtgaaatgtcgccaggggttctgcctgaagatcacacaggagggacggggccacgtcaaactgagcagagggtccgaagtggttcttgacgcctgtgattctagctgcgaggtgatgattcccaagggcaccggagacatcctcgtcgattgttccggcgggcagcaacactttctgaaagacaatctgatcgatctcggatgccctcatattcccctgcttggcaagatggcgatctatatttgtcgcatgagcaaccacccgcggacaaccatggctttcctgttttggttctcttttgggtacgtgatcacgtgcattttctgtaaggccctcttttattccctgatcatcattggaacactgggcaaaaagatcaaacagtacagagaacttaagcctcagacctgcaccatttgtgagacagcccccgtcaacgctatcgacgccgaaatgcatgatctcaattgcagctacaacatttgcccttattgtgcttctcgcctgacctccgacgggctggcccggcacgtgccccagtgccccaaaagaaaggagaaggttgaggaaacggagctctacctgaatcttgaacgcatcccttggatcgtgcggaaactgctccaagtcagcgagtctacaggcgtggcgctgaagagatccagctggctgattgttcttctcgtgctgctgaccgtctccctcagcccggtgcagtctgcccccgtgggacacggcaaaacaatcgaaacctatcagacacgggaggggttcaccagcatttgtctgtttatgcttggatccatcctgttcctcgtttcttgcctggtcaagggcctggtggacagcgtgtccgatagctttttccctgggctttctgtctgtaaaacgtgctccattggatctgtgaacggctttgagatcgaaagccataagtgttactgctccctcttctgttgcccctattgtcgccactgcagcgctgacagagagatccatcagctgcacctgtctgtttgcaaaaagcggaagaccgggtccaatgtgatgctcgccgtctgtaaaagaatgtgcttccgcgctacaattgaagccagccggagagcgctgcttatccgctctattatcaacaccacatttgtgatttgtatcctgaccctcacgatttgcgttgtgtccacaagcgccgtcgagatggaaaatctgcctgctggcacctgggagagagaggaagatctgacaaacttctgtcatcaagagtgccaggtgaccgaaaccgagtgtctttgcccctacgaggccctggttctccggaagcctctgtttctcgactccatcgtgaaaggaatgaagaatctgcttaactctacaagcctggaaacgtccctcagcatcgaggctccgtggggcgccattaatgtccagtctaccttcaaacccacagtgtccaccgccaacatcgctctgagctggtctagcgtggaacaccgcgggaataagattctggtcacaggaagatccgagtctatcatgaaacttgaggaacggaccggcgttagctgggatctgggggtggaggacgcgtccgaatctaagctcctgacggtgagcattatggatctctcccaaatgtatagccctgtctttgagtacctgtctggagaccgccaggtggaagagtggcccaaggccacatgtaccggcgattgccctgaaagatgtgggtgcacctccagcacatgccttcacaaagagtggccccattcccggaactggcgctgtaatccgacctggtgctggggcgttggaacaggctgtacgtgctgtggggtggacgtcaaggatctgttcaccgaccacatgtttgtgaaatggaaggttgagtacatcaagacagaagctatcgtgtgcgtcgagctcacctctcaggaaagacagtgtagcctgattgaggccggaacacggttcaacctgggccctgtgaccatcacgctttccgaaccccgcaacattcaacagaaactgccccctgagatcattaccctccatcccaaggttgaggaagggtttttcgatctgatgcacgtgcagaaagtcctctctgccagcacagtgtgcaagctgcagtcctgtacccatggaatccctggcgaccttcaagtgtatcacatcggcaatctgctgaaaggggacagagtcaacggacacctcattcataagatcgagccgcactttaatacaagctggatgtcttgggatggctgcgacctggattactattgtaacatgggggactggccctcctgcacctacacaggagttacgcagcataatcacgctgccttcgtgaaccttctgaatattgaaaccgattatacaaagacctttcacttccatagcaaacgggtgaccgcgcacggcgacacacctcagctcgatctgaaggctagacccacgtacggggccggagagatcaccgtcctcgtggaggttgccgacatggaactgcataccaaaaaggtggagatttctggccttaaattcgcttccctggcctgcaccggctgttatgcgtgcagctctgggatcagctgtaaggtccgcattcacgtggatgaacctgacgagctgacagttcatgtgaaatcctctgatcccgacgtcgtggctgccagcacctccctcatggcccggaagctggaatttggaacggatagcacattcaaggctttttccgccatgccgaaaacctctctttgcttctacatcgtcgagaaggagtactgtagaagctgctccgaagaggacacccagaaatgtgtggacacaaagctggaacaacctcagtctatcctcattgagcacaaaggcaccatcattgggaagcagaacgatacatgcaccgctaaggccagctgttggctggaatccgttaaatctttcttttatggactcaagaatatgctgggcagcgtgtttgggaacttctttatcgggattcttctgttcctgacgccctttgtcctcctggtgcttttcttcatgtttggctggaaaatcctgttctgctttaagtgttgccgccggacaagaggcctcctgaaataccgccacctcaaggacgatgaggagaccgggtatcggagaatcattgaacgcctgaataacaagaaaggaaagaatcggcttctggacggcgagagactggcggatcggaaaatcgccgaactcttctccacaaagacccatattgggtga

SEQ ID NO: 13616 - RNA, 5067 nt, synthetic construct
  misc_feature 1..5067: note = derived and/or modified CDS sequence (opt5) from CCHFV(3756-ST-2007)__KR814866.1__GP
  source 1..5067: mol_type = other RNA
atgcccatcaacattatgcacaccctgctcgtgtgcttcatcctgtaccttcagctgagcggcctcgggggagcccatggccaatccaatgctacagagcacaacagaacgaataccacaaccgtccctgggacatctcagagcccgaagccccctgcctccaccacactgccccatacccctgaatctagcacggttaaacttaccacacccacctccgagacagaaggatctggcgagaccacgcctccgcccaacacaacccaggggctgcctctccccggaacaacccctgaacggagcgcgaccacagctacgtccaccagctctacagacaatatgaacaccacaacccaggtgacggataatacacccacctccaccgtgagcatttctccgtccagctctccttccatgcccagcacatcccaaggcatccactatcctgtccgctctctgctgagcgtgtccagccccaagaccgttacaacgcccacccctatgtctccgggcgagatgtcccccgagacaagctctcagcatagcgccatgtcccgcattcctaccctctacacagccacccaggtgtctacggaaaacatcaatcggagcacccccagacagtccgagagctctgtccaacctgctacacagtcccccatcaccagcccggcccagacaattctgcttatgtctgctgcccctaaagcgatccaggacatgcacccctcccctaccaacagaagcaagcggaatctggaagtggagattatcctcacgctgtcccaagggcttaaaaagtattacggaaagattctgaaactcctgcacctgacactcgaggaagataccgagggcctgcttgaatggtgtaagcgcaacctggggtctaattgcgacgatgactttttccagaaaagaatcgaggaatttttcattacaggagagggctattttaacgaggttctccagttcaagaccctgagcaccctttcccccacagaaccttctcatgtgcggctgcccacggccgagccgtttaaaagctacttcgctaaggggtttctctccatcgatagcggatatttctctgccaagtgttaccctcgctccagcacctctggcctgcaactgatcaatgtcacacagcaccccgctagaattgccgaaacccccggccctaaaacaacctccctcaagacgatcaactgcattaacctgcgggcgagcgtgtttaaagagcatcgcgaagtggagatcaatgtccttctgccgcagattgccgttaacctctctaattgtcacgtggtgatcaacagccacgtctgcgactactccctggatacagacgggcccgtgagacttcctcggatccatcacgagggaaccttcattcccggcacctataagatcgttattgatcgcaaaaataagctgaacgacagatgtagcctcgtgacaaattgcgtcatcaaagggcgggaagtgagaaagggacagtctgttctgcgccaatacaagaccgagattaaaatcggcaaggcttccacagggagccggaaactgctctccgaggaacctggagatgactgtatctctagaacgcagctgcttaagaccgaaacagccgagattcatgacgataactatggcggccccggggacaaaatcaccatttgcaatggaagcacaatcgtggatcagcgcctgggctccgagctcgggtgttacaccattaaccgggtcaagtcttttaagctgtgcgaaaatagcgctacgggaaaaacctgcgagatcgactccacacctgtgaagtgtagacagggcttctgcctgaaaattacccaagaagggcgcggccacgtcaaactttctcggggaagcgaggtggttctcgatgcctgtgactccagctgcgagatcatgatccccaaaggcacaggggatattctggtggactgttctggaggccagcagcatttcctgaaggataacctcatcgacctggggtgcccgcacattcctcttctgggaaagatggccatctatatttgtagaatgtccaatcacccccgcaccacaatggcttttctcttctggtttagcttcggctacgtcattacctgcatcttttgtaaagcgctgttctattctctgatcatcattgggacgcttggcaagaaaatcaagcagtaccgggaactcaaacctcaaacatgcaccatttgtgagaccgcccccgtgaacgctatcgatgccgaaatgcatgacctgaattgctcctacaacatctgcccgtattgtgccagcagactgacatctgacggactcgctcgccacgttacccagtgccctaagcggaaggagaaagtggaagagacggagctgtaccttaacctggaacggattccctggatcgtcagaaagctccttcaggtgtccgagagcacaggcgtggccctgaaacgctccagctggcttattgttctcctggtcctgctcaccgtgtctctgagccctgtgcagtccgcgcccgtcgggcatggaaagacaatcgaaacctatcaaacaagagagggctttacctctatttgtcttttcatgctggggagcatcctctttatcgtgtcctgcctggttaaaggactggtggattctgtcagcgactccttctttcccggcctttctgtgtgtaagacgtgcagcattgggtccatcaatggcttcgaaattgagagccacaaatgttactgctctctcttttgttgcccttattgtcggcactgctccgctgatagagagatccatcagctgcacctgagcatttgcaagaagcgcaaaaccggatctaacgttatgctcgccgtgtgtaagcggatgtgcttcaaagccacaatcgaggcttccagacgcgccctgcttattagaagcatcatcaataccacattcgtcatttgtatcctgaccctcgctatttgcgtggtttccacgtctgccgtggaaatggaagacctgccggcgggcacatgggagcgggaagaggatctgaccaacttttgtcatcaggagtgccaagtcacagaaaccgagtgtctttgcccctacgaagccctggtgctccgcaagcctctgttcctcgacagcatcgtgaaagggatgaagaatctgcttaactccaccagcctggagacatctctctccattgaggctccctggggagccatcaatgtccagagcacgtttaagcctaccgtttctacagctaacatcgccctgagctggtcctctgtggaacacagaggcaataaaattctggtgaccgggcggagcgagtccatcatgaaacttgaggaacgcacaggagtctcttgggatctgggcgtggaagacgcgagcgagtccaagctcctgaccgttagcattatggatctctctcagatgtattcccccgtgttcgagtacctgagcggggacagacaggtcgaagagtggcctaaggccacgtgtacaggcgattgcccggaacggtgtggatgcacctcctctacctgccttcataaagagtggccccacagccgcaactggagatgtaatcctacatggtgctggggcgtggggaccggatgtacatgctgtggcgttgacgtgaaggatctgtttacggaccacatgttcatcaagtggaaagtcgaatacattaagaccgaggctatcgtgtgcgttgagctcacatcccaagaacggcagtgttctctgatcgaggccgggacccgctttaacctgggacccgtgacaattacccttagcgaacctagaaatatccagcagaaactgcccccggagattatcacgctccatcctaagattgaagagggcttctttgacctgatgcacgtccaaaaagtgctctccgctagcaccgtgtgcaagctgcagtcttgtacacatggcatccccggggatcttcagatttatcacatcggaaacctgctgaagggcgaccgggtcaatgggcatctcatccacaaaattgagccccacttcaacacctcctggatgagctgggatggatgcgacctggattactattgtaacatgggcgactggccttcttgcacatacaccggggttacacagcataatcacgccgcctttgtgaaccttctgaatatcgaaacggattataccaagacattccattttcactccaaaagagtgaccgctcacggagacacaccccaactcgatctgaaggcgcgccctacctacggcgccggcgagattacggtcctcgtggaagttgctgacatggagctgcataccaaaaaggtggagatcagcgggcttaaattcgcctctctgacatgcaccggatgttatgcctgcagctccggcatttcttgtaaggtccggatccacgtggatgaaccggacgagctgacagttcatgtcaagagctccgatcccgacgtggtggctgccagcacctccctcatggcgagaaaactggagttcgggacggactctacatttaaggctttcagcgccatgcctaaaacctccctttgcttttacatcgtcgaacgcgaatactgtaagtcttgcagcgaggatgacaccaaaaagtgtgtggatacaaagctggagcagccccagtccattctcatcgaacacaaaggaaccattatcggcaagcaaaacgacacatgcaccgccaaggcttcttgttggctggagagcgttaagtccttcttttatgggctcaaaaatatgctgggaagcgtgttcggctcctttttcgtcggcattcttctgtttctgacgcctttcgtgctcctggttctgtttttcatgttcgggtggaagatcctgttttgcttcaagtgttgccggagaacacgcggactctttaaataccggcatctgaaggatgacgaagagaccggctatagacgcatcattgaacggctcaactctaaaaaggggaaaaatagactgcttgatggagagcggctggccgaccgcaagatcgcggagctgttcagcacaaagacccacattggctga

SEQ ID NO: 13617 - RNA, 5067 nt, synthetic construct
  misc_feature 1..5067: note = derived and/or modified CDS sequence (opt5) from CCHFV(81-R-2014)__KR814865.1__GP
  source 1..5067: mol_type = other RNA
atgcccaccaacatcatgcacacactgctcgtgtgcttcattctgtaccttcagctgctcggcctgggaggagcccatggccaaagcaatgctacggagcacaacgggaccaatacaaccacagtcccttccacctctcagagcccgaagccccttgtttccacaacccctccccatgccctggaatctagcacgatcaaacctaccacacccacctccgagacagaaggatctggcgagaccgcgcctctcccgaacacgacacaggggccccctccccctgaaaccacacccgagagaccggctaccaccgtgacaagcacgccttccaccgacaatacaaacagcaccattcacgtgacagataataaccccacctctacgatctccacaagcccttcttccagcccctctaccccctccacccctcaggggattcatcacccggcccggagcctgctgtccgtctctagccccaagacagccaccacacctacgcccacctcccctggcgagatcaatagcgaaacatcttccctccacagcgctatgtctcgcacccccacactgcataccgccacgcaagtgagcaccgagaacgctaatcactccgccccgagacagtctgaaagctccgcgcagcctacaaccacaagccttatgacctctcccgcccagtccatcctgctcatgagcgctgcccctacggctattcaaaacacacatccctctcctaccaatcggtccaaacgcaacctggagatggagatcattcttacactgagccagggcctcaagaaatattacgggaagatcctgaagctgctccacctgacccttgaagaggacaccgaaggactgctcgagtggtgtaaaagaaatctgggctccaactgcgatgacgatttcttccagaagcggattggggaatttttcatgacaggagagggctattttaacgaggttcttcagttcaaaacgctgtctaccctcagccccacagaaccgtcccacgcccgcctgcctaccgtggagccctttaagtcttacttcgcgaaagggtttctgagcatcgactccggatatttcagcgccaagtgttaccccagatcttccacaagcggcctccaactgattaatgtcacccagcatcctgctcggatcgccgaaacgccgggccccaagacaacctctcttaaaaccatcaactgcattaatctgcgcgcttccgtgtttaaggagcacagagaaatcgagattaacgttctcctgcctcagatcgccgtgaatcttagcaactgtcatgtcgtgattaattctcacgtgtgcgattatagcctggacacagatgggcccgtccggctccctcatatctaccacgagggaaccttcatccccggcacatacaaaattgttatcgacaagaaaaacaagctgaatgatcgctgtacgctggtgaccaactgcgtgattaaagggagagaagtccggaagggacaatccgtgctccgccagtataagacagagatcaaaattggcaaggccagcaccgggtctagaaaactgctttccgaggaacctggagacgattgtatcagccggacacagctgctcagaaccgaaacggctgagatccacgacgacaattacggcggccccggggataagattaccatctgcaacggatccacaattgttgaccagcgcctgggctctgagctggggtgttataccatcaatcgggtgaaatcctttaaactttgcgaaaacagcgcgacaggaaagacctgcgagattgattctacaccggtcaagtgtagacaaggcttctgcctcaagatcacccaggaagggcgcggccatgtgaaactgagccggggatccgaggttgtgctggacgcctgtgattctagctgcgaggtcatgattcctaagggcacgggggacatcctcgtggattgttccggaggccagcagcacttcctgaaagacaatcttatcgatctggggtgcccccatattcctctcctgggaaagatggctatctacatttgtagaatgagcaaccacccccgcacaaccatggcctttctgttctggttttctttcggctatgtcattacctgcatcttttgtaaggcccttttctactccctcatcatcattgggacactgggcaaaaagatcaaacaatatcgggaactgaagccgcagacctgcacgatttgtgagacagctcctgtgaacgccatcgacgcggaaatgcacgatctcaattgcagctacaacatttgcccctactgtgcttctagactgacctccgacggacttgcccgccatgttcctcagtgccccaaacggaaggagaaggtggaagagacagagctgtatctcaatctggaaagaatcccctggatcgtccgcaaactgcttcaggtgagcgagtctaccggcgttgccctcaagcggtccagctggctgattgtgctgctcgtcctgcttacagtgtccctgagccctgtgcaatctgctccggttgggcacggaaaaaccatcgaaacgtaccagaccagagagggctttacaagcatttgtctcttcatgctggggtccatcctgtttcttgtctcttgcctcgtgaagggactggtggacagcgtctccgattctttctttcccggcctgagcgtgtgtaaaacctgctccattgggtctatcaacggcttcgaaatcgagagccataagtgttattgctccctcttttgttgcccttactgtcggcactgcagcgccgaccgcgagattcatcagctgcacctttctatctgcaaaaagagaaagacaggatccaatgttatgctggctgtgtgtaaacggatgtgcttcagagccaccattgaagcgagccgccgggccctcctgatcagatctattatcaacacgacattcgtcatttgtatcctgacccttacaatctgcgtggtttccaccagcgctgtggagatggaaaatctgcccgccggcacctgggagcgcgaagaggatctcacaaacttttgtcaccaggagtgccaagtcacggaaaccgagtgtctgtgcccttatgaagctctcgtgctgagaaagccccttttcctggactccattgttaaagggatgaagaatctcctgaactctacaagcctggagacctcccttagcatcgaggccccttggggagcgattaatgtgcagtctacatttaaaccgaccgtctccacggccaacatcgctctgagctggtctagcgtggaacatcggggcaataagattctcgtgacagggcgctccgagtctatcatgaagctggaagagagaaccggagtcagctgggatctcggcgttgaagacgcctccgagtctaaactgcttaccgtgagcatcatggatctgtcccagatgtacagccccgtgttcgagtatctctctggggaccggcaagtcgaagagtggcctaaggctacatgtaccggcgattgccccgaacgctgtggatgcacatccagcacgtgcctgcacaaagagtggcctcattccagaaactggcggtgtaatcccacctggtgctggggcgtggggacaggatgtacctgctgtggcgttgacgtgaaggatctgtttacagaccacatgttcgtcaaatggaaggtggaatacattaagaccgaggccatcgtttgcgtggagcttacgtctcaggaacgccagtgtagcctgattgaggccgggaccagatttaacctcggaccggtcacaatcaccctgtccgaacctcggaacattcagcaaaaactccctcccgagatcatcacactgcatcccaaggtggaagagggcttctttgatcttatgcacgttcagaaagtgctgtctgctagcaccgtctgcaagctgcagtcctgtacacacggcattcccggggacctccaggtgtaccatatcggaaatctgcttaaaggcgaccgcattaacgggcacctgatccataagattgagcctcacttcaatacgagctggatgtcttgggatggatgcgacctcgattattactgtaacatgggcgactggccgtcctgcacctatacaggggtgacccaacacaatcatgcggcctttgtcaacctgctcaatatcgaaaccgattacacaaagacgttccactttcatagcaaaagagttaccgctcacggagacacaccccagctggatcttaaggcccggcctacctatggcgccggcgagattacagtgctggtggaagtcgctgacatggagctgcataccaaaaaggtggagatctctgggctcaaattcgcctccctggcgtgcacgggatgttacgcttgcagctctggcatcagctgtaaggttcgcattcacgtggatgaacccgacgagcttacagtccacgtgaaatcctctgatcctgacgttgtggccgccagcacctccctgatggctagaaagctcgaatttgggaccgatagcacatttaaggccttctccgcgatgcccaaaacctctctgtgcttttatatcgtcgagcgggaatactgtaagagctgctccgaggaggacacacagaaatgtgtggacaccagactcgaacagccgcaatctattctgatcgagcataagggaacgattatcggcaaacagaacgatacatgcaccgctaaggccagctgttggcttgaatccgtcaagtctttcttttacgggctgaaaaatatgctgggaagcgtgttcggcaactttttcatcggcattctcctgtttcttgcccctttcgttctgctcgtgctgtttttcatgttcgggtggaagatcctcttttgcttcaaatgttgccgccggacaagaggactgcttaagtatcgccacctgaaagacgatgaggaaaccggctaccggagaattatcgagcgcctgaataacaagaaggggaaaaatcggctcctggacggagagagacttgctgatcggaagattgccgaactgttttccacgaaaacccatatcggctga

SEQ ID NO: 13618 - RNA, 5067 nt, synthetic construct
  misc_feature 1..5067: note = derived and/or modified CDS sequence (opt5) from CCHFV(75-ST-2010)__KR814864.1__GP
  source 1..5067: mol_type = other RNA
atgcccaccaacatcatgcacacactgctcgtgtgcttcattctgtaccttcagctgctcggccctgggggagcccatggccaaccgaatgctacggagcacaacagaaccaatacaaccacagcccccagcacctcccagtctcctaagccccctgtcagcacagcgccccctcatgctctggaatccccgaccatcaaatctacgacccccacaagcgagaccgaagggtccggagagacaacccctccccctaacacgacacagggcccctctcttccggaaaccacacctgagcggcccgccaccaccgccacaagcacgccttccaccgacaatacaaacagcaccacacacgttaccgataataaccccacgtctacaatttccaccagcccctcttccagcccttctaccccgtccacaccccgcgggatccatcaccctgctagaaatctgctcagcgtgtcctctcccaagaccgccacaacgcctacccccacaagcccgggagagatttccagcgaaacctcttccctgcacagcgctatgtctcggacaagcaccctgtatacggccacccaggcgtccacagagaacgccaatcattctgctcctcgccaaagcgaatcccccgcccagcctaccacaaccagcctcatgacgtctcccgctcagtccatcctggtgatgagcgccgcgcctacagccatccagaacattcacccctctccgaccaatagatccaaacggaaccttgagatggagatcattctgacactcagccaaggcctgaagaaatactatggcaagatccttaagctgctccatctgaccctggaagaggacaccgaagggctcctggagtggtgtaaacgcaatcttggatccaactgcgatgacgactttttccagaagagaattgaagagtttttcatgacaggcgaggggtactttaacgaagtcctgcagttcaaaacgctctctaccctgagccctacagagccctcccacgctcggccccctaccgtggaaccgtttaagtcttatttcgccaaaggatttcttagcatcgattccggctacttcagcgctaagtgttatcccagatcttccacaagcgggctgcagctcattaatgttacccaacaccctgccagaatcgccgagacgcccggacctaagacaacctctctgaaaaccatcaactgcattaatctgcgggcttccgtgtttaaggaacatcgcgagatcgagattaacgtcctcctgccccagatcgcggtgaatcttagcaactgtcacgttgtgattaattctcatgtctgcgattacagcctggacacagatggccctgtgagactcccccacatctaccatgaaggcaccttcatcccggggacatataaaattgtgatcgacaagaaaaacaagctgaatgatcggtgtacgcttgtcaccaactgcgttattaaaggacgcgaggtgagaaagggccagtccgtgctgcggcaatacaagacagaaatcaaaattgggaaggtcagcaccggatctagaaaactcctgtccgaggaaagcggcgacgattgtatctcccgcacacagctgctccggaccgagacggccgagatccacgacgacaattatgggggacctggcgataagattaccatctgcaacggctctacaattgtggaccagagactggggagcgaacttggatgttacaccatcaatcgcgttaaatcctttaagctgtgcgagaactctgctacaggcaagacctgcgaaattgatagcacacccgtgaaatgtcggcaggggttctgcctcaagatcacccaagagggaagaggccacgtcaaactgtcccgcgggtctgaggtggttctggacgcctgtgatagctcctgcgaagtgatgattcctaagggcacgggagacatccttgtcgattgtagcggcgggcagcagcatttcctcaaagacaatctgatcgatctgggatgcccccacattccgctcctgggcaagatggccatctatatttgtcggatgtctaaccatcctagaacaaccatggcttttcttttctggttttccttcgggtacgtgattacctgcctgttttgtaaggccctcttctatagcctgatcatcatcggaacactgggcaaaaagattaaacagtaccgcgagcttcggccccaaacctgcacgatctgtgaaacagcgcctgtcaacgctattgacgccgagatgcacgatctcaattgctcttacaacatctgcccctattgtgcctccagactgaccagcgacgggctggctcgccacgtgccccagtgccctaagcggaaagaaaaggttgaggagacagaactctacctgaatcttgagcgcattccgtggatcgtgcggaagctgctccaggtctctgaatccaccggcgtggccctgaaacgcagctcctggctgatcgttcttctcgtgctgctgacagtcagcctctctcccgtgcagagcgctcctgtgggacatggcaagaccattgagacgtatcaaaccagagaagggtttacatccatctgtctgttcatgcttggatctattctgtttctcgttagctgcctggtcaaaggcctggtggactccgtgtctgatagcttctttcccgggctttccgtctgtaagacctgctctatcggaagcattaacggcttcgagatcgagtcccacaaatgttactgcagcctcctgtgttgcccttattgtcggcattgctctgccgacagagaaatccaccagctgcatctctccatttgcaagaaacgcaagacagggagcaatgtgatgctggcggtttgtaagcggatgtgctttagagccaccatcgaggcttctcgcagagcccttctgattcggtccatcattaacacgacattcgtgatctgtattctcaccctgacaatctgcgtcgtgagcacctccgctgttgaaatggagaatctgccctctggcacctgggaaaaagaggaggatcttacaaacttctgtcaccaggaatgccaggtgacggagaccgaatgtctgtgcccttacgaggccctcgtcctgcgcaagccgctctttctggacagcatcgtgaaaggaatgaagaatcttctgaactccacaagcctcgagacctctctgtccattgaagcgccctggggcgccatcaatgttcaaagcacattcaaacctaccgtgtctacggctaacattgccctgagctggtcctctgtcgagcacagagggaataagatccttgtgacaggacggagcgaatccattatgaagctggaggaacgcaccggcgtgtcttgggatctcggggtcgaggacgctagcgagtccaaactgctcaccgttagcatcatggatctgtctcagatgtattcccccgtgtttgaataccttagcggagacagacaggtggaggaatggcctaaggccacatgtaccggcgattgccccgagcggtgtgggtgcacatcctctacgtgcctgcataaagaatggccgcacagccgcaactggagatgtaatcctacctggtgctggggcgtcggaacaggctgtacctgctgtggggtggacgttaaggatctcttcacagaccatatgtttgtgaaatggaaggtcgagtacatcaagaccgaggccattgtgtgcgttgaactgacgtcccaagagcggcagtgttctctgatcgaagctggaacccgcttcaaccttggccccgtgacaattaccctgagcgagcccagaaacatccagcagaaactccctcccgaaattatcacactgcaccctaaggtcgaggaggggtttttcgatctcatgcatgtgcaaaaagttctgtccgcgagcaccgtgtgcaaacttcagtcttgtacacacggaatcccgggcgacctgcaggtctatcacattggcaatctgctcaaaggggaccgggtgaacggacatctgatccacaagattgaaccccattttaatacgtcctggatgagctgggatggctgcgaccttgattactattgtaacatgggggactggccttcttgcacctacacaggagtgacccagcacaatcacgccgctttcgtcaacctgctcaatatcgagaccgattatacaaagacgtttcatttccactccaaaagagttaccgcccatggcgacacaccccaactggatctcaaggcccgccctacctacggggctggagaaattacagtgctggtggaggtcgccgacatggagcttcacaccaaaaaggtggaaatcagcggcctgaaatttgcgtctctggcttgcacgggctgttatgcctgcagctccgggatttcttgtaaggttcggatccatgtggatgagcccgacgaactcacagtccacgtgaaaagctccgatccggacgttgtggccgctagcacctccctgatggccagaaaacttgagttcggaaccgattctacattcaaggcgtttagcgctatgcctaagacctccctgtgcttctacatcgtcgaacgcgagtactgtaagtcttgcagcgaggaagacacacagaaatgtgtggacaccaagctcgagcagccccagtccattctgatcgaacacaaaggcacgattatcgggaagcaaaacgatacatgcaccgccaaggcctcttgttggctcgagagcgtcaaatcctttttctatggactgaagaatatgcttggcagcgtgtttgggaacttctttattggaatcctgctgttcctcgctccttttgttctgcttgtgctgttctttatgttcggctggaaaatcctcttctgctttaagtgttgccggagagcccgcggcctgctcaaataccggcatctgaaggacgatgaagagacagggtatagaaagattatcgagcgccttaataacaaaaagggaaagaatcggctgctggacggcgaaagactcgctgatcggaagattgccgagctgttctctaccaaaacgcacatcgggtga

SEQ ID NO: 13619 - RNA, 5067 nt, synthetic construct
  misc_feature 1..5067: note = derived and/or modified CDS sequence (opt5) from CCHFV(75-R-2012)__KR814863.1__GP
  source 1..5067: mol_type = other RNA
atgcccaccaacattatgcacaccctgctggtgtgcttcattctgtaccttcagctgctgggactcggcggggctcatagacaaagcaatgctacggggcacaacgggaccaataccaccacagccccttccacctctcagagcccgaagccccttgtctccacagcgcctccccatgctctggagtctagcatcattaaacacaccacgcctgtttccgaaaccgagggatctggcgaaacaacaccccctccgaacacaacccaggggcccagccctctcgagacgacacccgaacggcctgccaccacagccacctccacccccagcacagataatacgaactctaccacacatgtgaccgataataacccgacatccaccatcagcacgtctccttccagctctccctccacacctagcacaccccagggcattcaccaccccgctcgcaatctgctgtccgtgtctagcctcaagaccgccacaacccctacaccgacgtcccccggcgagatcagctctgagacctccagcctgcattctgctatgagcagaacatccaccctttatacagccacccaagtctctacggaaaacgcgaatcacagcgcccctcggcagtccgagagctctgctcagcagaccacaacctcccccatgacaagccctgcccaatctatcctggtgatgtccgctgcccccaccgcgattcagaacacgcatccgagccctacaaatcgctccaaaagaaacctcgaaatggagatcattctgaccctttctcagggcctgaagaagtactatgggaagatcctcaagctgctgcacctcacactggaggaagacaccgagggacttctggaatggtgtaagcggaatctcggcagcaactgcgatgacgactttttccagaagcgcattgaggaatttttcatgaccggggagggatactttaacgaggttctgcaattcaaaacactttccacgcagtctcccaccgaacctagccacgccagaccccctacagtggagccctttaagtcctatttcgctaaaggctttctgagcatcgactctgggtacttctccgccaagtgttatccgcggctcagcacctctggactgcagctgattaatgtcacacaacatcctgctcgcatcgccgaaacccccggccccaagacgacatccctcaaaaccatcaactgcattaatctgagagccagcgtgtttaaggagcaccgggaaatcgagattaacgttcttctgcctcagatcgctgtgaatctctctaactgtcatgtcgtgattaatagccacgtgtgcgattactccctggacaccgatggcccggtccgccttccccatatctaccacgaggggacattcatccctggaacctataaaattgttatcgacaagaaaaacaagctgaatgatagatgtacactcgtgacgaactgcgtgattaaaggccgggaagtccgcaaggggcagagcgtgctgagacagtacaagaccgagatcaaaattggaaaggcgtctacaggctcccggaaactgctcagcgaagaacccggggacgattgtatctccagaacccaactgcttcgcacagaaaccgccgagatccacgacgacaattatggaggccctggcgataagattacgatctgcaacgggtctaccattgttgaccagcggctgggaagcgagctcggctgttacacaatcaatagagtgaaatcctttaagctgtgcgaaaactctgctaccgggaagacatgcgagattgatagcgcccccgtcaaatgtcgccagggattctgcctgaagatcacccaggaaggccgggggcatgtgaaactttccagaggctctgaggttgtgctcgacgcctgtgatagctcctgcgaggtcatgattcctaagggaacaggcgacatcctggtggattgtagcgggggacaacagcacttcctgaaagacaatctcatcgatctgggctgcccccatattccgcttctggggaagatggctatctatatttgtcgcatgtctaaccaccctcggaccacgatggcctttctcttctggttttccttcggatacgtcatcacatgcatcttttgtaaggcgctgttctatagcctgatcatcattggcacccttgggaaaaagatcaaacagtacagagaactcaagccccagacctgcacaatttgtgagaccgctcctgtgaacgccatcgacgccgaaatgcacgatctgaattgctcttacaacatttgcccctattgtgcttcccgcctgacgagcgacggcctcgcccggcatgttccgcaatgccctaaaagaaaggagaaggtggaagagacagagctgtaccttaatctggaacgcatcccctggatcgtccggaaactcctccaggtgtctgagtccaccggagttgctctgaagagaagctcctggcttattgtgctcctggtcctgctcacagtgagcctgtctcctgtgcagagcgcccccgttggccacgggaaaaccatcgaaacatatcagacccgggagggatttacgtccatttgtcttttcatgctgggctctatcctctttctggtcagctgcctggtgaaggggcttgtgaactccgtctctgacagcttctttcccggactctccgtgtgtaaaacctgctctattggcagcatcaatgggttcgaaatcgagtcccataagtgttactgcagcctgttttgttgcccttattgtcgccactgctctgcggatagagagattcatcaactgcacctctccatctgcaaaaagcggaagacaggcagcaacgttatgctggccgtgtgtaaaagaatgtgcttccgcgctaccattgaagcctctcggagagcccttctgatccgctccattatcaatacaaccttcgtcatttgtatcctcacgctgacaatctgcgtggttagcacctccgccgtggagatggaaaacctgccgtctggaacatgggagagagaagaggaccttaccaatttttgtcaccaggagtgccaggtcaccgaaacagagtgtctgtgcccctacgaagcgctcgtgctgcggaagcctctcttcctggatagcattgttaaaggcatgaagaaccttctcaattccacgagcctcgagacctctctgtccatcgaggccccctggggagctattaacgtgcaaagcacatttaaacctaccgtctctacagccaatatcgctctgagctggtcctctgtggaacatcgcggaaacaagattcttgtgaccggcagaagcgagtccatcatgaagctggaggaacggacgggggtctcttgggacctcggagttgaagatgccagcgagtccaaactgctcacagtgagcatcatggacctgtctcagatgtattcccccgtgttcgagtaccttagcggcgatcgccaggtcgaagagtggcctaaggccacctgtaccggggactgcccggaaagatgtggctgcacatcctctacctgcctgcacaaagagtggccccatagccggaattggcgctgtaaccctacatggtgctggggagtgggcacggggtgtacctgctgtggagttgatgtgaaggacctctttacagatcacatgttcgtcaaatggaaggtggaatacattaagaccgaggctatcgtttgcgtggagctgacatcccaggaaagacaatgttctctgattgaggcgggcacccggtttaaccttgggcccgtcacgatcaccctgagcgaacctcgcaatattcagcagaaactgcccccggagatcatcacactgcatcctaaggtggaagagggattctttgacctcatgcacgttcagaaagtgctgtccgccagcaccgtctgcaaacttcaatcttgtacacacggcattcccggcgatctccaggtgtatcatatcgggaacctgctcaaaggagacagagtgaatggccacctgattcataagatcgagccccacttcaacacctcctggatgagctgggacgggtgcgatcttgactactattgtaatatgggagattggccttcttgcacatacacgggcgtcacccagcacaaccatgctgcctttgttaatctgctcaacattgaaacagactataccaagaccttccactttcattccaaacgggtgacagcccacggggatacgccccagctggacctcaaggctagacctacctacggagccggcgagatcacagtgctggtcgaagtggcggatatggagcttcataccaaaaaggttgagattagcggcctgaaattcgcttctctggcctgcacagggtgttatgcctgcagctccggaatctcttgtaaggtgcgcatccacgtcgacgaaccggatgagctcaccgtgcacgttaaaagctccgaccccgatgtggtcgctgccagcacgtccctgatggcgcggaaacttgagttcggcacagactctacctttaaggctttcagcgccatgcctaaaacctccctgtgcttttacattgtggagagagaatactgtaagtcttgcagcgaggaggatacacaaaaatgtgtcgacaccaagctcgaacagccccagtccatcctgattgagcataaagggacaatcattggaaagcaaaatgatacctgcacggccaaggcttcttgttggctcgaaagcgtgaaatccttcctgtatggccttaagaacatgctggggagcgtttttggaaatttctttatcggcatcctgctgttcctggccccttttgtgcttctggtcctcttctttatgttcggctggaaaattctgttctgctttaagtgttgccgccggacaagagggctcctgaaataccgccttctgaaggacgacgaggaaaccggatatcggagaatcattgagcgcctgaacaataagaaaggcaagaaccggctcctggatggggagagacttgctgaccggaaaatcgccgaactgttctctacaaagacccacattggatga

SEQ ID NO: 13620 - RNA, 5067 nt, synthetic construct
  misc_feature 1..5067: note = derived and/or modified CDS sequence (opt5) from CCHFV(52-R-2014)__KR814862.1__GP
  source 1..5067: mol_type = other RNA
atgcccaccaacatcatgcacacactgctcgtgtgcttcattctgtaccttcagctgctcggccttgggggagcccatagacaaagcaatgctacggagcacaacggcaccaatacaaccacagccccttccacctctcagagcccgaagccccctgtctccacagcgccccctcatgctcccgaatctagcaccatcaaacctacgaccccggcctccgagacagaagggtctggagagaccacaccccctcccaacaccacgcagggccctagcccgcccgaagccacacctgagcggcccgctaccacagccacctccacccctagcacagacaatacgaactctaccacacacgctaccgataataaccccacatccaccattagcacgtctccctccagctctccttccacaccgagcacaccccaggggatccatcaccctgcccgcaatcttctgtccgtttctagccccaagaccgcgaccacccctacacccacgtccccgggagacattagctctgagacctccagcctccactctgccatgagcagaacacctaccctgcatacagctacccaagcctccacggaaaacgctaatcactctgcgccccggcagagcgagtccagcgcccagcagaccacaacctctcctatgacatcccccgcccaacctatcctggtgatgagcgctgcccccaccgctatccagaacattcatccgtctcctacgaatcgctccaaaagaaacctcgaaatggagatcattctgacacttagccagggcctgaagaaatattacggcaagatcctcaagctgcttcacctgaccctcgaggaagatacagaggggctgctggaatggtgtaaacggaatctcggatccaactgcgacgatgactttttccagaagcgcattgaggaatttttcatgaccggcgaggggtattttaacgaggtgctgcaattcaaaaccctttctacactgagccccacggaaccctcccacgccagacctccgaccgtcgagccctttaagtcttacttcgccaaaggatttctcagcatcgattccggctatttcagcgctaagtgttaccctcggctgtctacatccgggcttcagctgattaatgtgacccagcatcccgcgcgcatcgccgaaacacctggacccaagaccacgagcctcaaaacaatcaactgcattaatctgagagcttctgtttttaaggagcaccgggaaatcgagattaacgtgctgctccctcaaatcgccgtcaatctgtccaactgtcatgtggttattaatagccacgtgtgcgactattctcttgataccgacggccccgtccgcctgccgcatatctaccacgagggcaccttcatccctgggacatacaaaattgtgatcgataagaaaaacaagctcaatgacagatgtaccctggtgacaaactgcgtcattaaaggacgggaagttcgcaagggccagagcgtgcttagacagtataagacggagatcaaaattgggaaggcctccaccggaagccggaaactgctctctgaagaacccggcgatgactgtatctccagaacacagctgctgcgcaccgaaacagctgagatccacgacgataattacgggggacctggcgacaagattaccatctgcaacggcagcacgattgtggatcaacggctcgggtccgagctgggatgttataccatcaatagagtcaaatcttttaagctgtgcgaaaacagcgccacaggcaagacctgcgagattgactccacacccgtgaaatgtcgccaggggttctgcctgaagatcacccaggaaggacggggccatgttaaactctctagagggagcgaggtggtcctggatgcgtgtgacacatcctgcgaggtgatgattccgaagggcaccggagatatcctggttgactgttctggcgggcagcaacacttccttaaagataatctcatcgacctgggatgccctcatgtgcccctgctcggcaagatggctatttacatctgtcgcatgagcaaccaccctcggacgacaatggcctttctgttctggttttccttcgggtatgtcattacctgcatcttttgtaaggcccttttctacagcctgattatcatcggaaccctcggcaaaaagattaaacagtatagagaactgaagccccagacatgcaccatctgtgagacggctcccgtgaacgccattgatgctgaaatgcacgacctgaattgctcttacaacatctgcccttactgtgcctcccgccttacaagcgacgggctcgcgcggcatgtcccgcagtgccccaaaagaaaggagaaggtggaagagaccgagctgtatctgaatctcgaacgcattccttggatcgttcggaaactgcttcaagtgtctgagtccacaggcgtcgccctgaagagaagctcttggctcatcgtgctgctggttcttctcaccgtgtccctgagccccgtccagtccgctcctgtgggacacggcaaaacaattgaaacctaccagacgcgggaggggtttaccagcgtgtgtctgttcatgctcggatctatcctgtttcttgttagctgcctggtcaagggcctcgtggattccgtgtctgacagcttctttcccgggctgtccgtctgtaaaacatgctctattggaagcatcaacggcttcgaaattgagtcccataagtgttattgctctctgttttgttgcccttactgtcgccactgcagcgccgatagagagatccatcagcttcacctctccatctgcaaaaagcggaagatggggagcaatgtgatgctggctgtttgtaaaagaatgtgcttccgcgccaccattgaagcgtctcggagagccctgctcatccgctccattatcaacacaaccttcgtgatttgtatcctgacgcttacaatttgcgtcgtgagcacctctgctgttgagatggaaaatctgccgtccggcacatgggagagagaagaggacctcaccaacttttgtcaccaagagtgccaggtgaccgaaacagagtgtctgtgcccctatgaagccctggtccttcggaagcctctgttcctcgatagcatcgtgaaaggaatgaagaatctgctcaactccacgtctctggagaccagcctttccatcgaggctccctggggcgccattaatgttcagagcacatttaaacctaccgtgtctacagccaacatcgctctgtcctggagctctgtcgaacatcgcgggaataagattctcgtgaccggaagaagcgagtccatcatgaagctggaggagcggacgggcgtgtcttgggacctgggggtcgatgacgcgagcgaatccaaacttctgacagtttctattatggatctcagccaaatgtactcccccgtgttcgagtatctgagcggagaccgccaggtggaggaatggccgaaggccacctgtaccggcgattgccctgagagatgtgggtgcacatcttccacatgcctccacaaagaatggccccatagccggaactggcgctgtaatcccacctggtgctggggcgtcggaacgggctgtacctgctgtggggtggacgttaaggatctgtttacagaccacatgttcgtgaaatggaaggtcgagtacatcaagaccgaagctatcgtgtgcgttgagcttacatcccaggagagacagtgttctctgattgaagccggaacccggtttaacctcggccctgtgacgatcaccctgagcgagccccgcaacattcaacagaaactgcctccggaaatcattacacttcatcccaaggtcgaggaagggttctttgacctgatgcacgtgcagaaagttctctccgcctctaccgtgtgcaagctgcagagctgtacacacggaatccctggcgatctccaagtctaccatatcggcaatctgcttaaaggggacagagtgaacggacacctgattcataagatcgagccccacttcaatacctcctggatgagctgggatggctgcgacctggattattactgtaacatgggggactggccttcttgcacatatacgggagtgacccagcacaatcatgctgcctttgtcaacctcctgaatattgagacagattacaccaagaccttccactttcattccaaacgggttacagcgcacggcgacacgccccagcttgatctgaaggctagaccgacctatggggccggagaaatcacagtgctcgtggaggtcgccgacatggaactgcataccaaaaaggtggagattagcggcctcaaattcgcttctctggcctgcacaggctgttacgcgtgctccagcgggatctcttgtaaggttcgcattcacgtggatgagcctgacgaacttaccgtccacgtgaaaagcaacgatcccgacgttgtggctgcctccacgtctctgatggcccggaagctggagttcggaacagacagcacctttaaggctttctccgccatgcctaaaaccagcctctgcttttatatcgtcgaaagagagtactgtaagtcctgctctgaagaggatacacagaaatgtgtggacaccaagctggagcaaccccagagcatccttattgaacataaaggcacaatcattgggaagcagaatgatacctgcacggctaaggccggatgttggctggagtccgtcaaatctttcttttacggcctcaagaacatgctggggagcgtgttcggaaactttttcatcggcattctcctgtttcttgcgcctttcgttctgctggtgctctttttcatgttcggctggaaaatcctgttttgcttcaagtgttgccgccggacaagagggcttctgaaatatcgcctcctgaaggacgatgaagagaccggataccggagaatcattgaacgcctcaataataagaaaggcaagaaccggctgcttgacggggagagactggccgatcggaaaatcgctgagctgttttccacaaagacccacattggatga

SEQ ID NO: 13621 - RNA, 5067 nt, synthetic construct
  misc_feature 1..5067: note = derived and/or modified CDS sequence (opt5) from CCHFV(47-ST-2013)__KR814861.1__GP
  source 1..5067: mol_type = other RNA
atgcccatcaacattatgcacaccctgctcgcctgcttcatcctgtaccttcagctgagcggcctcgggggagctcatggccaatccaatgccacagagcacaacgggacgaataccacaaccgtgcctggaacatctcagagcccgaagccccctgcgtccaccacactgccccatacccctgaatctagcacggtcaaacttaccacacccacctccgagacagaaggctctggggagaccacgcctccgcccaacacaacccagggactgcctccccctggcacaacccccgaaagaagcgctaccacagccacgtccaccagctctacagacaatatgaactccaccacacagatgaccggcaatacgccgacacctaccgttaacatgagcccctcttccagcccttctatgccctccaccagccaagggattcactatcccgtgcggtccctcctgtctgtgcctagcccgaagacagccaccacacccacgcctgtctcccccggagagatgagccctgagacctcttcccagcatagcgctacatctcgcatccccaccctgtacacagccacccaggtgagcacggaaaataccaacagatccacaccgcggcagtctaaaagctccgttcaacctgctacccagagccccattacacctcccgcccagaccatcctcctgatgtctgcggcccctaaggctatccaggatatgcacccctccccgacgaatcgcagcaaaagaaaccttgaggtggaaattatcctgacactctctcaaggcctgaagaagtattacgggaaaattcttaagctgctccacctgaccctggaggaggacacagaaggactcctggagtggtgtaaacggaatcttggctccaactgcgatgacgactttttccagaagcgcatcgaagagtttttcattaccggggaaggatattttaatgaggtcctgcagttcaaaaccctcagcacactgtcccctacggagccctctcatgtgagacttcccaccgccgaaccttttaagagctactatgctaagggcttcctgtccctcgactctggctactttagcgccaaatgttacccgcggtccagcacatctgggctgcaactgatcaacgttacccagcaccccgcgcgcattgccgagacacctggacccaagaccacgtccctcaaaacaatcaactgcatcaatctgagagctagcgtgttcaaggaacatcgggaggtcgaaattaacgtgcttctgcctcagatcgccgtgaatctctctaactgtcacgtcgttattaattcccacgtgtgcgattatcccctggacaccgatggccctgtgcgccttcccagaatccatcacgaggggacctttattccgggaacatacaaaatcgtcatcgacaagaaaaacaagctgaatgatcggtgtagcctcgtgaccaactgcgttattaagggccgcgaggtgagaaaagggcagtctgtcctgcggcaatataagacagaaatcaaaattggaaaggctagcacgggctccagaaaactgctcagcgaggaacctggcgacgattgtatctctcgcacccagctgcttaagacagagaccgccgaaattcatgacgacaattacgggggacccggcgataagatcacaatctgcaacgggtccaccattgtggaccagcggctgggaagcgagctcggctgttatacgatcaatagagttaaatccttcaagctgtgcaaaaactctgccaccgggaagacatgcgagattgatagcacccctgtgaaatgtcgccagggcttttgcctgaagatcacacaagaaggacggggccacgtcaagctctccagagggtctgaggtggtcctcgacgcttgtgatagctcctgcgaaattatgatccccaaaggaaccggcgacattctggtggattgttctgggggacagcagcatttcctgaaggacaatctcatcgatctgggctgcccgcacatccctcttctggggaaaatggcgatttacatctgtcgcatgagcaaccacccccggacaaccatggccttcctcttttggttctcctttggctatgttattacgtgcatcttctgtaaggctctgttttacagcctgattatcatcggaacacttggcaaaaagattaagcagtacagagagctcaaacctcaaacctgcaccatctgtgagacagcccccgtgaatgccattgacgctgaaatgcatgatctgaactgctcttataacatctgcccctactgtgcctcccgcctgaccagcgacgggctcgcgcggcacgtcacgcagtgccctaagagaaaagagaaggtggaagagacagaactgtatcttaatctggagcgcattccgtggatcgttcggaaactccttcaggtgtctgagtccaccggagtcgctctgaagagaagctcttggcttatcgtgctcctggtgctgctcacagtttccctgagccccgtccagtccgcccctgtgggccatgggaaaaccattgaaacataccaaacccgggagggattcacgagcatctgtctttttatgctgggctctattctcttcatcgtgagctgcctggtcaaggggctggtggactccgtttctgatagctttttccccggcctttccgtgtgtagaacctgctctattggaagcatcaacggctttgaaatcgagtcccacaagtgttattgctctctcttctgttgcccttactgtcgccactgcagcgccgaccgggaaattcatcagctgcacctgtccatctgcaaaaagagaaaaacagggagcaatgtcatgctcgctgtgtgtaagcgcatgtgctttaaagccaccattgaggcttctcggagagccctgttcatccgctccattatcaacacaaccttcgttacgtgtattcttacactggcgatctgcgtggtcagcacctctgccgtggagatggaagatctccccgctggaacatgggagagagaagaggacctgaccaatttttgtcatcaggaatgccaagttaccgagacagagtgtctgtgcccttatgaagcccttgtgctgcggaagccgcttttcctggattccatcgtcaagggcatgaaaaacctcctgaatagcacgtcccttgagacctctctgagcattgaagctccctggggagccatcaacgtgcagtccacatttaagcctaccgtgagcacagcgaatattgccctctcttggtccagcgtcgagcaccgcgggaacaaaatcctggttaccggcagatctgagagcattatgaagctggaggaacggacgggggtgtcctgggaccttggcgtggaagatgcttctgagagcaaactgctcacagtctccatcatggacctgtctcagatgtacagccccgtgttcgaatacctctccggagatcgccaggttgaggagtggcctaaggccacctgtaccggcgaatgccccgagagatgtgggtgcacaagctctacctgcctgcataaggaatggccgcactcccggaattggcgctgtaaccctacatggtgctggggagtgggcacggggtgtacctgctgtggagtcgacgtgaaagatctttttacagaccacatgttcatcaagtggaaagttgagtatattaagaccgaagctatcgtgtgcgtcgagctgacaagccaagagagacagtgttccctcattgaagccggcacccggtttaatctgggccccgtgacgatcaccctgtctgagccccgcaacattcagcagaaacttcctcccgaaatcatcacactgcatcctaagattgaggaagggttctttgatctcatgcacgttcaaaaggtgctgagcgcctccaccgtctgcaaactccagtcttgtacacatggaatcccgggcgacctgcagatttaccacatcgggaatcttctgaagggagacagagtgaacggccatctgattcacaaaatcgagccccacttcaacaccagctggatgtcctgggatgggtgcgacctcgattattactgtaatatgggagactggcctagctgcacatatacgggcgtgacccagcataaccacgctgcgtttgtcaatctgcttaacattgagacagattacaccaagaccttccattttcactctaaacgggttacagcccacggcgacacgccccaactggatctcaaggctagacctacctatggggccggagaaatcacagtgctggtggaggtcgccgacatggaactccataccaaaaaggtggaggtttccggcctgaagttcgctagccttgcctgcacagggtgttacgcgtgttcttccggaatcagctgcaaagtgcgcattcacgtcgatgagcccgacgaactgaccgtgcatgttaagtctagcgatccggacgtggtcgctgcctccacgtctctgatggcccggaaactcgagttcggcacagatagcacctttaaggctttctccgccatgcctaaaaccagcctgtgcttttacatcgtggaaagagagtattgtaagtcctgctctgaagacgacacaaagaaatgtgtcgataccaaacttgagcagccccagagcattctgatcgagcacaaagggacaattatcggaaagcaaaatgatacctgcacggcgaaggcttcctgttggctcgaatctgttaagagcttcttttacggcctgaagaacatgctcggctccgtgttcgggaatttctttgtgggaatcctgctttttctggcccctttcgtcctgctcgtgctgtttttcatgttcggctggaaaattctgttttgcttcaagtgttgccgccggacaagagggctgtttaaatatcgccatctcaaggatgacgaggaaaccggataccggagaatcattgagcgcctgaactctaaaaagggcaagaatcggctcctggatggggaaagacttgccgaccggaaaatcgctgagctgttcagcacaaagacccacattggatga

SEQ ID NO: 13622 - RNA, 5067 nt, synthetic construct
  misc_feature 1..5067: note = derived and/or modified CDS sequence (opt5) from CCHFV(46-ST-2012)__KR814860.1__GP
  source 1..5067: mol_type = other RNA
atgcccaccaacatcatgcacacactgctcgtgtgcttcattctgtaccttcagctgctcggccttgggggagcccatggccaaagcaatgctacggagcacaacgggaccaatacaaccacagtcccttccacctctcagagcccgaagccccttgtttccacaacccctccccatgccctggaatctagcacgatcaaacctaccacacccacctccgagacagaaggatctggcgagaccgcgcctctcccgaacacgacacaggggccccctccccctgaaaccacacccgagagaccggctaccaccgtgacaagcacgccttccaccgacaatacaagctctaccattcacgtgacagataacaatcccacctccacgatcagcacatctccttccagctctccctccacccccagcacccctcaggggattcatcacccggcccggtccctgctgtctgtcagctcccccaagacagccaccacacctacgcccaccagccctggcgagatcaactctgaaacatccagcctccactctgctatgagccgcacccccacactgcataccgccacgcaagtgtccaccgagaatgctaaccactctgccccgagacagagcgaatccagcgcgcagcctacaaccacatctcttatgacctcccccgcccagagcatcctgctcatgtctgctgcccctacggctattcaaaatatccatccctcccctacaaaccggagcaaacgcaatctggagatggagattatccttaccctgtcccagggcctcaagaaatattacgggaagattctgaagctgctccacctgacacttgaagaggacaccgaaggactgctcgagtggtgtaaaagaaacctgggctctaattgcgatgacgactttttccagaagcggatcgaagagtttttcatgaccggggagggatattttaacgaagttcttcagttcaaaacactgagcacgctctcccccaccgagccgtctcacgcccgcctgcctacagtggaaccctttaagagctacttcgcgaaaggctttctgtccgtcgatagcgggtatttctctgccaagtgttaccccagatccagcacctctggactccaactgattaacgtgacacagcatcctgctcggatcgccgagaccccgggccccaagacgacatcccttaaaaccatcaattgcattaacctgcgcgctagcgtttttaaggaacacagagagatcgagattaatgtgctcctgcctcagatcgccgtcaacctttctaattgtcatgtggtgattaacagccacgtctgcgattattccctggacaccgatggccccgttcggctccctcatatctaccacgaagggacattcatccccggaacctacaaaattgtgatcgacaagaaaaataagctgaacgatcgctgtacactggtgacgaattgcgtcattaaaggcagagaggtgcggaaggggcaaagcgttctccgccagtataagaccgaaatcaaaattggaaaggcctctacaggctccagaaaactgcttagcgaggaacctggggacgattgtatctcccggacccagctgctcagaacagagaccgctgagatccacgacgacaactacggaggccccggcgataagattacgatctgcaatgggtctaccattgtggaccagcgcctgggaagcgaactgggctgttatacaatcaaccgggtcaaatcctttaagctgtgcgaaaattctgcgaccgggaagacatgcgagattgatagcaccccggtgaaatgtagacaaggattctgcctcaagatcacacaggagggccgcgggcatgttaaactgtcccggggctctgaggtggtcctggacgcctgtgatagctcctgcgaagtgatgattcctaagggaaccggcgacatcctcgtcgattgtagcgggggacagcagcacttcctgaaagacaaccttatcgatctgggctgcccccatattcctctcctggggaagatggctatctacatttgtagaatgtctaatcacccccgcacgacaatggcctttctgttctggttttccttcggatatgtgattacctgcatcttttgtaaggcccttttctacagcctcatcatcattggcaccctggggaaaaagatcaaacaatatcgggagctgaagccgcagacatgcaccatttgtgaaacggctcctgttaacgccatcgacgcggagatgcacgatctcaactgctcttacaatatttgcccctactgtgcttccagactgacaagcgacggccttgcccgccatgtgcctcagtgccccaaacggaaggaaaaggtcgaggagaccgaactgtatctcaacctggagagaatcccctggatcgtgcgcaaactgcttcaggtttctgaatccacaggagtggccctcaagcggagctcctggctgattgtcctgctcgtgctgcttaccgtgagcctgtctcctgttcaaagcgctccggtcggccacgggaaaacaatcgagacctaccagacgagagaaggatttacctccatttgtctcttcatgctgggctctatcctgtttcttgtgagctgcctcgtgaaggggctggtcgactccgtgtctgatagcttctttcccggactgtccgtttgtaaaacatgctctattggcagcatcaatgggttcgagatcgagtcccataagtgttattgcagcctcttttgttgcccttactgtcggcactgctctgccgaccgcgaaattcatcagctgcacctttccatctgcaaaaagagaaagaccggcagcaacgtgatgctggctgtctgtaaacggatgtgcttcagagccacaattgaggcgtctcgccgggccctcctgatcagatccattatcaatgctaccttcgtgatttgtatcctgacgcttacaatctgcgttgtgagcacctccgccgtcgaaatggagtctctgcccgctggaacatgggaacgcgaggaggatctcaccaacttttgtcaccaggaatgccaagtgaccgagacagaatgtctgtgcccttatgaggccctcgttctgagaaagccccttttcctggacagcattgtgaaaggcatgaagaatctcctgaactccacgagcctggagacctctctttccatcgaagcgccttggggagccattaatgtccagagcacatttaaaccgaccgtgtctacagctaacatcgccctgagctggtcctctgtggagcatcggggaaataagattctcgtcaccggccgcagcgaatccatcatgaagctggaggaaagaacgggggtttcttgggatctcggagtggaggacgctagcgagtccaaactgcttacagtgagcatcatggatctgtctcagatgtactcccccgtcttcgaatatctcagcggcgaccggcaagtggaggaatggcctaaggccacctgtaccggggattgccccgagcgctgtggctgcacatcctctacctgcctgcacaaagaatggcctcatagcagaaactggcggtgtaatcccacatggtgctggggagttggcacggggtgtacctgctgtggagtggacgtcaaggatctgtttacagaccacatgttcgtgaaatggaaggttgagtacattaagaccgaggccatcgtgtgcgtcgaacttacatcccaggagcgccagtgttctctgattgaagctggcaccagatttaacctcgggccggtgacgatcaccctgagcgagcctcggaatattcagcaaaaactccctcccgaaatcatcacactgcatcccaaggttgaggagggattctttgatcttatgcacgtgcagaaagtcctgtccgcgagcaccgtgtgcaagctgcagtcttgtacacacggcattcccggcgacctccaggtgtaccatatcgggaacctgcttaaaggagaccgcattaacggccacctgatccataagattgaacctcacttcaatacctcctggatgagctgggatgggtgcgacctcgattattactgtaacatgggagactggccgtcttgcacatatacgggcgtcacccaacacaatcatgccgcttttgttaacctgctcaatatcgagacagattacaccaagaccttccactttcattccaaaagagtgacagcccacggggacacgccccagctggatcttaaggcccggcctacctatggagctggcgaaattacagtgctggtcgaggtggccgacatggagctgcataccaaaaaggttgaaatcagcggcctcaaattcgcgtctctggcttgcacagggtgttacgcctgcagctccggaatctcttgtaaggtgcgcattcacgtcgatgagcccgacgaacttaccgtgcacgttaaaagctccgatcctgacgtggtcgccgctagcacgtccctgatggccagaaagctcgagttcggcacagattctacctttaaggcgttcagcgctatgcccaaaacctccctgtgcttttatatcgtggaacgggagtactgtaagtcttgcagcgaggaagacacacagaaatgtgtcgacaccagactcgagcagccgcaatccattctgatcgaacataaggggacaattatcggaaaacagaacgatacctgcacggccaaggcctcttgttggcttgagagcgtgaagtccttcttttacggcctgaaaaatatgctggggagcgttttcggaaactttttcatcggcattctcctgtttcttgctcctttcgtgctgctcgtcctgtttttcatgttcggctggaagatcctcttttgcttcaaatgttgccgccggacaagagggctgcttaagtatcgccacctgaaagacgatgaagagaccggataccggagaattatcgagcgcctgaataacaagaagggcaaaaatcggctcctggacggggaaagacttgccgatcggaagattgctgagctgttttctacaaaaacccatatcggatga

SEQ ID NO: 13623 - RNA, 5067 nt, synthetic construct
  misc_feature 1..5067: note = derived and/or modified CDS sequence (opt5) from CCHFV(44-ST-2010)__KR814859.1__GP
  source 1..5067: mol_type = other RNA
atgcccatcaacattatgcacaccctgctcgtgtgcttcatcctgtaccttcagctgagcggcctcgggggagcccatggccaatccaatgctacagagcacaacgggacgaataccacaaccgtccctggaacatctcagagcccgaagccccctgcctccaccacactgccccatacccctgaatctagcacggttaaacttaccacacccacctccgagacagaaggctctggggagaccacgcctccgcccaacacaacccagggactgcctccccctggcacaacccccgaaagaccggcgaccacagctacgagcatgtccagcaccgacaatatgaactctacaacccaggtgacagataatacccctacgtccacagtgagcatttctccctccagctctccttccatgcccagcacctcccaaggcatccactatcccgtccggtctctcctgagcgtgtccagccctaagaccgttacaaccccgacacccatgtctcctggggagatgtcccccgagacgagctctcagcatagcgccatgtcccgcattcctaccctgtacacagccacccaggtgtctacagaaaacaccaatagaagcacgccccggcagtccgagagctctgctcaaccggccacccagtcccctacaaccagccccacacagaccatcctcctgatgtctgctgcccctaaagcgatccaggacatgcacccctcccctacgaaccgcagcaagagaaatcttgaagtcgagattatcctgacactctcccaaggactgaaaaagtattacggcaagattcttaaactgctccacctgaccctggaggaagatacagaggggctcctggaatggtgtaagcggaaccttggatctaattgcgacgatgactttttccagaaacgcatcgaggaatttttcattaccggcgaggggtattttaacgaggtgctgcagttcaagaccctcagcacactgtcccccacggaaccgtctcatgttagacttcctaccgccgagccctttaaaagctacttcgctaagggatttctgtccatcgatagcggctatttctctgccaagtgttacccccggtccagcacatctggcctccaactgattaatgtgacccagcaccctgctcgcatcgccgaaacaccggggcccaaaaccacgtccctgaagacaatcaactgcattaacctcagagcgagcgtctttaaagagcatcgggaagtggagatcaatgtgctgcttcctcagattgccgtcaacctgtctaattgtcacgttgtgatcaacagccacgtgtgcgactactccctcgataccgacggacccgtccgcctgcctcggattcatcacgagggcaccttcatccccgggacatataagatcgtgattgataaaaagaataaacttaacgaccggtgtagcctggttaccaattgcgtgatcaagggacgcgaagtcagaaagggccagtctgtgctccggcaatacaaaacagagattaagatcgggaaagctagcacgggaagcagaaagctgctgtccgaggaacctggcgatgactgtatttctcgcacccagctcctgaaaacagaaaccgccgagatccatgacgataactatggcgggcccggagacaagatcacaatttgcaatggcagcaccatcgttgatcagcggcttgggtccgagctgggatgttacacgattaacagagtgaagtcttttaaactctgcgaaaatagcgctaccggcaagacatgcgagatcgactccaccccggtcaaatgtcgccaggggttctgcctgaagattacacaagaaggccggggacacgtgaaactgtctagaggcagcgaggtcgtgcttgatgcctgtgactccagctgcgagatcatgattcctaaggggaccggagatatcctcgttgactgttctggcgggcagcagcatttcctgaaggataacctgatcgacctcggatgcccccacattcctctgcttggcaaaatggccatctatatttgtcgcatgtccaatcacccccggacaaccatggcttttctgctctggttcagctttgggtacgtgatcacgtgcattttctgtaaggcgctgttttattctctgatcatcattggcacacttggaaagaagatcaaacagtacagagaactcaagccgcaaacctgcaccatttgtgagacagcccctgtcaacgctatcgatgccgaaatgcatgacctgaattgctcctacaacatttgcccctattgtgccagccgcctgacctctgacggcctcgctcggcacgtgacgcagtgccctaagagaaaagagaaggttgaagagacagagctgtaccttaacctggaacgcatcccctggatcgtgcggaaactcctgcaggtctccgagagcaccggggtggccctgaagagatccagctggcttattgtgctcctggttctgctcacagtctctctgagccccgtgcagtccgcgcctgtgggacatggcaaaaccatcgaaacatatcaaacccgggaggggttcacgaatatttgtctttttatgctgggatctatcctcttcattgtcagctgcctggtgaagggcctggttgattccgtgtctgacagctttttcccggggctttccgtctgtaaaacctgctcttttggcagcatcaacggattcgaaatcgagtcccacaagtgttactgcagcctcttttgttgcccctattgtcgccactgctctgctgatagagagattcatcagctgcacctgggcatctgcaagaaacggaagacagggtccaatgtgatgctcgccgtttgtaaaagaatgtgcttcaaggccaccattgaagctagccgccgggccctgcttatcagatctattatcaacacaaccttcgtgatttgtatcctgacgctcgctatctgcgtcgtgtccacaagcgccgttgagatggaaaatctgcctgcgggaacctgggagcgcgaagaggacctgacaaacttttgtcatcaggagtgccaagtgtccgaaaccgagtgtctttgcccctacgaagccctggtcctcagaaaacctctgttcctcgattctattgtgaagggcatgaagaatctgcttaacagcacctccctggagacaagcctctctatcgaggctccctggggagccattaatgtgcagtccacgtttaaacctaccgtcagcacagctaacatcgccctgtcttggagctccgttgaacaccggggaaataagattctggtgaccggccgctctgagagcatcatgaaacttgaagagagaacaggggtgtcctgggacctgggcgtcgaagatgcgtctgagagcaagctcctgaccgtgtccatcatggacctcagccagatgtattctccggttttcgagtacctgtccggagatagacaggtggaagagtggcccaaagccacgtgtacaggcgactgccctgaacgctgtgggtgcaccagctctacctgccttcataaggagtggccccactccagaaactggcggtgtaatcctacatggtgctggggagtcggcaccgggtgtacatgctgtggagtggatgttaaggacctgtttacggatcacatgttcattaaatggaaggtggaatacatcaaaaccgaggctattgtctgcgtggagctcacaagccaagaacgccagtgttccctgatcgaggccggcaccagatttaacctgggccccgttacaattaccctttctgaaccgcggaatatccagcagaagctgcctcccgagatcattacgctccatcccaaaatcgaagaggggttctttgacctgatgcacgtgcaaaaggtcctcagcgcttccaccgtgtgcaagctgcagagctgtacacatgggattcctggcgaccttcagatctatcacattgggaacctgctgaaaggagatcgcctcaacggccatctgatccacaagattgagccccacttcaatacctcttggatgtcctgggacgggtgcgatcttgactactattgtaacatgggagattggcctagctgcacatacaccggcgtgacacagcataatcacgccgcctttgtcaacctgctcaatatcgaaacggactataccaaaacattccattttcactctaagagagttaccgctcacggcgataccccgcaactggacctcaaagcgcggcccacatacggggccggagagatcacggtgctggtggaagtcgctgatatggagcttcataccaagaaagtggagatttccggcctgaagttcgccagcctggcctgcacagggtgttatgcttgctctagcggaatctcctgtaaggttcgcattcacgtggacgaacctgatgagctcaccgtccatgtgaaatctagcgaccccgatgttgtggccgcgtccacaagcctgatggctagaaaacttgagttcggcaccgactccacgtttaaagccttctctgccatgcctaagacaagcctgtgcttttacatcgtcgaacgggaatactgtaaatcctgctctgaggacgataccaagaagtgtgtggacaccaaactcgatcagccccagagcattctgatcgagcacaaggggacaatcattggaaaacaaaacgatacctgcacagctaaggcctcctgttggctcgaatctgtcaaatccttcttttatggcctgaagaatatgcttggctccgtgttcgggaactttttcgttggaatcctgctgtttctcgcgccgttcgtgctgcttgtcctgtttttcatgtgcggctggaagattctcttctgttttaaatgctgcagacgcacccgggggctgttcaagtacagacatctcaaagacgacgaggaaacgggatatcgccggatcattgagagactgaatagcaagaaaggcaagaaccgccttctggatggggaacggctggctgacagaaagatcgccgagctcttttctacaaaatcccacatcggatga

SEQ ID NO: 13624 - RNA, 5067 nt, synthetic construct
  misc_feature 1..5067: note = derived and/or modified CDS sequence (opt5) from CCHFV(37-R-2013)__KR814858.1__GP
  source 1..5067: mol_type = other RNA
atgcccaccaacatcatgcacacactgctcgtgtgcttcattctgtaccttcagctgctcggccttgggggagcccatagacaaagcaatgctacggagcacaacggcaccaatacaaccacagccccttccacctctcagagcccgaagccccctgtctccacagcgccccctcatgctcccgaaacctctacgatcaaacctaccacaccggccagcgagaccgaagggtccggagagacaacgccccctcccaacaccacacagggcccttctcccccggaagccacccctgagcggcccgctacaaccgttaccagcacaccttccacggacaataccaacagcacaacccacgccacagataataaccccacctctacgatttccacaagcccctcttccagcccttctaccccgtccacaccccaggggatccatcaccctgctcgcaatcttctgagcgtgtcctctcccaagaccgccaccacacctacgcccaccagcccgggagacatttccagcgagacatcttccctccacagcgcgatgtctagaacccctacactgcataccgccacgcaagctagcaccgaaaacgccaatcactccgctccccggcagtctgagagctccgcccagcagacaaccacaagccctatgacctctcccgcgcaacctatcctggtgatgtccgccgctcccacggccatccagaacattcatccgagccctacaaatcgctctaaaagaaacctcgaaatggagatcattctgaccctttcccagggcctgaagaaatattacggcaagatcctcaagctgcttcacctgacactcgaggaagataccgaggggctgctggaatggtgtaaacggaatctcggaagcaactgcgacgatgactttttccagaagcgcattgaggaatttttcatgaccggcgaggggtattttaacgaggtcctgcaattcaaaacactttccacgctgtctcccaccgaacccagccacgctagacctccgacagtggagccctttaagtcctacttcgccaaaggatttctctctatcgatagcggctatttctccgccaagtgttaccctcggctgaccacaagcgggcttcagctgattaatgttacccagcatcccgctcgcatcgcggaaacgcctggacccaagacaacctctctcaaaaccatcaactgcattaatctgagagcctccgtgtttaaggagcaccgggaaatcgagattaacgtcctgctccctcaaatcgctgtgaatctgagcaactgtcatgttgtgattaattctcacgtctgcgactattcccttgatacagacggccccgtgcgcctgccgcatatctaccacgagggcaccttcatccctgggacatacaaaattgtgatcgataagaaaaacaagctcaatgacagatgtacgctggtcaccaactgcgttattaaaggacgggaagtgcgcaagggccagagcgtgcttagacagtataagacagagatcaaaattgggaaggcctctaccggaagccggaaactgctctccgaagaacccggcgatgactgtatcagcagaacacagctgctgcgcaccgaaacggccgagatccacgacgataattacgggggacctggcgacaagattaccatctgcaacggctctacaattgtcgatcaacggctcgggtccgagctgggatgttataccatcaatagagtgaaatcctttaagctgtgcgaaaacagcgctacaggcaagacctgcgagattgactctacacccgttaaatgtcgccaggggttctgcctgaagatcacccaggaaggacggggccatgtgaaactcagcagagggtccgaggtcgtgctggatgcctgtgacacgtcttgcgaggttatgattccgaagggcacaggagatatcctggtggactgtagcggcgggcagcaacacttccttaaagataatctcatcgacctgggatgccctcatattcccctgctcggcaagatggcgatctacatttgtcgcatgtccaaccaccctcggaccaccatggcttttctgttctggttttctttcgggtatgtcatcacatgcatcttttgtaaggcccttttctacagcctgattatcattggaaccctcggcaaaaagatcaaacagtatagagaactgaagccccagacgtgcacaatttgtgagaccgcccccgtgaacgctatcgatgccgaaatgcacgacctgaattgctcctacaacatttgcccttactgtgctagccgccttacatctgacgggctcgcccggcatgtcccgcagtgccccaaaagaaaggagaaggtggaagagaccgagctgtatctgaatctcgaacgcatcccttggatcgttcggaaactgcttcaagtgtccgagagcacaggcgtcgcgctgaagagatcttcctggctcattgtgctgctggttcttctcaccgtgagcctgtctcccgtccagtccgcccctgtgggacacggcaaaacgatcgaaacctaccagacacgggaggggtttaccagcgtgtgtctgttcatgctcggatccattctgtttcttgttagctgcctggtcaagggcctcgtggattctgtgagcgactccttctttcccgggctgtctgtctgtaaaacatgcagcatcggatccattaacggcttcgaaatcgagtctcataagtgttattgcagcctgttttgttgcccttactgtcgccactgctccgctgatagagagatccatcagcttcacctctctatttgcaaaaagcggaagatggggagcaatgtgatgctggccgtttgtaaaagaatgtgcttccgcgctaccatcgaagcctcccggagagcgctgctcattcgcagcatcattaacacgacattcgtgatctgtattctgacccttacaatctgcgtcgtgtctacctccgccgttgagatggaaaatctgccgagcggcacctgggagagagaagaggacctcacaaacttttgtcaccaagagtgccaggtgacggaaaccgagtgtctgtgcccctatgaagctctggtccttcggaagcctctgttcctcgattctatcgtgaaaggaatgaagaatctgctcaactccacaagcctggagacctccctttctattgaggccccctggggcgctatcaatgttcagagcacatttaaacctaccgtgtccacggccaacattgccctgagctggtcttccgtcgaacatcgcgggaataagatcctcgtgacaggaagaagcgagtctattatgaagctggaggagcggaccggcgtgagctgggacctgggggtcgatgacgcttccgaatctaaacttctgaccgttagcatcatggatctctcccaaatgtactctcccgtgttcgagtatctgagcggagaccgccaggtggaggaatggccgaaggcgacatgtaccggcgattgccctgagagatgtgggtgcacatccagcacgtgcctccacaaagaatggccccattctcggaactggcgctgtaatcccacctggtgctggggcgtcggaacaggctgtacctgctgtggggtggacgttaaggatctgtttacagaccacatgttcgtgaaatggaaggtcgagtacatcaagaccgaagccattgtgtgcgttgagcttacgtcccaggagagacagtgtagcctgatcgaagctggaacccggtttaacctcggccctgtgacaattaccctgtccgagccccgcaacatccaacagaaactgcctccggaaattatcacacttcatcccaaggtcgaggaagggttctttgacctgatgcacgtgcagaaagttctctctgccagcaccgtgtgcaagctgcagtcctgtacacacggaatccctggcgatctccaagtctaccatattggcaatctgcttaaaggggacagagtgaacggacacctgatccataagattgagccccacttcaatacgtcttggatgagctgggatggctgcgacctggattattactgtaacatgggggactggccttcctgcacctatacaggagtgacccagcacaatcatgccgcttttgtcaacctcctgaatatcgagaccgattacacaaagacgttccactttcatagcaaacgggttaccgcccacggcgacacaccccagcttgatctgaaggcgagaccgacctatggggctggagaaattacagtgctcgtggaggtcgccgacatggaactgcataccaaaaaggtggagatctctggcctcaaattcgcctccctggcttgcacgggctgttacgcctgcagctctgggatttcctgtaaggttcgcatccacgtggatgagcctgacgaacttacagtccacgtgaaaagcaacgatcccgacgttgtggcggcttctaccagcctgatggcccggaagctggagttcggaaccgactccacatttaaggccttctctgctatgcctaaaaccagcctctgcttttatatcgtcgaaagagagtactgtaagtcctgcagcgaagaggatacacagaaatgtgtggacaccaagctggagcaaccccagtccattcttatcgaacataaaggcacgattatcgggaagcagaatgtcacatgcaccgccaaggcttcttgttggctggagagcgtgaaatccttcttttacggactcaagaacatgctgggctctgttttcgggaactttttcattggaatcctcctgtttcttgcccctttcgtgctgctggtcctctttttcatgttcggctggaaaatcctgttttgcttcaagtgttgccgccggacaagaggccttctgaaatatcgcctcctgaaggatgacgaagagaccgggtaccggagaattatcgaacgcctcaataataagaaaggaaagaaccggctgcttgatggcgagagactggcggaccggaaaattgccgagctgtttagcacgaagacccacatcgggtga

SEQ ID NO: 13625 - RNA, 5067 nt, synthetic construct
  misc_feature 1..5067: note = derived and/or modified CDS sequence (opt5) from CCHFV(36-ST-2014)__KR814857.1__GP
  source 1..5067: mol_type = other RNA
atgcccatcaacattatgcacaccctgctcgtgtgcttcatcctgtaccttcagctgagcggcctcgggggagcccatggccaatccaatgctacagagcacaacgggacgaataccacaaccgtccctggaacatctcagagcccgaagccccctgcctccaccacactgccccatacccctgaatctagcacggttaaacttaccacacccacctccgagacagaaggctctggggagaccacgcctccgcccaacacaacccagggactgcctccccctggcacaacccccgaaagaccggcgaccacagctacgagcatgtccagcaccgacaatatgaactctacaacccaggtgacagataatacccctacgtccacagtgagcatttctccctccagctctccttccatgcccagcacctcccaaggcatccactatcccgtccggtctctcctgagcgtgtccagccctaagaccgttacaaccccgacacccatgtctcctggggagatgtcccccgagacgagctctcagcatagcgccatgtcccgcattcctaccctgtacacagccacccaggtgtctacagaaaacaccaatagaagcacgccccggcagtccgagagctctgctcaaccggccacccagtcccctacaaccagccccacacagaccatcctcctgatgtctgctgcccctaaagcgatccaggacatgcacccctcccctacgaaccgcagcaagagaaatcttgaagtcgagattatcctgacactctcccaaggactgaaaaagtattacggcaagattcttaaactgctccacctgaccctggaggaagatacagaggggctcctggaatggtgtaagcggaaccttggatctaattgcgacgatgactttttccagaaacgcatcgaggaatttttcattaccggcgaggggtattttaacgaggtgctgcagttcaagaccctcagcacactgtcccccacggaaccgtctcatgttagacttcctaccgccgagccctttaaaagctacttcgctaagggatttctgtccatcgatagcggctatttctctgccaagtgttacccccggtccagcacatctggcctccaactgattaatgtgacccagcaccctgctcgcatcgccgaaacaccggggcccaaaaccacgtccctgaagacaatcaactgcattaacctcagagcgagcgtctttaaagagcatcgggaagtggagatcaatgtgctgcttcctcagattgccgtcaacctgtctaattgtcacgttgtgatcaacagccacgtgtgcgactactccctcgataccgacggacccgtccgcctgcctcggattcatcacgagggcaccttcatccccgggacatataagatcgtgattgataaaaagaataaacttaacgaccggtgtagcctggttaccaattgcgtgatcaagggacgcgaagtcagaaagggccagtctgtgctccggcaatacaaaacagagattaagatcgggaaagcgtccacgggaagcagaaagctgctgtccgaggaacctggcgatgactgtatttctcgcacccagctcctgaaaacagaaaccgccgagatccatgacgataactatggcgggcccggagacaagatcacaatttgcaatggcagcaccatcgttgatcagcggcttgggtccgagctgggatgttacacgattaacagagtgaagtcttttaaactctgcgaaaatagcgctaccggcaagacatgcgagatcgactccaccccggtcaaatgtcgccaggggttctgcctgaagattacacaagaaggccggggacacgtgaaactgtctagaggcagcgaggtcgtgcttgatgcctgtgactccagctgcgagatcatgattcctaaggggaccggagatatcctcgttgactgttctggcgggcagcagcatttcctgaaggataacctgatcgacctcggatgcccccacattcctctgcttggcaaaatggccatctatatttgtcgcatgtccaatcacccccggacaaccatggcttttctgttctggtttagcttcgggtacgtgatcacgtgcatcttttgtaaggctctcttctattctctgattatcattggcacactggggaaaaagatcaaacagtacagagaacttaagccgcaaacctgcaccatttgtgagacagcccctgtcaacgctatcgatgccgaaatgcatgacctcaattgctcctacaacatttgcccctattgtgccagccgcctgacctctgacggcctggctcggcacgtgacgcagtgccctaagagaaaagagaaggttgaagagacagagctctacctgaaccttgaacgcatcccctggatcgtgcggaaactgctccaggtctccgagagcaccggggtggccctgaagagatccagctggctgattgtgcttctcgttctgctgacagtctctctcagccccgtgcagtccgcgcctgtgggacatggcaaaaccatcgaaacatatcaaacccgggaggggtttacgaatatttgtctgttcatgcttggatctatcctgtttattgtcagctgcctcgtgaagggcctggttgattccgtgtctgacagcttctttccggggctgtccgtctgtaaaacctgctctatcggcagcatcaacggattcgaaattgagtcccacaagtgttactgcagcctcttttgttgcccctattgtcgccactgctctgctgatagagagatccatcagcttcacctgggcatttgcaagaaacggaagacagggtccaatgtgatgctggccgtttgtaaaagaatgtgcttcaaggccaccatcgaagctagccgccgggccctcctgattagatctatcattaacacaaccttcgtgatctgtatccttacgctggctatttgcgtcgtgtccacaagcgccgttgagatggaaaatctccctgcgggaacctgggagcgcgaagaggacctgacaaacttttgtcatcaggagtgccaagtgtccgaaaccgagtgtctgtgcccctacgaagcccttgtcctgagaaaacctctcttcctggattctatcgtgaagggcatgaagaatctcctgaacagcacctcccttgagacaagcctgtctattgaggctccctggggagccatcaatgtgcagtccacgtttaaacctaccgtcagcacagctaacattgccctctcttggagctccgttgaacaccggggaaataagatcctggtgaccggccgctctgagagcatcatgaaactggaagagagaacaggggtgtcctgggaccttggcgtcgaagatgcgtctgagagcaagctgctcaccgtgtccattatggacctgagccagatgtattctccggttttcgagtacctctccggagatagacaggtggaagagtggcccaaagccacgtgtacaggcgactgccctgaacgctgtgggtgcaccagctctacctgcctgcataaggagtggccccactccagaaactggcggtgtaatcctacatggtgctggggagtcggcaccgggtgtacatgctgtggagtggatgttaaggacctttttacggatcacatgttcatcaaatggaaggtggaatacattaaaaccgaggctatcgtctgcgtggagctgacaagccaagaacgccagtgttccctcattgaggccggcaccagatttaacctgggccccgttacaatcaccctgtctgaaccgcggaatatccagcagaaacttcctcccgagattatcacgctgcatcccaaaattgaagaggggttctttgacctcatgcacgtgcaaaaggtcctgagcgcttccaccgtgtgcaagctccagagctgtacacatggaatccctggcgacctgcagatttatcacatcgggaaccttctgaaaggagatcgcctgaacggccatctcattcacaagatcgagccccacttcaatacctcttggatgtcctgggacgggtgcgatctggactactattgtaacatgggagattggcctagctgcacatacaccggcgtgacacagcataatcacgccgcctttgtcaaccttctgaatatcgaaacggactataccaaaacattccattttcactctaagagagttaccgctcacggcgataccccgcaactcgacctgaaagcgcggcccacatacggggccggagagattacggtgctcgtggaagtcgctgatatggagctgcataccaagaaagtggagatctccggccttaagttcgccagcctggcctgcacagggtgttatgcttgctctagcggaatttcctgtaaggttagaatccacgtggacgaacctgatgagctgaccgtccatgtgaaatctagcgaccccgatgttgtggccgcgtccacaagcctcatggctcgcaagctggagttcggcaccgactccacgtttaaagccttctctgccatgcctaagacaagcctttgcttttacattgtcgaacgggaatactgtaaatcctgctctgaggacgataccaagaagtgtgtggacaccaaactggatcagccccagagcatcctcatcgagcacaaggggacaattatcggaaaacaaaacgatacctgcacagctaaggcctcctgttggctggaatctgtcaagagcttcttttatggcctcaagaatatgctgggctccgtgttcgggaactttttcgttggcattcttctgtttctggcgccgttcgtgctcctggtccttttctttatgtgcggatggaagttcctgttttgtttcaaatgctgcagacgcacccgggggctctttaagtacagacatctgaaagacgacgaggaaacgggatatcgccggatcattgagagactcaatagcaagaaaggcaagaaccgcctgcttgatggggaacggctggctgacagaaagatcgccgagctgttctctacaaaatcccacatcggatga

SEQ ID NO: 13626 - RNA, 5067 nt, synthetic construct
  misc_feature 1..5067: note = derived and/or modified CDS sequence (opt5) from CCHFV(24-R-2012)__KR814856.1__GP
  source 1..5067: mol_type = other RNA
atgcccaccaacatcatgcacacactgctcgtgtgcttcattctgtaccttcagctgctcggccttgggggagcccatagacaaagcaatgctacggagcacaacggcaccaatacaaccacagccccttccacctctcagagcccgaagccccctgtctccacagcgccccctcatgctcccgaatctagcaccatcaaacctacgaccccggcctccgagacagaagggtctggagagaccacaccccctcccaacaccacgcagggccctagcccgcccgaagccacacctgagcggaccgctacaaccgccacctccacacccagcacggacaataccaactctacaacccacgctacagataataaccctacctccacgattagcacatctccctccagctctccctccacccctagcaccccgcaggggatccatcaccccgcccgcaatctgctgtccgtttctagccctaagacagcgaccacacccacgcctacctcccccggagacattagctctgagacatccagcctccactctgccatgagcagaaccccgacactgcataccgctacgcaagcctccaccgaaaacgctaatcactctgcccctcggcagagcgagtccagcgcgcagcagacaaccacatctcccatgacctcccctgcccaacccatcctggtgatgagcgctgcccctacggctatccagaacattcatccctctccgacaaatcgctccaaaagaaacctcgaaatggagatcattctgacccttagccagggcctgaagaaatattacggcaagatcctcaagctgcttcacctgacactcgaggaagataccgaggggctgctggaatggtgtaaacggaatctcggatccaactgcgacgatgactttttccagaagcgcattgaggaatttttcatgaccggcgaggggtattttaacgaggtgctgcaattcaaaacactttctacgctgagccctaccgaaccctcccacgccagaccccctacagtcgagccgtttaagtcttacttcgccaaaggatttctcagcatcgattccggctatttcagcgctaagtgttacccccggctgtctacctccgggcttcagctgattaatgtgacacagcatcctgcgcgcatcgccgaaacccccggacctaagacgacaagcctcaaaaccatcaactgcattaatctgagagcttctgtttttaaggagcaccgggaaatcgagattaacgtgctgctcccccaaatcgccgtcaatctgtccaactgtcatgtggttattaatagccacgtgtgcgactattctcttgataccgacggccctgtccgcctgccccatatctaccacgagggcacattcatcccggggacctacaaaattgtgatcgataagaaaaacaagctcaatgacagatgtacactggtgacgaactgcgtcattaaaggacgggaagttcgcaagggccagagcgtgcttagacagtataagaccgagatcaaaattgggaaggcctccacaggaagccggaaactgctctctgaagaacctggcgatgactgtatctccagaacccagctgctgcgcacagaaaccgctgagatccacgacgataattacgggggacccggcgacaagattacgatctgcaacggcagcaccattgtggatcaacggctcgggtccgagctgggatgttatacaatcaatagagtcaaatcttttaaactttgcgaaaacagcgccaccggcaagacatgcgagattgactccacccctgtgaaatgtcgccaggggttctgcctgaagatcacacaggaaggacggggccatgttaaactctctagagggagcgaggtggtcctggatgcgtgtgacacctcctgcgaggtgatgattcccaagggcacgggagatatcctggttgactgttctggcgggcagcaacacttccttaaagataatctcatcgacctgggatgcccgcatattcctctgctcggcaagatggctatctacatttgtcgcatgagcaaccacccccggacaaccatggcctttctgttctggttttccttcgggtatgtgattacctgcatcttttgtaaggcccttttctacagcctgatcatcattggaacactcggcaaaaagatcaaacagtatagagaactgaagcctcagacctgcacgatttgtgagacagctcccgtcaacgccatcgatgctgaaatgcacgacctgaattgctcttacaacatttgcccctactgtgcctcccgccttaccagcgacgggctcgcgcggcatgtgcctcagtgcccgaaaagaaaggagaaggtcgaagagacagagctgtatctgaatctcgaacgcatcccctggatcgtgcggaaactgcttcaagtttctgagtccaccggcgtggccctgaagagaagctcttggctcattgtcctgctggtgcttctcacagtttccctgagccctgtgcagtccgctcccgtcggacacggcaaaaccatcgaaacgtaccagacccgggaggggtttacaagcgtgtgtctgttcatgctcggatctattctgtttcttgtgagctgcctggttaagggcctcgtcgattccgtgtctgacagcttctttcctgggctgtccgtgtgtaaaacctgctctatcggaagcattaacggcttcgaaatcgagtcccataagtgttattgctctctgttttgttgcccctactgtcgccactgcagcgccgatagagagatccatcagcttcacctctccatttgcaaaaagcggaagatggggagcaatgtcatgctggctgtgtgtaaaagaatgtgcttccgcgccacaatcgaagcgtctcggagagccctgctcattcgctccatcattaacaccacgttcgttatctgtattctgacacttaccatctgcgtggtcagcacatctgctgtggagatggaaaatctgccttccggcacctgggagagagaagaggacctcaccaacttttgtcaccaagagtgccaggttacagaaacggagtgtctgtgcccgtatgaagccctggtgcttcggaagcccctgttcctcgatagcatcgtcaaaggaatgaagaatctgctcaactccacctctctggagacaagcctttccattgaggctccttggggcgccatcaatgtgcagagcacctttaaacccacagtttctaccgccaacattgctctgtcctggagctctgtggaacatcgcgggaataagatcctcgtcacgggaagaagcgagtccattatgaagctggaggagcggacaggcgtgtcttgggacctgggggtggaagatgcgagcgagtccaaacttctgaccgtctctatcatggacctcagccaaatgtactcccctgttttcgagtatctgagcggagatcgccaggtggaagagtggcccaaggccacctgtacaggcgactgcccggaaagatgtgggtgcacctcttccacatgcctccacaaagagtggcctcatagccggaactggcgctgtaatcccacgtggtgctggggcgtgggaaccggctgtacatgctgtggggtcgatgtgaaggacctgtttaccgatcacatgttcgttaaatggaaggtggaatacatcaagacagaggctattgtctgcgtggagcttacctcccaggaaagacagtgttctctgatcgaggccggaacgcggtttaacctcggccccgttaccattacactgagcgaacctcgcaacatccaacagaaactgccccctgagattatcacccttcatccgaaggtggaagaggggttctttgacctgatgcacgtccagaaagtgctctccgcctctacagtttgcaagctgcagagctgtacccacggaatccccggcgacctccaagtgtaccatattggcaatctgcttaaaggggatagagtcaacggacacctgatccataagattgagcctcacttcaatacatcctggatgagctgggacggctgcgatctggactattactgtaacatgggggattggccctcttgcacgtataccggagtgacacagcacaatcatgctgcctttgtgaacctcctgaatatcgaaaccgactacaccaagacattccactttcattccaaacgggtcacggcgcacggcgatacccctcagcttgacctgaaggctagacccacatatggggccggagagattaccgttctcgtggaagtggccgatatggagctgcatacaaagaaggtcgagatcagcggcctcaaattcgcttctctggcctgcaccggctgttacgcgtgctccagcgggatttcttgtaaggtgcgcatccacgttgacgaaccggatgagcttacggtgcacgtcaaaagcaacgaccctgatgtggttgctgcctccacatctctgatggcccggaagctggaatttggaaccgacagcacctttaaggctttctccgccatgcccaaaacaagcctctgcttttatatcgtggagagagaatactgtaagtcctgctctgaggaggacacccagaaatgtgtcgatacaaagctggaacaacctcagagcattcttatcgagcataaaggcaccattatcgggaagcagaatgacacgtgcacagctaaggcctcctgttggctggaatctgtgaaatccttcttttacggactcaagaacatgctgggcagcgtcttcgggaatttcttcattggaatcctcctgtttcttgcgcccttcgtgctgctggttctctttttcatgttcggctggaaaatcctgttttgcttcaagtgttgccgccggaccagaggccttctgaaatatcgcctcctgaaggatgacgaggaaacagggtaccggagaattatcgagcgcctcaacaataagaaaggaaagaaccggctgcttgatggcgagagactggccgaccggaaaattgctgaactgttttctaccaagacgcacatcgggtga

SEQ ID NO: 13627 - RNA, 5064 nt, synthetic construct
  misc_feature 1..5064: note = derived and/or modified CDS sequence (opt5) from CCHFV(Oman-199809166)__KR864901.1__GP
  source 1..5064: mol_type = other RNA
atgcccgtgaacaccatgcacacactgctcgtctacgccgttttctgcctgcagctttggagccctggcgggacgagaggactgtccaatgagacccaacataacgaaacaggcatcacccgggctccggaggggtctcagggacccagcctccctgtgtccacagcctctcccattatgagcgacccttccatcaccacactgtctgcgagcacctccggccttgaagggagcggagatacgacaccccctgctattacacagggcccgaccctgcccgagacaacccctgaaccctctacgacaaccggcacaaatgccttttccaccgccatcgctaacgtgagcacccagacagtcaaggacacgcctacccccacagtgcaaacctctccgccttccacacccgatgccagcaccattcctcaggggacgcaccatacagctcgcggactcctgtctgttaccgtgaccaaacccgaggaggtccccacacctaccggcccggaacaggcctccatcgagacaaatagctccagactggcgacgtctaagacccccagcccttcccccacagcccaggtgaccacagaaaacagcaatcctaacacctctcggcaactcgttctgtccacgcagcccgctaccagctctccggtgacaagccctgcccagcttaatttcgtccagtccgctaccacaatcgccgtgcaagacgcgcacccctctcctaccaaccgcagcaaaagaaatctggagatggaggtgattctcacgctgtcccaggggcttcggaagtattacggacgcatcctgaaactcctggatctgacactcgaagaggacaccgaaggcctgcttgagtggtgtaagagaaacctggggctcacatgcgatgacaactttttccagaagcggattgaagagtttttcctgaccggagagggccattttaatgaagtccttcaattcaaaacccccagcacactgtctcctacggagtccgccagcgttggcctccccaccgtggaaccgtttaagtcttatttcgctaaagggtttctgtccatcgatagcggatacttctccgccaagtgttatcctcgcgcttctaatagcggcctgcagctcattaacgtgacacagcactccgccagaatcgccgacacccccgggcccaaaattacaaacctgaagaccatcaattgcatcaaccttaaggctctggtctttaaagagcaccgggaaattgagatcaatgtgctcctgcctcaggttgcggtgaacctttctaattgtcatgtccacattaagagccatgtgtgcgattactccctggacatcgatggaacggttcgcctcccgcggattcaccacgagggcacattcatccccgggacctataaaatcgtgattgacaagaaaaacaagcaaaatgacagatgtaacctggtcaccaattgcgtgatcaaaggacgcgaagtcagaaagggccagagcgtgctgcggcagtacagaacagagattcgcatcggcaaggcctcttccgggagccggagactcctgtctgaagagtccggagaagattgtattagccgcacccagcttctgcggacagagacggctgagatccatggcgacaactacgggggacctggcgataaaatcaccatttgcaatgggtctacaatcgttgaccaaagactcggcagcgaactgggatgttataccattaaccgcgtgaagtccttcaaactgtgcgagaatagcgccacaggcaagtcttgcgaaatcgataacacccccgtcaaatgtaagcaggggttttgccttaagattacgcaggagggacggggccacgtgaaactctccagagacagcgaggttgtgctggatgcctgtgactcctcttgcgaaatcatgattcctaaggggaccggagatatcctggtcgactgtagcggcgggcagcaacatttcctcaaagataatctgatcgaccttggctgccccaacattcctctgctcggaaagatggctatctacatttgtcgcatgtccaaccaccccaaaacaaccatggcctttctgttctggttttctttcggctatgtgatcacatgcattctgtgtaaggtgatcttttaccttctcatcgttgtcgggaccctgggaaagaaattcaagcagtatcgggagctgaaaccgcagacatgcaccatttgtgaaacgacacctgtgaatgcgatcgacgctgagatgcatgatctcaactgcagctacaatatttgcccctattgtgcctccagactgacctctgacggccttgcccgccacgtgatgcagtgccctaagcggaaagaaaagatcgaggagaccgaactgtacctcaacctggagcggattccctgggtcgtgagaaagctgcttcaagttagcgaatccacaggggtggctctcaaacgcagctcttggctgatcgtcctgctcgtgctgcttaccgtttccctgagcccggtgcagtctgcccctatcggacacggcaagacgattgagacataccagaccagagaagggtatacatccatctgtctctttgtcctgggcagcattctgttcatcgtgtctcatcttatgaaaggactcgttgattccgtgggcaatagctttttccccgggctgtccatttgcaagacctgtagcatcggatctatcaacggctttgagattgagagccacaaatgctactgttccctgttctgctgtccttattgccggcattgttctgctgacaaggaaatccacaaactccacctgagcatttgcaagaagagaaaagccgggtccaatgtcatgcttgcggtgtgcaagcgcatgtgtttccgggccacaatggaggtgtctaacaaagctctgctcatcagaagcgtcattaataccacgtttgttgtgtgcatcctgattctggccgtgtgtgtcgtgtccacctctgctgttgaaatggagagccttcccgccggaacatgggaacgcgaggaggatctgaccaacttctgccatcaagaatgtcaggtgacagagaccgaatgcctctgtccctacgaggcgctggtcctcagaaagcctctgtttcttgactccatcgccaaaggcatgaagaatctgctcaacagcacgtctctggagacatccctgagcatcgaagctccgtggggcgccattaatgtgcagtctaccttcaagcccacagtttccaccgctaacatcgcccttagctggtcctctgtggagcaccgggggaataaaattctggtcagcggacgctccgaaagcatcatgaagctcgaggaaagaaccggcatttcttgggatctgggggtggaggacgcctccgagagcaaactcctgacagtttctgtgatggatcttagccagatgtattcccctgtctttgaatacctgtctggagaccggcaagtggaggaatggcccaaggctacgtgcaccggcgattgtcctgagcgctgcgggtgtacaagctctacctgcctccataaagaatggccccactctagaaactggcggtgcaaccctacatggtgttggggagtgggcaccggctgcacgtgttgcgggctggacgtcaaggatctgttcacagactatatgtttgttaagtggaaagtggagtacatcaagaccgaggcgatcgtgtgtgtcgaacttaccagccaggagcgccagtgctccctgattgaagccggaacaagattcaatctcggcccggtgaccatcacactgagcgagccccggaacattcagcaaaaactccctcccgaaatcgttacgctgcatcctcgcattgaggaggggtttttcgaccttatgcacgtgcagaaggtcctgtctgcttccaccgtgtgtaaactgcagagctgcacacacggagttcccggcgatctccaggtgtaccatatcgggaatctgcttaagggagacaaggtcaacggccacctgatccataaagtggaaccgcactttaatacctcctggatgtcttgggatggctgtgacctcgattattactgcaacatgggggactggcctagctgtacatataccggagtcacgcaacataatcacgccgccttcgtgaacctgctcaatattgagaccgattacacaaagaactttcacttccattccaaaagagttaccgctcacggcgacacaccccagctggatcttaaggcccggcccaattatggggcgggagaaatcaccgtgctggtcgaggtggctgacatggagctgcataccaaaaagattgaaatctctggcctcaaattcgccagcctgacgtgcaccgggtgctacgcctgttccagcggaatttcttgcaaggttagaatccacgtggatgagcctgacgaacttacagtccacgtgaagtccgaggatcccgacattgtggctgccagctcctccctgatggcgcgcaaactcgaatttggcaccgacagcaccttcaaggctttttctgccatgcctaaaacaagcctgtgtttctatatcgttgagcgggagtactgcaagtcctgttctaaagaagatacgcagaagtgcgtcaacgccaagctcgagagaccgcaaagcatcctgattgaacataaaggcaccatcattgggaagcagaatgacacatgtaccgctaaagcctcctgctggcttgagagcgtgaagtcctttttctacggactgaaaaacatgctgtctggcatctttgggaatgtgttcattggaatctttctcttcctggctccctttatccttctgattctcttcttcatgtttggctggcgcatcctgttctgttttaagtgctgtcggagaacacgcggactcttcaagtatcggcacctgaaagatgacgaagagaccgggtacagaaagattatcgagcgccttaacaacaaaaagggcaaaaataagctgctggatggcgaacggctcgccgacagaaagattgcggagctgtttagcacgaaaacacatatcgggtga

SEQ ID NO: 13628 - RNA, 5064 nt, synthetic construct
  misc_feature 1..5064: note = derived and/or modified CDS sequence (opt5) from CCHFV(Oman_812956)__KY362518.1__GP
  source 1..5064: mol_type = other RNA
atgcccgtgaacaccatgcacacactgctcgtgtacgccgttttctgcctgcagctttggagccctggcgggacgagaggactgtccaatgagacccaacataacgagacaggcatcacccgggctccggaggggtctcagggacccagcctccctgtgtccacagcctctcccattatgagcgacccttccatcaccacactgtctgcgagcacctccggccttgaagggagcggagatacgacaccccctgctattacacagggcccgaccctgcccgagacaacccctgaaccctctacgacaaccggcacaaatgccttttccaccgccatcgctaacgtgagcacccagacagtcaaggacacgcctacccccacagtgcaaacctctccgccttccacacccgatgccagcaccattcctcaggggacgcaccatacagctcgcggactcctgtctgttaccgtgaccaaacccgaggaggtccccacacctaccggcccggaacaggcctccatcgagacaaatagccccagactggcgacgtccaagaccccttctcccagccctacagcccaggtgaccacagaaaactccaatcccaacaccagccggcaactcgttctgtctacgcagccggctacctccagccctgtgacatctcccgcccagcttaatttcgtccagagcgctaccacaatcgccgtgcaagacgcgcacccttcccccaccaaccgctctaaaagaaatctggagatggaggtgattctcacgctgagccaggggcttcggaagtattacggacgcatcctgaaactcctggatctgacactcgaagaggacaccgaaggcctgcttgagtggtgtaagagaaacctggggctcacatgcgatgacaactttttccagaagcggattgaagagtttttcctgaccggagagggccattttaatgaagtccttcaattcaaaaccccttccacactgagccccacggagtctgcctccgttggcctcccgaccgtggaaccttttaagagctatttcgctaaagggtttctgtctatcgattccggatacttcagcgccaagtgttatccccgcgcttccaattctggcctgcagctcattaacgtgacacagcacagcgccagaatcgccgacacccccgggcctaaaattacaaacctgaagaccatcaattgcatcaaccttaaggctctggtctttaaagagcaccgggaaattgagatcaatgtgctcctgccgcaggttgcggtgaacctttccaattgtcatgtccacattaagtctcatgtgtgcgattacagcctggacatcgatggaacggttcgcctcccccggattcaccacgagggcacattcatccctgggacctataaaatcgtgattgacaagaaaaacaagcaaaatgacagatgtaacctggtcaccaattgcgtgatcaaaggacgcgaagtcagaaagggccagtccgtgctgcggcagtacagaacagagattcgcatcggcaaggccagctctgggtcccggagactcctgagcgaagagtctggagaagattgtatttcccgcacccagcttctgcggacagagacggctgagatccatggcgacaactacgggggacccggcgataaaatcaccatttgcaatgggagcacaatcgttgaccaaagactcggctctgaactgggatgttataccattaaccgcgtcaagagcttcaaactgtgcgaaaattccgccacaggcaagagctgcgaaatcgataacacccctgtgaaatgtaagcaggggttttgccttaagattacgcaggagggacggggccacgtgaaactctctagagactccgaggttgtgctggatgcctgtgacagctcctgcgaaatcatgattcccaaggggaccggagatatcctggtcgactgttctggcgggcagcaacatttcctcaaagataatctgatcgaccttggctgccctaacattcccctgctcggaaagatggctatctacatttgtcgcatgagcaaccacccgaaaacaaccatggcctttctgttctggttttccttcggctatgtgatcacatgcattctgtgtaaggtgatcttttaccttctcatcgttgtcgggaccctgggaaagaaattcaagcagtatcgggagctgaaacctcagacatgcaccatttgtgaaacgacacccgtgaatgcgatcgacgctgagatgcatgatctcaactgctcttacaatatttgcccttattgtgccagcagactgacctccgacggccttgcccgccacgtgatgcagtgccccaagcggaaagaaaagatcgaggagaccgaactgtacctcaacctggagcggattccgtgggtcgtgagaaagctgcttcaagtttctgaaagcacaggggtggctctcaaacgctccagctggctgatcgtcctgctcgtgctgcttaccgtttctctgtcccctgtgcagagcgcccccatcggacacggcaagacgattgagacataccagaccagagaagggtatacatctatctgtctctttgtcctgggctccattctgttcatcgtgagccatcttatgaaaggactcgttgattctgtgggcaattcctttttccctgggctgagcatttgcaagacctgttccatcggaagcatcaacggctttgagattgagtctcacaaatgctactgtagcctgttctgctgtccctattgccggcattgttccgctgacaaggaaatccacaaactccacctgtctatttgcaagaagagaaaagccgggagcaatgtcatgcttgcggtgtgcaagcgcatgtgtttccgggccacaatggaggtgtccaacaaagctctgctcatcagatctgtcattaataccacgtttgttgtgtgcatcctgattctggccgtgtgtgtcgtgagcacctccgctgttgaaatggagtctcttcccgccggaacatgggaacgcgaggaggatctgaccaacttctgccatcaagaatgtcaggtgacagagaccgaatgcctctgtccttacgaggcgctggtcctcagaaagccgctgtttttcgacagcatcgccaaaggcatgaagaatcttctgaactccacgagcctcgagacatctctgtccatcgaagctccctggggcgccattaatgtgcagagcacctttaagcctacagtttctaccgctaacatcgccctgtcctggagctccgtggagcaccgggggaataaaattcttgtctctggacgcagcgaatccatcatgaagctggaggaaagaaccggcattagctgggatctcggggtggaggacgcctctgagtccaaactgctcacagttagcgtgatggatctgtctcagatgtatagccccgtcttcgaatacctttccggagaccggcaagtggaggaatggcctaaggctacgtgcaccggcgattgtcccgagcgctgcgggtgtacatctagcacatgcctgcataaagaatggcctcactccagaaactggcggtgcaacccgacctggtgttggggagtgggcaccggctgcacgtgttgcgggctcgacgtcaaggatctgtttacagactatatgttcgttaagtggaaagtggagtacatcaagaccgaggcgatcgtgtgtgtcgaactgacctctcaggagcgccagtgcagccttattgaagccggaacaagatttaatctgggccccgtgaccatcacactctccgagcctcggaacattcagcaaaaactgccccctgaaatcgttacgctccatccccgcattgaggaggggttctttgacctgatgcacgtgcagaaggtccttagcgcttctaccgtgtgtaaactgcagtcctgcacacacggagttccgggcgatcttcaggtgtaccatatcgggaatctcctgaagggagacaaggtcaacggccaccttatccataaagtggaacctcacttcaataccagctggatgtcctgggatggctgtgacctggattattactgcaacatgggggactggccctcttgtacatataccggagtcacgcaacataatcacgccgcctttgtgaacctcctgaatattgagaccgattacacaaagaacttccacttccatagcaaaagagttaccgctcacggcgacacaccccagctcgatctgaaggcccggcctaattatggggcgggagaaatcaccgtgcttgtcgaggtggctgacatggagctgcataccaaaaagattgaaatctccggcctgaaatttgcctctctcacgtgcaccgggtgctacgcctgtagctccggaattagctgcaaggttagaatccacgtggatgagcccgacgaactgacagtccacgtgaagtctgaggatcctgacattgtggctgcctccagctctcttatggcgcgcaaactggagttcggcaccgactccacctttaaggctttcagcgccatgccgaaaacatctctctgtttttatatcgttgagcgggagtactgcaagagctgttccaaagaagatacgcagaagtgcgtcaacgccaagctggagagaccccaatctatcctcattgaacataaaggcaccatcattgggaagcagaatgacacatgtaccgctaaagccagctgctggctggagtccgtcaagagcttcttttacggacttaaaaacatgctgtccggcatcttcgggaatgtgtttattggaatcttcctgtttctcgctcctttcatcctgcttattctgttctttatgttcggctggcgcatcctcttttgtttcaagtgctgtcggagaacacgcgggctgtttaagtatcggcacctcaaagatgacgaagagaccggatacagaaagattatcgagcgcctgaacaacaaaaagggcaaaaataagctgctggatggcgaacggctggccgacagaaagattgcggaactcttctctacgaaaacacatatcgggtga

SEQ ID NO: 13629 - RNA, 5064 nt, synthetic construct
  misc_feature 1..5064: note = derived and/or modified CDS sequence (opt5) from CCHFV(Oman)__DQ211632.1__GP
  source 1..5064: mol_type = other RNA
atgcccgtgaacaccatgcacacactgctcgtctacgccgttttctgcctgcagctttggagccctggcgggacgagaggactgtccaatgagacccaacataacgaaacaggcatcacccgggctccggaggggtctcagggacccagcctccctgtgtccacagcctctcccattatgagcgacccttccatcaccacaccctctgcgagcacctccggcctggaagggagcggagatacgacccctccggctattacacagggccccacccctcccgagacaacccctgaaccctctacgacaaccggcacaaatgccttttccaccgccatcgctaacgtgagcacccagacagtcaaggacacgccgacccctacagtgcaaacctctcccccttccacacccgatgccagcaccattccccaggggacgcaccatacagctcgcggacttctgtctgttaccgtgaccaaacctgaggaggtcccgacacccaccggccctgaacaggcctccatcgagacaaatagccccagactcgcgacgtccaagaccccttctcccagcccgacagcccaggtgaccacagaaaactccaatcctaacaccagccggcaactggttctgtctacgcagcccgctacctccagccctgtgacatctcccgcccagctcatcttcgtccagagcgctaccacagtggccgtgcaagacgcgcacccttcccccaccaatcgctctaaaagaaacctggagatggaggtcattcttacgctgagccaggggctccggaagtattacggacgcatcctgaaacttctggatctcacactggaagaggacaccgaaggcctgctcgagtggtgtaagagaaatctggggcttacatgcgatgacaactttttccagaagcggattgaagagtttttcctgaccggagagggccattttaatgaagttctccaattcaaaaccccgtccacactgagctctacggagtccgccagcgtgggccttcctaccgtggaaccctttaagtcttatttcgctaaagggtttctgtccatcgatagcggatacttctccgccaagtgttatccccgcgcttctaacagcggcctccagctgattaatgtcacacagcactccgccagaatcgccgacacccctgggccgaaaattacaaacctgaagaccatcaactgcatcaatctcaaggctctggtgtttaaagagcaccgggaaattgagatcaacgttcttctgccccaggtggcggtcaatctctctaactgtcatgtgcacattaagagccatgtttgcgattactccctggacatcgatggaacggtgcgccttcctcggattcaccacgagggcacattcatccccgggacctataaaatcgtcattgacaagaaaaataagcaaaacgacagatgtaatctggtgaccaactgcgtcatcaaaggacgcgaagtgagaaagggccagagcgttctccggcagtacagaacagagattcgcatcggcaaggcctcttccgggagccggagactgctgtctgaagagtccggagaagattgtattagccgcacccagctcctgcggacagagacggctgagatccatggcgacaattacgggggacctggcgataaaatcaccatttgcaacgggtctacaatcgtggaccaaagacttggcagcgaactgggatgttataccattaatcgcgtcaagtccttcaaactctgcgagaacagcgccacaggcaagtcttgcgaaatcgataatacccccgtgaaatgtaagcaggggttttgcctgaagattacgcaggagggacggggccacgttaaactgtccagagacagcgaggtggtccttgatgcctgtgactcctcttgcgaaatcatgattcctaaggggaccggagatatcctcgtggactgtagcggcgggcagcaacatttcctgaaagataacctgatcgacctcggctgccccaatattccgctgcttggaaagatggctatctacatttgtcgcatgtccaaccaccctaaaacaaccatggcctttctgttctggttttctttcggctatgtgatcacatgcattctctgtaaggttatcttttacctgctgatcgtcgtggggacccttggaaagaaattcaagcagtatcgggagctcaaaccccagacatgcaccatttgtgaaacgacacctgtgaacgcgatcgacgctgagatgcatgatctgaattgcagctacaacatttgcccctattgtgcctccagactgacctctgacggcctcgcccgccacgtcatgcagtgcccgaagcggaaagaaaagatcgaggagaccgaactgtaccttaatctggagcggattccttgggtggttagaaagctcctgcaagtgagcgaatccacaggggtcgctctgaaacgcagctcttggcttatcgtgctcctggttctgctcaccgtgtccctgagccccgtccagtctgcccctatcggacacggcaagacgattgagacataccagaccagagaagggtatacatccatctgtctttttgtgctgggcagcattctcttcatcgtttctcatctgatgaaaggactggtggattccgtcggcaacagctttttccccgggctttccatttgcaagacctgtagcatcggatctatcaatggctttgagattgagagccacaaatgcttctgttccctcttctgctgtccctactgccggcattgttctgctgacaaggaaatccacaaactgcacctgagcatttgcaagaagagaaaagccgggtccaacgtgatgctcgcggtgtgcaagcgcatgtgttttcgggccacaatggaggtctctaataaagctctgcttatcagaagcgttattaacaccacgttcgtggtgtgcatcctgattctcgccgtctgtgtggtttccacctctgctgtggaaatggagagcctgcctgccggaacatgggaacgcgaggaggatctgaccaatttttgccatcaagaatgtcaggtcacagagaccgaatgcctttgtccgtatgaggcgctggtgctcagaaagcccctgttcctcgactccatcgccaaaggcatgaagaacctgcttaatagcacgtctctggagacatccctcagcatcgaagctccttggggcgccattaacgttcagtctacctttaagcccacagtgtccaccgctaatatcgccctgagctggtcctctgtcgagcaccgggggaacaaaattctggtgagcggacgctccgaaagcatcatgaaacttgaggaaagaaccggcatttcttgggatctgggggttgaggacgcctccgagagcaaactcctgacagtgtctgtcatggatctcagccagatgtactcccctgtgttcgaatatctgtctggagaccggcaagtggaggaatggcccaaggctacgtgcaccggcgattgtcctgagcgctgcgggtgtacaagctctacctgccttcataaagaatggccgcactctagaaattggcggtgcaaccccacatggtgttggggagtcggcaccggctgcacgtgttgcgggctggacgttaaggatctctttacagactacatgttcgtgaagtggaaagtggagtatatcaagaccgaggcgatcgtctgtgtggaactgaccagccaggagcgccagtgctccctgattgaagccggaacaagatttaaccttggccctgttaccatcacactgagcgagccccggaatattcagcaaaaactccctcccgaaatcgtgacgctgcatccgcgcattgaggaggggttctttgacctcatgcacgtccagaaggtgctgtctgcttccaccgtttgtaaacttcagagctgcacacacggagtgcctggcgatctgcaggtctaccatatcgggaacctgctcaagggagacaaggtgaatggccacctgatccataaagtcgaaccccacttcaacacctcctggatgtcttgggatggctgtgaccttgattactattgcaatatgggggactggcccagctgtacatacaccggagtgacgcaacataaccacgccgcctttgttaatctgctcaacattgagaccgattatacaaagaatttccacttccattccaaaagagtgaccgctcacggcgacacacctcagctggatctcaaggcccggcccaactacggggcgggagaagtcaccgtgctggttgaggtggctgacatggagcttcatacaaagaagatcgaaatttctggcctgaaatttgccagcctgacgtgcaccgggtgctatgcctgttccagcggaatctcttgcaaggtccgcattcacgtggatgagcctgacgaactcacagtgcacgttaagtccgaggatccggacatcgtcgctgccagctcctccctgatggcgagaaaacttgagttcggcaccgacagcacctttaaggctttctctgccatgcccaaaacaagcctgtgtttttacattgtggaacgggagtattgcaagtcctgttctaaagaagatacgcagaagtgcgtgaatgccaagctcgagagacctcaaagcatcctgatcgaacataaaggcaccattatcgggaagcagaacgacacatgtaccgctaaagcctcctgctggctcgagagcgtcaagtccttcttttacggactgaaaaatatgctttctggcattttcgggaacgtgtttatcggaattttcctgtttctggctcccttcatcctcctgatccttttctttatgttcggctggcgcattctgttttgtttcaagtgctgtcggagaacacgcgggctctttaagtaccggcacctgaaagatgacgaagagaccggatatagaaagatcattgagcgcctcaataacaaaaagggcaaaaacaagctgcttgatggcgaacggctggccgacagaaagatcgcggagctgttcagcacgaaaacacatattgggtga

SEQ ID NO: 13630 - RNA, 5064 nt, synthetic construct
  misc_feature 1..5064: note = derived and/or modified CDS sequence (opt5) from CCHFV(3820-ST-2007)__KR814868.1__GP
  source 1..5064: mol_type = other RNA
atgcccatcaacattatgcacaccctgctcgtgtgcttcatcctgtaccttcagctgagcggcctcgggggagcccatggccaatccaatgctacagagcacaacgggacgaataccacaaccgtccctggaacatctcagagcccgaagccccctgcctccaccacactgccccatacccctgaatctagcacggttaaacttaccacacccacctccgagacagaaggctctggggagaccacgcctccgaacacaacccagggactgcccctccctggcacaacccccgaaagaagcgcgaccacagctacgtccaccagctctacagacaatatgaactccaccacacaggtgaccgataatacgcctacaagcaccgtgtctatttccccctcttcttccagctccatgccgtctaccagccaaggcatccaccatcctgtccggtccctgctgagcgtgtcttcccccaagacagttaccacacctacgcccatgagccccggggagatgtctcctgagaccagctcccagcactctgccatgagccgcgtgccgacactctataccgccacacagatttccaccgaaaacacggacagaagcacaccccggcagtctgagtccagcgtccaacctgctacccagtctcccatcacctcccctgcccagacaatcctgcttatgagcgctgcccccaaagcgattcaggatatgcacccgtcccctaccaatcgctctaagagaaacctggaagtggagatcattctcacgctgagccaaggacttaaaaagtactatggcaagatcctgaaactcctgcatctgacactcgaggaagacaccgaggggctgcttgaatggtgtaagcggaatctgggatccaactgcgatgacgactttttccagaaacgcattgaggaatttttcatcacaggcgaggggtactttaatgaggttctccagttcaagaccctgtctacccttagccccacagaaccttcccacgtgagactgcccacggccgagccttttaaaagctatttcgctaagggatttctctctattgattccggctacttcagcgccaagtgttatccccggtcttccaccagcggcctgcaactgatcaacgtcacacagcatccggctcgcatcgccgaaacccctgggcccaaaacaacctctctcaagacgattaattgcatcaacctgagagcgagcgtgtttaaagagcaccgggaagtggagattaacgtccttctgccccagatcgccgttaatctctccaactgtcacgtggtgattaatagccatgtctgcgattactctctggacacagatggacctgtgcgccttccgagaatccaccatgagggcaccttcatccccgggacctacaagattgttatcgaccggaaaaacaagctgaatgatcgctgttccctcgtgacaaactgcgtcattaaaggaagagaagtgcggaagggccagagcgttctgagacaatataagaccgagatcaaaattgggaagacatccacgggatctcgcaaactgctcagcgaggaacctggcgacgactgtatctcccggacccagctgcttaagacagaaaccgctgagatccacgatgacaattacggctctcccggggataaaattacaatctgcaacggaagcaccattgtggaccagagactgggctccgagctcgggtgttatacgatcaatcgcgtcaagtcttttaagctgtgcgaaaacagcgccaccggaaaaacatgcgagattgattccacccctgtgaagtgtcggcagggcttctgcctgaaaatcacacaagaagggagaggccatgtcaaacttagccgcggatctgaggtggttctcgacgcttgtgattccagctgcgagattatgatccccaagggcaccggggacatcctggtggattgttctggaggccagcagcacttcctgaaggacaatctcattgatctggggtgccctcacatcccccttctgggaaagatggccatttacatctgtcggatgtccaaccatccgagaacaaccatggcctttctcttctggtttagcttcggctatgtcattacgtgcatcttttgtaaagctctgttctactctctgatcattatcgggacacttggcaagaaaattaagcagtatcgcgaactcaaacctcaaacctgcaccatctgtgagacagcgcccgtgaatgccattgacgctgaaatgcacgacctgaactgctcctacaatatctgcccttactgtgccagccggctgacctccgatggactcgccagacatgttacgcagtgccccaagcgcaaggagaaagtggaagagacagagctgtatcttaacctggaacggatcccgtggattgtcagaaagctccttcaggtgagcgagtctaccggcgtggctctgaaacggagctcctggcttatcgttctcctggtcctgctcgccgtgtctctgagccctgtgcagtccgcgcccgtcgggcacggaaagacaattgaaacctaccaaacacgcgagggctttacctctatctgtcttttcatgctggggagcattctctttatcgtgtcctgcctggttaaaggactggtggactctgtcagcgattccttctttcctggccttagcgtgtgtaagacgtgctctatcgggtccattaacggcttcgaaatcgagagccacaaatgttattgctctctcttttgttgcccctactgtagacattgctccgctgaccgggagattcaccagctgcatctgagcatctgcaagaagagaaaaaccggatccaatgttatgctcgccgtgtgtaagcgcatgtgcttcaaagccacaattgaggcttctcggagagccctgcttatccgcagcattatcaacaccacattcgtcatgtgtatcctgaccctcgctatttgcgtggtttccacgagcgccgtggaaatggaagatctgcccgcgggcacatgggagagagaagaggacctgaccaatttttgtcaccaggagtgccaagtcacagaaaccgagtgtctttgcccttatgaagccctggtgctccggaagccgctgttcctcgattctatcgtgaaagggatgaagaacctgcttaattccaccagcctggagacatctctcagcattgaggctccctggggagccatcaacgtccagtccacgtttaagcctaccgtttctacagctaatattgccctgagctggtcctctgtggaacatcgcggcaacaaaatcctggtgaccgggagaagcgagtccatcatgaaacttgaggaacggacaggagtcagctgggacctgggcgtggaagatgcgtctgagtccaagctcctgaccgttagcattatggacctctcccagatgtactctcccgtgttcgagtatctgagcggggatcgccaggtcgaagagtggcctaaggccacgtgtacaggcgactgccccgaaagatgtggatgcacctcctctacctgccttcacaaagagtggcctcacagccggaattggcgctgtaacccgacatggtgctggggcgtggggaccggatgtacatgctgtggcgttgatgtgaaggacctgtttacggaccatatgttcatcaagtggaaagtcgaatacattaagaccgaggctatcgtgtgcgttgagctcacatcccaagaaagacagtgtagcctgattgaggccgggacccggtttaatctgggacccgtgacaatcaccctttctgaacctcgcaacatccagcagaaactgccccctgagattatcacgctccaccccaagattgaagagggcttctttgatctgatgcatgtccaaaaagtgctctccgctagcaccgtgtgcaagctgcagtcttgtacacacggcatcccgggggaccttcagatttaccatatcggaaatctgctgaagggcgatagagtcaacgggcacctcattcacaaaatcgagcctcatttcaatacctcctggatgagctgggacggatgcgatctggactattactgtaacatgggcgattggccctcttgcacatataccggggttacacagcacaaccatgccgcctttgtgaatcttctgaacatcgaaacggactacaccaagacattccactttcacagcaaacgggtgaccgctcatggagatacaccccaactcgacctgaaggcgagacctacctatggcgccggcgagattacggtcctcgtggaagttgctgatatggagctgcacaccaaaaaggtggagatctccgggcttaaattcgcctctctgacatgcaccggatgttacgcctgcagctccggcattagctgtaaggtccgcatccatgtggacgaacccgatgagctgacagttcacgtgaagtcctctgaccctgacgtcgtggctgccagcacctccctcatggcgcggaaactggagttcgggacggattctacatttaaggctttcagcgccatgccgaaaacctccctttgcttttatattgtcgaaagagaatactgtaagtcttgcagcgaggacgataccaaaaagtgtgtggacacaaagctggagcagccccagtccatcctcatcgaacataaaggaaccattatcggcaagcaaaatgatacatgcaccgccaaagctagctgttggctggagtctgttaagtccttcttttacgggctcaaaaacatgctgggaagcgtgttcggcagctttttcgtcggcattcttctgtttctggcccctttcgtgctcctggttctgtttttcatgttcgggtggaagatcctgttttgcttcaagtgttgccgccggacgagaggactctttaaatatcgccacctgaaggacgatgaagagacaggctaccggagaattatcgaacgcctcaattccaaaaaggggaaaaaccggctgcttgacggagagagactggcggatcggaagatcgctgagctgttcagcaccaagacacacattggctga

SEQ ID NO: 13631 - RNA, 5058 nt, synthetic construct
  misc_feature 1..5058: note = derived and/or modified CDS sequence (opt5) from CCHFV(SR3)__AJ538199.1__GP
  source 1..5058: mol_type = other RNA
atgcacatcagcctgatgtacgccgtgttctgcctccagctgtgtggccttgggaagaccaacggaccccataatggcacagagcacaacaatacgcatgtcatgaccacacctgacgattcccaatctccggaaccccctgttagcaccgctctgcccgtgacacctgacccctccaccgtgacaccttctaccccggccagcgggctcgagggatccggcgaagtctatacgtctagccccattaccacaaaagggctgtcccttcctgaggcgaccagcgaaccccctgctacaacctctgtggttacgtccagcgcctctgatacagactccagcacccaggccgctggagatacacccaccccgaccgtgagaacatctctgccttccagcccctccacgccttctaccagccagggcacacactaccccgtccggtccctcctgagcgtgacctctcccaagcctgaggagacaccgaccccctccaaaagcggcaaggacgatctggccacgaactctcctcatcccgctacaagccgccctaccacacccccgaccaccgcccagaaacctacagaaaataactcccacaatacgaccgagcaactcgaatctctgacacaccttgcgaccctggggctcatgatcagccccacacagaccgttctgcctcagtccgtgacgagcattgccatccaggacattcataactctcccaccaatagatccaagcggaaccttgatatggagatcatcctgacactcagccaaggactgaagaaatattacggcaagattctgaaactcctgcaccttaccctggaggaagacacagaggggctcctggaatggtgcaagcgcaatcttggactggattgtgacgatacctttttccagaaaagaatcgaggaatttttcattacgggcgaggggcattttaacgaggtcctccagttccggacactgggaaccctgtctacaaccgaatccacccacgctggcagccctacagtggagccctttaagtcctatttcgccaagggctttctctctatcgacagcgggtacttctccgctaaatgctattctcgcacgagcaattccggactgcagcttattaacgtgaccagacacagcacacggatcgccgacaccccgggccctaagattacaaatctgaaaaccatcaactgtatgaacctcaaggcgtctgtctttaaagaacatcgcgaggttgaaatcaatgtgctgcttccccaagtggccgtcaacctgtccaattgccacgtggctattaagagccatatctgtgattactctctcgacacggatggggccattagactgccccagatccaccatgagggaacattcattcctggcacctacaaaatcgttatcgacaagaagtcccggctgaacgatcgctgcaccctctttacaaattgtgtgattaaagggagagaggtccggaagggacagagcgtgctgcgccaatataaaaccgaaatcagaattggccgggcttctacaggcagcagacgccttctgtccgaggaaagcggggacgattgcatctctcggacgcagctcctgagaaccgagacagccgaagttcacggagacaactacggcgggccgggagataagattaccatctgtaatggctccacagtggtcgaccagcgcctggggagcgagcttggctgctataccatcaaccgggtgagatccttcaaactctgcgaaaattctgccacgggaaagagctgtgagattgattccatccccgtcaagtgcaaacagggctactgtctgaagattacccaagaggggcgcggacacgtgaaactgtctcggggcagcgaagttgtgctcgacgtctgcgactcctcttgtgaggtgatgatccctaaggggacaggagatattctggttgactgcagcggcgggcagcagcatttccttaaagataacctggtggacctcggctgtcccaagatccctctgctgggaaagatggctatttatatctgcagaatgtccaatcaccccaaaaccacaatggcgtttcttttctggtttagcttcggctacgtcatcacctgtattctctgcaaggccatctttttcctgctgattatctttgggacactcggaaaacgcttcaagcagtatcgggagctgaaacctcaaacctgtacgatttgcgaaacaacccccgtgaacgctatcgatgccgagatgcatgaccttaattgctcttacaacatctgtccgtactgcgcctccagactgaccagcgatggcctcgctcgccacgtgacacagtgtcctcggagaaaggaaaaggttgaggaaaccgagctgtatctgaatcttgagcggattccctgggtcgtgcgcaaactcctccaggtgtctgaatccacggggacagtcctgaagagaagctcttggctcatcgtgctgcttgttctgtttaccgtgtccctcagccctgtccagtccgcccccattggacacggcaaaacaatcgagacctaccgggtgagagaagagtatacaagcatttgcctgttcgttctggggtctatcctttttatcgtgagcttcctcatgaagggcctggtcgacggagtgggcaacatctttttcccggggctgtccgtttgtaaaacctgctctattggaagcattaacggcttcgaaatcgagtcccataagtgttactgctctctcttttgttgcccttattgtcgccactgcagcgcggatggggagattcatcaactgcacctttccatctgcaaaaagcggaagacgggatctaatgtgatgctggctgtctgtaaaagaatgtgcttccgcgccaccatggaagtgagcaacaaggccctctttatcagatccattatcaatacaaccttcgtgatgtgtattctgaaaggcgagtttgctgccgtcaagagcatccatcccattgaaatggagtctctgcctgctgggacatgggaacgggaggaggaccttaccaacttctgccaccaggaatgtcaggttacggagacagaatgcctgtgtccctacgaggccctcgtgctgcgcagacccctctttctggattccatcgtgaaaggcatgaagaatcttctgaacagcacctctctcgagacatccctgagcattgaagcgccttggggagccatcaatgtccagtccacctataagccgaccgtgtctacagctaacatcgccctgagctggtccagcgttgagcaccggggcaataaagtgcttgtctctgggcgctccgaaagcattatgaagctggaggaaagaacgggaatctcttgggacctcggcgtggaggatgctagcgagtccaaactgctcaccgtttctgtgatggacctgagccaaatgtactcccccgtcttcgaatacctttctggggacagacaggtggaggaatggcctaaggccacatgcaccggagattgtcccgagcgctgcggctgtacaagctccacgtgcctgcataaagaatggcctcacagcagaaactggcggtgcaatcccacctggtgttggggcgttgggacaggatgcacctgttgcggcctcgacgtgaaggatctgtttaccgactatatgttcgtcaagtggaaagtggagtacattaagacagaggcgatcgtgtgtgtcgaactgacctctcaggagcgccaatgctcccttattgaagccgggacaagatttaacctgggaagcgttacgatcaccctctccgagcctcggaatatccagcagaaactgccgcccgaaattatcacactccatcctaagattgaggagggcttctttgatctgatgcacgtgcagaaagtgctttctgctagcaccgtctgtaagctgcaatcctgcacacatggggtgcccggagacctgcaggtttatcacatcggcaacctcctgaagggcgatagagtgaatgggcaccttattcataaaatcgaacagcacttcaacacctcttggatgagctgggacggatgtgatctggactactattgcaacatgggcgattggccttcctgtacgtacaccggggtcacacagcataatcacgccagcttcgtgaacctcctgaatatcgagaccgactatacaaagacctttcacttccattctaaacgcgttacagctcacggagatacgccccaactcgacctgaaggcccggccgacctacggcgccggggaaattacagtgcttgtcgaggtggctgacatggagctgcataccaaaaagatcgaaatttccggactgaaatttgcgggcctgacctgcacaggctgctacgcctgtagctctgggatctcctgcaaggtccggattcacgtggatgagcctgacgaactgacggttcatgtcaagagcgatgaccccgatgtggtggctgcctctagctcccttatggcccgcaaactggagttcggaaccgactctacatttaaggctttcagcgccatgcccaaaacctccctctgtttttatatcgttgaacgggagtactgcaagagctgtaacaaagaggatacacagaagtgcgtgaataccaagctggaacagcctcagtccattctcatcgagcacaaaggcacgatcattgggaagcaaaacaatacatgtaccgcgaaggcttcttgctggctggaaagcgtcaaatccttcttttatggacttaaaaacatgctgggcgggatcttcggaaatgtgtttattggcatcttcaccttcctgacaccctttattctcctgatccttttctttatgttcggctggagaatcctgttttgtttcaagtgctgtcgccggaccagagggctctttaagtaccgccacctgaaagacgatgaggaaacaggatatcggaagattatcgagagactcaacaataaaaagggcaaaaaccggctgcttgacggggagcgcctggccgatagaaagattgccgaactgttctctaccaagacgcatatcggatga

SEQ ID NO: 13632 - RNA, 5055 nt, synthetic construct
  misc_feature 1..5055: note = derived and/or modified CDS sequence (opt5) from CCHFV(SPU 187/90)__KJ682814.1__GP
  source 1..5055: mol_type = other RNA
atgcacatcagcctgatgtacgccgtgctctgcctgcagctttgttccctgggcgagacccatagatctcacaacgaaattgggcataataagacagacgtcatgacgacccccggagataacctcagctccgagcaacctgtttctacagctctgagcatcaccccggacccctccacagtgacccctacaacccccgcctctggcagcgaagggtccggagaggtgtatacgagctctcctattaccacagaatcccttagcctgcccgagaccacacctgagctcccggcgaccacgggcatcgattcttccagcgcttctggggtcgactccagcacacaggccgccggaggcacctccgctctgacagtgcggacctctctgcccaatagcccttccacccccagcacacctcaggatacgtaccaccccgttcgcattctcctgtctgtgaccggcccggggcctgaagagacatccacccccagcggatctggcaaagaaagctccgccacatctagccttcatcctatctccgacagactgcccacaccccctgctacggcccaggggccgacagagaacaatagccacaacgcgaccgagcaccccaagcctctcacccaatctgccacacccggactgatgacctcccctacacagatcgtccatccccagagcgctacgtctattaccgtgcaggatacatatccgtcccctaaaaatcggagcaagcgcaaccttgaaatggagatcattctgaccctctcccaaggcctgaaaaagtactatgggaagatcctgagactcctgcggcttacactggaagaggacaccgaaggactcctggagtggtgcaaacgcaatcttggcctggattgtgacgatacgttctttcagaagagaattgaggagttctttatcaccggcgaagggcacttcaacgaagttctccagtttaaaacacccggaaccctgtctacaaccgagagcacgcctgccgaactgcccacagctgagcctttcaagtcctactttgccaaaggcttcctctctattgacagcgggtattactccgcgaagtgctacagcggaacctctaattccggcctgcagcttatcaacatcacacggcatagcacccgcattgtggatacccccgggccgaagatcacaaatctgaaaacgattaactgtatcaatctcaaggcctctatttttaaagagcacagagaagtcgagatcaacgtgctgcttcctcaaatcgctgtgaacctgtccaattgccacgtcgttattaagagccatgtgtgtgactattctctcgacatcgatggaaccgtgcggctgccccacatttaccatgaaggcgtcttcatccccggcacatataaaattgtgatcgacaagaaaaacaagctgaatgatcgctgcaccctctttacaaactgtgttatcaaggggagagaggtgcggaaaggacagagcgtcctgcgccagtacaagaccgaaattagaatcggcaaagcctccacggggagccggagacttctgtctgaggagccttccgacgattgcattagccgcacacaactcctgcggaccgaaaccgctgagatccacggagacaattatggcgggccgggcgataagattacaatctgtaacggatccaccattgtggaccagagactgggctctgaacttgggtgctacacaatcaatcgcgttaagagcttcaaactctgcgagaactccgccacgggaaagtcttgtgagatcgatagcgtgcccgtcaaatgccggcagggctattgtctgagaattacccaggaagggcgcggacatgtgaagctgtcccggggctctgaggtcgtgctcgacgcctgcgatacaagctgtgaaatcatgattcctaaagggaccggcgacatcctggttgactgctccggaggccaacagcactttcttaaggataatctgattgacctcgggtgtcccaaaatccctctgctgggaaagatggctatctacatttgcagaatgagcaaccaccccaagacaaccatggcgttccttttctggttttctttcggctacgtgatcacgtgtattctctgcaaagccatcttttatctgctgattatcatcgggaccctcggaaagcgcttcaaacagtaccgggagctgaagcctcagacatgtaccatttgcgaaacaacccccgtcaatgctatcgatgccgagatgcatgaccttaactgctcctataatatttgtccgtactgcgccagcagactgacatctgatggcctcgctcgccacgtgacccaatgtcctaaacggaaggagaaggttgaagagacggaactgtatctgaaccttgagagaatcccctgggtggtccggaaactcctccaggtgtccgaaagcacaggggtggccctgaagagatcttcctggctgattgttctgcttgtcctgtttaccgtgagcctctcccctgtgcagagcgcgcccatcggccatggaaaaaccatcgaggcttacagagcccgggagggctatacatctatttgcctgttcgtcctggggagcatcctttttgtggtttcctgtctcatgaagggactggtggactctgtcggcaatagcttctttccggggctgtccatttgcaaaacctgttctatcggaagcattaacggcttcgaaatcgagtcccacaagtgctactgttctctcttttgctgtccttactgcagacactgcagcgccgataaagaaattcataagctgcacctttccatctgtaagaaacgcaagacggggagcaacgtgatgctggctgtttgcaaacggatgtgtttcagagccacaatggaggtgtctaatcgcgctctctttatcagatccattatcaacaccacattcgtcctgtgcattctgatccttgccgtgtgtgttgtgagcacctctgcggtcgaaatggagaatctgcccgccggcacatgggagcgggaagaggacctcaccaacttctgccatcaggaatgtcaagtgacggagaccgagtgcctgtgtccttatgaagctctcgtgctgcgcagacccctttttctggattccattgtcaagggaatgaaaaatctcctgaacagcacatccctggagacctctcttagcatcgaagccccctggggcgctatcaatgttcagtccacatacaagcctaccgtgagcacggccaacattgcgctgtcttggtccagcgtggagcaccgggggaataagatcctcgtctctggacgcagcgaatccattatgaaactggaggagagaacaggcatctcttgggacctcggggtggaagatgccagcgagtccaagctgcttaccgtttctgtgatggacctgagccagatgtattccccggtcttcgaatacctcagcggagatagacaggtggaggaatggcccaaagctacatgcaccggcgactgtcctgagcgctgcggctgcacctcttccacatgtctgcataaggagtggccccacagcagaaactggcggtgcaatcctacgtggtgttggggagttggaaccggctgcacatgttgcgggctggacgtgaaagatctttttaccgactatatgttcgtcaagtggaaggtggaatacattaaaacagaggccatcgtttgtgtggaactgacctcccaagagcgccagtgctctctcatcgaagctggaacgagatttaacctgggccccgtcacaattaccctcagcgagcctcggaatatccagcaaaagctgccgcccgagattatcacccttcaccctagaattgaagaggggttctttgatctgatgcatgtgcagaaagtgctgtccgcctctacagtctgtaagctccagagctgcacccacggagttcccggcgaccttcaggtgtatcatatcggcaacctgctgaaaggggataaggtgaatggacacctcattcataagatcgaacctcacttcaacacatcctggatgagctgggacggctgtgatctggactactactgcaacatgggggattggccctcttgcacgtataccggagtcacacaacacaatcatgcctcctttgtgaacctcctgaatatcgagaccgactacaccaaaaacttccactttcatagcaagcgcgttaccgctcacggcgatacgccgcagcttgacctgaaagcgcggcctacctatggggccggagagattacagtgctggtcgaagtggctgatatggagctccacaccaagaaaatcgaaatttctggcctgaagttcgcctcccttacatgtaccggctgctacgcctgtagctctgggatcagctgcaaagttcgcattcatgtggacgagcccgacgaactgacagtccacgtgaagtccgatgaccccgatgtcgtggctgcctctagctccctcatggcgcgcaagctggagtttggaacggacagcatcttcaaggctttctccgccatgcctaaaacctctctctgtttttatatcgttgagcgggaacattgcaaaagctgttccgaggaagatacaaagaaatgcgtgaataccaagctggagcagccccagtctattcttatcgaacacaagggcaccattatcgggaaacaaaacagcacatgtacggccaagacctcctgctggctggagtctgtcaagagcttcttttacggactgaaaaatatgctctccggcattttcgggaacgtgtttatcggaatcttcctgtttcttgctcctttcattctgctcatcctgtttttcatgtttggctggcggattctcttctgtttcaaatgctgccgccggacaagaggcctgtttaagtatcgccatcttaaggacgatgaggaaaccgggtaccggagaatcattgagcggctgaataacaaaaaggggaaaaataagctgctcgacggcgaacgcctggccgatagacggatcgcggagcttttcagcacaaaaacccacattgggtga

SEQ ID NO: 13633 - RNA, 5055 nt, synthetic construct
  misc_feature 1..5055: note = derived and/or modified CDS sequence (opt5) from CCHFV(SPU 48/90)__KJ682813.1__GP
  source 1..5055: mol_type = other RNA
atgcacatcagcctgatgtacgccgtgctctgcctgcagctttgtggcctgggggagacccatagatcccacaacgaaacaggacataataagacggacgtcgctaccacacccggcgataacctctctagcgagcaactggtttccaccgccctttctattacacctgacccgagcaccgtgacacccaccacgtccgcgtctgggctggaaggaagcggcgaggtgtatacctccagcctcatcacaaccgaatctctgtccctgctcgagacaacccctaaactgcccacgacaaccgggattgatacaagctctgcttccgacgtcgatagctctacccaggccgccggagacacctccgctcttacagtgcggacgagccctccctccaatccttctaccccgagcacaccccaggatacccaccatcctatgcgcaacctgctctccgttacaagccccggccctgaggaaacctctacgccctccggcagcgggaaggagtctccggccacaagctcccctcaccccgtgtctaatagaagccagacccctcccgctaccgcccaaggacccacagaagacaactcctacaatgcgaccgagcaccctgagcatctgacacagagcgccacgtctggccttatgacctccccgacacagatcgtccacccccagagcgctacctctattacagtgcaagatacctatccttcccccacgaaccggagcaaacgcaatctggaaatggagatcatcctcaccctgtcccaggggctgaagaaatactatggaaagattctcagactgcttcggctgacactcgaagaggacaccgaaggcctgcttgagtggtgcaagcgcaacctggggctcgattgtgacgatacattctttcagaaaagaatcgaggagttctttattaccggagagggccatttcaatgaagttctgcagtttaagacgcctggcacactgtctaccacagagagcacccccgccgaaccgcctaccgctgagcccttcaaatcctactttgccaaggggttcctctctatcgacagcggatattactccgcgaaatgctacagcggcacatctaactccgggctgcaacttattaatatcacgcggcacagcaccaagattgccgacacacctggacccaagatcaccaacctgaaaacaatcaattgtattaacctcaaggcttctatctttaaagagcaccgcgaagtggagattaacgtcctgcttcctcaggtggccgtgaatctgtccaactgccatgtcgttatcaagagccacgtgtgtgattatcccctcgacattgatggcaccgtgagactgccgcatatctaccacgaaggggtcttcatccctggaacgtataaaattgtgatcgacaagaaaacaaagctgaatgatcggtgcaccctctttaccgactgtgttattaagggccgcgaggtgagaaaaggccagtctgtcctgcggcaatacaagacagaaatccgcattgggaaaaccagcacaggatccagacggcttctgagcgaggagccctctgatgactgcatctccagaacgcagctcctgcgcaccgaaacagctgagatccatggcgataactatgggggacccggcgacaagattaccatctgtaatgggagcacaattgtggatcagcggctgggctccgaacttggatgctacaccatcaacagagttaaatctttcaagctctgcgagaatagcgccacgggcaagtcctgtgtgattgactctgtccctgtgaaatgccgccaggggtattgtctgcggatcacccaagagggaagaggccacgtcaagctgagccgcgggtccgaagtggttctcgacgcctgcgatacatcttgtgagattatgatcccgaaaggaaccggcgacatcctggtggattgcagcgggggccagcagcactttcttaaggacaacctgattgatctcggatgtcccaaaatccctctgctgggcaagatggctatttacatctgccggatgtccaatcatcccacaaccacaatggcgttccttttctggtttagcttcgggtacgtcattacctgtatcctctgcaaggccatcttttatctgctgattatcattggaacgctcggcaaaagattccgccagtaccgggaactgaagcctcaaacatgtaccatctgcgagaccacacccgtgaacgctattgacgccgaaatgcacgatcttaattgctcttataacatctgtccttactgcgcctccagactgaccagcgacgggctcgctcgccatgttacgcagtgtcccaaacggaaggagaaagtggaggaaacagagctgtatctgaatcttgaaagaatcccgtgggtcgtgcggaagctcctccaggtgtctgagtccaccggagttgccctgaagcgcagctcttggctcattgtcctgcttgtgctgtttacagtgtccctcagccctgtccagtccgcgcccatcggccacgggaaaaccattgaggcttacagagcccgggaaggctatacaagcatctgcctgttcgtgctgggatctattctttttgttgtgagctgtctcatgaagagactggtcgattccgtgggcaactctttctttcctgggctgagcatctgcaaaacctgttccatctctagcattaatggattcgagatcgaatcccacaagtgctactgttctctcttttgctgtccctactgccgccattgcagcgccgacaaagagattcacaagctgcatctttccatctgtaaaaagcggaagacgggcagcaacgttatgctggctgtgtgcaaaagaatgtgtttccgcgccaccatggaagtctctgatagagctctctttattcggtccatcattaacacaaccttcgtgctgtgcatcctgatccttgccgtttgtgtggtcagcacatctgcggtggagatggaaaatctgccggccgggacctgggagcgcgaggaagacctcacgaacttctgccaccaagagtgtcaggtgacagaaaccgagtgcctgtgtccttatgaggctctcgtcctgagaaagcccctttttcgggattccattgttaaaggaatgaagaatctgctcaacagcacatccctggaaacctctctgagcatcgaggccccttggggcgctattaatgtgcagtccacctacaaacccacagtgagcacggccaacatcgcgctttcttggtccagcgtcgaacatcgcgggaataagattctggtgtctggcagaagcgagtccatcatgaagctcgaagaacggaccggaatctcttgggacctgggcgttgaggacgccagcgaatccaaactcctgacagtgtctgtcatggatcttagccagatgtattcccccgtgttcgagtacctgagcggggaccgccaagttgaagagtggcctaaggctacctgcacaggagattgtccggaaagatgcggctgcacctcttccacgtgtctccacaaagagtggccccacagccggaactggcgctgcaatcctacatggtgttggggagtgggaaccggctgcacctgttgcggcctggacgtcaaggatctgtttacagactatatgttcgtgaaatggaaggttgagtacattaagaccgaagccatcgtgtgtgtcgagcttacatcccaggaaagacagtgctctctgattgaggctgggacgcggtttaacctcggacccgtgaccatcacactgagcgaacctagaaatattcaacagaaactgccccctgagatcatcaccctgcatccgcgcattgaggaaggcttctttgatcttatgcacgtgcagaaggtcctgtccgcctctacagtttgtaaactgcagagctgcacccatggggtgcccggagacctccaagtgtatcacatcggcaacctgcttaagggggataaagtcaatggacatctgattcacaagatcgagcctcacttcaacacgtcctggatgagctgggacggctgtgatctcgactactactgcaatatgggcgattggccctcttgcacctatacaggggtgacccagcataaccgggcctcctttgttaacctgctcaatattgaaacagactacaccaagaacttccactttcatagcaaaagagtgacagctcacggagacacgcctcagctggatcttaaggcgcgccccacctatggcgccggggagatcacagtcctggtggaggttgctgacatggaactgcacaccaaaaagattgagatctctggactcaaattcgcctccctgacctgtacaggctgctacgcctgtagctctgggatcagctgcaaggtgcggattcatgtcgatgaaccggacgagcttacggtgcacgtcaaatccgatgaccctgatgtggttgctgcctctagctccctgatggcgagaaagctcgaatttggaaccgacagcacattcaaggctttctccgccatgcccaaaacctctctgtgtttttatatcgtggagaaggagtactgcaaaagctgttccgaagaggatacaaagaaatgcgtcaataccaagctcgaacagccccaatctattctgatcgagcataagggcacgattatcggcaaacagaacagcacatgtaccgccaaggtgtcctgctggcttgaatctgctaagagcttcttttatgggctgaaagacatgctgtccggaatcttcggcaatgtttttattgggatcttcctctttctggcccctttcattcttctgatcctctttttcatgtttggatggcgcattctgctctgtttcaaatgctgccggagaacccgcggcctgttcaagtaccggcaccttaaggatgacgaggagacagggtacagacggatcatcgaacgcctgaacaataaaaaggggaaaaacaagctgctcgacggcgagagactggcggatcggcgcattgctgaactttttagcaccaaaacacatatcggctga

SEQ ID NO: 13634 - RNA, 5055 nt, synthetic construct
  misc_feature 1..5055: note = derived and/or modified CDS sequence (opt5) from CCHFV(Sudan AB1-2009)__HQ378187.1__GP
  source 1..5055: mol_type = other RNA
atgcacatcagcctgatttacgccatcctctgcctgcagctttgtggcctgggggagacccatggatcccacaacgaaacaagacataataagacggacaccattacaacccccggcgataacctctctagcgagccttccgtgtctacagctctgagcatcaccccggacccctccacagtcacccctacgacccccgcctctgggcttgaaggaagcggcgaggtttatacatcccctcccattaccacagggagcctgcctctcccgggaaccacgcccgaactgcctgcgacaaccggcacagatacctcttccgctagcgacgtggattcttccacccaaacagccggcgggacgttcaccctgacagtgcggaccagcctcccccgctctccttccacacccagcaccccgcaggacacgcaccatcctgtcagaaatctgctttccgtgacatctcccggacctgatgagaccagcaccccctccggcacagggaaagagagccccgccacctcttcccctcacccggttagcaaccggccccctacaccccctgctacggcccagggacccaccgaaaatgactctcacaacgctacagagcatccggaaagcctgacccagtccgccacaaccggccctatgacgtctcccacccaaatcgtgcaccctcagagcgcgacacccatcaccgtccaggatacacatccttcccccaccaatcgcagcaagagaaacctcgagatggagattatcctgacgctttctcaggggctgaaaaagtactatggaaaaattctccggctgctgcacctcacactggaagaggacaccgaaggccttctggagtggtgcaagcgcaatctcggcctggattgtgacgatacatttttccaaaagagaatcgaagagtttttcattaccggggagggacactttaacgaagtgcttcagttccggaccccgggcacactgtccacgaccgagagcacccctgccgggctccccaccgctgaaccctttaaatcttacttcgccaagggatttctgtccatcgacagcggctattactccgctaaatgctattctgggacaagcaattccggactgcagctcattaacatcacccgccattctacgagaatcgttgacacacctggcccgaagattaccaatctgaaaaccatcaactgtattaatcttaaggccagcatcttcaaggagcaccgggaagtggagattaacgtcctgctcccccaggtggcggtgaacctgtccaattgccatgtcgttatcaaaagccacgtgtgtgattactctcttgacatcgatggcgccgtgcgcctgcctcatatttaccacgagggggtctttatccccggaacatataagattgtgatcgacaaaaagaacaaactcaatgatagatgcaccctgttcacaaactgtgttattaagggccgggaagtgcgcaaagggcaatccgtcctgagacagtacaagacggaggtgcggatcggaaaggctagcaccggctctagacgcctcctgtccgaggaacctagcgacgattgcatctctcggacacagcttctgagaaccgaaacagccgagattcacggggacaattatggcggacccggcgataaaatcaccatttgtaacgggagcacgatcgttgaccaacgcctcggatccgagctgggctgctacaccattaatcgggtcaagagctttaaactgtgcgaaaactctgctacagggaagaattgtgagatcgattccgtgcctgtgaaatgcagacagggatattgtcttcgcattacccaggaaggccgggggcatgtcaagctcagcagaggctccgaggtggttctggacgcctgcgacacatcttgtgagatcatgatccccaagggaaccggcgatattctggtggactgcagcgggggacagcaacacttcctcaaagataacctgatcgaccttggctgtccgaagattcctctgctcgggaaaatggccatctacatttgccgcatgtccaatcatcccaagacaaccatggctttcctgttttggttctcttttggatatctgatcacgtgtatcctttgcaaagcgattttctacctcctgatcattatcggcacactggggaagcggctcaagcagtacagagaactgaaacctcagacctgtaccatttgcgagacaacccccgtcaacgccatcgatgctgaaatgcacgaccttaattgcagctataacatctgtccgtactgcgcctcccgcctgacgtctgatggcctcgcccggcacgtgattcagtgtcctaagagaaaagagaaggttgaagagacagagctgtatctgaatcttgaacggatcccctgggtggtccgcaaactcctgcaagtgagcgagtccaccggagtggctctgaagagaagctcttggctcattgttctgcttgtcctgtttacagtgtccctcagccctgtgcagtctgcccccatcggccaggggaagaccattgaagcgtaccgggctagagagggatatacatccatctgcctgttcgtcctgggcagcatcctttttattgtgtcttgtctcatgaaagggctggttgactccgtgggaaacagcttctttcccggcctgtccatctgcaagacctgtagcatttctagcatcaacgggttcgaaattgagtcccataaatgctactgttctctcttttgctgtccttattgccgccactgcagcacggataaggagatccataaactgcacctttccatttgtaagaaacggaagaccggctctaatgtcatgctggccgtgtgcaagagaatgtgtttccgcgccacaatggaagttagcaacagagctctctttatccggtccatcattaataccacattcgtgctgtgcatcctgattcttgccgtctgtgtggtttctaccagcgctgtggagatggaaaacctgccggccggaacgtgggagcgcgaagaggacctcacaaatttctgccatcaggagtgtcaagtcaccgaaacagagtgcctgtgtccctacgaagcgctcgtgctgagaaaacctctttttctggattccatcgccaagggcatgaaaaacctcctgaatagcacctctctggagacctcccttagcattgaggctccctggggagccatcaacgtgcagtctacatacaagcctacggtctccaccgctaatatcgccctgagctggtcctctgttgaacaccgggggaacaaaattctcgtgagcggccgctccgagagcatcatgaagctggaagagagaacagggatttcttgggacctcggagtggaagatgcgtccgagagcaagctgcttaccgtctctgtgatggacctgagccagatgtattcccccgttttcgagtacctctctggcgaccgccaggtggaagagtggcctaaagccacatgcaccggcgattgtccggaacggtgcgggtgcacgagctccacatgtctgcacaaggagtggccccattctagaaattggcggtgcaaccctacctggtgttggggagtcggcaccgggtgcacatgttgcggactggacgtgaaagatctttttaccgactatatgttcgttaagtggaaagtggaatacatcaagacagaggctattgtctgtgtggagctgacgagccaagaacgccagtgctccctcatcgaggccggcaccagatttaatctggggcccgttacaatcaccctcagcgaacctcggaacattcagcaaaagctgcccccggagatcattacacttcaccctagaatcgaagagggattctttgatctgatgcatgtgcagaaagtcctgtctgcttccaccgtgtgtaagctccagagctgcacgcacggcgtgcccggcgacctgcaggtctatcatattgggaatcttctgaaaggagataaggttaacggccacctcatccacaaaattgagccccatttcaacacctcctggatgtcttgggacgggtgtgatctggactactattgcaatatgggagattggcctagctgcacatacaccggcgtgacacaacacaaccatgcctcctttgtgaatctcctgaacatcgaaaccgactacacaaagaatttccactttcactctaagcgcgtcacggcccatggggatacaccccagcttgacctgaaagctcggcctacatatggagcgggcgagatcaccgtgctggttgaagtggccgacatggagctccacaccaagaaaattgagatcagcggcctgaagttcgcttcccttacatgtacggggtgctacgcctgtagctctggaatttcctgcaaagtcagaatccatgtggatgaaccggacgagctgaccgttcacgtcaagagcgatgaccccgatgtggtggccgcttcttccagcctcatggcccgcaaactggaatttggcacagactctaccttcaaggcgttcagcgctatgcctaagacatccctctgtttttatattgtcgagcgggaacattgcaaatcttgtaacgaggaggataccaagaaatgcgtgaatacgaagctggaacagccccagagcatccttatcgagcacaaagggacaattatcggaaagcaaaactccacctgtaccgccagagccagctgctggctggaatccgttaagtctttcttttacggcctgaaaaatatgctcagcgggattttcggaaacgtgtttatgggcatcttcctgtttcttgctcctttcattctgctcatcctgtttttcatgtttggctggcgcatcctcttctgtttcaagtgctgccggagaacacgcgggctgtttaaatatcggcaccttaaggacgatgaggaaaccggatacagacggattatcgagcgcctgaataacaaaaagggcaagaataaactgctcgacggggagagactggccgatcggcgcattgcggaacttttctccacaaagacccatatcggatga

SEQ ID NO: 13635 - RNA, 5055 nt, synthetic construct
  misc_feature 1..5055: note = derived and/or modified CDS sequence (opt5) from CCHFV(Sudan Al-Fulah 9-2008)__HQ378185.1__GP
  source 1..5055: mol_type = other RNA
atgcacatcagcctgatgtacgccgtgctctgcctgcagctttgtggcctgggggagacccatagatcccacaacgaaacagtccataataagacggacattgttaccacaccctctgatgacctcagctccgagcagctggtgtctaccgctcttagcatcacacctgatccgtccaccgtgacacccaccacgtctgccagcggactggaaggctccggggaggtctataccagctctcctattacaaccgaatccctcagccagcccgagacaacccctaaactgcccgcgacgacaggaatcgacacctcttccgctagcgatgtggactcttccacacaggccgccggcgataccagcaccctgacagttcggacgtcccctccgaactctcccagcaccccttccacaccccaggacacccaccatcctatgcgcaatctcctgagcgtgacatctcccgggccggaggaaacctccacgcctagcggatctggcaaggagagctccgctacatctagcccccaccctgtctccaacagaccccaaacaccccctgccaccgctcagggcccgacagaagataatagccacaacgccaccgagcatcccgagcaccttacacagtctgcgacgtccgggcctatgaccagccccacacagattgtgcatcctcaatctgccaccacaatcaccgttcaggacacgtacccctccccgaccaatcggagcaaacgcaacctggaaatggagatcattctcacactgtcccagggacttaagaaatattacggcaagatcctgagactcctgcggctgaccctcgaagaggatacagaagggctgcttgagtggtgcaagcgcaatctgggactcgactgtgatgacaccttctttcagaaaagaattgaggagttctttatcacgggcgaggggcacttcaacgacgtgctgcaatttaagacacctggaaccctttctacaaccgaaagcacccccgctaaacctcccacagccgagcctttcaagtcctattttgctaaaggcttcctgacgattgattctggctactatagcgccaagtgctactccgggaccagcaattctggactccagctgatcaacattacacggcactccacccgcatcgtcgacacacccggcccgaagatcaccaatctgaaaacgattaactgtatcaatctcaaggcgagcatttttaaagaacatagagaggtggagatcaacgtgctgcttcctcaggtcgccgttaacctgtctaattgccacgtggtgattaagtcccatgtctgtgattaccccctcgacatcgatgggacagtgcggctgccccacatctatcatgaaggagttttcattcctggcacctacaaaatcgtgattgacaagaaaaacaaacttaatgatcgctgcaccctgtttacagactgtgtcatcaaggggagagaggtgcggaaaggacaaagcgttctccgccagtataagaccgaaattagaatcggcaaggcttctacaggcagccggagactgctgtccgaggaaccgagcgatgactgcatctctcgcacgcagctcctgcggaccgagacagccgagattcacggggataactacggaggccccggggacaagatcaccatttgtaatggatccacaatcgtggaccagagacttggcagcgaactggggtgctataccattaaccgcgtcaaatccttcaagctctgcgaaaattctgctacgggcaagagctgtgtgatcgattccgtccctgtgaaatgccggcaaggatactgtctgagaattacccaggaaggccgcgggcacgttaagctgtctcggggaagcgaggtggtccttgacgcctgcgatacatcctgtgagatcatgatccccaaaggcaccggggacattctcgtggattgctctggaggccagcagcattttctgaaggacaacctggttgatctcgggtgtcctaaaatccccctgcttggcaagatggccatttatatctgcagaatgagcaatcaccctaagacaaccatggctttcctgttctggttttccttcggatacgtgattacatgtatcctctgcaaagcgatcttttacctgctgattatcattggcacccttgggaagcgcttccggcaatatagagaactcaaaccccagacgtgtacaatctgcgagaccaccccggtcaacgccattgacgctgaaatgcatgatctgaattgcagctacaacatctgtccttattgcgcctctcgcctgacatccgacggactcgcccggcacgtgacccagtgtcccaagagaaaagagaaggtggaagagacggagctgtaccttaatctggaacggatcccttgggttgtccgcaagctccttcaggtgagcgagtctacaggcgtggctctgaaaagatccagctggcttattgtcctcctggtgctgtttaccgtttctctctcccccgtgcaaagcgccccgatcgggcacggaaagacaattgaagcgtatcgggctagagagggctacacctccatctgcctgttcgtccttgggagcattctgtttatcgtgtcttgtctcatgaaaggcctggttgatagcgtgggaaactccttctttcctggcctgtctatctgcaagacatgtagcatttcctctatcaatgggttcgaaattgagagccataaatgctattgttccctgttttgctgtccctactgccgccactgctctgccgacaaggagatccataaactccacctgagcatttgtaagaagcggaaaaccggatccaacgtcatgctggccgtgtgcaagagaatgtgtttccgcgctacgatggaagttagcaacagagccctctttatccggtctattatcaataccacattcgtgctgtgcatccttattctggctgtctgtgtggtgtccaccagcgccgtcgagatggaaaacctccctgcgggcacatgggagcgcgaagaggatctgaccaatttctgccatcaggagtgtcaggttacggaaacagagtgcctgtgtccctacgaagcccttgtgctgagacggcccctctttctggactctatcgtgaaagggatgaagaacctccttaattccaccagcctggagacatccctgtctattgaggctccttggggagccatcaacgtccagagcacctataaaccgaccgtgtccacagctaatattgccctcagctggtcttccgttgaacaccgcggcaacaagatcctggtgagcgggagatctgagagcatcatgaagctggaggaacggacgggcatttcctgggaccttggagtcgaagatgcgtctgagagcaaactgctcaccgtgtccgttatggacctgtctcaaatgtacagccccgtgttcgagtatctctccggcgatcgccaggtcgaagagtggcctaaggccacatgcaccggggactgtcccgaaagatgcggatgcacaagctctacctgtctgcacaaagagtggcctcattcccggaattggcgctgcaaccccacgtggtgttggggcgtggggacaggatgcacctgttgcggccttgatgttaaggacctgtttaccgattacatgttcgtgaaatggaaggtcgaatatatcaagacagaggctattgtgtgtgtggagctcaccagccaggaaagacaatgctccctgatcgaggccggcacacggtttaatctggggcctgtcacgattaccctttctgaaccgagaaacatccagcagaaactgccccctgagatcattacactccacccccgcatcgaagagggattctttgacctgatgcatgttcagaaggtgctcagcgcttccaccgtgtgtaaactgcaatcttgcacacacggcgtccctggggatcttcaggtgtaccatattggaaatctgctgaagggcgacaaagttaacgggcacctcatccacaagattgagccccatttcaataccagctggatgtcctgggatggatgtgacctggattattactgcaacatgggcgactggccgagctgcacgtacaccggcgtgacacagcacaaccatgcctcttttgtcaatcttctgaacatcgaaaccgactatacaaagaatttccactttcactccaaacgggtgaccgcccatggggatacacctcagctcgacctgaaggctagacccacgtacggagcgggcgagattaccgttctcgtggaagtcgccgatatggagctgcacaccaaaaagatcgagatcagcgggcttaaattcgcttctctgacctgtaccggatgctatgcctgttccagcggcatttcttgcaaggtgcgcatccatgtcgacgaacccgatgagctgacagtgcacgttaaaagcgacgatcctgacgtggtcgccgcttcctctagcctcatggcccggaagctggaatttgggacggattccaccttcaaggcgttcagcgctatgcccaaaacatccctttgtttttacattgtggagaaggaatattgcaaatcttgtagcgaggaggacaccaagaaatgcgttaacacaaagctggaacaacctcagtccatcctcattgagcataagggaaccatcatcggcaaacaaaattctacgtgtacagccaaggtgagctgctggctggaatccgccaaatctttcttttacggcctcaaggatatgctgagcgggattttcggaaacgtctttatcggcattttcctttttctggctccgttcgtgctgctcgtgctgtttttcatgtttgggtggagaatccttctgtgtttccgctgctgccggagaacccgcggactcttcaaatatcggcacctgaaggacgacgaggaaaccggctacagacggattatcgagcgcctcaataacaagaaagggaagaataaactgcttgatggagagagactggccgaccggaagatcgcggaactgttttccacaaaaacccacattggctga

SEQ ID NO: 13636 - RNA, 5055 nt, synthetic construct
  misc_feature 1..5055: note = derived and/or modified CDS sequence (opt5) from CCHFV(SPU4/81)__DQ157175.1__GP
  source 1..5055: mol_type = other RNA
atgcacatcagcctgatgtacgccgtgctctgcctgcagctttgtggcctgggggagacccatggatcctataacgaaacaggccacaataagacggacgtcatgaccacacccggggataacctctctagcgagcaacctgtttccaccgctctgtctattacaccggaccccagcaccgtgacacctaccacgcccgccaatggacttgaaggctccggggaggtgtacacctctagccctatcacaaccgaatccctgagcctccccgagacaacccctgagctgccggcgacggctggaattgatacatcttccgccagcgacgtcgattcttccacccaggccgctggcggcacaagcgcccccaccgtgagaacctctctgcctaactcccccagcacaccttccacgccccaggaaacccatcacccggttcggaatctcctgtctgtgacaagccttgggcctgaggaaacctccacacccagcggacctggcaaagagtcttccgctaccagctctccccatcccgtcagcaacaagcctccgacgccccctgcccgcgcgcaggggcccacagagaataactcccacaatgccaccgaacaccctgagcccctgacccaatctgctacaccgggactcatgaccagccctacacaggtggttcatccccagtccgccacgagcatcaccgtgcaggacacatatccttctcccaccaacagatccaaacggaatctggaaacagagattatccttaccctgagccaaggcctcaagaaatactatgggaagatcctgcgcctgctcagactgacgcttgaagaggataccgagggactgctcgaatggtgcaagcggaacctgggccttgactgtgatgacacattctttcagaaacgcattgaggagttctttatcaccggcgaggggcacttcaatgaagtcctgcagtttaagacacctggaaccctctctacgacagagtccacccccgctgagctgccgacagccgaacctttcaaaagctactttgcgaagggcttcctgtccattgattctgggtattacagcgccaaatgctactccggaacctctaacagcggcctccagctgatcaatattaccagacattccacacggatcgtggacacgcccgggcccaagattaccaaccttaagacaatcaactgtatcaatctgaaagctagcatttttaaggagcaccgcgaagtggagatcaacgtcctcctgcctcaagccgctgttaatctttctaactgccacgtggtgattaaatcccatgtctgtgattatagcctggacatcgacggaaccgtgagactcccgcacatttaccatgaaggcgttttcatccccggcacatataagatcgtgattgataaaaaggacaaactgaatgatcggtgcaccctgtttacggactgtgtcatcaaggggcgcgaggtgagaaagggacagtctgttctccggcagtacaaaacagagattcgcatcggcaaggcctccattgggagcagacggctgctttctgaagaacctagcgatgactgcatctccagaacccaactgctccgcaccgaaacagccgagatccacggagataactatggcgggcccggcgacaaaattaccatctgtaatggaagcacaattgtggatcagcggctgggctctgagctggggtgctacacgatcaacagagtcaagtccttcaaactttgcgaaaatagcgctaccggaaagtcctgtgagattgaatctgtgcctgtcaagtgccgccagggctattgtctccggatcacacaggaggggagaggacatgtgaaactgagccgcggctccgaagttgtgctggacgcgtgcgatacctcttgtgagattatgatccccaaggggacaggcgacatcctcgtcgactgcagcggaggccaacagcactttctgaaagataaccttattgacctggggtgtcctaagatccccctcctgggaaaaatggccatttacatctgccggatgtccaatcacccgaagaccacgatggctttcctgttctggttttctttcggctacgtgattacctgtatcctttgcaaggccatcttttatctcctgattatcattgggacactgggaaaaagattcaagcagtaccgcgagctcaaacctcagacctgtacaatctgcgaaaccacacccgttaacgccattgatgctgagatgcatgacctgaattgcagctataacatctgtccttactgcgcctcccggcttaccagcgatggcctggcgagacacgtgacgcaatgtcccaagcgcaaagaaaaggtcgaggaaacagagctctatctgaatctggagcggatcccgtgggtggtgagaaaacttctccaggtttctgaatccaccggggtcgctctgaaacggagctcttggctgattgtgctcctggtgctttttaccgtctccctgagccctgtgcagtctgcccccatcggccatggaaagacaattgaggcctaccgcgctagagaaggctatacctccatctgcctcttcgttctggggagcattctgtttatcgtgtcctgtcttatgaaaggactcgtcgacagcgtgggcaactctttctttcctgggctgagcatctgcaagacgtgttccatttctagcatcaacggattcgagattgaatcccacaaatgctactgttctctgttttgctgtccctactgccggcactgcagcgccgataaggagatccataaactccacctgtccatttgtaagaagagaaaaacaggctctaatgttatgcttgctgtgtgcaagcgcatgtgtttccgggccaccatggaggtcagcaacagagcgctgtttatccgctccattatcaatacaaccttcgtgctctgcatcctgattctggccgtttgtgtggtcagcacatctgctgtggaaatggagaaccttcccgccgggacctgggaaagagaggaggacctgacgaatttctgccatcaggaatgtcaagtgaccgagacagaatgcctctgtccttatgaggctctggtcctccggaaaccgctgtttcttgattccatcgttaagggcatgaaaaacctgctcaatagcacctctctggaaacatccctgagcattgaggccccctggggagcgatcaacgtgcagtccacctacaagcctacggtgtctacagccaatattgctcttagctggtccagcgtcgagcaccgcggcaacaagatcctggtgtctgggagatccgaaagcatcatgaaactcgaggaacggaccggaatttcttgggacctgggcgttgaggatgccagcgaatccaagctcctgacagtgtctgtcatggaccttagccagatgtattcccccgtgttcgagtacctgtctggggatcgccaggttgaggaatggcctaaagctacctgcaccggagactgtcccgagagatgcggctgcacaagctccacgtgtctccataaggaatggcctcacagccggaattggcgctgcaacccgacctggtgttggggcgtggggacaggatgcacctgttgcggcctggacgtcaaagatctgtttacagactatatgttcgtgaagtggaaggttgagtacatcaaaaccgaagccattgtgtgtgtcgagcttacgtctcaagagagacagtgctccctgatcgaagccgggacacggtttaatctcggacccgtgaccattaccctgagcgagcctcgcaacatccagcaaaagctgccccctgaaatcattacactccaccccagaatcgaggagggcttctttgatcttatgcatgtgcagaaagtcctgtccgcttctaccgtttgtaagctgcagagctgcacacacggggtgccgggagacctccaggtgtatcatattggcaatctgcttaaaggcgataaggtcaacgggcacctgatccataagattgaacctcacttcaacacgtcctggatgtcttgggacggatgtgatctcgactactactgcaatatgggcgattggcccagctgcacctatacaggggtgacccaacacaaccatgcgtcctttgttaatctgctcaacatcgagacagactacaccaaaaatttccactttcatagcaagcgggtgacggcccacggagatacaccccagctggaccttaaagctagacctacctatggcgccggggaaattaccgtcctggtggaggttgccgatatggaactgcacacaaagaaaatcgagatctctggactcaagttcgcttccctgacctgtacaggctgctacgcctgtagctctggcatttcctgcaaagtgcgcatccatgtcgacgagcccgacgaacttacggtgcacgtcaagagcgatgaccctgatgtggttgcggcttctagctccctgatggcccggaagctcgagtttgggaccgactctacattcaaagccttcagcgctatgccgaagacctccctgtgtttttatattgtggaaagagagcattgcaaaagctgttccgaagaggataccaagaaatgcgtcaacacaaagctcgagcagccccagtctatcctgattgaacacaagggaacgatcatcggcaaacaaaatagcacctgtacagccaaggcgtcctgctggcttgagtctgtgaaatctttcttttacgggctgaagaacatgctgtccggaattttcggcaatgtttttatcgggattttcctctttctgggacctttcatccttctgattctctttttcatgtttggctggcgcatcctgttctgtttcaaatgctgccggagaacccgcggcctcctgaagtatcggcatcttaaggaagacgaggaaacagggtacagacgcatcattgagcggctgaacaataaaaagggaaagaacaagctgctcgatggcgagagactggctgaccggcgcatcgccgaactttttagcaccaaaacgcacattgggtga

SEQ ID NO: 13637 - RNA, 5055 nt, synthetic construct
  misc_feature 1..5055: note = derived and/or modified CDS sequence (opt5) from CCHFV(NIV 11703)__JN572086.1__GP
  source 1..5055: mol_type = other RNA
atgcacaccagcctgatctacgtggtcctctgcctgcagctttgttccctgggcaagacacatgggtctcacaacggaacggagcataataaaaccgacgttatgacaacccccggcgataaccaaagccctgaaccgctcgtgtccacagccctgcccgtgacccctgacccctctacagtcacccctacggctcccgccagcgggcttgagggatccggcgaagtgtatacctctagctccattacaaccaaggggctgagcctccctaaagcgacatctgagctgctggctaccacgggaatggttacatccagcgcctctgatatcgacccgtccacccaggccgctggcgatacacccacccctaccgtgagaacaagcctccccaattctccttccacgcccagcacctcccaggacacacaccatccggtccggaacctgctttctgtgaccagccctaagcccgaagagacacctaccccctccaaaagcgataaggactcttccgccacgaatagcccccaccctgctgcctctcgcctgagcacaccgcccaccaccgatcagggccctacagagaacaataaccacaattccaccgaacaactcgagtctctgacaagaagcgcgacgtccagctctatggtttcccttacccagacagtgctgccccagagcgccacctctattgctacacaggacacccatccttcccccacgaaccggagcaagcgcaatctcgaaatggagatcattctgaccctgccgcaagggctcaaaaagtactatggaaaaatcctgaaacttctgcacctcacactggaggaagataccgagggccttctggaatggtgcaaaagaaacctcgggctggactgtgatgacacattctttcagaagcggatcgaggagttctttattaccggagaaggccatttcaatgaggtcctgcagtttcgcgcccctgggacgctctccacaaccgaacccacacacgctggatctcctaccgccgagcccttcaagagctactttgcgaaaggcttcctgtccatcgactctggctattttagcgccaagtgctactccagaaccagcaactctgggcttcagctgattaatgtgacacggcactccacgcgcatcgctgatacccctggacccaaaattacaaacctcaagaccatcaactgtattaatctgaaagccagcgtgttcaaggaacatagagaggtcgaaatcaacgttcttctgccgcaagtggctgtgaatctctctaactgccacgtcgccatcaaatcccatgtgtgtgactatagcctggatacagacggcgccattcggctgcctcacatccattacgaggggacctttattcccggaacgtacaagatcgttattgataagaaaaataagctcaacgaccgctgcacactgttcaccaattgtgtgatcaaaggcagagaggtccggaaggggcagtctgtgcttcgccagtataaaaccgaaatcagaattggacgggctagcacaggctccagacgcctgctcagcgaggaatctggcgatgactgcatctcccggacccaactgctgagaacagagacggcggaagttcacggggataactacggaggccccggggacaagattaccatctgtaatggaagcacagtggtcgatcagcgccttggctccgagctcgggtgctataccattaaccgggtgaagtcttttaaactgtgcgagaatagcgccacaggcaagtcctgtgaaatcgactctatccctgtcaaatgcagacagggatactgtctgaagattacccaggagggccgcgggcacgtgaaactcagccggggatccgaagttgtgctggacgcttgcgattctagctgtgaggtcatgatcccgaagggcacgggggacattcttgtggattgctccggaggccaacagcatttcctgaaggacaacctcatcgatctggggtgtcccaaaattcctctgcttggcaagatggccatctatatttgcagaatgagcaatcaccccaaaaccacaatggccttcctcttttggttctcttttggatacgttatcacctgtatcctgtgcaaggtgattttctatctgctcatcatttttggcacactggggaaacgcttcaagcagtaccgggagcttaagcctcagacctgtacaatctgcgaaaccacgcccgtcaacgctattgacgccgagatgcatgatctgaattgctcctacaacatctgtccttattgcgcgagcagactcacatctgacggactggctcgccacgtgacccaatgtcccaaacggaaggaaaaagtggaggaaaccgagctgtaccttaacctcgagagaatcccgtgggttgtccggaagctgctccaggtgtccgaaagcacaggcattgccctgaaaagatcttcctggctgatcgtgcttctggtcctctttaccgtgagcattacgcctgttcagtccgcccccatcgggcacggaaagacaattgaggcttatcgcgcccgggaagagtacaccagcatctgcctgttcgtgctgggctctgtcctttttgtggttagctgtctcatgaaagggctggtggattccgtcggcaatatcttctttcctggactgttcatttgcaagacatgttctatcggcagcattaacgggtttgaaatcgagtcccataagtgctattgttctctcttctgctgtccctactgcagacactgcagcgctgaccgcgagattcatcagctgcacctttccatctgtaaaaagcggaaaaccggatctaatgtgatgctggccgtttgcaagagaatgtgtttccgcacaaccatggaagtgagcaacaaagcgctctttgtcagatccatcattaatacgaccttcgtggtgtgcatcctgattctggccgtctgtgttgtgagcacatctgctgtggagatggaatcccttccggccggcacctgggagcgggaagaggatctgacaaacttttgccatcaagagtgtcaggtcaccgaaacggagtgcctctgtccttatgaagctctggtgctccgcagacccctgttccttgacagcatcgttaaggggatgaagaatctgctcaactctacatccctggagaccagcctgtccattgaggccccttggggagcgatcaatgtgcagtctacatacaaacccaccgtcagcgccgctaacattgccctttcctggagctctgtggaacaccggggcaataagatcctggtttccgggcgcagcgagtctatcatgaaactcgaagagagaaccggcattagctgggatctgggagtggaagacgcttccgagtctaagctcctgacagtcagcgtgatggacctttcccagatgtactctcccgtttttgagtatctgagcggcgatcggcaagtggaagagtggcctaaagccacgtgcaccggggactgtccggaacgctgcggatgcacatccagcacctgtctccacaaggagtggccccattctagaaactggcggtgcaatcctacatggtgttggggcgtcgggaccggatgcacgtgttgcggcctggatgtgaaggacctgttcacagattacatgtttgtgaaatggaaggtcgaatatatcaaaaccgaggccattgtttgtgtggagcttacctcccaggaacgccagtgcagcctgatcgaggctggcacaagattcaacctcgggtccgtgaccattacactgtctgaaccccggaatatccaacagaagctccctcccgagatcattacgctgcaccctagaatcgaagagggatttttcgaccttatgcatgtccagaaagtgctgagcgcgtccaccgtttgtaagctgcagtcttgcacacacggcgtgccgggggatctccaagtctaccatattggaaacctgcttaagggcgaccgcgtgaacgggcacctgatccacaaaattgagcagcatctcaataccagctggatgtcctgggatggatgtgacctggattattactgcaacatgggcgactggcccagctgcacatataccggcgttacgcagcacaatcatgcctcttttgtgaacctcctgaatatcgaaaccgattacacaaagaccttccactttcactccaaacgggtcacagctcatggggacacccctcagcttgacctgaaggccagacccacatacggagccggcgagatcacggtgctggtcgaagtggctgatatggagctccacaccaaaaagattgagatcagcgggctgaaattcgcctctctttcctgtacaggatgctatgcgtgtagctctggcattagctgcaaggttcgcatccatgtggacgaacctgatgagctgaccgtccacgtgaagtccgacgatcccgacgttgtggctgcctctagctccctcatggcccggaaactggaaagcgggaccgattccacattcaaggctttttctgccatgccgaaaacgagcctctgtttctacattgtcgagagagaatattgcaagggatgttccaaagaggacacccaaaagtgcgtgaacacaaagctggagcagcctcagtctatccttattgaacataaaggcaccatcatcggcaagcagaataacacatgtaccgcgaaagctagctgctggctggagtccgtgaagtctttcttttacgggctgaaaaatatgctcagcggaatttttggcaacgttttcctggggatcttttccttccttgccccctttgtcctgctcattctgttctttatgttcggatggcgcatcctcttctgttttaagtgctgccggagaacgcgcggcctgttcaagtatcggcaccttaaagatgacgaagagacagggtacagaaagattatcgaacggctgaataacaaaaagggaaagaataagctgctcgatggcgagcgcctggccgacagaaagatcgctgagctttttagcaccaaaacccacattggctga

SEQ ID NO: 13638 - RNA, 5055 nt, synthetic construct
  misc_feature 1..5055: note = derived and/or modified CDS sequence (opt5) from CCHFV(NIV 112143)__JN572085.1__GP
  source 1..5055: mol_type = other RNA
atgcacaccagcctgatctacgtggtcctctgcctgcagctttgttccctgggcaagacacatgggtctcacaacggaacggagcataataaaaccgacgttatgacaacccccggcgataaccaaagccctgaaccgctcgtgtccacagccctgcccgtgacccctgacccctctacaattacccctacggctcccgccagcgggcttgagggatccggcgaagtctatacctctagctccatcacaaccaaggggctgagcctccctaaagcgacatctgagctgctggctaccacgggaatggtgacatccagcgcctctgatattgacccgtccacccaggccgctggcgatacacccacccctaccgttagaacaagcctccccaattctccttccacgcccagcacctcccaggacacacaccatccggtgcggaacctgctttctgtcaccagccctaagcccgaagagacacctaccccctccaaaagcgataaggactcttccgccacgaatagcccccaccctgctgcctctcgcctgagcacaccgcccaccaccgatcagggccctacagagaacaataaccacaattccaccgaacaactcgagtctctgacaagaagcgcgacgtccagctctatggtgtcccttacccagacagttctgccccagagcgccacctctatcgctacacaggacacccatccttcccccacgaaccggagcaagcgcaatctcgaaatggagattatcctgaccctgccgcaagggctcaaaaagtactatggaaaaatcctgaaacttctgcacctcacactggaggaagataccgagggccttctggaatggtgcaaaagaaacctcgggctggactgtgatgacacattctttcagaagcggattgaggagttctttatcaccggagaaggccatttcaatgaggtgctgcagtttcgcgcccctgggacgctctccacaaccgaacccacacacgctggatctcctaccgccgagcccttcaagagctactttgcgaaaggcttcctgtccattgactctggctattttagcgccaagtgctactccagaaccagcaactctgggcttcagctgatcaatgtcacacggcactccacgcgcattgctgatacccctggacccaaaatcacaaacctcaagaccattaactgtatcaatctgaaagccagcgtgttcaaggaacatagagaggtggaaatcaacgtccttctgccgcaagttgctgtgaatctctctaactgccacgtggccattaaatcccatgtctgtgactatagcctggatacagacggcgccatccggctgcctcacattcattacgaggggacctttatccccggaacgtacaagattgtgatcgataagaaaaataagctcaacgaccgctgcacactgttcaccaattgtgttatcaaaggcagagaggtgcggaaggggcagtctgtccttcgccagtataaaaccgaaattagaatcggacgggctagcacaggctccagacgcctgctcagcgaggaatctggcgatgactgcatttcccggacccaactgctgagaacagagacggcggaagtgcacggggataactacggaggccccggggacaagatcaccatttgtaatggaagcacagttgtggatcagcgccttggctccgagctcgggtgctataccatcaaccgggtcaagtcttttaaactgtgcgagaatagcgccacaggcaagtcctgtgaaatcgactctattcctgtgaaatgcagacagggatactgtctgaagatcacccaggagggccgcgggcacgtcaaactcagccggggatccgaagtggttctggacgcttgcgattctagctgtgaggtgatgattccgaagggcacgggggacatccttgtcgattgctccggaggccaacagcatttcctgaaggacaacctcattgatctggggtgtcccaaaatccctctgcttggcaagatggccatttatatctgcagaatgagcaatcaccccaaaaccacaatggccttcctcttttggttctcttttggatacgtgatcacctgtattctgtgcaaggttatcttctatctgctcattatctttggcacactggggaaacgcttcaagcagtaccgggagcttaagcctcagacctgtacaatttgcgaaaccacgcccgtgaacgctatcgacgccgagatgcatgatctgaattgctcctacaacatctgtccttattgcgcgagcagactcacatctgacggactggctcgccacgtcacccaatgtcccaaacggaaggaaaaagtggaggaaaccgagctgtaccttaacctcgagcgcattccgtgggtggttcggaagctgctgcaggtctccgaaagcacaggcatcgccctcaaaagatcttcctggctgattgtgcttctggtgctctttaccgtcagcatcacgcctgtgcagtccgcccccattgggcacggaaagacaatcgaggcttatagagcccgggaagagtacaccagcatctgcctgttcgttctgggctctgtgctttttgtcgtgagctgtctcatgaaagggctggttgattccgtgggcaatattttctttcctggactgttcatctgcaagacatgttctattggcagcatcaacgggtttgaaattgagtcccataagtgctattgttctctcttctgctgtccctactgcagacactgcagcgctgaccgcgagatccatcagctgcacctttccatctgtaaaaagcggaaaaccggatctaatgtcatgctggccgtgtgcaagagaatgtgtttccgcgcgacaatggaagttagcaacaaagccctctttgtgagatccattatcaataccacgttcgtcgtgtgcattctgatcctggctatttgtgtggtcagcacctctgccgttgagatggaatcccttccggctggcacatgggagcgggaagaggatctgaccaacttttgccatcaagagtgtcaggtgacagaaaccgagtgcctctgtccttatgaagccctggtgctccgcagacccctgttccttgacagcatcgtcaaggggatgaagaatctgctcaactctacgtccctggagacaagcctgtccattgaggcgccttggggagccatcaatgtgcagtctacctacaaacccacagttagcgctgccaacatcgctctttcctggagctctgtggaacaccggggcaataagattctggtctccgggcgcagcgagtctatcatgaaactcgaagagagaaccggcattagctgggatctgggagtggaagacgcctccgagtctaagctcctgaccgttagcgtgatggacctttcccagatgtactctcccgtctttgagtatctgagcggcgatcggcaagtggaagagtggcctaaagccacatgcacgggggactgtccggaacgctgcggatgcacctccagcacatgtctccacaaggagtggccccattctagaaactggcggtgcaatcctacctggtgttggggcgttgggacaggatgcacctgttgcggcctggatgtgaaggacctgttcacggattacatgtttgtcaaatggaaggtggaatatatcaaaacagaggctattgtgtgtgtcgagcttacctcccaggaacgccagtgcagcctgatcgaggcgggcaccagattcaacctcgggtccgttacaatcaccctgtctgaaccccggaatattcaacagaagctccctcccgagatcattacactgcaccctagaatcgaagagggatttttcgaccttatgcatgtgcagaaagtgctgagcgcctccacggtctgtaagctgcagtcttgcacccacggcgtgccgggggatctccaagtttaccatattggaaacctgcttaagggcgaccgcgtgaacgggcacctgatccacaaaatcgagcagcatctcaatacaagctggatgtcctgggatggatgtgacctggattattactgcaacatgggcgactggcccagctgcacctatacaggcgtcacccagcacaatcatgcttcttttgtgaacctcctgaatattgaaacggattacaccaagacattccactttcactccaaacgggttaccgcccatggggacacacctcagcttgacctgaaggccagacccacctacggagctggcgagatcacagtgctggtcgaagtggccgatatggagctccacacgaaaaagattgagatcagcgggctgaaattcgcgtctctttcctgtaccggatgctatgcttgtagctctggcattagctgcaaggtccgcatccatgtggacgaacctgatgagctgacagttcacgtgaagtccgacgatcccgacgtcgtggccgcctctagctccctcatggctcggaaactggagttcgggaccgatagcacctttaaggccttctccgcgatgccgaaaacatctctctgtttttacattgttgaaagagaatattgcaagggatgtagcaaagaggacacgcaaaagtgcgtgaacaccaagctggagcagcctcagtccatccttatcgaacataaaggcacaattatcggcaagcagaataacacctgtacagctaaagcctcttgctggctggagagcgtcaagtccttcttttacgggctgaaaaatatgctctctggaattttcggcaacgtgtttctggggatcttcagctttcttgcccccttcgtgctgctcattctgtttttcatgttcggatggcgcatcctcttttgtttcaagtgctgccggagaacccgcggcctgtttaagtatcggcaccttaaagatgacgaagagacggggtacagaaagatcattgaacggctgaataacaaaaagggaaagaataagctgctcgatggcgagcgcctggctgacagaaagatcgccgagcttttctccacaaaaacccacattggctga

SEQ ID NO: 13639 - RNA, 5055 nt, synthetic construct
  misc_feature 1..5055: note = derived and/or modified CDS sequence (opt5) from CCHFV(NIVA 118594)__JN572084.1__GP
  source 1..5055: mol_type = other RNA
atgcacaccagcctgatctacgtggtcctctgcctgcagctttgttccctgggcaagacacatgggtctcacaacggaacggagcataataaaaccgacgttatgacaacccccggcgataaccaaagccctgaaccgctcgtgtccacagccctgcccgtgacccctgacccctctacagtcacccctacggctcccgccagcgggcttgagggatccggcgaagtgtatacctctagctccattacaaccaaggggctgagcctccctaaagcgacatctgagctgctggctaccacgggaatggttacatccagcgcctctgatatcgacccgtccacccaggccgctggcgatacacccacccctaccgtgagaacaagcctccccaattctccttccacgcccagcacctcccaggacacacaccatccggtccggaacctgctttctgtgaccagccctaagcccgaagagacacctaccccctccaaaagcgataaggactcttccgccacgaatagcccccaccctgctgcctctcgcctgagcacaccgcccaccaccgatcagggccctacagagaacaataaccacaattccaccgaacaactcgagtctctgacaagaagcgcgacgtccagctctatggtttcccttacccagacagtgctgccccagagcgccacctctattgctacacaggacacccatccttcccccacgaaccggagcaagcgcaatctcgaaatggagatcattctgaccctgccgcaagggctcaaaaagtactatggaaaaatcctgaaacttctgcacctcacactggaggaagataccgagggccttctggaatggtgcaaaagaaacctcgggctggactgtgatgacacattctttcagaagcggatcgaggagttctttattaccggagaaggccatttcaatgaggtcctgcagtttcgcgcccctgggacgctctccacaaccgaacccacacacgctggatctcctaccgccgagcccttcaagagctactttgcgaaaggcttcctgtccatcgactctggctattttagcgccaagtgctactccagaaccagcaactctgggcttcagctgattaatgtgacacggcactccacgcgcatcgctgatacccctggacccaaaattacaaacctcaagaccatcaactgtattaatctgaaagccagcgtgttcaaggaacatagagagtttgaaatcaacgtccttctgccgcaagttgctgtgaatctctctaactgccacgtggccatcaaatcccatgtctgtgactatagcctggatacagacggcgccattcggctgcctcacatccattacgaggggaccttcattcccggaacgtacaagatcgtgattgataagaaaaataagctcaacgaccgctgcacactgtttaccaattgtgttatcaaaggcagagaggtgcggaaggggcagtctgtccttcgccagtataaaaccgaaatcagaattggacgggctagcacaggctccagacgcctgctcagcgaggaatctggcgatgactgcatctcccggacccaactgctgagaacagagacggcggaagtgcacggggataactacggaggccccggggacaagattaccatctgtaatggaagcacagttgtggatcagcgccttggctccgagctcgggtgctataccattaaccgggtcaagtctttcaaactgtgcgagaatagcgccacaggcaagtcctgtgaaatcgactctatccctgtgaaatgcagacagggatactgtctgaagattacccaggagggccgcgggcacgtcaaactcagccggggatccgaagtggttctggacgcttgcgattctagctgtgaggtgatgatcccgaagggcacgggggacattcttgtcgattgctccggaggccaacagcatttcctgaaggacaacctcatcgatctggggtgtcccaaaattcctctgcttggcaagatggccatctatatttgcagaatgagcaatcaccccaaaaccacaatggcctttctcttctggttttctttcggatacgtgatcacctgtatcctgtgcaaggttattttctatctgctcatcattttcggcacactggggaaacgctttaagcagtaccgggagcttaagcctcagacctgtacaatctgcgaaaccacgcccgtgaacgctattgacgccgagatgcatgatctgaattgctcctacaacatctgtccttattgcgcgagcagactcacatctgacggactggctcgccacgtcacccaatgtcccaaacggaaggaaaaagtggaggaaaccgagctgtaccttaacctcgagagaatcccgtgggtggttcggaagctgctgcaggtctccgaaagcacaggcattgccctcaaaagatcttcctggctgatcgtgcttctggtgctctttaccgtcagcattacgcctgtgcagtccgcccccatcgggcacggaaagacaattgaggcttatcgcgcccgggaagagtacaccagcatctgcctgtttgttctgggctctgtgcttttcgtcgtgagctgtctcatgaaagggctggttgattccgtgggcaatatctttttccctggactgtttatttgcaagacatgttctatcggcagcattaacgggttcgaaatcgagtcccataagtgctattgttctctcttctgctgtccctactgcagacactgcagcgctgaccgcgagattcatcagctgcacctttccatctgtaaaaagcggaaaaccggatctaatgtcatgctggccgtgtgcaagagaatgtgttttcgcacaaccatggaagttagcaacaaagccctcttcgtgagatccatcattaatacgacctttgtcgtgtgcatcctgattctggcggtgtgtgtcgttagcacatctgctgtggagatggaatcccttccggccggcacctgggagcgggaagaggatctgacaaacttctgccatcaagagtgtcaggtgaccgaaacggagtgcctctgtccttatgaagctctggtcctccgcagacccctgtttcttgacagcatcgtgaaggggatgaagaatctgctcaactctacatccctggagaccagcctgtccattgaggccccttggggagcgatcaatgttcagtctacatacaaacccaccgtgagcgccgctaacattgccctttcctggagctctgtcgaacaccggggcaataagatcctggtgtccgggcgcagcgagtctatcatgaaactcgaagagagaaccggcattagctgggatctgggagttgaagacgcttccgagtctaagctcctgacagtgagcgtcatggacctttcccagatgtactctcccgtgttcgagtatctgagcggcgatcggcaagttgaagagtggcctaaagccacgtgcaccggggactgtccggaacgctgcggatgcacatccagcacctgtctccacaaggagtggccccattctagaaactggcggtgcaatcctacatggtgttggggcgtggggaccggatgcacgtgttgcggcctggatgtcaaggacctgtttacagattacatgttcgtgaaatggaaggtggaatatatcaaaaccgaggccattgtctgtgttgagcttacctcccaggaacgccagtgcagcctgatcgaggctggcacaagatttaacctcgggtccgtgaccattacactgtctgaaccccggaatatccaacagaagctccctcccgagatcattacgctgcaccctagaatcgaagagggattctttgaccttatgcatgtgcagaaagtcctgagcgcgtccaccgtgtgtaagctgcagtcttgcacacacggcgttccgggggatctccaagtgtaccatattggaaacctgcttaagggcgaccgcgtcaacgggcacctgatccacaaaattgagcagcatctcaataccagctggatgtcctgggatggatgtgacctggattattactgcaacatgggcgactggcccagctgcacatataccggcgtgacgcagcacaatcatgcctctttcgttaacctcctgaatatcgaaaccgattacacaaagacctttcacttccactccaaacgggtgacagctcatggggacacccctcagcttgacctgaaggccagacccacatacggagccggcgagatcacggtcctggtggaagtcgctgatatggagctccacaccaaaaagattgagatcagcgggctgaaattcgcctctctttcctgtacaggatgctatgcgtgtagctctggcattagctgcaaggtgcgcatccatgttgacgaacctgatgagctgaccgtgcacgtcaagtccgacgatcccgacgtggttgctgcctctagctccctcatggcccggaaactggaaagcgggaccgattccacatttaaggctttctctgccatgccgaaaacgagcctctgtttttacattgtggagagagaatattgcaagggatgttccaaagaggacacccaaaagtgcgtcaacacaaagctggagcagcctcagtctatccttattgaacataaaggcaccatcatcggcaagcagaataacacatgtaccgcgaaagctagctgctggctggagtccgtgaagtctttcttttacgggctgaaaaatatgctcagcggaattttcggcaacgtgtttctggggatcttctcctttcttgcccccttcgttctgctcattctgtttttcatgttcggatggcgcatcctcttttgtttcaagtgctgccggagaacgcgcggcctgtttaagtatcggcaccttaaagatgacgaagagacagggtacagaaagattatcgaacggctgaataacaaaaagggaaagaataagctgctcgatggcgagcgcctggccgacagaaagatcgctgagcttttcagcaccaaaacccacattggctga

SEQ ID NO: 13640 - RNA, 5055 nt, synthetic construct
  misc_feature 1..5055: note = derived and/or modified CDS sequence (opt5) from CCHFV(UCCR4448)__KY484042.1__GP
  source 1..5055: mol_type = other RNA
atgcacatcagcctgatgtacgccgtgctctgcctgcagctttgtggcctgggggagacccatggatcccacaacgaaacaggccataataagacggacgtcatgaccacacccggggataacctctctagcgagcaacctgtttccaccgctctgtctattacaccggaccccagcaccgtgacacctaccacgcccgcctccggacttgaaggctctggggaggtgtataccagccctcccatcattacagaatccctgagcctccctgagaccacaccggagctgtctgcgaccgctggaatcgatacgtccagcgcctctgacgtcgattccagcacacaggccgctagaggcacctctgccctgacagtgcggacctccctccccaatagcccttccaccccctctacacctcaggaaacgcaccatcccgttcgcaacctgcttagcgtgacctccccgagacctgaggaaacaagcaccccctctggctccgggaaagagagctctgctacaagcggacctcaccccgtctccaataagccccctaccccgcccgccaaaacgcagggccctacagagaacaattctcacaacgcgaccgaacatcccgagcctctgacccaaagcgccacactcgggctgatgacctcccccacacagattgtgcacccgcagagcgctacgtctatcaccgttcaggacacatacccttcccccaccaatcggagcaagcgcaaccttgaaatggagatcattctgacactctctcaaggactgaaaaagtattacggcaagatcctgagactcctgcggcttaccctggaagaggatacggaggggctcctggaatggtgcaaacgcaatcttggactggactgtgatgacaccttctttcagaagagaattgaggagttctttatcacaggcgaaggccatttcaacgaagtgctccagtttaaaacccctgggacactgtccaccacggagagcacacccgccgagctgcctaccgctgaacccttcaagtcctattttgccaaaggattcctctctattgatagcggctactattccgcgaagtgctactctgggacaagcaattccggactgcagcttatcaacattacccggcacagcgcccgcatcgtcgacaccccgggccctaaggtgacaaatctgaaaacgatcaactgtattaacctcaaggcttctatctttaaagagcacagagaagtggagattaatgtcctgcttccccaagttgccgtgaacctgtccaattgccatgtgatcattaagagccacgtctgtgattactctctcgacatcgacgggaccgtgcggctgccccatatctatcacgaaggagttttcattcctggcacatacaaaatcgtgattgataagaaagacaagctgaacgatcgctgcaccctctttacagactgtgtcatcaagggcagagaggtgcggaaagggcagtccgttctgcgccagtataagaccgagattagaatcggaaaagctagcacgggctctcggagacttctgagcgaagagacatccgatgactgcatcagccgcacccaactcctgcggaccgaaacagccgagattcatggggataattacggaggcccgggggacaagatcaccatttgtaacggctctacaatcgtggatcagagactgggatccgagcttggctgctatacgattaatcgcgtcaaatccttcaagctctgcgaaaactccgccaccgggaagtcttgtgagatcgacagcgtgcccgtcaaatgccggcagggatactgtctgagaattacacaggaaggccgcgggcacgtgaagctgtcccggggatctgaggttgtgctcgatgcttgcgacaccagctgtgaaatcatgatccctaaaggcacaggggacattctggtcgattgctccggcggacaacagcactttcttaaggacaatctgatcgatctcggctgtcccaaaattcctctgctggggaagatggcgatctatatttgcagaatgtctaaccatcccaagaccacgatggccttccttttctggtttagcttcggatacgtgatcacctgtatcctctgcaaagctatcttttacctgctgattattatcggcacactcgggaagcgcttcaaacagtatcgggagctgaagcctcagacctgtacaatttgcgagaccacacccgttaatgccatcgacgccgaaatgcacgatcttaactgctcctacaatatctgtccgtattgcgctagcagactgacctctgacggactcgcccgccatgtgacgcaatgtcctaaacggaaggagaaggtcgaagagacagaactgtacctgaaccttgagcgcattccctgggtggtgcggaaactcctgcaggtttccgagagcaccggcgtcgcgctgaagagatcttcctggctcatcgtgctgcttgtgctgtttaccattagcctctctcctgtccagtccgctcccatcagccacgggaaaacaattgaagcctatagagcccgggagggctacacctccatctgcctgttcgtgctgggaagcatcctttttattgtttcttatctcatgaagggcctggtggatagcgtcgggaatagcttctttccgggactgtctatctgtaaaacgtgcagcacatcctctattaacggcttcgaaatcgagagccacaagtgttactgctccctcttttgttgcccttactgtagacattgctctgctgacaaagaaattcacaagctgcatcttagcatctgcaagaaacgcaagaccgggtccaacgtgatgctggccgtttgtaaacggatgtgcttcagagctacaatggaggtgagcaatcgcgccctctttattagatctatcatcaacaccacattcgtcctgtgtattctgatccttgcggtgtgcgttgtgtccaccagcgccgtcgagatggaaaatctgcccgctggaacgtgggagcgggaagaggatctcaccaacttctgtcaccaggagtgccaagtgacagaaaccgagtgtctgtgcccttatgaagccctcgtgctgcgcaagcccctttttctggactctattgtcaaaggcatgaagaatctcctgaactccacaagcctggagacctccctttctatcgaagctccctggggcgccattaatgttcagagcacgtacaagcctacagtgtccaccgcgaacatcgccctgagctggtcttccgtggagcatagagggaataaaatcctcgtcagcggacggtctgagagcattatgaagctggaagagaaaacaggcatctcctgggatctcggggtggaagacgcttctgagagcaagctgcttaccgtttccgtgatggatctgtctcagatgtatagcccggtcttcgaatacctctccggagaccgccaggtggaggagtggcccaaagccacctgtacaggcgactgccctgaaagatgtgggtgcacgagctctacctgcctgcacaaggagtggccccactcccggaactggcgctgtaatcctacatggtgctggggagttggcaccggctgtacatgctgtgggctggatgtgaaggacctttttaccgattatatgttcgtcaaatggaaggtggaatacattaaaacggaggctatcgtttgcgtggaactgacaagccaagagagacagtgttccctcattgaggccggaacccggtttaacctgggccccgtcaccatcacactctctgaacctcgcaatatccagcaaaagctgccgcccgagattatcacccttcatcctagaattgaagaggggttctttgacctgatgcacgtgcagaaagtgctgagcgcctccacagtctgcaagctccagtcttgtacgcatggagttcccggcgatcttcaggtgtatcacatcgggaacctgctgaagggagacaaagtgaatggccatctcattcacaagatcgagcctcacttcaacaccagctggatgtcctgggatggctgcgacctggattactactgtaacatgggggactggcccagctgcacatataccggagtcacacaacataatcacgcttcttttgtgaacctcctgaatattgaaaccgattacacgaaaaacttccattttcactccaagcgggttaccgcgcacggcgacacaccgcagcttgatctgaaagccagacctacctatggggctggagagatcacagtgctggtcgaagtggccgacatggagctccataccaagaaaatcgaaattagcggcctgaagttcgcctctcttacatgcacggggtgttacgcttgctccagcggaatctcttgtaaggttcgcattcacgtggacgagcccgatgagctgaccgtccatgtgaaaagcgacgatcccgacgtcgtggccgcgtcctctagcctcatggctcggaagctggaatttggcacagattccaccttcaaagccttcagcgccatgcctaagacctccctctgcttttatatcgttgagagagaacactgtaaatcttgcagcgaggaagacacaaagaagtgtgtgaatacgaaactggagcagccccagtccattcttatcgagcataagggcaccatcattgggaaacaaaactctacatgcaccgctaaggccagctgttggctggaatccgtcaaatctttcttttacggactgaagaatatgctcagcggcatcttcgggaacgtgtttattggaatcttcctgtttcttgcgcctttcattctgctcatcctgtttttcatgtttggctggaagatcctcttctgcttcaaatgttgccgccggacaagagggctgtttaagtatcgccaccttaaagatgacgaggaaaccggataccggagaattatcgagcgcctgaataacaagaaaggcaagaataagctgctcgatggcgaaattctggctgaccggagaatcgccgagcttttctccacgaaaacacacattgggtga

SEQ ID NO: 13641 - RNA, 5055 nt, synthetic construct
  misc_feature 1..5055: note = derived and/or modified CDS sequence (opt5) from CCHFV(UCCR4401)__KY484035.1__GP
  source 1..5055: mol_type = other RNA
atgcacatcagcctgatgtacgccattctctgcctgcagctttgtggcctgggggagacccatggatcccacaacgaaacaagacataataagacggacaccatgacaacccccggcgataacccttctagcgagccgcccgtgtccacagctctctctatcaccctggaccctagcacagtcacccccacgacccctgcctccgggcttgaaggatctggcgaggtttatacaagccctcccattaccacagggtccctgccgctcagcgaaaccacgcccgagctgcctgtgacaaccggaacagataccctgtctgcgggcgacgtggatccctccacccaaacagctggcgggacgagcgcccctaccgtccggacatctctccccaattccccgagcaccccttctacaccccaggacacccaccatcctgtgcgcaacctgctttccgttacgagccccggacccgatgagacatccaccccttctggcaccgggaaagaaagctccgccacaagctctccgcaccccgtgtccaatagacctcccacccctcccgctacagcccagggaccgacggagaacgacagccacaattctaccgaacatcctgagagcctgacacagtccgctacccccggcctcatgacatctcctacccaaatcgtccacccccagagcgccacgcctattaccgtgcaggatacacatccctccccgaccaaccggagcaagcgcaatctgaaaatggagatcatccttacactgtctcaggggctcaagaaatactatggaaagattctgagactgctccaactgacccttgaagaggacacggaaggcctgctcgagtggtgcaagcggaacctgggccttgattgtgacgatacattctttcagaaacgcatcgaagagttctttattaccggggagggacacttcaatgaagttctgcagtttagaacacctggcaccctctccaccacagagagcacgcccgcggggctgcccaccgccgaacctttcaagtcttactttgctaaaggattcctgtccatcgacagcggctattactccgccaagtgctattctgggacaagcaactccggactccagctgattaatatcacccggcactctacacgcattgtggacaccccgggccccaaaatcacgaaccttaagacaatcaattgtattaacctgaaggctagcatctttaaagagcatagagaagtcgagattaacgtgctcctgcctcaagtggccgtcaatctttccaactgccacgttgtgatcaagagccatgtgtgtgattactctctggacattgatggcgcggtccggctcccccacatctaccatgagggggtgttcatccctggaacctataaaattgttatcgacaagaaaaataagctgaacgatcgctgcaccctgtttacagactgtgtgattaaaggcagagaagtccggaaggggcagtccgtgctccgccagtacaagaccgagatcagaattggaaaagccagcacaggctctcggagactgctttccgaagaacccagcgatgactgcatctctcgcacgcaactgctccggaccgaaacagctgagatccacggggataattatggcggacctggcgacaagattaccatctgtaacgggagcacaattgttgatcagagactgggatccgagctgggctgctacaccatcaatcgcgtgcggagcttcaaactttgcgaaaactctgccacggggaagaattgtgagattgactccgtccccgtgaaatgcagacagggatattgtctccgcatcacccaggaaggccgggggcacgtcaagctgagcagaggctccgaggtggttctggacgcttgcgatacatcttgtgagattatgatcccgaagggaaccggcgacatcctcgtggattgcagcgggggacaacagcattttctgaaagacaaccttattgatctgggctgtcctaagatccccctcctggggaaaatggccatttacatctgccgcatgtccaatcaccctaagacaaccatggccttcctgttctggttttctttcggatatgtcattacatgtatcctttgcaaagctatcttttacctcctgattatcgtgggcaccctggggaagcggctcaagcagtacagagaactgaaaccccagacgtgtacaatttgcgagaccaccccggttaacgcgatcgacgccgaaatgcatgatcttaattgcagctataacatttgtccttactgcgcttcccgcctgacatctgacggcctcgcccggcacgtgatccaatgtcccaagagaaaagagaaggtcgaagagaccgagctgtatctgaatcttgaacggatcccttgggtggtgcgcaaactcctgcaggttagcgagtccacgggagtcgccctgaagagaagctcttggctcattgtgctgcttgtgctgttcacagtctccctcagccccgtgcagtctgctcccatcggccaggggaagaccattgaagcctaccgggcgagagagggatatacatccatctgcctgtttgttctgggcagcattcttttcatcgtgtcttgtctcatgaaagggctggtcgattccgtgggaaacagctttttccctggcctgtccatctgcaagacctgtagcatttctagcatcaacgggtttgaaattgagtcccacaaatgctactgttctctcttctgctgtccgtattgccgccattgcagcacagacaaggagatccacaaactgcatctttccatttgtaagaaacggaagaccggctctaatgttatgctggctgtgtgcaagctcatgtgttttagagccacgatggaagtcagcaaccgcgccctgttcatcagatccattatcaataccacatttgtgctgtgcatccttattctggctgtttgtgtggtctctaccagcgccgtggagatggaaaacctccccgctggaacatgggagcgggaagaggatctgaccaatttctgccaccaagagtgtcaggtgacggaaacagagtgcctctgtccttacgaagccctggtccttcgcaaacccctgttcctcgactccaccgcgaagggcatgaaaaacctgctgaatagcacatctcttgagacctccctgagcatcgaggccccttggggagctattaacgttcagtctacctacaagcccacagtgtccacggccaatatcgctctcagctggtcctctgtggaacatagagggaacaaaattctggtcagcggccggtccgagagcatcatgaagctcgaggagcgcaccgggatctcttgggatctgggagtggaagacgcctccgagagcaaacttctgacagtttctgtgatggacctcagccagatgtattcccctgtctttgagtacctgtctggcgatagacaagtggaagagtggccgaaagcgacctgcacaggcgactgtcccgaacggtgcgggtgcaccagctccacgtgtctgcacaaggagtggcctcactctcgcaattggagatgcaaccccacatggtgttggggagttggcaccgggtgcacctgttgcggacttgatgtgaaagacctgttcacagattatatgtttgtcaagtggaaagtggaatacattaagaccgaggccatcgtttgtgtggagctcacaagccaggaacggcagtgctccctgattgaggctggcacgcgcttcaatctcgggcctgtcaccatcacactgagcgaacccagaaacattcaacagaaacttccgcctgagatcatcaccctgcatccccggattgaagagggatttttcgacctgatgcacgtgcagaaggtgctctctgcctccacagtctgtaagctgcagagctgcacccatggcgttcccggcgatcttcaagtgtatcacatcgggaatctgctcaaaggagacaaggtgaacggccatctgattcacaaaatcgagcctcactttaacacgtcctggatgtcttgggatgggtgtgacctcgattactattgcaatatgggagactggcccagctgcacctacacaggcgtcacccagcataaccacgcttccttcgtgaatctgcttaacattgaaacagattacaccaagaattttcatttccactctaagagagttacagcccacggggacacgcctcagctggacctgaaagcccgcccgacctatggagctggcgagatcacagtgctcgtcgaagtggcggatatggagctgcataccaagaaaattgagatcagcggccttaagtttgcctccctggcttgtaccgggtgctacgcctgtagctctggaatctcctgcaaagttcggattcacgtggacgaacccgatgagctcacagtccatgtcaagagcgacgatcctgacgtggtggccgcttcttccagcctgatggccagaaaactcgagttcggcacggattctacctttaaggcgttcagcgctatgcccaagacatccctgtgtttctatatcgttgaacgcgaacactgcaaatcttgtagcgaggaggacaccaagaaatgcgtgaacacaaaacttgaacagcctcaatccattctgatcgagcataaggggaccattatcggaaagcagaatagcacgtgtacagccaaggcctcctgctggctggaatctgtcaagagctttttctacggcctcaagaacatgctgtccgggatctttggaaatgtgttcatgggcatttttcttttcctggctccctttatcctcctgattctcttctttatgttcggctggcggatcctgttttgtttcaaatgctgcagacgcacccgggggcttttcaagtatagacacctgaaagatgacgaggaaaccggataccgccggattatcgagaagctgaacaataagaaaggcaagaacaaactcctggatggggagagacttgccgaccggcgcatcgcggaactgttttctacaaagacccacattggatga

SEQ ID NO: 13642 - RNA, 5055 nt, synthetic construct
  misc_feature 1..5055: note = derived and/or modified CDS sequence (opt5) from CCHFV(IbAn7620)__KX013451.1__GP
  source 1..5055: mol_type = other RNA
atgcacatcagcctgatttacgccatcctctgcctgcagctttgtggcctgggggagacctatggatcccataacgaaacaagacacaataagacggacaccatgacaacccccggcgataacctctctagcgagcctccggtgtccacagctctgttcattacccccgacccttctacagtcacccccacgacccctgccagcgggcttgaaggatccggcgaggtttacacatctccccctatcaccacagggagcctgccgctccccgaaaccacgcctgagctgcccgcgacaaccggaacagatacctccagcgcttctgacgtggatttttccacccaaacagccggcggcacgagcgccctgaccgtgcggacagggctccctgactctccctccaccccgagcacacctcaggatacccatcaccccatgcgcaatctgctttctgtcacgtcccctggacccgacgagacaagcaccccctccggcaccgggagagaatctagcgctacatccagccctcatccggtgtctaaccggccccctacaccccctgccacagctcagggacccacggagaatgattcccacaacgccaccgaacacccggagagcctgacacagtctgcgacccctggcctcatgacaagccccacccaaacgattcatcctcagtccgccacccccatcacagttcaggacaaacagccttctcccaccaatcgcagcaagagaaacctggagatggaaatcattcttacactgtcccaagggctcaaaaagtattacggaaaaatcctgcggctgctccacctgacccttgaggaagatacggagggcctgctcgaatggtgcaagcgcaatctgggccttgactgtgatgacaacttctttcagaagagaattgaggagttctttatcacaggggaaggacatttcaatgaggtgctgcagtttcggaccccgggcacactcagcaccaccgaatctacccctgctgggctgcccacggccgagcccttcaaatcctattttgctaagggattcctgagcattgactctggctactattccgccaaatgctacagcgggacctccaactctggactccagctgatcaatattacacgccacagcaccagaatcgtcgatacacctggcccgaagatcaccaaccttaaaacgattaattgtatcaacctgaaggcgtccatttttaaggaacaccgggaggtggagatcaacgttctcctgccccaagtggccgtcaatctttctaactgccatgtggtgattaaaagccacgtctgtgactactccctggatatcgacggcgctgttcgcctccctcatatctatcacgaaggggtgttcattcccggaacatacaagatcgtgattgataaaaagaataaactgaacgacagatgcaccctgtttaccgattgtgtcatcaagggccgggaggtgcgcaaagggcagagcgttctcagacagtataagacagaaattcggatcggaaaggcctctaccggctccagacgcctgcttagcgaggaaccttctgacgattgcatctcccggacacaactgctcagaacggagaccgctgagattcatggggacaattacggcggacccggcgataaaatcacaatttgtaacgggagcaccatcgtggaccagcgcctgggatctgaactgggctgctatacaattaatcgggtcaagagcttcaaactttgcgagaactccgccaccgggaagaattgtgaaatcgacagcgtgcctgttaaatgcagacagggatactgtctccgcattacgcaggagggccgggggcacgtgaagctgtctagaggctccgagatcgtcctggatgcctgcgacaccagctgtgaaatcatgattcccaagggaacaggcgatatcctcgtggactgctccgggggacaacagcacttcctgaaagataaccttattgacctgggctgtccgaagatccctctcctggggaaaatggctatttatatctgccgcatgtctaatcatcccaagaccacaatggcgtttctgttctggtttagcttcggatacgtcatcacctgtattctttgcaaagccatcttttacctcctgattatcattggcacactggggaagcggctcaagcagtatagagagctgaaacctcagacctgtacgatctgcgaaacaacccccgtgaacgctatcgatgccgagatgcacgaccttaattgctcctacaacatttgtccgtattgcgcctctcgcctgaccagcgatggcctcgctcggcatgttatccaatgtcctaagagaaaagaaaaggtggaggagacagaactgtacctgaatcttgagcggattccctgggtcgtgcgcaaactcctgcaggtttccgaatctaccggagtggccctgaagagaagctcctggctcatcgtcctgcttgtgctgttcacggtgagcctctctcctgttcagtccgcgcccattggccaggggaagacaaccgaggcttatcgggccagagaaggatacacaagcatctgcctgtttgtcctgggctctatccttttcattgtgtcctgtctcatgaaagggctggtggacagcgtcggaaactctttcttccccggcctgtccatctgcaagacctgtagcatttccagcatcaacgggtttgagattgagtctcacaaatgctattgtagcctcttctgctgtccttactgccgccactgctccacagataaggaaatccataaactgcacctttctatttgtaagaaacggaagaccggcagcaatgtgatgctggccgtttgcaagagaatgtgttttcgcgctacgatggaggtgtccaacagagccctcttcatccggtctatcattaataccacattcgtcctgtgcatcctgattcttgctgtgtgtgttgtgagcacctccgccgtcgaaatggagaacctgccggcgggaacatgggaacgcgaggaggacctcaccaatttttgccatcaagaatgtcaggtgacggagacagaatgcctgtgtccctacgaggccctcgttctgagaaaacctcttttcctggattctatcgctaagggcatgaaaaaccccctcaatagcacctccctggagacaagcctgtctattgaagccccttggggagctatcgacgtgcagtccacctataagcccaccgtcagcacagccaacatcgcgctttcttggtccagcgtggagcaccgggggaataaaattctggtgtccggccgctctgaaagcatcatgaagctcgaggaaagaacggggatttcctgggacctgggagtcgaggatgccagcgagtctaagctcctgaccgtttccgtgatggaccttagccagatgtactctcctgtgtttgaatatctgagcggcgatcggcaagtcgaggaatggccgaaagctacatgcaccggcgactgtcccgagcgctgcgggtgcacatcctctacctgtctccataaggaatggcctcacagcagaaactggcggtgcaatcccacgtggtgttggggagtgggcacagggtgcacctgttgcggactggatgttaaagacctgttcaccgattacatgtttgtgaagtggaaagtcgagtatatcaagacagaggccattgtgtgtgttgaacttacctcccaggagcgccagtgctctctgatcgaagctggcacaagattcaacctcgggcctgtgacgatcaccctgagcgagccccggaatattcaacagaagctcccgcctgaaatcattacactgcaccccagaatcgaggagggatttttcgaccttatgcatgtccagaaagtgctgtccgccagcaccgtttgtaagctgcagtcttgcacacacggcgtgcccggcgatctccaagtctaccatattgggaacctgcttaaaggagacaaggtgaatggccacctgatccataaaattgaacctcactttaacacctcctggatgagctgggatgggtgtgacctcgattattactgcaacatgggagactggccctcctgcacgtacaccggcgtgacacagcacaatcatgcctctttcgtcaacctgctcaatatcgagaccgactatacaaagaactttcacttccatagcaagcgcgttaccgctcacggggatacacctcagctggaccttaaagcgcggccgacgtacggagccggcgaaatcaccgtgctggtggaggtcgctaatatggagctgcacacaaagaaaattgaaatctccggcctcaagtttgcctctctgacctgtaccgggtgctatgcctgtagctccggaattagctgcaaagtgagaatccatgttgatgagcccgacgaacttacagtgcacgtcaagtctgatgaccctgatgtggttgctgcctccagctctctgatggcgcgcaaactcgagttcggcacggactccaccttcaaggcttttagcgccatgcccaagacatctctgtgtttctacattgtggaacgggagcattgcaaaagctgttccgaggaagataccaagaaatgcgtcaacacaaagctcgagcagcctcaatctatcctgatcgaacacaaagggaccattatcggaaagcagaatagcacgtgtacagccaaggcttcctgctggcttgagagcgtgaaatcctttttctatggcctgaagaacatgctgtctgggatttttggaaatgtcttcatgggcatctttctcttcctggccccctttattcttctgatcctcttctttatgttcggctggagaatcctgttctgttttaaatgctgccgccggaccagagggctctttaagtaccgccatctgaaagacgatgaagagaccggatatcggagaattatcgagcggcttaacaataagaagggcaaaaacaagctgctggacggggaacgcctcgcggacagacggattgctgagctgtttagcacaaaaacccacatcggatga

SEQ ID NO: 13643 - RNA, 5055 nt, synthetic construct
  misc_feature 1..5055: note = derived and/or modified CDS sequence (opt5) from CCHFV(Zahedan 2007)__KC867273.1__GP
  source 1..5055: mol_type = other RNA
atgcacatcagcctgatgtacgccgtgttctgcctccagctgtgtggccttgggaagaccaacggaccccataatggcacagagcacaacaatacgcatgtcatgaccacacctgacgattcccaatctccggaaccccctgttagcaccgctctgcccgtgacacctgacccctccaccgtgacaccttctaccccggccagcgggctcgagggatccggcgaagtccacacgtctagccccattaccacaaaagggctgtcccttcctgaggcgaccagcgaacccccttctacaacctccgtggttacgagctctgcttccgatacagacagctctacccaggccgccggagatacacccaccccgaccgtgagaacatccctgcctagctccccctctacgcctagcacctcccagggcacacattatcccgtccggagcctcctgtctgtgaccggccccaagcctgaggagacaccgaccccctccaaaagcgggaaggacaacctggctaccaattctcctcaccccgccacaagccgccctaccaccccctccacaatcgctcagaaaccgaccgaaaacaattctcacaacacaacggagcaactcgaaagcctgacccatcttgccacactgggatccaagattagccctacccagacagttctcccccagtctgtgacctccatcgcgattcaggatatccacacgagccctaccaatagatctaagcggaacctggacatggagatcattcttacactgtcccaaggcctcaaaaagtactatgggaaaatcctgaagctgctccgcctgacccttgaggaagatacagagggactgctcgaatggtgcaaaagaaatctgggccttgactgtgatgacacctttttccagaagcggattgaggaatttttcatcacgggggagggacattttaacgaggtcctgcagttccgcacactcggcaccctgagcacaaccgaatccacccacgccggctctcccacagtggagccttttaagagctacttcgctaaagggtttctgtccattgattctggatatttcagcgccaagtgctactccagaacgagcaattctggcctccagctgatcaacgtgacccggcactccacacgcattgctgacacccccgggccgaaaatcacaaatcttaagaccatcaactgtattaacctgaaagccagcgtctttaaggaacatagagaggttgaaatcaatgtgctcctgcctcaagtggcggtcaacctttctaattgccacgtggccattaaatcccatatctgtgactatagcctggatacggacggagctattcggctcccccagatccaccatgagggcacattcatccccgggacctacaagattgttatcgataagaaatctaagctgaacgaccgctgcaccctgtttacaaattgtgtgattaaaggaagagaggtccggaagggccagagcgtgctccgccaatacaaaaccgaaatcagaattggccgggcctccacagggagcagacgcctgctttctgaggaatccggagatgactgcatcagccggacgcagctgctcagaaccgagacagctgaagttcacggcgataactatgggggacctggcgacaagatcaccatttgtaatgggtccacagtggtcgatcagcgcctgggctctgagctgggatgctacaccatcaaccgggtgcgcagcttcaagctgtgcgagaactccgccacgggcaaatcttgtgaaattgacagcatcccggtcaagtgcaaacaggggttctgtctcaagattacccaagagggaagaggccacgtgaaactgtcccgggggtctgaagttgtgctggatgtctgcgacagctcctgtgaggtgatgatccccaagggaacaggcgacattctcgttgattgcagcgggggccagcagcattttctgaaggacaaccttgtggatctgggatgtcctaaaatccccctcctgggcaagatggccatctatatttgcagaatgtctaatcaccctaaaaccacaatggctttcctgttttggttctcctttgggtacgtcatcacctgtattctttgcaaggcgatcttctttctcctgattatcttcggaacactgggcaaacgctttaagcagtatcgggagctcaagccccaaacctgtacgatctgcgaaacaacccctgtgaacgccattgacgctgagatgcatgatctgaattgcagctacaacatctgtccctattgcgcctctagacttacctccgacgggctggcccgccacgtgacacagtgtccgcggagaaaagaaaaggttgaggaaaccgagctctacctgaatctggagcggattccttgggtcgtgcgcaaacttctccaggtgagcgaatctacgggaacagtcctgaagagatccagctggctgatcgtgctcctggttcttttcaccgtgtccctgagccccgtccagtctgctcctattggccacgggaaaacaatcgagacctaccgggtgagagaagagtatacaagcatctgcctctttgttctgggctccattctgttcatcgtgtcttttcttatgaagggactcgtcgatggcgtggggaacattttcttccccggactgagcgtttgtaaaacctgctccatcggctctattaacgggtttgaaatcgagagccatcgctgttactgctccctgttctgttgcccgtattgtcggcactgctctgccgacggagagatccatcaactccacctgagcatttgcaagaagagaaaaacgggctccaatgtgatgcttgcggtctgtaagcgcatgtgctttagagctaccatggaagtgagcaacaaagtgctgttcatccggtctattatcaatacaacctttgtcgtttgtattctcatcctggccgtgtgcgtggtctccacaagcgccgtggagatggaatctctgcctgctgggacctgggagcgcgaagaggatcttacgaacttctgtcatcaggagtgccaggttacagaaaccgagtgtctgtgcccctacgaagccctcgtgctgagacggcctctctttctggactccattgtcaaggatatgaaaaatcttctgaacagcacatccctcgagacctctctgagcatcgaggctccctggggcgccatcaatgtgcagtccacctataagcccacagttagcacggcgaacattgccctgtcttggtccagcgtggaacaccgcggaaataaggtccttgtgtctggcagaagcgagtccatcatgaaactggaagaacggaccgggatttcttgggacctcggagttgaagatgctagcgagtccaagctgctcacagtgtctgtcatggacctgagccaaatgtactcccctgtgttcgagtatcttagcggcgaccgccaggtggaagagtggccgaaagccacctgtacaggggattgccccgaaagatgtggatgcacctcttccacgtgcctgcacaaggagtggcctcatagccggaactggcgctgtaatcccacatggtgctggggcgtcggcaccgggtgtacctgctgtggactcgacgttaaagatctgtttacagactacatgttcgtgaagtggaaggtggaatacatcaaaaccgaggctattgtctgcgtggagctgacatcccaggaaagacaatgttctcttatcgaggccggcacgcggtttaacctggggagcgttaccatcacactctccgaacctagaaatattcagcagaagctgccccctgagatcattaccctccacccgaaaatcgaagagggattctttgatctgatgcatgtgcagaaggtcctttctgcgagcacagtgtgcaaactgcaatcctgtacccacggcgttcccggggaccttcaggtgtatcatattggaaacctcctgaagggcgatcgcgtcaatggccaccttatccacaagatcgagcagcatttcaacacgagctggatgtcttgggacgggtgcgatctggactactattgtaacatgggagattggccttcctgcacctacacaggcgtgacccagcacaatcatgccagcttcgtcaacctcctgaatattgaaacagactataccaaaacatttcacttccactctaagcgggtgacggctcatggggatacgccccaactcgacctgaaagccagacctacatacggagctggcgagatcaccgttcttgtggaagtcgccgacatggagctgcacaccaagaaaattgagatctccgggctgaagtttgccggactcacatgcacgggctgttatgcttgcagctctggcattagctgtaaagtgcgcatccatgttgatgaacccgacgagctgaccgtgcacgtcaagtccgatgacccggatgtggtggcggcctctagctcccttatggctcggaagctggagttcgggacagacagcacctttaaagccttctccgccatgcctaagacatctctctgcttttacattgttgagagagaatactgtaaaagctgctccaaggaggatacccagaaatgtgtcaacacgaagctggagcagccccagtctatcctcatcgaacataagggaacaattatcggcaaacaaaataatacctgcaccgctaaggccagctgttggctggagtccgtgaaatctttcttttatgggcttaagaatatgctgggaggcattttcgggaacgtgtttatcggaattttcacattcctgaccccctttatcctcctgatcttctttttcatgtttggctggcgcattcttttctgctttaaatgttgccggagaacacgcggcctgttcaagtaccggcacctcaaggacgatgaagagaccgggtatagaaaaatcattgaacggctgaataacaagaaaggaaagaatcgcctcctggacggcgagagacttgcggatcggaaaatcgctgagctgtttagcacgaagacacacattgggtga

SEQ ID NO: 13644 - RNA, 5055 nt, synthetic construct
  misc_feature 1..5055: note = derived and/or modified CDS sequence (opt5) from CCHFV(Afg09-2990)__HM452306.1__GP
  source 1..5055: mol_type = other RNA
atgcacatcagcctgatgtacgccgtgttctgcctccagctgtgtggccttgggaagaccaacggaccccataatggcacagagcacaacaatacgcatgtcatgaccacacctgacgattcccaatctccggaaccccctgttagcaccgctctgcccgtgacacctgacccctccaccgtgacaccttctaccccggccagcgggctcgagggatccggcgaagtctatacgtctagccccattaccacaaaagggctgtcccttcctgaggcgaccagcgaaccccctgctacaacctctgtggttacgtccagcgcctctgatacagactccagcacccaggccgctggagatacacccaccccgaccgtgagaacatctctgccttccagcccctccacgccttctaccagccagggcacacactaccccgtccggtccctcctgagcgtgacctctcccaagcctgaggagacaccgaccccctccaaaagcggcaaggacaacctggccaccaattctcctcatcccgctacaagccgccctaccacgcccccgacaaccgcccagaaacctacagaaaacaattcccacaacacgaccgagcaactcgaatctctgacacaccttgcgaccctggggagcatgatctcccccacacagaccgttctccctcagagcgtgacgtctattgccatccaggatattcataattcccccaccaacagaagcaagcggaatctggacatggagatcatccttacactgtctcaaggactcaagaaatattacggcaagattctgaaactgctccacctgacccttgaggaagatacagaggggctgctcgaatggtgcaagcgcaacctgggacttgactgtgatgacacctttttccagaaaagaatcgaggaatttttcattacgggcgaggggcattttaatgaggtcctgcagttccggacactcggaaccctgtccacaaccgaaagcacccacgctggctcccctacagtggagccctttaagtcttatttcgccaagggctttctgagcatcgattccgggtacttctctgctaaatgctatagccgcacgtccaacagcggactccagctgattaatgtgaccagacactctacacggatcgccgacaccccgggccctaagattacaaaccttaaaaccatcaactgtatgaatctgaaggcgtccgtctttaaagaacatcgcgaggttgaaatcaacgtgctcctgccccaagtggccgtcaatcttagcaactgccacgtggctattaagtctcatatctgtgactactccctggatacggacggggccattagactcccccagatccaccatgagggaacattcattcctggcacctacaaaatcgttatcgataaaaagagcaagctgaatgaccggtgcaccctgtttacaaactgtgtgattaaggggcgcgaggtcagaaaaggacagtctgtgctccggcaatataagaccgaaatccgcattggcagagctagcgccggctcccggagactgcttagcgaggaatctggggatgactgcatctcccgcacacagctgctccggacggagaccgccgaagttcacggagataattacggcgggccgggagacaaaattacaatctgtaacggcagcaccgtggtcgatcagagactggggtccgagctgggctgctatacaatcaatcgcgtgcggtctttcaagctctgcgagaacagcgctaccggaaagtcctgtgaaattgactctatccccgtcaaatgcaagcagggctactgtctcaaaattacgcaagaggggagaggacacgtgaagctgagccgcggctccgaagttgtgctggatgtctgcgactctagctgtgaggtgatgatccctaaagggaccggagacattctcgttgattgctccggcgggcagcagcattatctgaaggacaatcttgtggatctgggctgtcccaagatccctctcctgggaaaaatggcgatttacatctgccggatgagcaaccaccccaagacaaccatggccttcctgttttggttctcttttggctatgtcatcacatgtattctttgcaaagctatcttctttctcctgattatcttcgggaccctgggaaagagatttaaacagtaccgcgagctcaagcctcaaacatgtaccatttgcgaaacgacacccgtgaatgccatcgacgccgagatgcatgatctgaactgctcctacaatatctgtccgtattgcgctagccggcttacctctgacggcctggccagacacgtgacccagtgtcctcgccggaaggaaaaagttgaggaaacagagctctacctgaacctggagcgcattccctgggtcgtgcggaagctgctccaggtgtccgaaagcaccgggacggtcctgaaaagatcttcctggctgatcgtgctcctggttcttttcacagtgagcctgtcccctgtccagagcgcgcccattggacacggcaagaccatcgagacatatagagtgcgggaagagtacacctctatttgcctctttgttctggggagcatcctgttcatcgtgtcctttcttatgaaaggcctcgtcgatggagtgggcaacattttctttccggggctgtctgtttgtaagacatgcagcatcggatccattaatggcttcgaaatcgagtctcataaatgttattgcagcctgttctgttgcccttactgtagacactgctccgctgacggggagattcatcaactccacctgtctatctgcaagaagcgcaaaaccggaagcaacgtgatgcttgccgtctgtaagcggatgtgctttagagccacgatggaagtgtccaataaagctctgttcatccgcagcattatcaacaccacatttgtggtctgtattctcatcctggccgtttgcgtggtgtctacctccgctgtcgagatggaaagcctgcccgccggcacatgggagagagaagaggatcttaccaatttctgtcatcaggagtgccaggtgacggaaacagagtgtctgtgcccttatgaagcgctcgttctgcggcgccccctctttctggactctattgtgaaggggatgaaaaaccttcttaattccaccagcctcgagacatccctgtctatcgaggccccctggggcgctattaacgtccagagcacctacaagcctaccgtgtccacagccaatatcgctctgagctggtcttccgttgaacacagaggaaacaaggtgcttgtcagcggccggtctgagagcatcatgaaactggaggaacgcacggggatttcctgggatctcggagtggaagacgcctctgagagcaagctgctcaccgtttccgtgatggatctgtctcaaatgtacagcccggtcttcgagtatctttccggcgacagacaggtggaagagtggcccaaagcgacatgtaccggggactgccctgaacggtgtggatgcacaagctctacctgcctgcacaaggagtggccccattcccgcaattggagatgtaaccctacgtggtgctggggcgtgggcacagggtgtacctgctgtggactcgatgtcaaagacctgtttaccgattacatgttcgttaagtggaaggtggaatatatcaaaacagaggccattgtgtgcgtcgagctgaccagccaggaacggcaatgttcccttatcgaggctggcacacgctttaatctggggtctgtgacgattaccctcagcgaacccagaaacatccagcagaagctgcctccggagatcattacactccaccccaaaatcgaagagggattctttgacctgatgcatgttcagaaggtgctttccgcctctaccgtctgcaaactgcaaagctgtacacacggcgtgcctggggatctgcaggtttaccatattggaaatctcctgaagggcgaccgggtgaacggccaccttatccacaagattgagcagcatttcaacacctcctggatgagctgggatgggtgcgacctggattattactgtaatatgggagactggccctcttgcacgtataccggcgtcacacagcacaaccatgcttcctttgtgaatctcctgaacatcgaaaccgattacacaaaaaccttccacttccacagcaagagagtcacagcccatggggacacgcctcaactcgatctgaaagcccgccccacctacggagctggcgagatcacagtgcttgttgaagtggcggacatggagctgcacaccaagaaaattgagatctctgggctgaagtttgccggacttacctgcacaggctgttatgcttgctccagcggcatttcttgtaaagtccggatccatgtggacgaaccggatgagctgacggttcacgtcaagagcgacgatcctgacgtggtggccgcctcctctagccttatggctagaaagctggagttcgggaccgattccacatttaaagccttcagcgcgatgcccaagacctccctctgcttttacattgtggaacgcgaatattgtaaatcttgcagcaaggaggacacacagaaatgtgttaataccaagctggagcagccccagtccatcctcattgaacataagggaacgatcatcggcaaacaaaacaatacatgcaccgctaaggcctcttgttggctggagagcgtcaaatccttcttttacgggcttaagaacatgctgggaggcattttcgggaatgtgtttatcggaattttcacctttctgacacctttcatcctcctgattcttttctttatgttcggctggcggatcctgttttgcttcaaatgttgcagacgcacccggggcctctttaagtatagacacctgaaggatgacgaagagacagggtaccgcaaaatcattgaacggctcaacaataagaaaggaaagaacagactgcttgatggcgagcggctggccgaccgcaaaatcgctgagctgttctctaccaagacgcacattgggtga

SEQ ID NO: 13645 - RNA, 5055 nt, synthetic construct
  misc_feature 1..5055: note = derived and/or modified CDS sequence (opt5) from CCHFV(SPU41/84)__AY900142.1__GP
  source 1..5055: mol_type = other RNA
atgcacatcagcctgatgtacgccgtgctctgcctgcagctttgtggcctgggggagacccatggatcccacaacggcacaagatataataacacggacgctaccacaacccccggggattctcaaagccctgaaccgcccgtctccacagcctctagcattacccataatccttccacagttacctctacgacccccacaagcggatccgagggcagcggggaagtgtacacctcttcccctatcacaaccgagggactcagccctcccggcacgacaccggaactgcccgcgaccacaggcattgacacctctggggcttccgatgccaaccctagcacccaggccgctcggggaacatctgcccttacggtgcacacctccctgcccagctccccttctacacccccgatcagccaggacacccatcaccctgtccgcaatctcctgtccgtgacaagccccatgcctgaggagaccacggctccctctggctccgggaaggaaagctctgccacaagctctccccaccctgcgtccgatagaccgcccacccctcccgccaccgctcagggactgacagagagcaactcccataatgccaccgaacacctcgagagcctgacacaatctgctacgcctggccttgttacctcccccgcccagacagtgcatccgcacagcgcgacctctattgccgctcctgacacacaccccaaccctaccaatcggtccaaacgcaacctggagatggaaatcatcctcacgctgagccaggggcttaagaaatattacggaaagattctgagactcctgcatctgaccctcgaggaagatacagagggcctgcttgaatggtgcaaacggaatctgggcctcgactgtgatgacaccttctttcagaagcgcatcgaggagttctttattacaggggaaggacacttcaacgaggtcctgcaatttagaacccccggcacggtgtccacaaccgaatctacacatgccgggcctcccaccgctgagccgttcaagagctattttgccaaaggatccctttctatcgatagcggctactattccgccaagtgctacagcgggacctctaattccggactgcagctcattaacatcacacggcacagcacgaaaattgctgacacccctggccccaagatcacaaatctgaaaaccatcaactgtattaacctgaaggcgctcacattcaaggaacatcgcgaggttgagatcaatgtgctgcttccccaggtcgccgtgaacctgtctaattgccacgtggtcattaaatcccacgtttgtgattacagcctcgacatcgacggcaccgtgagactgcctcatattcaccatgaagggatctttatcccgggaacgtataagattgtgatcgataaaaagaacaaaatgaatgaccggtgcacacttttcaccaactgtgtcattaagggccgcgaggtgagaaaagggcagtctgttctgaagcaatacaagaccgaaatccggattggaaaagctagcacaggctcccgcagactcctgagcgaggaatcttccgatgactgcatcagccggacccagctgctcagaacagagacggccgagatccacggggataattatggcggacccggcgacaagattaccatctgtaacgggtccacagtggtcgatcagcgcctgggatctgaacttggctgctacaccattaatcgggtgaaaacatttaagctgtgcgagaacagcgccaccgggaaatcctgtgaaatcgactctgttcctgtgaagtgcagacaaggatattgtctcaagattacgcaggagggccgcgggcacgtcaaactgagccggggctccgaggtggtcctggatgcttgcgacacctcttgtgaagtgatgatccccaagggaacaggcgatattcttgttgactgcagcgggggacagcagcatttcctcaaagacaatctgatcgatctgggctgtcctaagatccccctcctggggaaaatggccatttacatctgcagaatgtccaaccaccctaagaccacaatggcgtttcttttctggttcagctttggatatgtgattacctgtatcatttgcaaggtcatcttctacctgctcatcattgtgggcacactggggaaacgctttaagcaataccgggagctgaaaccccagacctgtacgatctgcgaaacaaccccggttaatgctattgacgccgagatgcatgatcttaactgctcttataatatctgtccttactgcgcctccagactcaccagcgacggcctggctcgccacgtgacacagtgtcccaagcggaaagaaaaggtcgaggagaccgaactgtatctcaacctggagcggattccttgggtggtgcgcaaacttctgcaggtttctgaatccacgggagtcgccctcaaacggagctcttggctggtggtgctgcttgtcctcctgacagtgtccctgagccccgttcaatccgctccgatcagccatggcaagaccgtggaggcctacagagcgcgggaagggtatacatctatgtgcctcttcgtcctgggaagcgtgctttttctggtttcctgtctcatgaaaggcctggtggattctgtcgggaacaccttctttcctggactgagcatctgcaagacatgttccatttctagcatcaatggcttcgagattgagtcccaccgctgctactgttctctcttttgctgtccctattgcagacactgcagcgccaacaaagaaatccatcagcttcacctgtccatttgtaagaaacggaaggctgggagcaatgtgatgctggccgtttgcaagagaatgtgtttccgcgctaccatggaggtgtctaaccgggccctctttatcagatccatcattaatacgaccttcgtcctgtgcatccttattctggcggcctgtgtggtgagcacatctgctgtcgaaatggagtccctccctgccggcacctgggaacgcgaggaggacctgacaaacttttgccatcaggaatgtcaggttgctgataccgagtgcctgtgtccctacgaagcccttgtgctgagacggcccctcttcctggacagcatcgtgaaaggaatgaagaatctcctgaactccacgtctcttgagacaagcctgtccattgaggccccttggggcgctatcaatgtccaaagcacctacaaaccgacagtgtctaccgcgaacattgccctctcctggagctctgttgaacaccgcgggaataagatcctggtgagcggaagatccgagtctatcatgaaactggaagagagaaccggcattagctgggatcttggggtcgaagacgcttccgagtctaagctgctcacagtgagcgttatggatctgtcccagatgtatagccccgtgttcgagtacctctctggagaccgccaggtcgaagagtggcctaaggccacgtgcaccggcgattgtcccgaaagatgcggctgcacatccagcacctgtctgcataaagagtggcctcactcccggaactggcgctgcaatcccacatggtgttggggagtggggaccggctgcacgtgttgcgggcttgacgttaaggacctgtttacagattatatgttcgtgaaatggaaggtcgaatacatcaaaaccgaggccattgtgtgtgtggagctcacctctcaggaaagacaatgcagcctgatcgaggctggaacacggtttaacctgggccctgtcaccattacactttccgaaccgcgcaatatccagcagaagctgccccctgagatcattacgctccaccccagaatcgaagaggggttctttgacctgatgcatgttcaaaaggtgctctctgccagcaccgtgtgtaaactgcagtcctgcacacacggagtccctggcgatcttcaggtgtatcatattggcaacctgctgaagggggacaaagttaacggacacctcgtgcacaagatcgagccccatttcaataccagctggatgtcttgggatggctgtgacctggattactattgcaacatgggggactggccgtcctgcacatacaccggagtcacgcagcacaatcatgcgagctttgtgaacatgcttaatattgaaaccgattacacaaagaacttccactttcattctaagcgggttaccgctcacggcgacacacctcaactggatctcaaggccagacccacctatggggccggagagatcacagtgctggtcgaagtggctgacatggagctccacacgaaaaagatcgagatttccggcctgaaattcaccagccttacatgtaccggctgctacgcctgttctagcgggatctcctgcaaggtccgcattcatgtggatgaacccgacgagctgaccgttcacgtgaaatctgaagaccctgatgtcgtggcggctagctccagcctgatggcccggaagctcgagtttggaacagactccacgttcaaagccttttctgctatgcccaagaccagcctgtgtttctatatcgttgaaagagagtactgcaagtcctgttctgaggaagatacacagaaatgcgtgaataccaaacttgagcagcctcagagcattctgatcgaacgcaagggcacaattatcgggaagcaaaacaatacctgtaaagccaaggctggatgctggctcgagtccgtcaagtctttcttttatggcctgaaaaacatgctcagcgggatcttcggaaatgtgtttattggcatcttcctgtttcttgccccgttcattctgctgatcctctttttcatgtttggctggcggattctgttctgttttaagtgctgcagacgcacgcgggggcttttcaaatacagacatctgaaggacgatgaagagacaggatatcgcaaaatcatcgagcggctcaacaataagaagggcaaaaacaagctgctcgacggggaaagactggcggatcggcgcattgccgagcttttctccaccaaaacccacatcggatga

SEQ ID NO: 13646 - RNA, 5055 nt, synthetic construct
  misc_feature 1..5055: note = derived and/or modified CDS sequence (opt5) from CCHFV(SPU103/87)__DQ211634.1__GP
  source 1..5055: mol_type = other RNA
atgcacatcagcctgatgtacgccgtgctctgcctgcagctttgtggccttgggggagctcatggctcccacaacgggaccagatataataacacaggagccctcacgaccctgggcgacgggcaatctagcgagccccctgtctccacagcgccgtctaccacacataatcccagcaccgttacatccaccacgcctgcttctggaagcgaaggctccggcgaggtgtacaccgccagccccgtgacaaccgaagggctttctcctcccggaacaacccctgagctgccggccacgacaggcattgatacctccggggctagcgacgccgatccctctacacaggctgccggagacacctccgcgctcaccgtccggacaagcctgccttcttcccccagcacgctgcctacctcccaggatacacaccatcccgtgcgcaacctcctgtctgttaccagcccgagacctgaagagacaaccgccccctccggcagcgggatcgagtcttccgctacgagctctcctcaccccgccagcgaccggccccctacaccgcccgctgccgcgcagggacctaccgaatccaattctcacaacgccaccgagcatcttgaaagcctgacacaatccgctacccccgatctcgtgacaagccctgcccagacggtccacccccagtctgctacctccattgccgccccggacacacatcctagccccaccaatcgctctaagagaaacctggaggtggagatcattcttacactgtcccagggcctcaaaaagtattacggcaaaatcctgcggctgctccacctgacccttgaagaggatacggaagggctgctcgagtggtgcaagcgcaatctgggacttgactgtgatgacaccttctttcagaaaagaatcgaagagttctttattacaggcgaggggcacttcaacgaagttctgcaatttcggacccctggaacagtgagcaccacggagtccacacatgctgggccccctaccgcggaacccttcaagtcttattttgccaaggggttcctcagcatcgattccggatactattctgctaaatgctacagcggcacatccaatagcggcctgcagctgattaacatcacccgccactctaccagaattgccgacacaccggggcctaagatcacgaatctcaaaaccattaactgtatcaatctgaaggcccttacatttaaagagcatcgggaagtcgagatcaacgtgctgctcccccaggtggctgtcaacctgtccaattgccacgttgtgattaagagccatgtgtgtgactactctcttgatatcgacggaaccgtccgcctgccccacattcaccatgagggcatcttcattcctgggacatataagatcgtgatcgataaaaagaacaaactcaatgacagatgcaccctgtttacggattgtgttattaagggacgggaagtgcgcaaaggccaatccgtcctgaagcagtacaaaacagagatcagaattgggaaggccagcaccggctctcggagactcctgagcgaagagtccagcgacgattgcatctctcgcacccagcttctgcggacagaaaccgcggagattcacggagacaactatggcgggccgggagataagatcacaatctgtaatggctccacgattgtggaccaaagactcgggagcgagctgggatgctacaccatcaaccgcgttaaaacattcaagctgtgcgaaaattccgctaccggcaaatcttgtgagattgatagcgtgcccgtcaagtgccggcaggggtattgtcttaaaatcacacaggaaggcagaggacatgtgaagctctcccgcggctctgaggtcgtgctggacgcctgcgacaccagctgtgaggttatgattcctaaggggacgggagatatcctggtggactgctccggcgggcagcaacactttctcaaagataacctgattgaccttggatgtcccaagatccctctgctcggcaaaatggccatctacatttgccggatgtctaatcaccccaagaccacaatggctttcctgttctggtttagcttcgggtatgtcatcacctgtgtgctgtgcaaagccatcttttaccttctcattattgttggcacactgggaaagagactgaagcagtaccgcgaactcaaacctcagacctgtacaatctgcgagaccacgcccgtgaacgctatcgatgccgaaatgcatgacctgaattgctcctataacatttgtccgtactgcgcgagccggcttacatctgatggcctggccagacacgtcacccagtgtcctaagcgcaaagagaaggtggaagagaccgagctctatctgaatctggaacggatcccctgggtggttagacggcttctccaagtctccgagagcacaggggtggctctgaaaagatcttcctggctgattgtgctcctggtccttttcaccgtgagcctgtctcctgttcagtccgcccccatcagccatggaaagacggtggaggcttaccaggccagagaaggctatacagggatgtgcctctttgtcctgggatccattctgttccttgtgagctgtctcatgaagggcctggttgactctgtggggaacacctttttcccgggcctgagcatctgcaaaacatgttccatctctagcattaatggatttgaaatcgagtcccaccggtgctactgttctctcttctgctgtccttattgcagacattgcagcgcgaacaaggagattcaccagctgcacctttccatctgtaaaaagcgcaaaaccggctctaacgtcatgctggccgtgtgcaagcggatgtgttttagagctacaatggaagttagcaatcgcgccctcttcattagatccatcatcaacaccacgtttgtgctgtgcattctgatccttgctgtctgtgtggtgagcacctctgccgtcgagatggaatccctgcccgccgggacatgggagcgggaagaggatctcaccaatttctgccatcaagagtgtcaggttacagacaccgaatgcctgtgtccttacgaggctctcgtgctgcgcagaccccttttcctggataacattgtgaaaggaatgaagaatctcctgaacagcacgtctctggaaacatcccttagcatcgaggcgccctggggcgccattaatgtccagtccacctacaagcctacagtgtctaccgctaacatcgccctgagctggtccagcgttgagcaccgggggaataaaattctcgtgtctggacgctccgaaagcatcatgaagctggaggaaagaaccggcatctcttgggacctcggcgtcgaggatgccagcgaatccaaactgcttacagtgtctgttatggacctgagccagatgtattccccggtgtttgagtacctctctggggaccggcaagtcgaggaatggcccaaggctacgtgcaccggagattgtcctgagcgctgcggctgcacaagctccacctgtctgcataaagaatggccccacagcagaaactggcggtgcaatcctacatggtgttggggcgtgggaaccggctgcacgtgttgcgggctggacgttaaggatcttttcacagactatatgtttgtgaagtggaaaattgagtacatcaagaccgaagccattgtctgtgtggagctgacctctcaggagcgccagtgctccctcatcgaagcgggaacaagattcaacctgggccccgtgaccattacactcagcgagcctcggaatatccaacagaaactgccgtccgaaatcattacgcttcatcccagaatcgaggaaggctttttcgatctgatgcacgtccagaaggttctgtctgctagcaccgtgtgtaaactccagtcctgcacacacggggtgcctggagacctgcaagtctatcatattggcaaccttctgaagggggataaggtgaatggacacctcgttcataaaatcgagccccactttaacacctcttggatgagctgggacggctgtgatctggactactattgcaacatgggggattggccttcctgcacatacaccggagtgacgcagcacaatcatgccagcttcgtcaacctcctgaatattgagaccgactacacaaagaactttcacttccattctaaacgcgtgaccgcccacggcgatacaccccagcttgacctgaaggctcggccgacctatggcgccggggaaatcacagttctggtggaggtcgcggacatggaactccatacgaaaaagatcgagatttccggactgaagtttaccagccttacatgtaccggctgctacgcttgttcttccgggatcagctgcaaagtgcgcattcacgtcgatgagcctgacgaactgaccgtgcacgttaagtctgatgaccccgatgtggtcgccgccagctcctctctcatggctcgcaaactggagttcggaacagacagcacgtttaaggccttctccgctatgcccaaaaccagcctctgtttctatatcgtggaacgggagtactgcaagtcctgttctgaagaggatacacagaaatgcgttaataccaagctggagcaacctcagagcattcttatcgaacataagggcacaattatcgggaaacagaacaatacctgtaaggccagagcgggatgctggctggagtccgtgaaatctttcttttatggcctgaagaacatgctcagcggcatctttgggaatgtcttcattggaatctttctgttccttgccccctttattctgctcatcctgttctttatgttcggctggcgcattctcttttgtttcaaatgctgccggagaacgcgcgggctgttcaagtaccggcaccttaaggacgatgaagagacaggatatagaaaaatcatcgaacggctgaacaataagaaaggcaagaacaaactgctcgacggggagcgcctggctgatagacggattgccgagctgttttccaccaagacccatatcggatga

SEQ ID NO: 13647 - RNA, 5055 nt, synthetic construct
  misc_feature 1..5055: note = derived and/or modified CDS sequence (opt5) from CCHFV(Iran-53)__DQ446216.1__GP
  source 1..5055: mol_type = other RNA
atgcacatcagcctgatgtacgccgtgttctgcctccagctgtgtggccttgggaagaccaacggaccccataatggcacagagcacaacaatacgcatgtcatgaccacacctgacgattcccaatctccggaaccccctgttagcaccgctctgcccgtgacacctgacccctccaccgtgacaccttctaccccggccagcgggctcgagggatccggcgaagtctatacgtctagccccattaccacaaaagggctgtcccttcctgaggcgaccagcgaaccccctgctacaacctctgtggttacgtccagcgcctctgatacagactccagcacccaggccgctggaggcacacccaccccgaccgtgagaacatctctgccttccagcccctccacgccttctaccagccagggcacacactaccccgtccggtccctcctgagcgtgacctctcccaagcctgaggagacaccgaccccctccaaaagcgggaaggataacctggccacaaattctcctcatcccgctacgagccgccctaccgcgcccccgaccacagcccagaaacctaccgaaaacaattcccacaacacaacggagcaactcgaatctctgacccaccttgccacactgggaagcatgatctcccccacccagacagttctccctcagagcgtgacctctattgctatccaggacattcatacgtcccccaccaatagaagcaagcggaacctggatgtcgagatcatccttacactgtctcaaggcctcaagaaatattacgggaagattctgaaactgctccacctgacccttgaggaagacacagagggactgctcgaatggtgcaagcgcaatctgggccttgattgtgacgatacctttttccagaaaagaatcgaggaatttttcattacgggggagggacattttaacgaggtgctgcagttccggacactcggcaccctgtccacaaccgaaagcacccacgccggctcccctacagtggagccctttaagtcttatttcgctaaggggtttctgagcatcgactccggatacttctctgccaaatgctatagccgcacgtccaatagcggcctccagctgattaacgtcaccagacactctacacggatcgcggataccccggggcctaagattacaaatcttaaaaccatcaactgtatcaacctgaaggcctccgtttttaaagaacatcgcgaggtggaaattaatgtgctcctgccccaagtcgctgtgaaccttagcaattgccacgttgccatcaagtctcatatttgtgactactccctggacacggatggagctatcagactcccccagattcaccatgagggcacattcatccctgggacctacaaaatcgtgattgacaaaaagagcaagctgaacgatcggtgcaccctgtttacaaattgtgtcatcaagggacgcgaggtgagaaaaggccagtctgttctccggcaatataagaccgaaattcgcatcggcagagccagcacagggtcccggagactgcttagcgaggaatctggagacgattgcatttcccgcacgcagctgctccggaccgagacagccgaagtgcacggcgacaactacgggggaccgggcgataaaatcaccatctgtaatgggagcacagtcgtggaccagagactgggctccgagctgggatgctataccattaaccgcgtccggtctttcaaactttgcgagaatagcgctacgggcaagtcctgtgaaatcgattctattcccgtgaagtgcaagcaggggtactgtctcaaaatcacccaagagggaagaggccacgttaagctgagccgcgggtccgaagtggtcctggacgtgtgcgattctagctgtgaggttatgattcctaaaggaacaggcgacatcctcgtggactgctccgggggccagcagcatttcctgaaggataaccttgtcgacctgggatgtcccaagattcctctcctgggcaaaatggcgatctatatctgccggatgagcaatcaccccaagaccacaatggcctttctgttctggttttctttcgggtacgtgattacctgtatcctttgcaaagctatctttttcctcctgattatttttggaacactgggcaagagattcaaacagtatcgcgagctcaagcctcaaacctgtacgatctgcgaaacaacccccgtgaacgccatcgatgccgagatgcatgacctgaattgctcctacaacatttgtccgtactgcgctagccggcttacctctgatgggctggccagacacgttacacagtgtcctcgccggaaggaaaaagtcgaggaaaccgagctctatctgaatctggagagaatcccctgggtggtgcggaaacttctccaggtctccgaaagcacgggaacagtgctgaagagatcttcctggctgattgttctcctggtgctttttaccgtcagcctgtcccctgtgcagagcgcgcccatcggccacgggaagacaattgagacctaccgcgttcgggaagagtatacatctatctgcctcttcgtgctgggcagcatcctgtttattgtctccttccttatgaaaggactcgtggacggcgttgggaacatctttttcccgggactgtctgtgtgtaagacctgcagcattggctccatcaacgggttcgaaattgagtctcataaatgttactgcagcctgttttgttgcccttattgtagacactgctccgctgatggagagatccatcaactccacctgtctatctgcaagaagcgcaaaacgggcagcaatgtcatgcttgccgtgtgtaagcggatgtgcttcagagccaccatggaagtgtccaacaaagctctgtttattcgcagcatcattaatacaaccttcgtcgtttgtatcctcattctggccgtgtgcgtggtctctacatccgctgtggagatggaaagcctgcccgccgggacctgggagagagaagaggaccttacgaacttttgtcatcaggagtgccaggttacagaaaccgagtgtctgtgcccttacgaagcgctcgtgctgcggcgccccctcttcctggattctatcgtcaagggcatgaaaaatcttctgaactccacaagcctcgagacctccctgtctattgaggccccctggggagctatcaatgtgcagagcacctataagcctacagtttccacggccaacatcgctctgagctggtcttccgtggaacacagaggcaataaggtccttgtgagcgggcggtctgagagcattatgaaactggaggaacgcaccggaatctcctgggacctcggcgttgaagatgcctctgagagcaagctgctcacagtgtccgtcatggacctgtctcaaatgtacagcccggtgtttgagtacctttccggggatagacaggtggaagagtggcccaaagcgacctgtacaggagactgccctgaacggtgtggctgcaccagctctacgtgcctgcacaaggagtggccccattcccgcaactggagatgtaatcctacatggtgctggggcgtcgggaccggatgtacctgctgtggcctcgacgttaaagatctgttcacagactatatgtttgtgaagtggaaggtggaatacattaaaaccgaggccatcgtctgcgtggagctgacaagccaggaacggcaatgttcccttattgaggctgggacgcgcttcaacctgggatctgttaccatcacactcagcgaacccagaaatatccagcagaagctgcctccggagattatcaccctccaccccaaaattgaagagggctttttcgatctgatgcatgtgcagaaggtcctttccgcctctacagtgtgcaaactgcaaagctgtacccacggggttcctggagaccttcaggtgtatcatatcggcaacctcctgaagggcgatcgggtcaatgggcaccttattcacaagatcgagcagcattttaacacgtcctggatgagctgggacggatgcgatctggactactattgtaacatgggcgattggccctcttgcacctacacaggggtgacccagcacaatcatgcttccttcgtcaacctcctgaatatcgaaacagactataccaaaacattccactttcacagcaagagagtgacggcccatggagatacccctcaactcgacctgaaagcccgccccacatacggcgctggggaggttaccgtgcttgtcgaagtggcggatatggagctgcacaccaagaaaattgagatctctggactgaagttcgccggcctcacatgcacgggctgttacgcttgctccagcgggatttcttgtaaagttcggatccatgtggacgaaccggacgagctgaccgtccacgttaagagcgatgaccctgatgtggtggccgcctcctctagccttatggctagaaagctggaatttggaacagactccaccttcaaagcctttagcgcgatgcccaagacatccctctgcttctatattgtcgagcgcgaatactgtaaatcttgcagcaaggaggatacccagaaatgtgtgaacacgaagctggagcagccccagtccatcctcattgaacataagggcacaatcatcgggaaacaaaataatacctgcaccgctaaggcctcttgttggctggagagcgtgaaatcctttttctatggacttaagaacatgctgggcgggatttttggaaacgtcttcatcggcatttttacattcctgacccctttcatcctcctgattctgtttttcatgtttggctggcggatcctgttctgctttaaatgttgcagacgcacacggggactcttcaagtacagacacctgaaggacgatgaagagaccgggtatcgcaaaatcattgaacggctcaataacaagaaaggcaagaatagactgcttgacggggagcggctggccgatcgcaaaatcgctgagctgttttctacgaagacacacattggatga

SEQ ID NO: 13648 - RNA, 5055 nt, synthetic construct
  misc_feature 1..5055: note = derived and/or modified CDS sequence (opt5) from CCHFV(Iran-52)__DQ446215.1__GP
  source 1..5055: mol_type = other RNA
atgcacatcagcctgatgtacgccgtgttctgcctccagctgtgtggccttgggaagaccaacggaccccataatggcacagagcacaacaatacgcatgtcatgaccacacctgacgattcccaatctccggaaccccctgttagcaccgctctgcccgtgacacctgacccctccaccgtgacaccttctaccccggccagcgggctcgagggatccggcgaagtctatacgtctagccccattaccacaaaagggctgtcccttcctgaggcgaccagcgaaccccctgctacaacctctgtggttacgtccagcgcctctgatacagactccagcacccaggccgctggagatacacccaccccgaccgtgagaacatctctgccttccagcccctccacgccttctaccagccagggcacacactaccccgtccggtccctcctgagcgtgacctctcccaagcctgaggagacaccgaccccctccaaaagcggcaaggacgatctggccacgaactctcctcatcccgctacaagccgccctaccacacccccgaccaccgcccagaaacctacagaaaataactcccacaatacgaccgagcaactcgaatctctgacacaccttgcgaccctggggctcatgatcagccccacacagaccgttctgcctcagtccgtgacgagcattgccatccaggacattcataactctcccaccaatagatccaagcggaaccttgatatggagatcatcctgacactcagccaaggactgaagaaatattacggcaagattctgaaactcctgcaccttaccctggaggaagacacagaggggctcctggaatggtgcaagcgcaatcttggactggattgtgacgatacctttttccagaaaagaatcgaggaatttttcattacgggcgaggggcattttaacgaggtcctccagttccggacactgggaaccctgtctacaaccgaatccacccacgctggcagccctacagtggagccctttaagtcctatttcgccaagggctttctctctatcgacagcgggtacttctccgctaaatgctattctcgcacgagcaattccggactgcagcttattaacgtgaccagacacagcacacggatcgccgacaccccgggccctaagattacaaatctgaaaaccatcaactgtatgaacctcaaggcgtctgtctttaaagaacatcgcgaggttgaaatcaatgtgctgcttccccaagtggccgtcaacctgtccaattgccacgtggctattaagagccatatctgtgattactctctcgacacggatggggccattagactgccccagatccaccatgagggaacattcattcctggcacctacaaaatcgttatcgacaagaagtccaaactgaacgatcggtgcaccctctttacaaattgtgtgattaaggggcgcgaggtcagaaaaggacagagcgtgctgcggcaatataagaccgaaatccgcattggcagagcttctacaggcagccggagacttctgtccgaggaaagcggggacgattgcatctctcgcacgcagctcctgcggaccgagacagccgaagttcacggagacaactacggcgggccgggagataaaattaccatctgtaatggctccacagtggtcgaccagagactggggagcgagcttggctgctataccatcaaccgcgtgcggtccttcaagctctgcgaaaattctgccacgggaaagagctgtgaaattgattccatccccgtcaaatgcaagcagggctactgtctgaaaattacccaagaggggagaggacacgtgaagctgtctcgcggcagcgaagttgtgctcgacgtctgcgactcctcttgtgaggtgatgatccctaaagggacaggagatattctggttgactgcagcggcgggcagcagcatttccttaaggataacctggtggacctcggctgtcccaagatccctctgctgggaaaaatggctatttatatctgccggatgtccaatcaccccaagaccacaatggcgtttcttttctggtttagcttcggctacgtcatcacctgtattctctgcaaagccatctttttcctgctgattatctttgggacactcggaaagagattcaaacagtatcgcgagctgaagcctcaaacctgtacgatttgcgaaacaacccccgtgaacgctatcgatgccgagatgcatgaccttaattgctcttacaacatctgtccgtactgcgcctcccggctgaccagcgatggcctcgctagacacgtgacacagtgtcctcgccggaaggaaaaagttgaggaaaccgagctgtatctgaatcttgagcggattccctgggtcgtgagaaagctcctccaggtgtctgaatccacggggacagtcctgaaacgcagctcttggctgatcgtgctgcttgttctgtttaccgtgtccctcagccctgtccagtccgcccccattggacacggcaagacaatcgagacctacagagtgcgggaagagtatacaagcatttgcctgttcgttctggggtctatcctttttatcgtgagcttcctcatgaaaggcctggtcgacggagtgggcaacatctttttcccggggctgtccgtttgtaagacctgctctattggaagcattaacggcttcgaaatcgagtcccataaatgttactgctctctcttttgttgcccttattgtagacactgcagcgcggatggggagattcatcaactgcacctttccatctgcaagaagcgcaaaacgggatctaatgtgatgctggctgtctgtaagcggatgtgcttcagagccaccatggaagtgagcaacaaagccctctttatccgctccattatcaatacaaccttcgtggtctgtattctgatcctggctgtttgcgtggtgagcacatctgccgtcgagatggaatcccttcccgctggcacctgggagagagaagaggacctgacgaacttttgtcatcaggagtgccaggtgacagaaaccgagtgtctctgcccttacgaagccctggttctccggcgccccctgttccttgatagcattgtgaaggggatgaaaaatctgctcaactctacatccctggagaccagcctgtccatcgaggcgccctggggcgccattaatgtccagtctacctataagcctacagtgagcacggctaacatcgccctttcctggagctctgttgaacacagaggaaataaggtgctggtctccggccggagcgagtctatcatgaaactcgaggagcgcaccgggattagctgggacctgggagtggaagatgcttccgagtctaagctcctgacagttagcgtgatggacctttcccaaatgtactctccggtctttgagtacctgagcggcgacagacaggtggaagagtggcccaaagccacctgtacaggggattgccctgaacggtgtggatgcacctccagcacgtgcctccacaaggagtggccccattctcgcaactggagatgtaatcctacatggtgctggggcgtgggcaccgggtgtacctgctgtggactggacgtcaaagatctgttcacagactatatgtttgttaagtggaaggtggaatacatcaaaaccgaggcgattgtgtgcgtcgagcttacatcccaggaacggcaatgtagcctgatcgaggccggcacgcgcttcaacctcgggtccgtgaccattacactgtctgaacccagaaatatccagcagaagctccctccggagatcattaccctgcaccccaaaatcgaagagggatttttcgatcttatgcatgttcagaaggtgctgagcgcttccacagtctgcaaactgcaatcttgtacccacggcgtgcctggggacctccaggtttatcatattggaaacctgcttaagggcgatcgggtgaatggccacctgatccacaagattgagcagcattttaacacgagctggatgtcctgggacgggtgcgatctcgactactattgtaacatgggagattggcccagctgcacctacacaggcgtcacccagcacaatcatgcctctttcgtgaacctgctcaatatcgaaacagactataccaaaacattccactttcactccaagagagtcacggctcatggggatacccctcaactggaccttaaagcccgccccacatacggagccggcgagatcaccgtgctggttgaagtggctgacatggagctgcacaccaagaaaattgagatcagcgggctcaagttcgcgggactgacatgcacgggctgttacgcctgttcttccggcattagctgcaaagtccggatccatgtggaggaaccggatgaacttaccgttcacgtgaagtctgacgatcctgacgtcgtggctgccagctcctctctgatggccagaaagctcgagtttgggacagatagcaccttcaaggctttttccgccatgcccaaaacaagcctgtgcttctatattgtggaacgcgagtactgtaaatcctgctctaaggaggacacccagaaatgtgttaacacgaagctcgaacagccccagagcatcctgattgagcataagggaacaatcatcggcaaacaaaataatacctgcaccgcgaaggcttcctgttggcttgaatctgtcaagagctttttctatgggctgaaaaacatgctgggaggcatttttgggaacgtgttcatcggaatttttacattcctcacccctttcatcctgcttattctgtttttcatgtttggctggcggatcctcttctgctttaaatgttgcagacgcacacggggcctgttcaagtacagacacctcaaggatgacgaggaaaccgggtatcgcaaaatcattgagcggctgaataacaagaaaggaaagaatagacttctggatggcgagcggctggccgaccgcaaaatcgccgaactcttttccacgaagacacacattgggtga

SEQ ID NO: 13649 - RNA, 5055 nt, synthetic construct
  misc_feature 1..5055: note = derived and/or modified CDS sequence (opt5) from CCHFV(75024)__AB069671.1__GP
  source 1..5055: mol_type = other RNA
atgcacatcagcctgatgtgcgccgtgctctgtctgcagctttacggcctgggggagacccatggatcctctaacgaaacagagcacaataagacgaacgtcgttaccacacccggcgacagccaatcccctgaaccgctcgtgtctaccacactgcccgtgacccttgatagctccacagtcacccctacgacccccgcttctgggcctgagggaagcggcgaagtgtatacatcccctcccattaccacagaggggctgagcccgtctgaggccacctccgaactccccgcgacgacaggaatcggcattagctctgcttccgacgttgatagctctacccaggccgccggcgacacatccacccctaccgtgagaacaagccctcccaattcctctagcacgcccccgacctcccaggatacacatcaccctatgcggaacctgctgagcgtcacctctctcaaacccgaggaaacatccgctcctagcaagtctgggaaagagagccccgccgcttcctctccccatcctgtggccagccgcccgcccacccctcccacgacagcgcagggacctatcgagaataactcccacaataccaccggccaactggaaagcgttacacagtctgccacccttgggcccatggcttccccgacacagacggtgctgagccagaacgtcacctctattgccatccaagacacacacccttcccccaccaatagaagcaagcggaacctcgagatggaaatcattctgacacttcctcagggactgaaaaagtactatggcaaggtgctccgcctgctgcagctcaccctggaggaagatacggaggggcttctggagtggtgcaaaagaaatctcggactggactgtgatgacaccttctttcagaagcggatcgaagagttctttattacaggcgaaggccatttcaacgaggtgcttcaatttcgcacccccgggacactgtccaccacggaatctacacacgctgagagccctaccgccgagcccttcaaatcctactttgcgaagggattcctctctatcgatagcggctatttttccgccaaatgctacagcagaacatctaattccgggctgcagctgattaacgtcacccggcatagcacccgcatcgctgacacaccgggacctaagattacgaatctcaagaccatctcttgtatcaacctgaaagcctccgttttcaaggaacacagagaggtggaaattaacgtgcttctgccccaggtcgctgtgaatctcagcaactgccacgttacaatcaaatctcatgtgtgtgattatagcctggacattgacggcaccgtccggcttccccacatccatcacgaggggacatttattcctggaacctacaagatcgtgatcgataaaaagaataaactgaacgaccgctgcaccctcttcacaaattgtgttattaagggcagagaagtgcggaagggccaatccgtcctgcgccagtacaaaaccgagatcagaattgggaaggccagcaccggatctcggagactgctctccgaggaaagcggcgatgactgcatctcccgcacacagctgcttcggaccgagacagccgaaattcatggggataactatggaggcccgggggacaaaatcacgatctgtaatggctctaccattgtggatcagagactgggaagcgagatgggctgctacacaatcaaccgcgtcaagtcctttaaactctgcgaaaattctgctaccggaaagagctgtgaaattgactccatccccgtgaagtgccggcaagggtattgtctgaaaattacacaggagggcagagggcacgttaagctgtctcgcggaagcgaagtggtccttgatgcgtgcgactccagctgtgaggtgatgatccctaaaggcaccggggatattctcgttgactgctctggcggacagcagcacttcctgaaggacaacctgatcgatctcggctgtccctccatccctctgcttgggaaaatggccatttacatctgccggatgagcaatcatcccaagacgaccatggctttcctgttttggttctcttttggatatgtgattacatgtatcctctgcaaggccattttctacctgctgatcatcgtcggcacccttgggaaaagatttaagcaatatcgcgaactcaaacctcagacatgtaccatttgcgagacaacccccgccaacgctatcgacgccgagatgcacgatctgaattgctcctacaacatttgtccgtactgcgcgagccggctgacgtctgacggactcgctagacatgtgacacagtgtcctaagcgcaaagaaaaggtggaggaaaccgagctgtatcttaatctggaacggatcccctgggttgtcagaaagctccttcaggtgtccgagagcaccggcgtggccctgaaacggtccagctggcttattgtcctcctggtgctgttcgccatctctctcagccctgttcaatccgctcccatcgggcacggcaagacaattgagacctaccaggcccgcgaagagtatacgtctatctgcctgtttgtgcttggaagcattctgttcatcgtctcctgtctcatgaaaggcctggtggattctattgggaacatctttttcccgggactgagcatctgcaagacatgttccattggctctatcaacgggtttgaaattgagagccacaaatgctactgttcccttctctgctgtccttattgcagacattgcagcgctgaccgggaaatccaccagctgcatctgtctatttgtaagaaaagaaagaccggatccaatgttatgctcgccgtgtgcaagcgcatgtgtttccgggcgacaatggaggtcagcaacaaagccctgcttatcagatctattatcaataccacatttgtggtttgcatcctgattctcgctgtgtgtgtcgtgtccaccagcgccgtggagatggaatccctgcccgctggcacgtgggagcgcgaagaggatctgaccaacttctgccaccaggagtgtcaagtcacagaaaccgagtgcctttgtccttacgaagccctggttctcagacggcccctgttcctcgactctatcgtgcgcgggatgaagaatcagctgaacagcacatcccttgagaccagcctgtctattgaagcgccctggggcgccatcaatgtgcagtccacgtataaacctacagtcagcaccgctaacattgccctctcttggagctccgtggagcatagaggaaataagatcctggtttctggccggagcgagtccatcatgaaactggaggagcgcacagggatttcttgggatcttggagtggaagacgctagcgagtccaagctgctcaccgtcagcgtgatggatctgtctcaaatgtactccccggtttttgaatacctcagcggcgacagacaggtggaggagtggcccaaggctacctgcacaggggattgtcctgaacggtgcggatgcacgacctccacatgtctgcacaaagagtggccccactctcgcaactggagatgcaatcctacctggtgttggggcgtcggcacagggtgcacctgttgcggacttgacgtgaaggacctgttcacggattatatgatcgttaaatggaaggtggaatacattaaaacagaggccatcgtctgtgtggaactcaccagccaggagcggcagtgctccctgattgaggctggcacccgctttaacctggggtctgtgacaatcacccttagcgaacccagaaatatccaacagaagctgcctccggagattatcacactccatccccggattgaagagggattctttgacctgatgcacgtccagaaggttctctccgcgagcacggtgtgtaaactgcagtcttgcacccatggcgtgcctggggatcttcaagtctatcacgtgggaaacctgctgaagggcgacaaagttaatggccatctcatccacaagattgagccccacctgaacacatcctggatgagctgggatgggtgtgaccttgattactattgcaacatgggagactggccttcttgcacctacacaggcgtgacccagcataatcacgcctccttcgtcaacctgctcaatatcgaaacggattataccaagagctttcatttccactctaaaagagtgacagctcacggggacacgccccagctggatctcaaggcccgcccgacatacggagccggcgagattaccgttctggtggaagtcgctgacatggagtttacacctaaaaagatcgaaatcagcgggcttaaattcgcctccctgacgtgtaccggatgctacgcgtgttctagcggcatttcctgcaaggtgcggatccatgtcgatgagcccgacgagctgacagtgcacgttaaaagcgacgatcccgacgtggtcgctgcctcctctagcctcatggccagaaagctggaatttggcaccgattccaccttcaaagccttttctgccatgcctaagacaagcctttgtttctatattgtggagcgcgaatactgcaagtcctgttctaaagaggacacgcagaagtgcgttaacaccaaactggaacaaccccagagcatcctcattgagcataaggggacaatcatcggaaaacagaataacacctgtacagcgaaggcttcctgctggctggagagcgtgaagtctttcttttatggcctcaaaaatatgctgtccgggattttcggaaacctttttatgggcatcttcctgtttctggcccctttcattctcctgatcctgtttttcatgtttgggtggcggattctgttctgttttaagtgctgcagacgcacccggggactcttcaaatacagacacctgaaggatgacgaagagacgggctatcgccggatcatcgaaagactcaataacaaaaagggcaagaataaactgcttgatggggagcggctggccgaccgcagaattgctgaactgttcagcacaaagacccatatcggatga

SEQ ID NO: 13650 - RNA, 5055 nt, synthetic construct
  misc_feature 1..5055: note = derived and/or modified CDS sequence (opt5) from CCHFV(7803)__AB069672.1__GP
  source 1..5055: mol_type = other RNA
atgcacatcagcctgatgtgcgccgtgctctgtctgcagctttacggcctgggggagacccatggatcctctaacgaaacagagcacaataagacgaacgtcgttaccacacccggcgacagccaatcccctgaaccgctcgtgtctaccacactgcccgtgacccttgatagctccacagtcacccctacgacccccgcttctgagcctgaagggagcggagaggtgtatacatcccctcccattaccacagagggcctgagcccgtctgaagccacctccgagctccccgttacgacagggatcggaattagctctgcgtccgacgtggatagctctacccaggctgccggcgacacatccacccctaccgtcagaacaagccctcccaattccccctctacgccgcctaccagccaggatacacatcaccccatgcggaacctgctgtccgtgaccagcctcaaatctgaagagacatccgcccctagcaagtctggcaaagagagccccgctgcctcctctccccatcctgttgctagccgcccgcccacccaccctatcacggcccaggggcccacagaaaataactcccacaataccaccggacaactggagagcgtgacacagtctgcgacccttggccctatggcctcccccacacagacggtcctgagccagaacgtgacctctattgctatccaagacacacatccgtcccctaccaatagaagcaagcggaacctcgaaatggagatcattctgacacttccccaggggctgaaaaagtactatggaaaggtgctccgcctgctgcagctcaccctggaagaggatacggagggccttctggaatggtgcaaaagaaatctcgggctggactgtgatgacaccttctttcagaagcggatcgaggagttctttattacaggagaaggccacttcaacgaagtccttcaatttcgcacccctggcacactgtccaccacggagtctacacatgccgagagccccaccgctgaacctttcaaatcctactttgccaaggggttcctctctatcgatagcggatatttttccgcgaaatgctacagcagaacatctgactccggcctgcagctgattaatgttacccggcacagcacccgcatcgccgatacacccgggccgaagattacgaacctcaagaccatctcttgtatcaatctgaaggcttccgtgttcaaagagcacagagaagtggagattaacgtccttctgcctcaggtggccgttaacctcagcaattgccatgtgacaatcaaatctcacgtctgtgactatagcctggacattgatggaaccgtgcggcttccccatatccaccatgaaggcacatttattcccgggacctacaagatcgttatcgacaaaaagaacaaactgaatgatcgctgcaccctcttcacaaactgtgtgattaagggaagagaggtccggaagggccaatccgtgctgcgccagtacaaaaccgagatcagaattggcaaggctagcaccgggtctcggagactgctctccgaagagagcggagacgattgcatctcccgcacacagctgcttcggaccgaaacagccgagattcacggcgacaattatgggggacctggcgataaaatcacgatctgtaacgggtctaccattgtcgaccagagactgggcagcgagatgggatgctacacaatcaatcgcgtgaagtcctttaaactctgcgaaaactctgccaccggcaagagctgtgagattgattccatcccggttaagtgccggcaagggtattgtctgaaaattacacaggaaggaagaggccacgtgaagctgtctcgcgggagcgaggtcatccttgacgcttgcgattccagctgtgaagtgatgattcccaaaggaaccggcgacatcctcgttgactgctctgggggccagcagcatttcctgaaggataatctgatcgacctcggatgtccttccattcccctgcttggcaaaatggcgatctacatttgccggatgagcaaccaccctaagacgaccatggccttcctgttttggttctcttttgggtatgtgatcacatgtattctctgcaaggctatcttctacctgctgatcattgtcggaacccttggcaaaagatttaagcaatatcgcgagctcaaaccccagacatgtaccatctgcgagacaacccctgccaatgccattgatgctgaaatgcatgacctgaactgctcctacaatatctgtccctactgcgccagccggctgacgtctgatgggctcgcgagacacgtgacacagtgtccgaagcgcaaagagaaggtggaagagaccgaactgtatcttaacctggagcggattccttgggttgtcagaaagctccttcaggtgtccgagagcaccggagtggctctgaaacggtccagctggcttatcgtcctcctggtgctgttcgccatctctctcagccccgttcaatccgcccctatttctcacggcaagacaatcgaaacctaccaggctcgcgaggaatatacgagcatttgcctgtttgtgcttgggtccatcctgttcattgtctcttgtctcatgaaaggcctggtggacagcatcggaaatatctttttccccggcctgtccatttgcaagacatgttctatcgggagcattaacggatttgagatcgaatcccataaatgctactgtagccttctctgctgtccgtattgcagacactgctctgccgatcgggagattcatcagctgcacctgtccatctgtaagaaaagaaagaccggcagcaacgttatgctcgctgcctgcaagcgcatgtgtttccgggcgacaatggaggtgtctaataaagccctgcttattagatccatcatcaacaccacatttgtcgtgtacattctgatcctcgctgtttgcgtggtcagcacctccgccgtggaaatggagtctctgcctgctgggacgtgggaacgcgaggaggacctgaccaatttctgtcatcaggaatgccaagtgacagagaccgaatgtctttgcccctatgaggccctggtcctcagacggcctctgttcctcgatagcattgttcgcggaatgaagaacccccttaattccacaagcctggaaacctctctgtccatcgaggcgccctggggcgccattaacgtgcagagcacgtacaaacctacagtgtctaccgctaatatcgccctcagctggtcctctgtcgagcacagagggaacaagatcctggtgagcggccggtccgaatctattatgaaactggaggaacgcacaggaatcagctgggaccttggcgttgaggatgcttccgaaagcaagctgctcaccgtgtctgtcatggacctgtcccagatgtacagcccggtgtttgagtatctctccggggatagacaagttgaggaatggcccaaggccacctgtacaggagactgccctgagcggtgtggctgcacgacctctacatgcctgcacaaagaatggccccatagccgcaattggagatgtaaccctacctggtgctggggagtggggacaggctgtacctgctgtggccttgacgtcaaggatctgttcacggactacatgattgtgaaatggaaggttgagtatatcaaaacacgggggattgtgtgcgtcgaactcacctcccaggagcgccagtgttctctgatcgaggccggaaccagatttaatctgggcagcgtgacaatcaccctttccgaaccccggaacattcagcaaaagctgcctccggagatcattacactccaccccagaatcgaagaggggttctttgatctgatgcatgtgcagaaggtcctcagcgcttctacggtttgcaaactgcagtcctgtacccacggagtgcctggcgaccttcaggtgtaccatgtcgggaatctgctgaagggagataaagtgaacggccacctcattcacaagatcgagccccatctgaatacaagctggatgtcttgggacggctgcgatcttgactattactgtaacatgggggattggccttcctgcacctatacaggagttacccaacacaaccatgcgagcttcgtgaatctgctcaacattgaaacggactacaccaaatcttttcacttccacagcaagcgcgtcacagcccatggcgatacgccccagctggacctcaaggctcggccgacatacggggccggagagatcaccgtgctggttgaagtggccgatatggagtttacacctaaaaagatcgaaatttccggccttaaattcgcttctctgacgtgcaccgggtgttatgcctgcagctccggaatcagctgtaaggtccgcattcacgtggacgagcccgacgagctgacagtccatgtgaaatccgatgaccccgatgttgtggcggcttctagctccctcatggccagaaagctggaatttggcaccgactctaccttcaaagcctttagcgctatgcctaagacatccctttgcttctacatcgtcgagcgggaatattgtaagtcttgcagcaaagaggatacgcagaagtgtgtgaataccaaactggaacagccccaatccattctcatcgagcacaagggcacaatcattgggaaacagaacaatacctgcacagccaaggcgagctgttggctggagtctgttaagtccttcttttacggactcaaaaacatgctgagcggcatcttcgggaactttttcatgggaatttttcttttcctggctccttttatcctgctcattctgttctttatgttcggctggagaatcctgttttgcttcaagtgttgccgccggaccagagggctgttcaaatatcgccatctcaaggacgatgaagagacgggataccggagaatcattgaacggctgaataataaaaagggcaagaacaaactcctggacggcgagcgccttgccgatagacggatcgccgaactgttttctacaaagacccacattgggtga

SEQ ID NO: 13651 - RNA, 5055 nt, synthetic construct
  misc_feature 1..5055: note = derived and/or modified CDS sequence (opt5) from CCHFV(Hodzha)__AY223476.1__GP
  source 1..5055: mol_type = other RNA
atgcacatcctgctcatgtgcgccgtgctgtgtcttcagcaatacggcctgggggagacccatagacccaacaatggaacagagcacaacaagacgaatgtcctcaccacacctggcgacaaactgagcccggagcttcccgtttccaccgctctgtctgtgacacctgatagctccaccgtgacacccaccacgcctgtctctgggctcgaaggaagcggcgacgtgtataccagccctcccgttacaaccaaggggctgtctccgagcaaagccacatccgagctgcccgcgagctctggaattgatacctccagcgcttctgacgtggattccagcacgcaggccgcccgggacacatctaccctcacagtccgcacctcccctcccagctccccttctacacccccgacaagccaggatacgtaccatctggtgagaaaccttctgtccgttaccagcccttggcccgaagagacaaccgctccttctaagtccggcaaagagagccccgtggccaattctccccaccctgtcacaagccggccgtcctctccccctatcaccgtgcagggccccacggaaaacagctcccataatacaaccgggcaactcgagagcatggctcagtctaccacactggtgcctatggcctcccccacccagacagtccttagccagtctgttacgtccctggcggtgcaagacgcccacccgagccctaccaaccgctccaagagaaatctcgaaatggtgattatcctgacactgccccagggactcaagaaatattacggcaaggtcctgcggcttctgcagctcaccctggaggaggatacagaagggcttctggagtggtgcaaacgcaacctcggactggactgtgatgacaccttctttcagaagagaattgaagagttctttatcacgggcgaagggcacttcaatgaggtgctgcaatttaaaaccccttctacactcagcaccacagagtccacccatgctgtttctcccacggccgaacctttcaagagctattttgctaagggattcctgtccatcgatagcggctacttttctgccaaatgctattccaagacaagcaactctggccttcagctgattaatgtgacccggcactccacacgcatcgcggacacccccgggccgaaaattaccaacctcaagacaatcagctgtattaatctgaaagcctctgtcttcaaggagcatagagaagtggagatcaacgttcttctgcctcaggtggctgtcaacctcagcaattgccacgtgacgattaaatcccacgtctgtgactacagcctggatgtggacggaaccgttcggctgccccatatccaccatggcgggacatttatccccggaacctacaagattgtgatcgataagaaaaacaagctcaatgaccgctgcacactgtataccaactgtgtcattaaaggcagagaagtgcggaaggggcaatctatccttcgccagtacaaaacggagattagaatcggaaaggcctccacaggcagccggagactgctctccgaggaatctggcgatgactgcatcagccgcacccagctgctgcggaccgagacagctgaaattcacggggatgactatggaggccctggggataagatcaccatttgtaatggatccacaatcgttgaccagagacttggctctgagctcgggtgctacacgattaaccgcgtgaaatccttcaagctgtgcaaaaattccgccaccggcaagtcttgtgaaatcgatagcacaccggtcaaatgccggcaaggatattgtctgaagatcacccaggagggcagagggcatgtgaagctctcccgcggaagcgaggtggttctggacgcctgcgactcttcctgtgaagtcatgattcccaaaggcacaggggatatccttgtggactgcagcggaggccagcagcactttctgaaggataacctcattgacctggggtgtcctcggatccccctgcttggcaaaatggctatttacatctgcagaatgtctaatcaccctaagaccacgatggcgttcctcttctggttttccttcggatatgtgattacctgtatcctgtgcaaagccatcttttacctgctcattatcgtcggcacactggggaagcgcttcaagcaataccgggagcttaaaccccagacctgtacaatttgcgaaaccacccctgctaacgccatcgatgccgagatgcatgacctgaattgcagctataacatttgtccctactgcgcttctagactcacctccgatggactggcccgccacgtgacgcagtgtccgaagcggaaagagaaggttgaagagacagaactgtatcttaatctcgagagaatcccttggatcgtgcggaaactgctgcaggtcagcgaatccaccggcgtggcgctcaagcgcagctcttggctgattgttcttctggtgctctttgctgtcagcctgtcccccgtgcaatctgcccctatcgggcatggaaaaaccattgagacataccaggccagagaggactataccagcatctgcctgttcgttcttggctccattctctttatcgtgtcttgtctgatgaaggggctggtcgatagcatcggcaacattttctttcccggactcacgatctgcaagacatgttccattggctctatcaatgggttcgaaattgagagccacaaatgctactgttccctgctttgctgtccgtattgccggcactgcagcgctgacagagaaatccatcagctgcacctctctatctgtaagaaacgcaagaccggatccaacgtgatgctggccgtgtgcaaacggatgtgttttagagctacaatggaggtcagcaacaaggccctgcttattcgctctatcattaataccacattcgttgtgtgcatcctgattctcgcggtgtgtgtcgtgtccaccagcgccgttgaaatggagtccctgcctgctggcacgtgggagagagaagaggatctcaccaacttttgccatcaggaatgtcaagtgacagagaccgaatgcctgtgtccctacgaggcccttgtcctgcggcgccctctcttcctggactctatcgtgaaggggacaaagaatctgcttaacagcacctccctggagacgagcctctctattgaagctccctggggagccatcaatgttcagtccacatacaagcccaccgtgagcacagcgaacatcgccctgtcttggagctccgtcgagcacagaggcaataaaattctcgtgtctgggcggagcgaatccatcatgaagctggaggagcgcaccggcatttcttgggatcttggagttgaagacgctagcgagtccaaactgctcaccgtgagcgtcatggacctgtctcagatgtattcccctgtgttcgaatacctgagcggcgatagacaagtggaggaatggccgaaggccacatgcacgggggactgtcccgagcggtgcggatgcacctcctctacatgtcttcataaggagtggcctcacagccgcaactggagatgcaatcccacctggtgttggggcgtcgggacaggatgcacctgttgcggcctggatgttaaagacctctttacggattatatgttcgtgaagtggaaagtggactacatcaagacagaagctattgtctgtgtggagctgacctcccaggaacggcagtgctctctcgttgaggccggcacccgctttaacctggggcctgtgacaatcacccttagcgaacccagaaatatccagcaaaaactgcctccggagattatcacactgcacccccggattgaggaaggattctttgatctcatgcatgtccagaaggtgctgtccgccagcacggtttgtaaacttcagtcttgcacccacggcgtgcctggggacctgcaggtctatcatatcggaaacctcctgaaaggcgataaggtgaatgggcacctcattcataaaatcgagccccacttcaacacatcctggatgagctgggacggatgtgatctggactactattgcaatatgggcgattggccttcttgcacctacacaggcgtcacccaacacaaccatgcttcctttgtgaaccttctgaatatcgaaacggactacaccaagagcttccactttcattctaaaagagttacagcgcacggggacacaccccagctggatctcaaggcccgcccgacatatggagctggcgagattaccgtgctggtcgaagtggccgacatggagcttcacaccaaaaagatcgagattacggggctgaagttcgccagcctcacctgtacaggatgctacgcttgttcctctggcatcagctgcaaagttcggattcatgtggatgaacctgacgagctgaccgtccacgtgaagtccgatgaccccgatgtggttgccgcgagctcctctctcatggctagaaaactggaatttgggaccgacagcacattcaaggccttttccgccatgcccaaaacgtctctttgtttctatatcgtcgagcgcgagtactgcaagagctgttccaaggaagatacccagaaatgcgtgaacacaaagctggagcagcctcaatctattctgatcgaacggaaaggaaccatcattggcaagcagaataacacatgtaccgctaaagccagctgctggctcgagtccgtcaagagcttcttttatggcctgaagaatatgctttctgggatcttcggaaacgtgtttgtgggcattttcctgtttctcgcgcccttcatcctgctcattctgtttttcatgtttgggtggagaatccttttctgttttaaatgctgccgccggacgagaggactgttcaagtacaaacatctgaaggacgatgaagagacaggctatcgccggatcattgagagactcaataacaaaaaggggaagaataaactgcttgacggagaacggctggctgaccgcagaatcgccgaactcttctccaccaagacccacattggctga

SEQ ID NO: 13652 - RNA, 5055 nt, synthetic construct
  misc_feature 1..5055: note = derived and/or modified CDS sequence (opt5) from CCHFV(Hodzha)__KX013448.1__GP
  source 1..5055: mol_type = other RNA
atgcacatcctgctcatgtgcgccgtgctgtgtcttcagcaatacggcctgggggagacccatagacccaacaatggaacagaacacaacaagacgaatgtcctcaccacacctagcgacaaactgtccccggagccccctgtttctaccgctcttagcgtgacacccgattcctctaccgtgacacctaccacgcccgtcagcggcctggaagggtccggagaggtgtatacctctcctccggttacaaccaagggcctcagcccctccaaagccacaagcgaactgcctgcgaccacggggattgacacatcttccgctagcgatgtggactcttccacccaggccgcccgggatacaagcaccctgaccgtccgcacatctcccccttccagcccctccacgccgcctacctctcaggacacataccatctcgtgagaaacctgcttagcgttacctcccccagacctgaggagacaaccgctcccagcaagtctggaaaagaatcccccgtggccaatagccctcacccggtcacgtctcgccccagctcccctcccatcacagtgcagggccctaccgagaactctagccataataccacaggccaactggaatccatggctcagagcaccacactcgtgcccatggcctctccgacgcagaccgtcctgtcccagagcgttacatctcttgcggtgcaagatgcccacccttcccccaccaacagaagcaagcggaatctggagatggagattatcctcacactgcctcaggggctgaagaaatattacggaaaggtgctccgcctgcttcagctgaccctcgaagaggacacggaaggcctgcttgagtggtgcaaaagaaacctggggctcgattgtgacgataccttctttcagaagcggattgaagagttctttatcacaggagagggccacttcaatgaagtcctgcaatttaaaaccccctccacactgtctaccacggagagcacacatgctgtgtcccctaccgccgaacccttcaagtcttattttgctaaggggttcctcagcatcgactccggatactttagcgccaaatgctattctaagacatccaacagcggcctgcagcttattaatgttacccgccactctaccagaatcgcggatacaccgggccctaaaattacgaacctgaagaccatctcctgtattaatctcaaagccagcgtgttcaaggagcatcgggaagtcgagatcaacgtgctgcttccccaggttgctgtgaacctgtctaattgccacgtcacaattaaaagccacgtgtgtgactactccctcgacgtcgatgggaccgtgcgcctgccccatatccaccatggaggcacatttatccctgggacctacaagattgttatcgacaagaaaaacaagctgaatgatagatgcacgctctatacaaactgtgtgattaaaggacgggaggtccgcaagggccaaagcatcctgagacagtacaaaaccgaaattcggatcgggaaggcctctaccggatccagacgccttctgagcgaggaatccggcgacgattgcatctctcggacacagctcctgagaaccgagacagctgaaattcacggcgacgattatgggggaccgggcgacaagatcacgatttgtaatgggagcaccatcgtggatcagcgcctgggatccgagcttggctgctacacaattaaccgggttaaatctttcaagctctgcgagaatagcgccaccgggaaatcctgtgaaatcgactctacacccgtgaagtgcagacaaggctattgtctgaaaatcacccaggagggacgcggccatgtcaagctgagccgggggtccgaagtggtgctcgatgcctgcgacagctcttgtgaggttatgattcctaagggaacgggcgacatcctggtcgattgctccgggggacagcagcactttcttaaagacaacctgattgatctcggctgtcccagaatccctctgctggggaagatggctatttacatctgccgcatgagcaatcaccccgagaccacaatggcgttccttttctggttttctttcggctatgtgattacctgtatcctctgcaaagccatcttttacctgctgattatcgtgggaacactcggcaagcggttcaaacaatacagagaactgaagcctcagacctgtacaatttgcgagaccacgcccgctaacgccatcgacgccgaaatgcatgatcttaattgctcctataacatttgtccgtactgcgctagccgcctgacatctgacgggctcgcccggcacgtcacccagtgtcctaagagaaaagagaaggtggaagagaccgagctgtatctgaatcttgaacggatcccctggatcgttcgcaaactccttcaggtgtccgagagcacaggagtcgcgctgaagagatccagctggctcattgtgctgcttgttctgtttgctgtgtctctcagccctgtccaatccgcccccatcggccatgggaaaaccattgaaacgtaccaggcccgggaggaatatacatctatctgcctgttcgtgctgggaagcattctttttatcgtttcctgtctcatgaagggcctggtggattctatcgggaacattttctttccgggcctgaccatctgcaaaacatgtagcattggatccatcaatggcttcgagattgagtctcacaagtgctactgtagcctcctgtgctgtccttattgcagacactgccccgctgaccgcgaaatccatcagcttcacctgtccatctgtaagaaacggaagaccgggagcaacgtcatgctcgccgtgtgcaaaagaatgtgttttcgcgctacaatggaggtgtctaacaaggccctgctgattagatccatcattaataccacgttcgtcgtttgcatccttattctggcggtgtgtgtggtcagcacctctgccgtggaaatggagtccctccctgctggaacatgggaacgggaggaggatctgaccaacttttgccatcaggaatgtcaagttacagagaccgaatgcctctgtccctacgaggccctggtgcttcgcagacccctgttcctcgacagcatcgtcaaaggcaagaagaatctgctgaactccacgtctcttgagacaagcctgtccattgaagctccttggggagccatcaatgtgcagagcacctacaaaccgacagtttctaccgcgaacatcgccctctcctggagctctgtggagcaccgggggaataagattctggtcagcggccgctccgaatctatcatgaaactcgaggaaagaaccgggattagctgggatctgggcgtggaggacgcttccgagtctaagctgctgacagttagcgtgatggatctctcccagatgtatagccccgtcttcgaatacctgtctggagaccggcaagtggaggaatggcctaaagccacgtgcaccggcgactgttccgagcgctgcgggtgcacaagctccacctgtctgcataaggaatggccccactctagaaactggcggtgcaatcctacatggtgttggggagtgggcaccgggtgcacgtgttgcggacttgatgtcaaggacctgtttacagattatatgttcgttaaatggaaggtggactacatcaaaaccgaggctattgtgtgtgtcgagctcaccagccaggaacgccagtgctccctggtggaggccggcacaagatttaacctcggccccgttaccatcacactgtctgaacctcggaatatccagcaaaaacttccgcccgagattatcacgctgcaccctagaattgaagaggggttctttgatctgatgcatgtgcagaaggtcctcagcgcctccaccgtgtgtaagctgcagagctgcacacacggagttcccggcgaccttcaggtgtatcatatcgggaacctgctcaagggagataaagtcaatggccacctgattcataagatcgagcctcacttcaacacctcttggatgtcctgggacgggtgtgatctcgactactattgcaatatgggagattggcccagctgcacatacaccggcgtgacgcaacacaaccatgcttcttttgtcaacctgcttaatatcgaaaccgactacacaaaatccttccactttcatagcaagcgcgtgaccgcgcacggcgatacaccgcagctggacctgaaagcccggcctacctatggggctggagagattacagttctcgtggaagtcgccgacatggagctgcacacgaagaaaatcgagattaccggccttaagttcgcctctctgacatgtaccgggtgctacgcttgtagctccggaatctcttgcaaggtgcggattcatgttgatgaacccgacgagctcaccgtgcacgtcaaaagcgatgaccccgatgtggtggccgcgtccagctccctgatggctcgcaagctcgaatttggcacagactctacgttcaaagcctttagcgccatgcctaagacctccctgtgtttctatatcgttgagcgggaatactgcaaatcttgtagcaaggaggatacacagaagtgcgtcaacaccaaacttgagcagccccaatccattctgatcgaacagaaggggacaatcattggaaaacagaataacacctgtacggctaaggcctcttgctggctggagagcgtgaaatccttcttttatggcctcaagaatatgctgagcggcatcttcgggaacgtgtttgtcggaattttcctttttctggcgcctttcatcctcctgattctctttttcatgtttggctggagaatcctgttctgttttaagtgctgccgccggacaagagggcttttcaaatacaagcatctgaaagacgatgaagagaccggatatcgccggatcattgaaagactgaataacaagaaaggcaagaataagctcctggacggggagcggcttgctgatcgcagaatcgccgagctgttctctaccaaaacacacattggatga

SEQ ID NO: 13653 - RNA, 5055 nt, synthetic construct
  misc_feature 1..5055: note = derived and/or modified CDS sequence (opt5) from CCHFV(Baghdad 12)__AJ538197.2__GP
  source 1..5055: mol_type = other RNA
atgcacatcagcctgatttacgccgtgctctgcctgcagctttatggcctgggggagacccatggatcctctagcggcacagaacacaacagaacgaatgtcgttgctacccccgggggatcccaatctcctgagccgctcgtgagcacaaccctgcccgtgacacttgactcctctaccgtcacccctgccacccaggcgagcggccccgaagggtccggagaggtgtacacgagccctcccaccacaaccgaaggcctgtctccttccgatgctacaagcgagctcccgaccacgacaggcatcgggatttcttccagctctgacgttaactccagcacccaggccgccggagatacatccacccccaccgctcggacatctctgcctgacagcccctccacgcctcccaccagccaggatacacatcacccgatgcgcaatctgctctctgtgacctccctgaagcctgaggaaacacccgcccctagcaaatctggcaaggagagccccgctgcctcctctccccatcctgtcgcgagcagaccgcccaccccttccacgacagcccaagggcccaccgaaaacaatagccggaacaccacagtgcagcttaaatctgttacccagtccgctacactgggacctatggccagccccacgcagaccgtgctcctgcaatctgtcacatccatcgctattcaggacacccacccgagccctacaaatcgctccagacggaaccttgagatggagatcatcctgaccctcccccagggcctgaagaaatattacgggaaggtgctgcgcctcctgcagcttacgctggaagaggataccgaaggactcctggagtggtgtaagagaaatcttggcctggactgcgatgacacattctttcaaaaacggattgaagagttctttatcaccggcgaggggcacttcaacgaagtgctccagtttcgcacacctggaaccctgtctacgacagagagcacccatgccggctcccccacagtcgaacctttcaagtcttattttgcgaaagggttcctgctcattgatagcggatacttttccgccaagtgttatagcagaacctctaattccggcctgcagcttatcaacgttacccggcacagcacaaaaattgctgacacgcccgggccgaagatcaccaatctgaagacaatttcttgcatcaacctcaaagcctccatcttcaaggagcatcgcgaaattgagatcaatgtgctgcttcctcaagtggctgtcaacctgagcaactgtcacgtgaccattaaatctcacgtttgcgattacagcctcaatatcgacggaacagtgaagctgccccatattcaccatgagggcatctttatccccggcacctacaaaattgtcatcgacaagaaaaacaagctgaatgatagatgtacgcttttcacaaactgcgtgattaaggggcgggaagttcgcaaaggacagtccgtgctgagacagtataagaccgagatccggattggcaaagccagcaccgggtctagacgccttctgtccgaagagagcggagacgattgtatctcccggacaagactcctgcgcaccgaaacagccgagatccacggcgactcttacgggggccctggagataagattacgatctgcaatggcagcaccattgtcgaccagcggctggggtccgagatgggatgttatacaatcaacagagtgaaatcttttaagctctgcgaaaatagcgctaccggcaagtcctgcaaaattgattctatcccggtcaagtgtcgccaagggtactgcctcaaaattacacaggagggacggggccatgtgaagctgagcagagggtccgaagttgtgctggacgcgtgtgatagctcttgcgaggtcatgatccccaaaggcaccggagacatcctcgtggattgttccggcgggcagcagcacttcctgaaggacaaccttattgacctgggatgccctaatatccccctcctgggcaagatggccatttatatctgtcgcatgagcaaccaccctaaaacgaccatggctttcctgttttggttctcttttgggtacgttattacatgcatcctttgtaaggccatcttctatctcctgattatcgtgggaaccctgggcaaacggtttaagcaatacagagagctcaaaccccagacatgcaccatttgtgaaacaacccctgtcaatgccatcgatgctgagatgcatgacctgaactgctcctacaatatttgcccctattgtgccagccgccttacgtctgatgggctggcgcggcacgtgacacagtgcccgaagagaaaggaaaaagtggaggaaaccgagctctacctgaacctggagcggatcccttgggttgtccgcaaacttctccaggtgtccgaaagcaccggcgtggctctgaaaagatccagctggctgatcgtcctcctggtgcttctggccgtttctagctcccccgtgcaatctgcccctattggatatggcaagacaatcgagacctaccaggctcgggaagggtatacgagcatttgtctcttcgtcctgggatccatcctgtttattgtgtcttgccttacaaaaggcctcgttgacagcatcgggaatatcttctttcccggactgtccatttgtaagacctgctctatcggcagcattaacgggttcgaggtggaatcccataaatgttactgcagcctgctctgttgcccgtattgtagacactgctctgccgatcgcgagatccaccagctgcatctttccatttgcaagaagcggaaaacaggcagctctgtcatgctggctgtgtgtaagagaatgtgctttcgcgccaccatggaggtttccaacaaagcgctcctgatcagaagcattatcaatacaaccttcgtggtctgtatcctgacgcttgccgtgtgcgtggtctccacctctgctgttgaaatggagagcctgcctgccggaacatgggaacgggaggaagacctcaccaacttttgtcaccaggagtgccaagtgacagagaccgaatgtctgtgcccctacgaggctctcgtgctgcgcaagcctcttttcctggattccattgtcaaaggcacgaagaatctcctgaacagcacatctctggaaacctcccttagcatcgaggccccctggggagcgattaatgtgcagtctacatacaagcccaccgttagcaccgccaacatcgctctgtcctggtctagcgtggagcatagagggaataaaattctcgtctccggccggtctgaaagcatcatgaagctggaggaacgcacagggatctcctgggacctcggagtggaggatgccagcgaatctaaactgcttacggtttccgtgatggacctgagccagatgtattcccctgtcttcgagtacctctctggcgatagacaagtggaggaatggccgaaggctacctgtacaggcgactgccccgagcggtgtgggtgcaccacaagcacatgcctgcacaaagaatggcctcattcccgcaactggagatgtaatcccacgtggtgctggggagttggcacagggtgtacctgctgtggactggatgtgaaggacctttttaccgactatatgttcgtcaagtggaaagtggagtacattaagacagatgccatcgtgtgcgtcgaactgacctctcaggagcggcagtgtagcctcattgaggccggcacacgctttaacctggggtccgttacgatcaccctcagcgaacctagaaatattcagcaaaaactgccccctgagatcatcacacttcacccgcggattgaagagggattctttgacctgatgcacgtgcagaaggtgctgtctgcttccaccgtctgcaaactccagagctgtacacatggcgtgcccggcgatctgcaggtttatcacatcgggaaccttctgaagggagacaaggtgaatggccatctcattcacaaaatcgaacctcatttcaacacctcttggatgtcctgggatgggtgcgacctggattactattgtaatatgggagactggcccagctgcacgtacaccggcgtcacacaacacaaccacgcgtcttttgtgaacctcctgaatattgagaccgattacacaaagagcttccattttcactccaaaagagttaccgcccatggggacacacctcagcttgatctgaaggtgcgccccacgtatggagctggcgagatcaccgtcctggtggaagtcgccgacatggagctccacacaaagaagattgaaatctctggcctgaaattcgccagccttacctgcaccgggtgttacgcttgctccagcggaatctcctgtaaggtgcggattcacgttgatgagccggacgagctgacagtgcatgtcaagtctgacgatcctgacgtggttgccgcgagctcctctctcatggctagaaaactggaatttggcacggatagcaccttcaaggccttttccgccatgcccaaaacatctctctgcttctatatcgtggagcgcgaatactgtaagagctgctccaaagaggacacccagaagtgtgtcaacacaaagctggaacagccccaaagcattcttatcgagcacaaagggaccattatcggaaagcagaataacacgtgcacagctaaaacctcttgttggctggagtccgtgaagtccttcttttatggcctgaaaaatatgctctctgggatcttcggaaactttttcatgggcatttttctgttccttgccccttttatcctgctcattctgttctttatgttcggctggcggatcctcttttgcttcaagtgttgcagacgcacccgggggctgttcaagtacagacatcttaaagatgacgaagagacaggatatcgccggattatcgaaagactgaataacaagaaaggcaagaataaactgctcgatggggagcggctggcggaccgcagaatcgctgaactttttagcaccaagacacacattggatga

SEQ ID NO: 13654 - RNA, 5055 nt, synthetic construct
  misc_feature 1..5055: note = derived and/or modified CDS sequence (opt5) from CCHFV(TADJ/HU8966 )__AY179962.1__GP
  source 1..5055: mol_type = other RNA
atgcacatgctgctcatgtgcgccgtgctgtgtcttcagctgtacggcctcgggggaaccctgagaagcaacaatggcacagagcataacaagacgaatgtccttaccacacccggggacaaactgtcccctgaaccgcccgtttctaccgctctccctgtgacacccgatagctccaccgtgacacctaccacgcccgcctctggactggagggcagcggggaagtctatacctcccctccgatcacaaccaagggactgtctcccagcgaggcgacatccgaacctcccgctaccacgggcatgggcattagctctgcctccggggtggacttcagcacacaagccgctcgggatacctctacactcaccgttctgacctcccctcccaacagcccgaatacacctcccacgtctcaggacacccaccatcctgtgcgctcccttctgagcgtcacatcccccagacccgaggagaccacagccccttctaaaagcggaaaggaatccccggctgccaacagctctcaccccgtgacctcccggcctagctctcccctcatcacggttcgcggccctacagagaatagctcccataacaccaccgggcagctggaatctatgacacagagcaccacacttgtgcccatggcgtccccgacgcaaaccgtcctgagccagtctgtgacatccattgccgtgcaggatgctcaccctagctctaccaatagatccaaacggaacctcgagatggagatcattctgacactgccccagggactcaagaagtactatggcaaagtcctgcgccttctgcaactcaccctggaagaggacacggaagggcttctggagtggtgcaagagaaatctcggactggattgtgacgatacctttttccagaaacggatcgaagagtttttcatcacaggcgagggccactttaacgaagttctgcagttccgcacccctgggacactcagcaccacggagtccacacatgccggatctcccaccgctgaaccttttaagagctacttcgccaaaggctttctgtccattgactctgggtatttcagcgcgaagtgctactccagaacaagcaattctggacttcggctgatcaacgtgacccgccactccaccagaattgccgatacacccggcccgaagatcacgaatctcaaaaccattagctgtatcaacctgcgggcttctatttttaaggagcatcgcgaagtggagatcaacgtccttctgcctcaggtggccgttaatctctccaactgccacgtggctatcaaaagccacgtctgtgactattctctggatgtggacgggacagttagactgccccatattcaccatggaggcaccttcatccccggcacatacaagattgtgatcgacaaaaagaataaactcaacgatcggtgcaccctgtttacgaattgtgtcattaaggggagagaggtgcgcaagggacaaagcatccttcggcagtacaaaacagaaatcagaattggcaaggcctccaccgggagccgccggctgctctctgaggaatccggagacgattgcatcagcagaacccagctgctgcgcacagagaccgccgaaattcacggcgacgattatgggggccctggagacaaaatcacaatttgtaacggctccacgatcgtcgatcaacggcttgggtctgagctcggatgctacaccatcaatagagttaagagcttcaaactgtgcgagaactccgctacaggcaagaattgtgaaattgactctgtgccggtgaagtgccgccaggggtattgtctgaaaatcacccaggagggacggggccatgtcaagctcagcagagggtccgaagtggttctggatgcgtgcgactctagctgtgaggtgatgattcccaaaggcacaggagatatctccgtcgactgcagcggcgggcagcaacacttccttaaggacaacctgattgatctcggatgtcctaaaatccccctgctgggcaagatggccatttacatctgccgcatgtctaatcaccctaagaccacgatggcttttcttttctggttttccttcgggtatgtgatcacccggattctctgtaaagccatcttttacctgctgattatcgtgggaacactcggcaagagattcaaacagtatcgggagctgaagccccagacctgcacaatttgtgaaaccacgcctgccaacgctatcgacgccgagatgcatgatcttaattgcagctacaacatctgcccctactgtgcgtctcgcctgacctccgacgggctcgctagacacgttacgcagtgcccgaaacggaaggaaagagtcgaggaaacagagctgtatctgaatcttgagcgcattccttggatcgtgcggaagctcctgcaagtgagcgaatctaccggcgtcgccctgaaaagatccagctggctcattgtgctgcttgttctgtttaccgtgtccctcagccccgtccagtctgcccctatcggatacggcaacacaattgagacctatcaggctcgcgaagagtacacgagcatctgtctgttcgtgctggggtccatcctttttattgtttcttgcctcatgaagggactggtggatagcatcggcaacattttctttcccgggctgacaatctgtaaaacctgctccattggatctatcaatggcttcgaaatcgagagccataagtgttattgctccctcctgtgttgcccgtactgtagacactgctctgccgaccgggagattcaccagcttcatctgagcatctgcaaaaagcgcaaaacagggtccaacgtcatgctcgctgtgtgtaagagaatgtgctttcgggccaccatggaagttagcaataaggcgctgctgattcgctctatcattaacacaaccttcgtggtctgtatccttattctggccgtgtgcatcgtgtccacgagcgctgtcgagatggaatctctccctgccggcacctgggagagagaagaggatctgacaaatttctgtcaccaagagtgccaggttaccgaaacagagtgtctctgcccctatgaagctctggtgcttcggcgccctctgtttctcgactccatcgtgaaaggaatgaagaaccccctgaatagcacctccctggagacgtctcttagcattgaggccccctggggcgcgatcaacgtccagtccacatacaaacctaccgtgagcacagccaatattgctctgtcttggtccagcatcgaacatagagggaacaatattctcgtttctggacggagcgagtccatcatgaagctggaggaacgcaccggcatctctggggatctcggagtggaagacgccagcgagtccaaactgcttaccgtctctgtgatggatctgagccagatgtactccccggttttcgagtatctcagcggcgacagacaagtggaagagtggcccaaggctacatgtacgggcgattgccctgaacggtgtgggtgcacctcttccacatgcctgcacaaggagtggccccatagcagaaactggcgctgtaatcctacctggtgctggggagtcggcacagggtgtacctgctgtggactggacgtgaaagacctttttattgattacatgttcgttaagtggaaagtggactatatcaagacggaagccattgtctgcgtggagctgacatcccaggagcggcagtgttctctcgtggaagccggcaccagatttaacctggggcccgtcaccatcacactcagcgagcctcgcaatattcaacagaaactgccgcccgaaatcatcacccttcaccctcggattgaggaaggattctttgatctgatgcacgttcagaaggtgctgtccgcttctacagtgtgcaagctccagagctgtacgcatggcgtccccggcgacctgcaagtgtaccacatcgggaaccttctgaaaggagataaggagaacggccatctcattcacaaaatcgagcctcatttcaatacctcctggatgagctgggacgggtgcgatctggactattactgtaacatgggagattggccctcttgcacatataccggcgttacacagcacaatcacgcgtcctttgtgaacctcctgaatattgaaaccgactacacaaagagcttccattttcactctaaaagagtcaccgcccatggggatacaccgcagcttgacctgaaggctcgccctacctacggagccggcgagatcacagtgctggttgaagtggccgatatggagctccacaccaagaaaattgagatcacaggcctgaagttcgcttcccttacgtgcaccgggtgttatgcctgcagctctggaatcagctgtaaagtccggattcacgtggacgaacccgacgagctgacagtccatgtgaagtccgatgaccccgatgttgtggcggcttctagctccctcatggccagaaaactggaatttggcaccgacagcaccttcaaggccttctccgctatgcctaaaacatctctctgcttttacatcgtcgagcgcgaatatagaaagagctgttccaaggaggatacgcagaaatgcgtgaacaccaagctggagcaaccccagtctattcttatcgaacacaaagggacaattatcggaaagcagaataacacctgtacagccaaagcgagctgctggctggagtccgttaagtctttcttttacggcctgaagaatatgctcagcgggatcttcggaaacgtgtttgtcggcattttcctgtttcttgctcctttcatcctgctcattctgtttttcatgtttggctggcggatcctctcctgtttcaaatgctgtcggcgcaccagagggctgcttaagcatcggcacctgaaagacgatgaagagacgggatatcgcagaattatcgaacggctgaataacaagaaaggcaagaataagctcctggacggggagagacttgccgatcgccggatcgccgagctgttcagcacaaaaacccatattggatga

SEQ ID NO: 13655 - RNA, 5055 nt, synthetic construct
  misc_feature 1..5055: note = derived and/or modified CDS sequence (opt5) from CCHFV(K168_40)__KX013457.1__GP
  source 1..5055: mol_type = other RNA
atgcacatcagcctgatgtgcgccgtgctctgtctgcagctttacggccttgggggaacccatggcctccacaacgggacagagcataataagacgaacgctgtcaccacatcctctaatagccaatcctctgaaagccccgccagaaccgcgcctccggttacacccgactcccctaccgtgacacccaccacgcctgcttctgcccccgagggaagcggcgaagcccactccagccctccgaacaataccgaggggccctctctgcctgaatccacaagcgagccccctgctgccacctctacaggcattccctccgctagcgatgtgaactcttccacccaggccgcgcgggacacgagcacaccgaccgtccgcacatcccctcccaattctcctagcacccctcccacaccccaggagacccatcacccggtgagaaaccttctgtccgttacgagccacaaacccgaagagacctctgccccttccgaaagcggaaaggagtctcccgctgccaatagccctcatcccgtggcttcccggccgcctacaccctctaccacagcccagggccctaccgagaacaataactataatacgacagggcaactcgaaagcctgacccagtccaccacactgggacccatgaccagcctcacacagacggatctgcctcagtctgtcacctccatcgcggtgcaagacacacaccccagcccgaccaaccgctctaaaagaaatcttgagatggaaattatcctgacactccctcagggcctgaagaaatactatgggaaggttcttcggctgctccagctgaccctggaggaagatacggagggactcctggagtggtgcaagcgcaaccttggcctggactgtgatgacaccttctttcagaaaagaattgaagagttctttatcacaggggaaggacatttcaacgaggtgctccaatttcggacccccggcacactgtccaccacggaaagcacacacgccggccttcccaccgctgagcctttcaagtcctactttgccaaagggttcctgtctatcgatagcggatatttttccgctaagtgctactctcgcacaagcaattccggcctccagctgattaacgtcaccagacacagcacccggatcgccgacacaccggggcccaaaattacgaatctgaagaccatctcttgtattaacctcaaggcctccgtgttcaaagagcatcgcgaagtggagatcaatgtcctgcttcctcaggttgctgtgaacctgagcaattgccacgtgacaattaagtctcatgtctgtgattattccctcgacatcgatggaaccgtgagactgccccacatccatcacgacggcacatttattcctgggacctacaaaatcgttattgaccggaagaacaaacttaatgatcgctgcacgctgttcacaaactgtgtgatcaagggaagagaagtccggaaaggccaaagcgtgctcagacagtacaagaccgagattcgcatcggcaaggcgtctaccgggagccggagactgctgtccgacgaaagcggagatgactgcatctctcgcacacagctcctgcggaccgagacagccgagattcacggcgataattatgggggacccggcgacaaaatcacgatttgtaacgggtccaccatcgttgatcagagacttggcagcgaactgggatgctacacaattaatcgcgtgaagtcctttaaactctgcgagaactctgctaccggcaagagctgtgaagtcgactccatccctgtgaaatgccggcaagggtattgtctgaagatcacacaggagggaagaggccatgtcaagctgtctcgcgggagcgaggtggttcttgatgcctgcgactcctcttgtgaagtgatgattcccaaaggaaccggcgatatcctcgtcgactgcagcgggggccagcagcacttcctgaaggacaatctgattgatctcggatgtccgaaaatccctctgcttggcaagatggccatttacatctgccggatgtccaaccatcccaaaacgaccatggctttcctgttttggttcagctttgggtatgtgattacatgtatcgtttgcaaggccatcttctacctcctgattatcgtgggaaccctgggcaagagatttaaacaatatcgcgagcttaagcctcagacatgtaccatttgcgaaacaacccccacgaacgcgatcgacgctgagatgcacgatctcaattgctcttacaacatttgtccgtactgcgcctcccggctgacaagcgacgggctggccagacacgtcacccattgtcctaaacggaaggaaaaagtggaggagaccgaactctatctgaatcttgagcgcatcccctgggtggttagaaagctgctccaggtctctgaatccacaggagtggctctgaagcggagctcttggctgatcgtgcttctcgtcctgttcgccgtgtccctgagccctgttcagtccgctcccattggccacgggaaaaccatcgagacgtaccaagtgagagaagagtatacaagcatttgcctctttgtcctgggctctatccttttcattgtgagctgtctgatgaagggactcgttaactccgtgggcaatatctttttccccgggctgtctatctgcaaaacctgtagcattggatccatcaacggctttgagattgaatctcataagtgctactgtagcctgctttgctgtccttattgccgccactgctccgccgatcgggagatccatcagctccacctgtctatttgtaaaaagagaaaaacagggagcaatgtcatgctggcggtgtgcaagcgcatgtgtttcagagccaccgttgaagtgtccaacaaggctctcagcatccggtctatcattaatacaacctttgtcgtgtgcatcctgattcttgccgtgtgtgtcgtttccacgagcgctgtggagatggaatctctgccggccggaacctgggagcgcgaggaagacctcacaaacttctgccaccaggagtgtcaggtgaccgaaacagagtgcctgtgtccctacgaggcgctggtccttagacggcctctgttcctcgatggcatcgtgaaagggatgaagaatctgctcaactccaccagcctggaaacgtccctttctattgaggccccctggggcgctatcaatgttcaaagcacatataaacctaccgtgtccgccgctaacattgccctgagctggtcttccgtcgaacatcgcggaaataagatcctcgtgagcggcagatctgagagcatcatgaaactggaggaacggacagggatttcctgggacctgggagttgaggatgcctctgaaagcaaacttctgaccgtgtccgtcatggacctctctcagatgtacagccccgtgtttgagtacctgtccggcgatcgccaggttgaagagtggcctaaggctacctgcacaggggactgtccggaaagatgcggatgcacgagctctacctgtctccacaaggagtggccccattcccggaactggcgctgcaaccctacatggtgttggggcgtgggcaccgggtgcacatgttgcggactggatgtcaaggaccttttcaccgactatatgtttgtgaaatggaaggtggagtacatcaaaacggaagcgattgtctgtgttgagctgacaagccaagaaagacagtgctccctcatcgaggccggcacccggttcaatctggggcccgtgaccattacactgtctgaacctagaaacatccagcagaaacttcccccggagatcattaccctgcaccctcgcatcgaggaaggatttttcgatctcatgcatgtgcaaaaggtcctgagcgcttccacagtgtgtaagctccagtcttgcacgcacggcgttcccggggaccttcaggtgtatcacattggaaatctgctgaagggcgataaagtcaacggccatctgatccacaagattgagccccattttaataccagctggatgtcctgggacgggtgtgatctcgactactattgcaacatgggagattggcctagctgcacatacaccggcgtgacacagcacaatcacgcctctttcatcaacctgcttaatatcgaaaccgactatacgaaatcctttcatttccacagcaagcgggttaccgcccatggggatacaccccaactggacctcaaggctagacctaactacggagccggcgagattaccgtgctggtcgaggtggcggatatggaactccacaccaaaaagatcgagatttctgggctgaaatttgcttcccttacatgtacaggatgctacgcctgtagctctggcatcagctgcaaggtccgcattcatgtggacgaaccggatgagctgacggttcacgtgaaatccgacgaccccgatgtcgtggccgcttctagctccctgatggcccggaagctcgagttcggcaccgacagcacatttaaagcgttctccgctatgcctaagacctctctgtgtttctatatcgttgaaagagagtactgcaagagctgttccaaagaagatacccagaagtgcgtgaatacaaaacttgagcacccccagtctattctgatcgaacataaggggacgatcattggaaaacagaacaatacctgtacagccaagaccagctgctggctcgagtccgtcaagagctttttctatggcctgaaaaacatgctctctgggatctttggaaatgtgttcgtgggcatttttctgttccttgccccttttatcctgctgattctcttctttatgttcgggtggcgcatcctgttttgtttcaagtgctgccggagaacacgcggacttttccggtacaaacacctggaagacgatgaggagaccggctatagacggatcattgaacgcctcaacaacaagaaaggcaagaataagctgctcgacggggagagactggctgatcggcgcatcgccgaactgttttccacgaaaacacatattggatga

SEQ ID NO: 13656 - RNA, 5055 nt, synthetic construct
  misc_feature 1..5055: note = derived and/or modified CDS sequence (opt5) from CCHFV(K128_76)__KX013454.1__GP
  source 1..5055: mol_type = other RNA
atgcacatcagcctgatgtgcgccgtgctctgtctgcagctttacggcctcgggggaacccatggctcccacaacgagacagaacataataagacgaacgctgtcaccacatctagcgactcccaatctcccgagcctccgaccagaacaaccctgcccgttacacctgatagccccaccgtgacgcctaccacacccgcctccgcgcctgaagggtctggagaggtgcacaccagcccgcccaatacaaccgaaggcccttccctgcccgagagcacgcctgagcccccgacagctacctctacagggattccttccgccagcgacgtcaactcttccacccaggccgctcgggataccagcacacccacggtgcatacctctcctcccaattcccccagcacacctccgacccttcaggaaacacaccaccccatgcgcaacctgctctccgttacctctcataaacctgaggaaacgagcgccccctccgagagcggaaaggagtctcctgctgccaatagcccccacccggtggcggacagaccttccacatctagcaccaccgcccagggccccacagaaaacaattcctataacaccacagagcaactggaatctctgacgcagagcaccacactcggccctatgacctccctgacacagaccgtccttagccagtctgtgacgtccatcgctgttcaagatacccatctgagccccacaaatcggtctaaacgcaacctcgagatggaaattatcctgacccttcctcaggggctgaagaaatactatggaaaggtgctcagactgctgcagctcacactggaggaggacaccgaaggccttctggagtggtgcaagcggaatctcgatctggactgtgatgacacgttctttcagaaacgcattgaagagttctttatcacaggggaaggatacttcaacgaggtccttcaatttagaacccccggcacactgtccaccaccgagagcacacacgccgggctcccgacggctgaacctttcaagtcctattttgccaaaggattcctgtctatcgatagcggctacttttccgcgaagtgctattctcggaccagcaattccggcctgcagctcattaacgtgacacgccacagcaccagaatcgccgacacacccgggcccaaaattaccaacctgaagacgatctcttgtattaatcttaaggcttccgtgttcaaagagcatcgggaagtcgagatcaacgttctgctccctcaggtggccgtgaatctgagcaactgccacgtcacaattaagtctcatgtgtgtgattactcccttgacatcgacggaaccgttaaactgccgcacatccatcacgatggcacctttattcccgggacatacaagatcgtgattgaccgcaaaaataagctcaacgatagatgcaccctgttcacaaattgtgtcatcaaaggacgggaagtgcgcaagggccaaagcgttctgagacagtataagacggagattcggatcgggaaggcttctaccggaagcagacgcctcctgtccgacgagagcggcgatgactgcatctctcggacacagcttctgagaaccgaaacagccgagattcacggcgataactacgggggacctggcgacaaaatcaccatttgtaatgggtccacgatcgtggatcagcgcctcggaagcgaactgggctgctataccattaaccgggtcaaatcctttaagctgtgcgaaaattctgccacagggaaaagctgtgagatcgactccatccccgtgaagtgcagacaaggctactgtcttaagattacccaggagggacgcggccatgtcaaactctctcgggggagcgaggtggttctggatgcttgcgactcctcttgtgaagtgatgatccctaagggaacaggcgacattctggtcgattgcagcgggggacagcagcacttcctcaaagacaacctgatcgatcttggctgtcccaagattcctctgctcgggaaaatggcgatctatatttgcagaatgtccaatcatcccaagaccacaatggccttcctgttttggttcagctttggctacgtgatcacctgtatcgtttgcaaggctattttctatctgcttatcattgtgggaacgctcggcaaacgctttaagcaataccgggagctgaaaccgcagacatgtaccatctgcgaaaccacacctaccaacgccattgacgccgagatgcacgatctgaattgctcttacaacatctgtccctattgcgcttccagactcacgagcgacgggctggcccgccacgtcacacattgtcctaagcggaaagagaaggtggaagagaccgaactttacctgaacctcgagagaatcccctgggtggttcggaagctgctgcaggtctctgaatccacaggagtggcgcttaaacgcagctcttggctcattgtgctgctggtcctcttcgctgtgtccctgagcccggttcagtccgcccctatcagccacggcaagaccattgagacatatcaagtgagagaggaatacacctctatctgcctttttgtcctggggagcattctcttcatcgtgtcctgtctgatgaaaggactggttaattctgtgggcaacatctttttccccgggcttagcatttgcaagacgtgttccatcggctctattaatggatttgagatcgaaagccataaatgctattgttccctcctgtgctgtccttactgccggcactgctctgccgatagagagattcatcagctgcacctcagcatctgtaagaaacgcaagaccggctccaacgtcatgctggctgtgtgcaagcggatgtgtttcagagccacaatggaagttagcaataaagctctttttatccgctctattatcaacaccacattcgtggtctgcattctgatcctcgccgtgtgtgtggtctccaccagcgcggttgagatggagtctctgcccgccgggacgtgggaaagagaggaagacctgacaaatttctgccaccaggagtgtcaggtgaccgagacagaatgcctttgtccctatgaggctctggtgctccggcgccctctgtttcaagattccattgtcaagggaatgaaaaacctcctgaatagcacctcccttgaaacctctctgagcatcgaggccccgtggggcgctattaacgtgcagtccacatacaagcccgccgttagcgcggccaatatcgctctctcttggtccagcgtggaacatagagggtctaaaatcctggtcagcggacggtccgagtctattatgaagctggaggaacgcacgggcatcagctgggaccttggggtggaggatgcctccgaatctaagctgctcaccgttagcgtgatggacctgtcccagatgtacagccctgtcttcgagtatctctctggcgatagacaagtggaagagtggcccaaagctacatgcaccggagactgtcctgagcggtgcggctgcacatccagcacctgtctgcacaaggaatggccccattcccgcaactggagatgcaatcctacgtggtgttggggagttgggacaggctgcacctgttgcgggcttgacgtgaaagatctgtttaccgactacatgttcgtcaagtggaaagtggagtatattaagacagaagccatcgtgtgtgtcgagctcacctctcaggaacggcagtgcagcctgattgaggccggaacacgctttaacctgggcccggttacgatcaccctttccgagcccagaaatatccagcaaaagctgcctcccgaaattatcacactccaccctcggattgaggaaggcttctttgatctgatgcatgtgcagaaagtgctctctgctagcaccgtctgtaagctgcagtcctgcacacacggggtgcccggagaccttcaggtttaccacatcggcaacctgctgaaaggggatagagtgaacggacatctcattcacaagatcgagccgcatttcaataccagctggatgtcttgggacggctgtgatctggactattactgcaacatgggggattggccttcctgcacgtataccggagtcacacaacacaatcacgcgagctttgtgaaccttctgaatatcgagaccgactacacaaaatctttccattttcactccaagcgcgttaccgcccatggcgatacaccccagctcgacctgaaggctcggcccaactacggcgccggggaaattacggtgctcgtcgaggtggccgatatggaactgcacaccaaaaagatcgagattagcggacttaaattcgcttctctgacatgtaccggctgctatgcctgtagctccgggatctcttgcaaggtccgcattcatgtggacgaacctgacgagctgaccgttcacgtgaaaagcgatgaccccgatgtcgtggcggcttccagctccctcatggccagaaagctggagtttggaacagactctacgttcaaagccttcagcgctatgcctaagacctccctttgtttttacatcgttgaacgggagtattgcaagtcttgtagcaaagaagatacacagaagtgcgtgaataccaaactggagcagccgcaatccattctcatcgaacacaagggcacaatcattgggaaacagaacaatacctgtacggccaagacatcttgctggctggagagcgtcaagtccttcttttacggactcaaaaacatgctgagcggcatcttcggcaatgtgtttgtggggattttcctttttctggcgcccttcatcctgctcattctgtttttcatgtttggatggagaatccttttctgtttcaagtgctgccgccggaccagaggcctgtttcgctataaacatctcgagaacgacgaagagaccgggtaccggagaatcattgaacggctgaataacaagaaaggaaagaataagctcctggatggcgagcgccttgctgacagacggatcgccgaactgttctctacaaaaacccacattgggtga

SEQ ID NO: 13657 - RNA, 5055 nt, synthetic construct
  misc_feature 1..5055: note = derived and/or modified CDS sequence (opt5) from CCHFV(K168_125)__KX013460.1__GP
  source 1..5055: mol_type = other RNA
atgcacatcagcctgatgtgcgccgtgctctgtctgcagctttacggccttgggggaacccatggcctccacaacgggacagagcataataagacgaacgctgtcaccacatcctctaatagccaatcctctgaaagccccgccagaaccgcgcctccggttacacccgactcccctaccgtgacacccaccacgcctgcttctgcccccgagggaagcggcgaagcccactccagccctccgaacaataccgaggggccctctctgcctgaatccacaagcgagccccctgctgccacctctacagggattccctccgctagcgatgtgaactcttccacccaggccgcgcgggacacgagcacaccgaccgtccgcacatcccctcccaattctcctagcacccctcccacaccccaggagacccatcacccggtgagaaaccttctgtccgttacgagccacaaacccgaagagacctctgccccttccgaaagcggcaaggagtctcccgctgccaatagccctcatcccgtggcttcccggccgcctacaccctctaccacagcccagggccctaccgagaacaataactataatacgacagggcaactcgaaagcctgacccagtccaccacactgggacccatgaccagcctcacacagacggatctgcctcagtctgtcacctccatcgcggtgcaagacacacaccccagcccgaccaaccgctctaaaagaaatcttgagatggaaattatcctgacactccctcagggcctgaagaaatactatgggaaggttcttcggctgctccagctgaccctggaggaagatacggagggactcctggagtggtgcaagcgcaaccttggcctggactgtgatgacaccttctttcagaaaagaattgaagagttctttatcacaggggaaggacatttcaacgaggtgctccaatttcggacccccggcacactgtccaccacggaaagcacacacgccggccttcccaccgctgagcctttcaagtcctactttgccaaagggttcctgtctatcgatagcggatatttttccgctaagtgctactctcgcacaagcaattccggcctccagctgattaacgtcaccagacacagcacccggatcgccgacacaccggggctgaaaattacgaatctcaagaccatctcttgtattaacctgaaggcctccgtgttcaaagagcatcgcgaagtggagatcaatgtccttctgccccaggttgctgtgaacctcagcaattgccacgtgacaattaagtctcatgtctgtgattattccctggacatcgatggaaccgtgagacttcctcacatccatcacgacggcacatttattcccgggacctacaaaatcgttattgaccggaagaacaaactgaatgatcgctgcacactcttcacgaactgtgtgatcaagggaagagaagtccggaaaggccaaagcgtgctgagacagtacaagaccgagattcgcatcggcaaggcgtctaccgggagccggagactgctctccgacgaaagcggagatgactgcatctctcgcacacagctgcttcggaccgagacagccgagattcacggcgataattatgggggacctggcgacaaaatcacgatttgtaacgggtccaccatcgttgatcagagactgggcagcgaactcggatgctacacaattaatcgcgtgaagtcctttaaactgtgcgagaactctgctaccggcaagagctgtgaagtcgactccatccccgtgaaatgccggcaagggtattgtctgaagatcacacaggagggaagaggccatgtcaaactttctcgcgggagcgaggtggttctcgatgcctgcgactcctcttgtgaagtgatgattcctaagggaaccggcgatatcctggtcgactgcagcgggggccagcagcacttcctgaaggacaatctcattgatctgggatgtcccaaagtgccgcttctgggcaagatggccatctacatttgccggatgtccaaccatcctaaaacgaccatggctttcctcttttggttcagctttgggtatgttatcacatgtattgtgtgcaaggccatcttctacctgctgatcattgtcggaacccttggcaagagatttaaacaatatcgcgagctcaagccccagacatgtaccatctgcgaaacaacccctacgaacgcgattgacgctgagatgcacgatctgaattgctcttacaacatctgtccctactgcgcctcccggctgacaagcgacgggctcgccagacacgtgacccattgtccgaaacggaaggaaaaagtggaggagaccgaactgtatcttaatctggagcgcattccttgggttgtcagaaagctccttcaggtgtctgaatccacaggagtggctctgaagcggagctcttggctgatcgtcctcctggtgctgttcgccgtttccctcagccccgtgcagtccgctcctatcggccacgggaaaaccattgagacgtaccaagtcagagaagagtatacaagcatctgcctgtttgtgcttggctctattctgttcatcgttagctgtctcatgaagggactggtgaactccgtcggcaatatctttttccccgggctgtctatttgcaaaacctgtagcatcggatccattaacggctttgagatcgaatctcataagtgctactgtagccttctctgctgtccctattgccgccactgctccgccgatcgggagattcatcagctgcacctgtctatctgtaaaaagagaaaaacagggagcaatgtgatgctcgcggtttgcaagcgcatgtgtttcagagccaccgtggaagtctccaacaaggctctgagcattcggtctatcatcaatacaacctttgtggtgtgcattcttatcctggccgtctgtgttgtgtccacgagcgctgtggagatggaatctctccctgccggaacctgggagcgcgaggaagacctgacaaacttctgccaccaggagtgtcaggtcaccgaaacagagtgcctgtgtccgtacgaggcgcttgtgctgagacggcccctcttcctggattccattgttaaaggcaagaaaaatctcctgaacagcacctcccttgaaacgtctctgagcatcgaggccccttggggagctattaatgtgcaatccacatataagcccaccgtcagcgccgctaacatcgccctctcttggtccagcgtggaacatcgcggcaataaaattctggtttctggaagaagcgagtccatcatgaagctggaggaacggacaggcatctcttgggaccttggggtggaggatgccagcgaatccaagctgctcaccgtctctgtgatggacctgagccagatgtactcccctgtttttgagtacctcagcggagatcgccaggtggaagagtggcccaaagctacctgcacaggcgactgtcctgaaagatgcgggtgcacgtcttccacctgtctgcacaaggagtggccgcatagccggaactggcgctgcaaccccacatggtgttggggagtcggcaccggctgcacatgttgcgggcttgatgtgaaagacctgttcaccgactatatgtttgtgaagtggaaagtcgagtacattaagacggaagcgatcgtttgtgtggagctcacatcccaagaaagacagtgctctctgattgaggccggaacccggttcaatctgggccctgtgaccatcacacttagcgaacccagaaacattcagcagaagctgcctcccgagatcatcaccctccacccgcgcattgaggaagggtttttcgatctgatgcatgtccaaaaagtgctctccgcttctacagtttgtaagctgcagagctgcacgcacggagtgcctggcgaccttcaggtctatcacatcgggaatctgctgaaaggagataaggtgaacggccatctcattcacaaaatcgagccccattttaatacctcctggatgagctgggacggctgtgatctggactactattgcaacatgggggattggccctcttgcacatacaccggagttacacagcacaatcacgcctccttcattaaccttctgaatatcgaaaccgactataccaagagctttcatttccactctaagcgggtgacggcccatggcgatacacctcaactcgacctgaaagctagacccaactacggggccggagagatcaccgtcctcgtggaggtcgcggatatggaactgcacacaaagaaaattgagatctccggccttaagtttgctagcctgacctgtacagggtgctacgcctgttctagcggaatttcctgcaaagtgcgcatccatgttgacgaacctgatgagctgacggtgcacgtcaagtctgacgacccggatgtggttgccgctagctccagcctcatggcccggaaactggagttcggcaccgactccacatttaaggcgttctctgctatgcccaagaccagcctttgtttctatattgtggaaagagagtactgcaaatcctgttctaaggaagatacccagaaatgcgtcaatacaaagctggagcaccctcagagcatcctcattgaacataaaggcacgatcatcgggaagcagaacaatacctgtacagccaagacctcctgctggctggagtctgtgaaatcctttttctatggactcaagaacatgctgagcggcatttttgggaatgtgttcgttggaatctttcttttcctggccccctttattctgctcatcctgttctttatgttcggctggcgcattctgttttgtttcaaatgctgccggagaacacgcgggctgttccggtacaagcacctcgaagacgatgaggagaccggatatagacggatcatcgaacgcctgaacaacaaaaagggcaagaataaactcctggacggcgagagacttgctgatcggcgcattgccgaactgtttagcacgaagacacatatcgggtga

SEQ ID NO: 13658 - RNA, 5052 nt, synthetic construct
  misc_feature 1..5052: note = derived and/or modified CDS sequence (opt5) from CCHFV(Kosova Hoti)__EU037902.1__GP
  source 1..5052: mol_type = other RNA
atgcacaccctgctcgtgtgcttcatcctgtaccttcagctgctcggcctgggaggagcccatggccaaagcaacgctacagagcacaatgggacgaacaccacaaccgcccccggaacatcccagtctcctaagccgcccgcgagcaccacaccttcccatgctcccgaaccttctaccattaaacttacgacccccacaagcgagaccgaaggctccggggagacaacccctccgacgaatacaacccaggactctccccctctggaaacaacccccgagagaagcgccaccacagccacgtccaccagcggaacagataacatgaatagcaccacacagatgaccgacaacacgcctacatccaccgtcagcacctctctctccagctctccctccacaccgagcacctcccaaggcatgcaccatcctgttcggtctctgctgagcgtgtccagccccaagacagctacgacccctacacccatgtctcccggcgagatgtccagcgaaacctctagccagcactccgccatgtctcgcacacctaccccgcacacggctacccaggtgagcacagagaatgccaacagatccaccagccggcagtctgaatccagcgcgcaacccgccacacagtctcctgtcacctcccccgctcagagcatcctcctgatgtccgccacgcctacaaccattcagaatatccatccctctccgacaaaccgcagcaaaagaaatcttgagatggagattatcctgaccctctcccaagggctgaagaaatattacggaaagatccttaagctgctccacctgaccctggaagaggatacagaaggcctcctggagtggtgtaaacggaaccttgggtctaattgcgacgatgactttttccagaagcgcattgaagagtttttcatcacgggagagggctattttaacgaagtgctgcagttcaaaaccctcagcacaccttccagcaccgagccctctcatgctagactgcctacagccgaaccctttaagtcctacttcgcgaaagggtttcttagcattgattctggatatttctccgccaagtgttaccctcggagctctaccagcggcctgcaactcatcaatgttacgcagcaccccgctcgcattgccgagacaccgggccctaagaccacctccctgaaaacaatcaactgcattaacctgagagctagcgtgtttaaggaacaccgggaggtcgagatcaatgtgctcctgccccagatcgccgttaacctttctaattgtcatgtggtcattaactcccacgtgtgcgactatagcctggataccgacgggcccgtgcgcctccctagaatctaccatgaaggaacattcatgccgggcacgtacaaaattgtcatcgatcggaagaataaactgaacgaccgctgtacccttgttacaaattgcgtgattaaggggagagaggtgcggaaaggacagtccgtcctgagacaatataagaccgaaatcaagatcggcaaagcccccacagggtctcgcaagctcctgagcgaggaacctggagatgactgtatttcccggacccagctgctcagaacggagaccgctgagatccacgacgataactacggcggccccggggacaaaattacaatctgcaatggatctaccattgtggatcagcgcctgggcagcgaacttgggtgttatacaatcaaccgggttaagtcctttaaactgtgcgaaaattctgcgaccggaaagacatgcgaaatcgacagcacccctgtgaagtgtagacagggcttctgcctcaaaattacgcaaaaggggcgcggccatgtcaaactgtcccggggaagcgaggtggttctggatgcctgtgactctaactgcgaggtgatgatccccaagggcacaggggatattcttgtcgactgttccggaggccagcagcacttcctcaaagataatctgatcgacctggggtgccctcacattcccctcctgggaaagatggctatctacatttgtagaatgagcaaccatccgaagaccaccatggcctttcttttctggttttctttcggctatgtgatcacatgcatcttttgtaaagccctgttctactccctcattatcattgggaccctgggcaagaaaatcaagcagtatcgcgaactgaaacctcaaacgtgcacaatttgtgagaccgctcccgtcaatgccatcgatgcggaaatgcacgaccttaactgcagctacaacatctgcccttactgtgcttctcggctcacatccgacggactggccagacatgtgaagcagtgccccaagcgcaaagagaaggttgaagagaccgagctgtatctcaatctggaacggattccgtgggtggtcagaaaacttctccaggtgagcgagtccacaggcgttgccctgaagcggagctcttggctgatcgtgctgcttgtcctcctgaccgtgagcctgtcccctgtgcagtctgctcccgttgggcacggaaaaacgattgaaacctaccaaacacgcgagggctttaccagcatctgtctcttcatgctggggtccattctttttatcgtctcttgcctggtgaagggactcgtggatagcgtctccgactctttctttcctggcctgagcgtgtgtaaaacatgctccatcgggagcattaacggcttcgaaatcgagtctcacaagtgttattgctccctgttttgttgcccctactgtagacattgcagcgccgatcgggagattcaccagcttcatctcaatatctgcaagaaaagaaagaccggatctaacgttatgctggctgtgtgtaaacgcatgtgcttccgggccacgattgaagcgtccagacgcgccctgctcatcagaagcatcattaatacaaccttcgtcatctgtattctgacacttaccatctgcgtggtttccacctctgctgtggagatggaaaacctgcccgccggcacatgggagcgggaagaggacctcacgaatttttgtcaccaggagtgccaagtcaccgaaacagagtgtctgtgcccttatgaagctctggtgcttcgcaagccgctgttcctcgatagcattgttaaagggatgaagaacctgctcaattccaccagcctggagacatctctttccatcgaggccccctggggagcgattaacgtgcagagcacctttaagcctacggtctctacagccaatatcgctctgagctggtcctctgtggaacatagaggcaacaaaatcctcgtgaccgggcggagcgagtccattatgaagctggaggagcgcaccggaatctcttgggacctgggcgtcgaagatgccagcgagtccaaacttctgacagttagcattatggacctctctcagatgtactcccccgtgttcgagtatctgagcggggatagacaggtggaagagtggcctaaggctacctgtacaggcgactgcccccaacggtgtggatgcacgtcctctacctgcctccacaaagaatggcctcacagccgcaattggagatgtaacccgacatggtgctggggcgtcgggaccggatgtacatgctgtggcgtggatgttaaggacctgtttaccgatcatatgttcgtgaagtggaaagtcgagtacatcaagacggaagccattgtgtgcgttgagcttacctcccaggagcggcagtgttctctgatcgaagccgggacacgctttaatctcggacccgtgaccatcacactgagcgagcctagaaacattcagcaaaaactgccccctgaaatcattacccttcaccccaagatcgaggaaggcttctttgacctgatgcatgtccagaaagtgctctccgctagcacagtttgcaagctgcagtcttgtacgcacggcattccgggggacctccaggtgtaccatatcggaaacctgcttaagggcgatcgggtcaatgggcacctgatccacaaaattgagcctcatttcaacacctcctggatgagctgggacggatgcgatctggactattactgtaatatgggcgattggccctcttgcacatataccggggtgacccaacacaaccatgcggcctttgtgaatctcctgaacatcgagacagactacacgaagaccttccactttcactccaaaagagtcacagctcatggagatacaccccagcttgacctgaaggcccgccctacctatggcgccggcgaaattaccgttctcgtggaggtggctgatatggaactgcacacgaaaaaggtcgagatcagcgggctcaaattcgcctctctggcgtgcacaggatgttacgcttgcagctccggcatttcttgtaaggtgcggatccatgttgacgagcccgatgaacttaccgtgcacgtcaagagctccgaccctgatgtggttgccgccgggaccagcctgatggctagaaaactggagttcggaacagactccacctttaaggccttctctgcgatgccgaaaacaagcctctgcttttatattgtggaaaaggagtactgtaaatcctgctctgaagacgataccaagaagtgtgtcgacacgaaactggagcagccccaaagcatccttatcgagcatcgcggcacaattatcgggaagcagaatgatacctgcacagctaaagcctcctgttggctggaatctgtgaagtctttcttttacggactcaaaaacatgctgggctccgtcttcggcaactttttcattgggatcctcctgtttcttgcccctttcgtgctgctggttctctttttcatgttcggatggaagattctgttttgcttcaagtgttgccggagaacccgcggcctttttaaatatcggcacctgaaggacgatgaggaaacggggtacagacgcatcatcgagcggctcaataataaaaaggggaaaaacagactgctcgacggcgaacggctggctgatcgcaagattgccgagcttttcagcaccaagacacacatcgggtga

SEQ ID NO: 13659 - RNA, 5049 nt, synthetic construct
  misc_feature 1..5049: note = derived and/or modified CDS sequence (opt5) from CCHFV(Oman)__DQ211632.1__GP
  source 1..5049: mol_type = other RNA
atgcacaccctgctcgtgtacgccgtcttctgcctgcagctttggagccccggcgggacaagaggactgtccaacgagacgcaacataatgaaaccggcatcacacgggctcctgaggggtctcagggaccgagcctccccgtttccaccgcctctcctattatgagcgacccctccatcacaaccccttctgcgagcacatccggcctggaagggagcggagataccacgccccctgctattacccagggcccgacaccccctgagaccacacccgaaccttctaccacgacaggcaccaacgccttttccacagccatcgctaatgtgagcacccagaccgtgaaggacacacccacgccgaccgtccaaacatctcctccctccacccctgatgccagcacaattccccaggggacccaccatacggctcgcggacttctgtctgtgacagttaccaaacccgaggaggtgcctaccccgacaggccccgaacaggcctccatcgagaccaacagccctagactcgcgacatccaagacgccctctcctagccccaccgcccaggtcacaaccgaaaattccaacccgaatacaagccggcaactggtgctgtctacccagcctgctacgtccagccccgttacctctcctgcccagctcatcttcgtgcagagcgctacaaccgtcgccgtgcaagacgcgcacccctcccctacaaaccgctctaaaagaaatctggagatggaggtgattcttaccctgagccaggggctccggaagtattacggacgcatcctgaaacttctggatctcacgctggaagaggacacagaaggcctgctcgagtggtgtaagagaaacctggggcttacctgcgatgacaatttcttccagaagcggattgaagagtttttcctgacaggagagggccattttaacgaagtcctccaattcaaaaccccctccaccctgagctctacagagtccgccagcgttggccttccgacggtggaaccttttaagtcttatttcgctaaagggtttctgtccatcgatagcggatacttctccgccaagtgttatccccgcgcttctaatagcggcctccagctgattaacgtgacccagcactccgccagaatcgccgacacacccgggcctaaaattaccaatctgaagacaatcaactgcatcaacctcaaggctctggtctttaaagagcaccgggaaattgagatcaatgtgcttctgccgcaggttgcggtgaacctctctaattgtcatgtccacattaagagccatgtgtgcgattactccctggacatcgatggaaccgttcgccttcccagaatccaccacgagggcacgttcatccctgggacatataaaatcgtgattgacaagaaaaacaagcaaaatgaccggtgtaacctggtcaccaattgcgtgatcaaaggacgcgaagtcagaaagggccagagcgtgctccggcagtacagaaccgagattcgcatcggcaaggcctcttccgggagccggagactgctgtctgaagagtccggagaagattgtattagccgcacacagctcctgcggaccgagacagctgagatccatggcgacaactacgggggacccggcgataaaatcacgatttgcaatgggtctaccatcgttgaccaaagacttggcagcgaactgggatgttatacaattaaccgcgtgaagtccttcaaactctgcgagaatagcgccaccggcaagtcttgcgaaatcgataacacacctgtcaaatgtaagcaggggttttgcctgaagattacccaggagggacggggccacgtgaaactgtccagagacagcgaggttgtgcttgatgcctgtgactcctcttgcgaaatcatgattcccaaggggacgggagatatcctcgtcgactgtagcggcgggcagcaacatttcctgaaagataatctgatcgacctcggctgccctaacattcccctgcttggaaagatggctatctacatttgtcgcatgtccaatcacccgaaaaccacaatggcctttctgttctggttttctttcggctatgtgattacctgcattctctgtaaggtgatcttttacctgctgatcgttgtcgggacacttggaaagaaattcaagcagtatcgggagctcaaacctcagacctgcacaatttgtgaaaccacgcccgtgaacgcgatcgacgctgagatgcatgatctgaactgcagctacaatatttgcccttattgtgcctccagactgacatctgacggcctcgcccgccacgtgatgcagtgccccaagcggaaagaaaagatcgaggagaccgaactgtaccttaacctggagcggattccgtgggtcgtgagaaagctcctgcaagttagcgaatccaccggggtggctctgaaacgcagctcttggcttatcgtcctcctggtgctgctcacagtttccctgagccctgtgcagtctgcccccatcggacacggcaagaccattgagacgtaccagacaagagaagggtatacctccatctgtctttttgtcctgggcagcattctcttcatcgtgtctcatctgatgaaaggactggttgattccgtgggcaatagctttttccctgggctttccatttgcaagacatgtagcatcggatctatcaacggctttgagattgagagccacaaatgcttctgttccctcttctgctgtccctactgccggcattgttctgctgacaaggaaatccacaaactgcacctgagcatttgcaagaagagaaaagccgggtccaatgtcatgctcgcggtgtgcaagcgcatgtgttttcgggccaccatggaggtgtctaacaaagctctgcttatcagaagcgtcattaatacaaccttcgttgtgtgcatcctgattctcgccgtgtgtgtcgtgtccacgtctgctgttgaaatggagagcctgcccgccggaacctgggaacgcgaggaggatctgacaaacttttgccatcaagaatgtcaggtgaccgagacagaatgcctttgtccttatgaggcgctggtcctcagaaagccgctgttcctcgactccatcgccaaaggcatgaagaatctgcttaacagcacctctctggagacgtccctcagcatcgaagctccctggggcgccattaatgtgcagtctacatttaagcctaccgtttccacagctaacatcgccctgagctggtcctctgtggagcaccgggggaataaaattctggtcagcggacgctccgaaagcatcatgaaacttgaggaaagaaccggcatttcttgggatctgggggtggaggacgcctccgagagcaagctcctgaccgtttctgtgatggatctcagccagatgtactcccccgtcttcgaatatctgtctggagaccggcaagtggaggaatggcctaaggctacatgcacgggcgattgtcccgagcgctgcgggtgtaccagctccacatgccttcataaagaatggcctcactctagaaactggcggtgcaatccgacctggtgttggggagtgggcacaggctgcacctgttgcgggctggacgtcaaggatctctttacggactacatgttcgttaagtggaaagtggagtatatcaagacagaggcgatcgtgtgtgtcgaactgaccagccaggagcgccagtgctccctgattgaagccggaaccagatttaaccttggccccgtgacaatcaccctgagcgagcctcggaacattcagcaaaaactgccccctgaaatcgttacactgcatccccgcattgaggaggggttctttgacctcatgcacgtgcagaaggtcctgtctgcttccacggtgtgtaaacttcagagctgcacccacggagttccgggcgatctccaggtgtaccatatcgggaatctgctcaagggagacaaggtcaacggccacctgatccataaagtggaacctcacttcaatacatcctggatgtcttgggatggctgtgaccttgattactattgcaacatgggggactggcccagctgtacctacacaggagtcacccaacataatcacgccgcctttgtgaacctgctcaatattgagacggattataccaagaacttccacttccattccaaaagagttacagctcacggcgacacaccccagctggatctcaaggcccggcctaattacggggcgggagaagtgaccgtcctggtggaggttgctgacatggagcttcataccaaaaagatcgaaatttctggcctgaaatttgccagcctgacatgcacggggtgctatgcctgttccagcggaatctcttgcaaggtgcgcattcacgtcgatgagcccgacgaactcaccgtgcacgtgaagtccgaggatcctgacatcgttgctgcctctagctccctgatggcgagaaaacttgaatttggcacagacagcacctttaaggctttctctgccatgccgaaaaccagcctgtgtttttacattgtcgagcgggagtattgcaagtcctgttctaaagaagatacacagaagtgcgtgaacgccaagctcgagagaccccaaagcatcctgatcgaacataaaggcacgattatcgggaagcagaatgacacctgtacagctaaagcctcctgctggctcgagagcgtgaagtccttcttttacggactgaaaaacatgctttctggcattttcgggaatgtctttatcggaattttcctgtttctggctcctttcatcctcctgatccttttctttatgttcggctggcgcattctgttttgtttcaagtgctgtcggagaacccgcgggctctttaagtaccggcacctgaaagatgacgaagagacaggatatagaaagatcattgagcgcctcaacaataaaaagggcaaaaacaagctgcttgatggcgaacggctggccgacagaaagatcgcggagctgttcagcaccaaaacgcatattgggtga

SEQ ID NO: 13660 - RNA, 5049 nt, synthetic construct
  misc_feature 1..5049: note = derived and/or modified CDS sequence (opt5) from CCHFV(Oman_812956)__KY362518.1__GP
  source 1..5049: mol_type = other RNA
atgcacaccctgctcgtgtacgccgtcttctgcctgcagctttggagccccggcgggacaagaggactgtccaacgagacgcaacataatgaaaccggcatcacacgggctcctgaggggtctcagggaccgagcctccccgtttccaccgcctctcctattatgagcgacccctccatcacaaccctgtctgcgagcacatccggccttgaagggagcggagataccacgcctcccgctattacccagggccctacactgccggagaccacacccgaaccttctaccacgacaggcaccaacgccttttccacagccatcgctaatgtgagcacccagaccgtgaaggacacacccacgcctaccgtccaaacatctcccccgtccacccctgatgccagcacaattccccaggggacccaccatacggctcgcggactcctgtctgtgacagttaccaaacctgaggaggtgcccacccccacaggccctgaacaggcctccatcgagaccaacagcccgagactggcgacatccaagacgccctctcctagccccaccgcccaggtcacaaccgaaaattccaaccctaatacaagccggcaactcgtgctgtctacccagcccgctacgtccagcccggttacctctcctgcccagcttaacttcgtgcagagcgctacaaccatcgccgtccaagacgcgcacccctcccctacaaatcgctctaaaagaaacctggagatggaggtgattctcaccctgagccaggggcttcggaagtattacggacgcatcctgaaactcctggatctgacgctcgaagaggacacagaaggcctgcttgagtggtgtaagagaaatctggggctgacctgcgatgacaactttttccagaagcggattgaagagtttttcctgacaggagagggccattttaatgaagtgcttcaattcaaaaccccctccaccctgagccctacagagtctgcctccgtcggcctccccacggttgaaccgtttaagagctatttcgctaaagggtttctgtctatcgattccggatacttcagcgccaagtgttatcctcgcgcttccaactctggcctgcagctcattaatgtgacccagcacagcgccagaatcgccgacacacccgggcccaaaattaccaacctgaagacaatcaactgcatcaatcttaaggctctggtgtttaaagagcaccgggaaattgagatcaacgtcctcctgcctcaggtggcggttaatctttccaactgtcatgtgcacattaagtctcatgtctgcgattacagcctggacatcgatggaaccgtgcgcctcccgagaatccaccacgagggcacgttcatccccgggacatataaaatcgttattgacaagaaaaataagcaaaacgaccggtgtaatctggtgaccaactgcgtcatcaaaggacgcgaagtgagaaagggccagtccgtcctgcggcagtacagaaccgagattcgcatcggcaaggccagctctgggtcccggagactcctgagcgaagagtctggagaagattgtatttcccgcacacagcttctgcggaccgagacagctgagatccatggcgacaattacgggggacctggcgataaaatcacgatttgcaacgggagcaccatcgtggaccaaagactcggctctgaactgggatgttatacaattaatcgcgttaagagcttcaaactgtgcgagaactccgccaccggcaagagctgcgaaatcgataatacacccgtgaaatgtaagcaggggttttgccttaagattacccaggagggacggggccacgtcaaactctctagagactccgaggtggttctggatgcctgtgacagctcctgcgaaatcatgattcctaaggggacgggagatatcctggtggactgttctggcgggcagcaacatttcctcaaagataacctgatcgaccttggctgccccaatattcctctgctcggaaagatggctatctacatttgtcgcatgagcaaccaccccaaaaccacaatggcctttctgttctggttttccttcggctatgtcattacctgcattctgtgtaaggtgatcttttaccttctcatcgtggttgggacactgggaaagaaattcaagcagtatcgggagctgaaaccgcagacctgcacaatttgtgaaaccacgcctgtcaacgcgatcgacgctgagatgcatgatctcaattgctcttacaacatttgcccctattgtgccagcagactgacatccgacggccttgcccgccacgtgatgcagtgccctaagcggaaagaaaagatcgaggagaccgaactgtacctcaatctggagcggattccctgggtggtcagaaagctgcttcaagtgtctgaaagcaccggggttgctctcaaacgctccagctggctgatcgtgctgctcgtcctgcttacagtgtctctgtccccggttcagagcgcccctatcggacacggcaagaccattgagacgtaccagacaagagaagggtatacctctatctgtctctttgtgctgggctccattctgttcatcgtcagccatcttatgaaaggactcgtggattctgttggcaactcctttttccccgggctgagcatttgcaagacatgttccatcggaagcatcaatggctttgagattgagtctcacaaatgctactgtagcctgttctgctgtccttattgccggcattgttccgctgacaaggaaatccacaaactccacctgtctatttgcaagaagagaaaagccgggagcaacgtgatgcttgcggtctgcaagcgcatgtgtttccgggccaccatggaggtgtccaataaagctctgctcatcagatctgtgattaacacaacctttgtcgtttgcatcctgattctggccgtgtgtgtggtcagcacgtccgctgtggaaatggagtctcttcccgccggaacctgggaacgcgaggaggatctgacaaatttctgccatcaagaatgtcaggttaccgagacagaatgcctctgtccctacgaggcgctggtgctcagaaagcctctgtttttcgacagcatcgccaaaggcatgaagaaccttctcaattccaccagcctcgagacgtctctgtccatcgaagctccgtggggcgccattaacgtccagagcacatttaagcccaccgtgtctacagctaatatcgccctgtcctggagctccgttgagcaccgggggaacaaaattcttgtgtctggacgcagcgaatccatcatgaagctggaggaaagaaccggcattagctgggatctcggggtcgaggacgcctctgagtccaaactgctcaccgtgagcgttatggatctgtctcagatgtatagccctgtgttcgaatacctttccggagaccggcaagtcgaggaatggcccaaggctacatgcacgggcgattgtcctgagcgctgcgggtgtacctctagcacatgcctgcataaagaatggccccactccagaaattggcggtgcaaccctacctggtgttggggagtgggcacaggctgcacctgttgcgggctcgacgtgaaggatctgtttacggactatatgttcgtcaagtggaaagttgagtacatcaagacagaggcgatcgtgtgtgtggaactgacctctcaggagcgccagtgcagccttattgaagccggaaccagatttaacctgggcccggtcacaatcaccctctccgagccccggaatattcagcaaaaactgcctcccgaaatcgtgacactccatcctcgcattgaggaggggttctttgacctgatgcacgttcagaaggtgcttagcgcttctacggtctgtaaactgcagtcctgcacccacggagtgcccggcgatctgcaggtttaccatatcgggaacctcctgaagggagacaaggtgaatggccaccttatccataaagtcgaaccgcacttcaacacaagctggatgtcctgggatggctgtgacctggattattactgcaatatgggggactggccttcttgtacctatacaggagtgacccaacataaccacgccgcctttgtcaatctcctgaacattgagacggattacaccaagaatttccacttccatagcaaaagagtgacagctcacggcgacacaccccagctcgatctgaaggcccggcccaactatggggcgggagaaatcaccgttcttgtggaggtcgctgacatggagctgcataccaaaaagattgaaatctccggcctgaaatttgcctctctcacatgcacggggtgctacgcctgtagctccggaattagctgcaaggtgagaatccacgttgatgagcctgacgaactgaccgtgcacgtcaagtctgaggatcccgacattgtggctgcctccagctctcttatggcgcgcaaactggagttcggcacagactccacctttaaggctttcagcgccatgcctaaaacctctctctgtttttatatcgtggagcgggagtactgcaagagctgttccaaagaagatacacagaagtgcgttaatgccaagctggagagaccgcaatctatcctcattgaacataaaggcacgatcattgggaagcagaacgacacctgtacagctaaagccagctgctggctggagtccgtcaagagcttcttttacggacttaaaaatatgctgtccggcatcttcgggaacgtgtttattggaatcttcctgtttctcgctcccttcatcctgcttattctgttctttatgttcggctggcgcatcctcttttgtttcaagtgctgtcggagaacccgcgggctgtttaagtatcggcacctcaaagatgacgaagagacaggatacagaaagattatcgagcgcctgaataacaaaaagggcaaaaacaaacttctggatggcgaacggctggccgacagaaagattgcggaactcttctctaccaagacgcatatcgggtga

SEQ ID NO: 13661 - RNA, 5049 nt, synthetic construct
  misc_feature 1..5049: note = derived and/or modified CDS sequence (opt5) from CCHFV(Oman-199809166)__KR864901.1__GP
  source 1..5049: mol_type = other RNA
atgcacaccctgctcgtgtacgccgtcttctgcctgcagctttggagccccggcgggacaagaggactgtccaacgagacgcaacataatgaaaccggcatcacacgggctcctgaggggtctcagggaccgagcctccccgtttccaccgcctctcctattatgagcgacccctccatcacaaccctgtctgcgagcacatccggccttgaagggagcggagataccacgcctcccgctattacccagggccctacactgccggagaccacacccgaaccttctaccacgacaggcaccaacgccttttccacagccatcgctaatgtgagcacccagaccgtgaaggacacacccacgcctaccgtccaaacatctcccccgtccacccctgatgccagcacaattccccaggggacccaccatacggctcgcggactcctgtctgtgacagttaccaaacctgaggaggtgcccacccccacaggccctgaacaggcctccatcgagaccaacagctccagactggcgacatctaagacgccgagcccctcccctaccgcccaggtcacaaccgaaaatagcaaccccaatacatctcggcaactcgtgctgtccacccagcctgctacgagctctcccgttaccagcccggcccagcttaacttcgtgcagtccgctacaaccatcgccgtccaagacgcgcacccttctcccacaaatcgcagcaaaagaaacctggagatggaggtgattctcaccctgtcccaggggcttcggaagtattacggacgcatcctgaaactcctggatctgacgctcgaagaggacacagaaggcctgcttgagtggtgtaagagaaatctggggctgacctgcgatgacaactttttccagaagcggattgaagagtttttcctcacaggagagggccattttaatgaagtgcttcaattcaaaacccctagcaccctgtctcccacagagtccgccagcgtcggcctccctacggttgaaccctttaagtcttatttcgctaaagggtttctgtccatcgatagcggatacttctccgccaagtgttatccgcgcgcttctaacagcggcctgcagctcattaatgtgacccagcactccgccagaatcgccgacacacctgggcccaaaattaccaacctgaagacaatcaactgcatcaatcttaaggctctggtgtttaaagagcaccgggaaattgagatcaacgtcctcctgccccaggtggcggttaatctttctaactgtcatgtgcacattaagagccatgtctgcgattactccctggacatcgatggaaccgtgcgcctccctagaatccaccacgagggcacgttcatcccggggacatataaaatcgttattgacaagaaaaataagcaaaacgaccggtgtaatctggtgaccaactgcgtcatcaaaggacgcgaagtgagaaagggccagagcgtcctgcggcagtacagaaccgagattcgcatcggcaaggcctcttccgggagccggagactcctgtctgaagagtccggagaagattgtattagccgcacacagcttctgcggaccgagacagctgagatccatggcgacaattacgggggacccggcgataaaatcacgatttgcaacgggtctaccatcgtggaccaaagactcggcagcgaactgggatgttatacaattaatcgcgttaagtccttcaaactgtgcgagaacagcgccaccggcaagtcttgcgaaatcgataatacacctgtgaaatgtaagcaggggttttgccttaagattacccaggagggacggggccacgtcaaactctccagagacagcgaggtggttctggatgcctgtgactcctcttgcgaaatcatgattcccaaggggacgggagatatcctggtggactgtagcggcgggcagcaacatttcctcaaagataacctgatcgaccttggctgccctaatattcccctgctcggaaagatggctatctacatttgtcgcatgtccaaccaccctaaaaccacaatggcctttctgttctggttttctttcggctatgtcattacctgcattctgtgtaaggtgatcttttaccttctcatcgtggttgggacactgggaaagaaattcaagcagtatcgggagctgaaaccccagacctgcacaatttgtgaaaccacgccggtcaacgcgatcgacgctgagatgcatgatctcaattgcagctacaacatttgcccttattgtgcctccagactgacatctgacggccttgcccgccacgtgatgcagtgccccaagcggaaagaaaagatcgaggagaccgaactgtacctcaatctggagcggattccttgggtggtcagaaagctgcttcaagtgagcgaatccaccggggttgctctcaaacgcagctcttggctgatcgtgctgctcgtcctgcttacagtgtccctgagccccgttcagtctgccccgatcggacacggcaagaccattgagacgtaccagacaagagaagggtatacctccatctgtctctttgtgctgggcagcattctgttcatcgtctctcatcttatgaaaggactcgtggattccgttggcaacagctttttccctgggctgtccatttgcaagacatgtagcatcggatctatcaatggctttgagattgagagccacaaatgctactgttccctgttctgctgtccctattgccggcattgttctgctgacaaggaaatccacaaactccacctgagcatttgcaagaagagaaaagccgggtccaacgtgatgcttgcggtctgcaagcgcatgtgtttccgggccaccatggaggtgtctaataaagctctgctcatcagaagcgtgattaacacaacctttgtcgtttgcatcctgattctggccgtgtgtgtggtctccacgtctgctgtggaaatggagagccttcctgccggaacctgggaacgcgaggaggatctgacaaatttctgccatcaagaatgtcaggttaccgagacagaatgcctctgtccctacgaggcgctggtgctcagaaagcccctgtttcttgactccatcgccaaaggcatgaagaacctgctcaatagcacctctctggagacgtccctgagcatcgaagctccttggggcgccattaacgtccagtctacattcaagccgaccgtgtccacagctaatatcgcccttagctggtcctctgttgagcaccgggggaacaaaattctggtgagcggacgctccgaaagcatcatgaagctcgaggaaagaaccggcatttcttgggatctgggggtcgaggacgcctccgagagcaaactcctgaccgtgtctgttatggatcttagccagatgtattcccccgtgtttgaatacctgtctggagaccggcaagtcgaggaatggcctaaggctacatgcacgggcgattgtcccgagcgctgcgggtgtaccagctccacatgcctccataaagaatggcctcactctagaaattggcggtgcaaccccacctggtgttggggagtgggcacaggctgcacctgttgcgggctggacgtgaaggatctgttcacggactatatgtttgtcaagtggaaagttgagtacatcaagacagaggcgatcgtgtgtgtggaacttaccagccaggagcgccagtgctccctgattgaagccggaaccagattcaacctcggccctgtcacaatcaccctgagcgagccgcggaatattcagcaaaaactgccccctgaaatcgtgacactccatccccgcattgaggaggggtttttcgaccttatgcacgttcagaaggtgctgtctgcttccacggtctgtaaactgcagagctgcacccacggagtgcctggcgatctccaggtttaccatatcgggaacctgcttaagggagacaaggtgaatggccacctgatccataaagtcgaaccccactttaacacatcctggatgtcttgggatggctgtgacctcgattattactgcaatatgggggactggccgagctgtacctatacaggagtgacccaacataaccacgccgccttcgtcaatctgctcaacattgagacggattacaccaagaattttcacttccattccaaaagagtgacagctcacggcgacacccctcagctggatcttaaggcccggcccaactatggggcgggagaaatcacagttctggtggaggtcgctgacatggagctgcataccaaaaagattgaaatctctggcctcaaattcgccagcctgacatgcacggggtgctacgcctgttccagcggaatttcttgcaaggtgagaatccacgttgatgagcccgacgaacttaccgtgcacgtcaagtccgaggatcctgacattgtggctgcctctagctccctgatggcgcgcaaactcgaatttggcacagacagcaccttcaaggctttttctgccatgcccaaaaccagcctgtgtttctatatcgtggagcgggagtactgcaagtcctgttctaaagaagatacacagaagtgcgttaatgccaagctcgagagacctcaaagcatcctgattgaacataaaggcacgatcattgggaagcagaacgacacctgtacagctaaagcctcctgctggcttgagagcgtcaagtcctttttctacggactgaaaaatatgctgtctggcatctttgggaacgtgttcattggaatctttctcttcctggctccgtttatccttctgattctcttcttcatgtttggctggcgcatcctgttctgttttaagtgctgtcggagaacccgcggactcttcaagtatcggcacctgaaagatgacgaagagacagggtacagaaagattatcgagcgccttaataacaaaaagggcaaaaacaagctgctggatggcgaacggctcgccgacagaaagattgcggagctgtttagcaccaaaacgcatatcgggtga

SEQ ID NO: 13662 - RNA, 5055 nt, synthetic construct
  misc_feature 1..5055: note = derived and/or modified CDS sequence (opt5) from CCHFV(BA66019)__AF350448.1__GP
  source 1..5055: mol_type = other RNA
atgtacaccctgctcgtgtgcgccgtcctgtgtccccagctttggagcctggagggcacacacgttcctcataacgaaacgaagcacaatgggaccggaatcacagctgccccgggcgagtcccaagggcccatgtctcctgcgagcaccgctgtgcccctcacacctgaaccccctaacaccaaaccggccgcctccgcttctgagctggaaagctccggagagggccatacatctcttctggccaccacgcaggggctcaccagccccgaggctacacctgaactgcccaccacaaccgacacgggagtgtccagcacatctgtcgtggatattggcacccagatggccaaggacacacctacctccaccgcgcacacaagcctgccctctaatccgtccgcccctagcacggctcagggcacccatcacacaatcagagggctcctgtctgttacctccacaaaacccgaggaagccagcacccctacggatcccggaaaggctggcgccgagacagggagcccccggcctgcgatttctcgcaaaccgacccttagccccaccgccgaggctcctacagaaatcaacaattccagcacccccaagcaacctgagccctctattcagccggccacaccttccctggtgatcagccccgctcagcctgccttcccccagtctgccacgagcaccgctgcgcaagacatctattcctctcctacaaacagaagcaagcggaatctcaaaatggaaattatcctgaccctttcccagggactgaagaaatactatggcaagattcagaaaacactcgggctgaccctggaggaagatacggagggactcctggagtggtgcaagcgcaaccttggcctgacctgtgacgataactttttccagaagagaatcgaagagtttttcctcacaggcgaagggtactttaatgaggtcctgcaattcaaaacccccagcacaccgggatctaccgaacctacgcacgccgaggctcccacagtgaagccctttaaatcctatttcgcccggggctttcttaccattaatagcgggtacttctctgccaagtgctattcctggacaagcaactccggactgcagctcatcaatgttacccagcatcctgctcgcattgccgacaccccgggccccaaaatcacaaacctgaagacgatcaattgtattaacctgaaagcgtctgtgtttaaggagcacagagaaatcgagattaacgtcctcctgcctcaagtggctgtgaatcttagcaactgccatgtcctgatcaagtcccacgtttgtgattactctctcgacattgatgggaccatccggctgccccgcatctaccacgaaggaacattcattcctggcacctataaaatcgtgattgacaagagagataaacagaatgaccggtgcacacttgtgaccaactgtgtcatcaagggccgcgaggtgagaaaagggcagagcgccctgcggcagtaccgcacggaaattagaatcggaaaggcctccgctggcagccggagactcctgtctgaggagtccggggacgattgcatcagccgcacacaactgctccggaccgaaaccgccgaggttcatggagacaattatggcgggcccggcgataagattacaatctgtaacggatctaccattgtggaccagagactgggctccgaacttgggtgctacacaatcaatcgcgtcaaatcctttaagctgtgcgagaactctggaacgggcaaaagctgtaagattgataaacaccctgtgaagtgccggcaggggttctgtctcaagatcacccaggagggaagaggccatgttaaactgtcccgcgggagcgaagtggtcctggacgcttgcgattcttcctgtgagattatgatccccaagggcacaggagacatccttgtggattgcagcggcgggcaacagcacttcctcaaagacaatctggtcgatctgggatgtccgaacattcctctcctgggcaagatggccatctatatttgccggatgtccaatcatcccaaaaccacaatggcgtttcttttctggttttctttcgggtacgtgatcacctgtatcttttgcaagattatcttctatctgctcattgttgtgggaacgctgggcaagaaatttaagcagtacagagaactgaaacctcagacctgtacaatctgcgagaccacacccaccaacgccattgacgctgaaatgcacgaccttaagtgcagctacaatatctgtccgtattgcgcctcccgcctcacatctgatgggctggctcggcacgtcacccaatgtcctaaaagaaaggagaaagtggaggaaacggagctgtacctcaacctggaacgcattccctggatcgttcggaagctgcttcaggtgagcgagtccacaggcgtcgccctcaagagatctagctggctgatcgtgctgcttgtgctcctgaccgtttccctgagccctgtccagtctgcgcccattggacatggcaaaaccatcgaagcctatcagacacgggaggggtacacctccgtgtgcctcttcatgctgggaggcattctttttgtggtcagctgtctgatgaaggggctcgtggactctgtttccaatagcttctttcccggactgtctatctgcaaaacgtgttccattggcagcgtgaacgggttcgagatcgaatcccacaagtgctattgtagcctgctttgctgtctctactgccgccattgctctgctgatagagagatccaccaactgcacctgagcatttgtaaaaagcggagagccggcggaaacgtcatgctcgctgtgtgcaagcgcatgtgtctgcgggccacaatggaagtttccaataaagtgctttttatcagatctattatcaacaccacattcgtcatttgcatcctggtgctcgccgtttgtattgtgagcacctccgctgtcgagatggaatctctgcctgcgggcacatgggagcgcgaggaagacctgaccaatttctgccatcaggagtgtcaggtgacggaaaccgagtgcctttgtccgtatgaggccctggtgctcagaaagcccctgtttagcgattccatcgtcaaagggatgaagaacctcctgaatagcacaagccttgaaacctccctgagcatcgaggctccttggggagccattaacgttcaatctacattcaaacccaccgtgtccacggccaatatcgctctcagctggtcttccgtggaacaccggggcaacaagattctggtcagcgggcgctccgagtctatcatgaagctggaagagagaacaggaattagctgggaccttggcgtggaggatgcctccgaaagcaaactgctcaccgtttctgtgatggacctgtcccagatgtacagccctgtctttgagtacctctctggcgatcgccaggtggaagagtggcccaaggcgacatgcaccggggactgtcctgatcggtgcggatgcaccagctccacatgtctgcataaagaatggccgcactctagaaattggcggtgcaaccccacgtggtgttggggcgttgggaccggatgcacatgttgcggccttgacgtgaaggatctgttcaccgactatatgtttgtcaaatggaaggtggagtacatcaagacagaggctatcgtttgtgtggaactcaatagccaggagcgccaatgctccctgattgaagccgggaccagattcaacctgggacctgtcacgatcacactttctgagccccggaatattcagcagaaactgcctcccgaaatcattaccctccatccgcgcatcgaggagggctttttcgacctgatgcacgtgcagaaggtgctcagcgcctccaccgtctgtaaactgcaaagctgcacacacggcgttcctggggatcttcagatctatcatattggaaacctgctgaagggcgacagagtgaatgggcacctcatccataaaattgaaccccactttaacacctcttggatgtcctgggatggatgtgacctggattactattgcaacatgggcgactggcccagctgcacatacacgggggtgacccagcataatcacgctgccttcgtcaaccttctgaatatcgagacagattataccaagaactttcacttccattccaaacgggtgacagcgcacggagacacccctcagctcgatctgaaggctagacccacgtacggcgccggcgaaattaccgttctcgtggaggtcgccgacatggagctgcatacaaagaaaatcgctatttctgggcttaagtttgccagcctgacctgtacaggatgctacgcttgttcctctggcatcagctgcaaagtgcgcatccacgttgatgaacctgacgagctgaccgtgcacgtcaagtccgaagatccggacattgtggccgcgtcttcttccctcatggcccggaaactggagttcgggacagacagcacgttcaaggctttttctgccatgcccaagacctccctttgtttctatatcgtcgaaagagagtactgcgagagctgttctaaagaagatacacaaaagtgcgtgaataccaaactggagcagcctcagagcattctcatcgaacataagggaaccattatcggcaaacaaaacgacacatgtacggctaaggcctcctgctggctggagtctgttaagagctttttctatgggctcaaaaatatgctgtccggaatctttggcaacgtgttcattggcatctttcttttcctggccccctttattctgctcatcctgttctttatgttcgggtggcgcattcttttctgttttaagtgctgccggagaacccgcggactgttcaaataccggtatctcaaggatgacgaagagagcggctacagacgcatcatcgagcggctgaataacaaaaaggggaagaataaactcctggatggagaaagacttgctgaccggcgcattgcggagctgttttccacaaagacccacatcggctga

SEQ ID NO: 13663 - RNA, 5055 nt, synthetic construct
  misc_feature 1..5055: note = derived and/or modified CDS sequence (opt5) from CCHFV(SPU 18/88)__KJ682810.1__GP
  source 1..5055: mol_type = other RNA
atgtacacacccctgctctgcgccatcctgtgtcttcagctgtggagcctcgagggcatttatgggctgtccaacaagacccaacacaatgacacgtctaccatcaaagtgcctgaggagagccagaagacatcccttccggctaacaccgcctctcccattacaagcgatccttcctctgcgaccagcacagctctggcctccggacccgaaggcagcggggacacctctacgtcccctagcgtcaccacacagggacccaccctcctggagacaacccctgaaccgcatacgacaatcgatattgacgagtcttccaccgccatcgctgatatcagcacacagaccgttaaagacattcccacccctacaacgcacacctctctgccctccacacctagcgcccccaccatcccgcaagaggctcatcacacagccagaggcctcctgtccgtgacctctacgaagcctggggaaacaagcacccccacctcccctggagaggcgagcacagaagcctctagcccccagcccaccatttccgagacaccttctccgccccctacgacccaggctcccacagagatcaataaccctaataccagccggcagcccatgccgtccacacaacctgccgctcccaactctgtgacccctcccgtccagcctacgttcagccagtccgatgtgagcaccgttgcccaggacattcatccctctccgacaaatcgctccaaaagaaaccttgaaatggagatcattctgaccctcagccaaggcctgaagaagtactatggcaaagtgcttaagctgctcgatctgacactggaagaggacaccgaagggctcctggagtggtgcaaacggaatcttggactgacgtgtgatgacaactttttccagaagcgcatcgaggaatttttcctcacaggcgaggggcactttaatgaagtcctgcagttcaaaaccccttctacactttcccccaccgagcccgcgagagtggaaagccctaccgttgagccgtttaagtcctacttcgccaagggatttctgtctatggatagcggctatttctccgctaaatgctaccccaagtctagcaactccgggctccaactgatcaatgtgacacagcacagcattcggatcacggacacccctggacccaaaattacatctctgaagaccatcaactgtattaatctcaaagccctggtctttaaggagcatcgcgaaatcgagatcaacgtgcttctgcctcaggtggctgtcaacctctccaattgccacgttctgattaaaagccatgcctgtgactattctcttgatatcgacggccccgtgagactgcctcggattcaccacgaaggcacattcatccccgggacctacaagattgtgatcgataagaaaaacaagcagaatgaccgctgcacgctcgtcacaaactgtgtgatcaaaggaagagagattcggaagggccaatccgttctgcgccagtacagaaccgaaatcaaaattgggaaggccagctctggaagccggcgcctgctctccgaggagagcaatgatgactgcctgtctagaacccagcttctgcggacagaaaacgctgagatccattccgataattatggcgggccgggagacaagattaccatctgtaacggcagcacaattgtggatcagagactcggctccgaactggggtgctacacgatcaatcgcgtcaaatcttttaagctgtgcgagaacagcgcgaccggaaaatcctgtgagatcgactctacacctgtgcggtgcagacaaggcttctgtcttaagattacccaggaagggcgcggacacgttaaactcagccggggctccgaggtggtcctggatgcctgcgactctagctgtgaaatcatgattcccaaggggacaggcgacatcctggtggattgctccggaggccagcagcatttcctcaaggacaatctggtcgatcttgggtgtcctaacattcccctgctcggaaaaatggctatctatatctgcagaatgagcaatcacccgaagaccacgatgggctttctgttctggttttctttcgggtacgtgattacctgtatcctgtgcaaagttatcttttatcttctcattgtggtcggaacactgggcaagaaattcaagcaataccgcgagctgaagcctcagacctgtacaatttgcgaaaccaaccccgtgaatgccatcgacgccgagatgcatgatctcaactgctcctataacatctgtccttactgcgctagccggctgacatctgacgggcttgccagacacgttatgcagtgtcccaaacgcaaggagaaaattgaagagaccgaactgtacctcaatctggagcggatcccctgggtggtcagaaagctgcttcaggtgtccgaaagcacgggcgtggcgctcaaaagatcttcctggctggttattctgctcgtcctgcttacagtgagcctgtcccctgtgcaaagcgctccgatctctcacggagagaccgtcgaggtgtatcagacccgggaaggctacacaagcatttgcctctttgttctggggtccatcctgttccttgtgtcttgtctcatgaagggactggtcgatagcgtgggcaactccttttctcccgggctgagcatctgcaaaacctgttccattggatctatcaatggcttcgagattgaaagccataagtgctattgttccctcttttgctgtccttactgcagacactgcagcgccgacatcgagattcataagctgcacctttctatctgtaaaaagcggaaaacggggtccaacgttatgctggccgtgtgcaagcgcatgtgtttcagagctacagtcgaagtgagcaataaagccctcctgattcggaacatcatcaataccacatttgttgtgtgcattctgatccttgctgtctgtgtggtgtctacctccgccgtcgagatggagaacctgcccgcgggcacatgggaaaaggaggaagatctcaccaatttctgccaccaggagtgtcaagttacggagaccgaatgcctgtgtccttatgaggccctcgtgctgagaaagccccttttcctggacagcattgtgaaaggaaagaaaaacctccttaattccacatctctggaaaccagcctttccatcgaggctccttggggcgccattaacgtccagagcacatttaagccgaccgtgtctgctgccaatatcgcgctgtcctggagctctgttgaacatcgcgggaacaaaatcctcgtgagcggacggtccgagtctattatgaagctggaggaaagaacgggcatcagctgggatctcggggtcgaggacgcctccgaatctaagctgcttacagtgagcgttatggatctgtcccagatgtacagccccgtgttcgagtatctctctggagaccgccaggtcgaagagtggcctaaagctacctgcacaggcgactgtcccgagagatgcgggtgcacctccagcacctgtctgcacaaggaatggcctcattcccggaattggcgctgcaaccccacatggtgttggggcgtgggaacgggctgcacctgttgcgggctggatgttaaagacctttttacagattacatgttcgtgaagtggaaagtcgactacattaagaccgaggccatcgtgtgtgtggaactgacatctcaagagagacagtgcagcctcattgaagctggaacccggtttaacctgggcccggtcacgatcacactctccgagcctcgcaatatccagcagaagctgcctcccgagattgttacccttcaccccagaatcgaagaggggttctttgatctgatgcatattcaaaaagtgctgtctgccagcaccgtgtgtaagctccagtcctgcacacacggagtccccggcgacctgcagatctatcacattggcaaccttctgaaaggggataaggtgaatggacatctcatccacaaaattgaacctcatttcaacaccagctggatgtcttgggacggctgtgatctggactactattgcaatatgggggattggccgtcctgcagctacacaggagttacgcagcacaaccatgccgcttttgtgaatatgctcaacatcgagaccgactatacaaagaatttccactttcactctaaacgggtcaccgcgcatggcgatacaccccaactggaccttaaggcccgccctacctacggggctggagagatcacggtgctggttgaagtggccgacatggagctgcacaccaagaaaattgaaatctccggcctcaagttcgccagcctgacatgtaccggctgctatgcttgttctagcgggatttcctgcaaagtcagaatccatgtggatgagcccgacgaacttacagtccacgtgaagtctgaggatcctgacattgttgccgcgagctccagcctgatggctcggaaactcgagtttggaaccgattccacattcaaggccttctctgccatgcccaagacgagcctgtgtttttacatcgtggaacgcgagtactgcaaatcctgttctaaggaagacacccagaaatgcgtcaacacaaagctcgagcagccgcaaagcatcctgattgaacacaaaggcaccatcattgggaagcagaatgatacctgtacaggaaaggctggctgctggcttgagtccatcaaatctttcttttatgggctgaagaacatgctgagcggaattttcggcaatgtgtttatcggcatcttcctctttctggcccctttcattatgcttatcctgtttttcatgtttgggtggcgcattctcttctgtttcaaatgctgccggagaacgcgcggactgtttaagtaccggcatctcaaagacgatgaggaaatcggctatagaaagattatcgagcgcctgaagaacaaaaaggggaaaaataagctgctggacggagaacggctggcggatagaaaaattgctgaactcttctccaccaagacacacatcggctga

SEQ ID NO: 13664 - RNA, 5055 nt, synthetic construct
  misc_feature 1..5055: note = derived and/or modified CDS sequence (opt5) from CCHFV(66019)__AB069669.1__GP
  source 1..5055: mol_type = other RNA
atgtacaccctgctcgtgtgcgccgtcctgtgtccccagctttggagcctggagggcacacacgttcctcataacgaaacgaagcacaatgggaccggaatcacagctgccccgggcgagtcccaagggcccatgtctcctgcgagcaccgctgtgcccctcacacctgaaccccctaacaccaaaccggccgcctccgcttctgagctggaaagctccggagagggccatacatctcttctggccaccacgcaggggctcaccagccccgaggctacacctgaactgcccaccacaaccgacacgggagtgtccagcacatctgtcgtggatattggcacccagatggccaaggacacacctacctccaccgcgcacacaagcctgccctctaatccgtccgcccctagcacggctcagggcacccatcacacaatcagagggctcctgtctgttacctccacaaaacccgaggaagccagcacccctacggatcccggaaaggctggcgccgagacagggtcccccagacctgcgatttctcgcaaaccgacccttagccccaccgccgaggctcctacagaaatcaacaattccagcacccccaagcaacctgagccctctattcagccggccacaccttccctggtgatcagccccgctcagcctgccttcccccagtctgccacgagcaccgctgcgcaagacatctattcctctcctacaaacagaagcaagcggaatctcaaaatggaaattatcctgaccctttcccagggactgaagaaatactatggcaagattcagaaaacactcgggctgaccctggaggaagatacggagggactcctggagtggtgcaagcgcaaccttggcctgacctgtgacgataactttttccagaagagaatcgaagagtttttcctcacaggcgaagggtactttaatgaggtcctgcaattcaaaacccccagcacaccgggatctaccgaacctacgcacacagaggcccccaccgtgaagccctttaaatcctatttcgctcggggctttcttacaattgacagcgggtacttctctgccaagtgctattcccgcaccagcaattccggactgcagctcatcaacgttacccagcatcctgccagaattgctgatacaccgggccccaaaatcacgaatctgaagaccatcaactgtattaatctgaaagcctctgtgtttaaggagcaccgggaaatcgagattaacgtcctcctgcctcaagtggcggtgaaccttagcaattgccatgtcctgatcaagtcccacgtttgtgactactctctcgatattgacgggacaatccgcctgcccagaatctaccacgaaggaaccttcattcctggcacatataaaatcgtgattgataagcgggacaaacagaacgaccgctgcacccttgtgacgaattgtgtcatcaagggcagagaggtgcggcgcgggcagagcgctctgagacagtaccggacagaaattagaatcggaaaagcctccgccggcagccgccggctcctgtctgaggagtccggggatgactgcatcagcagaacccaactgctccgcaccgaaacagctgaggttcatggagataactatggcgggcccggcgacaagattaccatctgtaatggatctacaattgtggatcagcggctgggctccgaacttgggtgctacacgatcaacagagtcaagagctttaaactgtgcgaaaattctggaaccggcaagagctgtaaaattgacaacacacctgtgaagtgccgccaggggttctgtctcaaaatcacccaggagggacggggccacgttaagctgtccagagggagcgaagtggtcctggatgcctgcgactcttcctgtgagattatgatccccaagggcacaggagatatccttgtggactgcagcggcgggcaacagcatttcctcaaagataatctggtcgacctgggatgtccgaacattcctctcctgggcaagatggctatctatatttgccgcatgtccaatcaccccaaaaccacgatggcctttcttttctggttttctttcgggtacgtgatcacctgtatcttttgcaagattatcttctatctgctcattgttgtgggaacactgggcaaaaagtttaagcagtaccgggaactgaaacctcagacctgtacaatctgcgagaccacacccaccaacgcgattgacgccgaaatgcatgatcttaagtgcagctacaatatctgtccgtattgcgcttccagactcacgtctgacgggctggcccgccacgtcacacaatgtcctaaacggaaggagaaagtggaggaaaccgagctgtacctcaacctggaacggattccctggatcgttcggaagctgcttcaggtgagcgagtccaccggcgtcgctctcaaacgctctagctggctgatcgtgctgcttgtgctcctgacagtttccctgagccctgtccagtctgcccccattggacacggcaagaccatcgaagcgtatcagacgagagaggggtacacatccgtgtgcctcttcatgctgggaggcattctttttgtggtcagctgtctgatgaaggggctcgtggattctgtttccaatagcttctttcccggactgtctatctgcaaaacctgttccattggcagcgtgaacgggttcgagatcgaatcccataagtgctattgtagcctgctttgctgtctctactgccggcactgctctgccgacagagagatccatcaactgcacctgagcatttgtaaaaagcgccgggctggcggaaacgtcatgctcgccgtgtgcaaaagaatgtgtctgcgcgctacaatggaagtttccaataaggtgctttttatcagatctattatcaacaccacattcgtcatttgcatcctggtgctcgccgtttgtattgtgagcacctccgccgtcgagatggaatctctgcctgctggcacgtgggagcgggaggaagatctgaccaatttctgccaccaggagtgtcaggtgacagaaaccgagtgcctttgtccgtatgaggcgctggtgctccgcaagcccctgtttagcgactccatcgtcaaagggatgaagaacctccttaattctacaagcctggaaacctccctgagcatcgaggccccttggggagctattaacgttcaatctacgttcaaacccacagtgtccaccgccaatatcgccctcagctggtcttccgtggaacatagaggcaacaagattctggtcagcgggcggtccgagtctatcatgaaactggaggagcgcacaggaattagctgggatcttggcgtggaggacgcttccgaaagcaagctgctcaccgtttctgtgatggatctgtcccagatgtacagccctgtctttgagtacctctctggcgacagacaggtggaagagtggcccaaggcgacctgcacagggaattgtcctgatcggtgcggatgcacgagctccacctgtctgcacaaagaatggccgcattctcgcaactggagatgcaatcccacatggtgttggggcgttgggaccggatgcacatgttgcggccttgacgtgaaggatctgttcaccgactatatgtttgtcaaatggaaggtggagtacatcaaaacggaggccatcgtttgtgtggaactcaacagccaggagcggcaatgctccctgattgaagctgggacacgcttcaatctgggacctgtcaccatcaccctttctgagcccagaaacattcagcagaagctgcctagcgaaatcattacactccacccccggatcgaggagggctttttcgacctgatgcatgtgcagaaggtgctctccgccagcaccgtctgtaaactgcaatcttgcacacacggcgttccgggggatcttcagatctatcacattggaaatctgctgaagggcgacagagtgaacgggcatctcatccacaaaattgaacctcattttaacacgtcctggatgagctgggatggatgtgacctggattactattgcaatatgggcgactggccctcctgcacctacacaggggtgacccagcacaaccatgccgctttcgtcaatcttctgaacatcgagacagattataccaagaattttcacttccactctaaacgcgtgacggcccatggagacacaccccagctcgatctgaaggcgcggcctacatacggcgctggcgaaattaccgttctcgtggaggtcgccgacatggagctgcacaccaaaaagatcgccattagcgggcttaagtttgcttccctgacctgtacaggatgctacgcctgttctagcggcatctcctgcaaagtgagaatccatgttgatgaacccgacgagctgacggtgcacgtcaagagcgaagatcctgacattgtggctgcctcttccagcctcatggcgcgcaaactggagttcgggaccgactctacattcaaggccttttccgctatgccgaaaaccagcctttgtttctatatcgtcgaacgggagtactgcgagtcttgtagcaaggaagatacccaaaagtgcgtgaacacaaaactggagcagccccagtccattctcatcgaacacaagggaacgattatcggcaaacaaaatgacacctgtacagccaaggcttcttgctggctggagagcgttaaatcctttttctatgggctcaagaacatgctgagcggaatctttggcaatgtgttcattggcatctttcttttcctggccccttttattctgctcatcctgttctttatgttcgggtggcgcattcttttctgttttaagtgctgcagacggaccagaggactgttcaaataccgctatctcaaggatgacgaagagtccggctaccggagaatcatcgagcggctgaacaataaaaaggggaaaaacaagctcctggatggagaacgccttgccgacagacggattgctgagctgttttctacaaagacccatatcggctga

SEQ ID NO: 13665 - RNA, 5052 nt, synthetic construct
  misc_feature 1..5052: note = derived and/or modified CDS sequence (opt5) from CCHFV(Gaib)__KX013445.1__GP
  source 1..5052: mol_type = other RNA
atgtacatccccctggtgtatgccgtcatttacctccagctgtatggccttgggggagctcacggcctgctcaacaagaccgagcaaaatgaaacagggatcacggccacccatggaagagttcagggccctccgagcgcgtccattacactgcccgtgacccctgaccccctttctgctacaagcgccgcctccacctctgggcctgagggaagcggcgaagtgcccacatccccttctaccatcacgcagggcctgaccagctccgagaacacaccgcagctccccaccgctacagataccgggattagctctacgtccatcatcgacgtcagcacacaaaccgccggagatacatctacccctaccgctcacacatccctgcccaatagcccttctgcccccttcacgtcccaggacacccggcatacagtgcgcggcctgctcaccgttacaagcaccaaatccgatgaagcgtctacgctgacagacccgaaggaggccagcaccgaggctagatcccctagcccctctatttcccggacccctacacccagccccaccgtgcaggcctctacagaaaacaatacgcctagcaccccgcgccagcccgagcctacaaccagacccgcccttccttcccccacaacctctccgacgcaacctagcctgtcccagagcgctacctctgcggccatccaggatatgcacccctcccctacaaaccggagccgcagaaatctcgaaatggagattatcctgaccctttctcaggggctgaaaaagtactatggaaaaattctcaagctgctggacctcacactggaggaagataccgagggccttctggaatggtgcaagcggaacctcgacctgacgtgtgatgagaactttttccttaaacgcatcgaagagtttttcctgtccggggagggacattttaatgaagtcctccaattcaaggctcccagcacaatgtcctctaccgagcctacacacgccgggcccccgaccgtggaaccttttaaaagctacttcgctaagggctttctgtccattgactctggctatttcagcgccaaatgctaccccagaacctccaatagcggactgcagctcatcaacgttacacagcacacggcccggatcgctgatacccccggccctaagattacaaatgtgaagaccatcaactgtattaatctgaaagcgtctgtctttaagaaacatcgcgaggtggaaatcaacgtgcttctgccgcaaattgccgtcaacctctccaattgccacgttctgatcaagagccatgtgtgtgactactctcttaacttcgacgggatggtgagactgccccggatccaccacgagggaacatttattcctggcacctataaaatcgtcattgatcgcaagaataaacagaacgacagatgcacgctcgtgacaaattgtgttatcaaggggcgggaggtgagaaagggacagtccgctctgcgccagtaccggaccgaaattaaaatcggcgaggccagcatcggctctagacgcctgctcagcgaagagtccagcgatgactgcatttctcggacccaactgcttagaacagaaaccgccgagatccataacgataattatgggggacccggcgacaagattacaatctgtaacgggtccacgattgtcgatcagcgcctgggaagcgagctcggctgctacaccatcaatcgggtgaaatccttcaagctgtgtgaaaactctgctacagggaaaagctgcgagattgactccatccctgttaagtgcagacagggcttctgtctgaagatcacccaggaaggacgcggccacgtgaaactttctcgggggagcgaggtcgtgctcgatgcctgcgactcctcttgtgagattatgatccccaagggaacaggcgatattctggtcgactgcagcgggggacaacagcattttctgaaagacaatctcatcgatctgggctgtcctaacattccccttctggggaagatggcgatctatatctgcagaatgtccaatcacccgaaaaccacgatggctttcctcttttggttcagctttggctacgtgattacctgtatcttctgcaaggccatcttttatctgctgattattgttggaacacttggcaagaaattcaagcagtaccgcgaactcaaacctcagacctgtacaatctgcgagaccacacccgtgaacgccatcgacgctgaaatgcatgatctgaattgttcttacaacatttgcccttattgcgcctcccggctgaccagcgacgggctcgctagacacgtcgtgcactgtcccaagcggaaagagaagatcgaagagacggagctgtaccttaacctggaacgcgttccgtgggtggtcagaaagctcctgcaagtgtctgagtccacaggagtggccctgaaacggagctcttggcttattgttctcctggtcctgctcaccgtgtccctgagccctgtgcagtccgcgcccatcggccatgggaagaccattgaaacatatcagaccagagagggatacacgagcatctgcctttttgtcctgggcgggatcctcttcattgtgtcttgtctgatgaaaggcctggttgatagcgtgggaaataactttttccctggccttacaatctgcaagacctgttccatttctagcatcaatgggtttgaaattgagtcccacaaatgctattgttctctcctgtgctgtccctactgccgccattgtagcgccgaccgggagatccaccagctgcacctctccatttgcaagaaaagaaagacaggatctaacgtcatgctggctgtgtgcaagcgcatgtgtcttagagttaccacagaagtgagcaatcgggccctgttcatccgctccatcattaacaccacgttcgtcatctgcattctcatcctggctgtgtgtgttattagcacctctgccgtggagatggaaaatctgcccgcgggcacatgggagagagaagaggatcttaccaacttttgccatcaagagtgtcaggtcacagaaaccgagtgcctgtgtccttatgaagccctcgtgctgcggaaacccctcttctccgacagcatcgtgaaggggatgaaaaatctgcttaactctacgtccctggagacaagcctctccatcgaggctccctggggagccattaatgtccagtctacctttaagcctacagttagcaccgctaacatcgccctgtcctggagctctattgaacaccgcggcaataaaatcctggtgtccgggagaagcgagtctattatgaaacttgaggaacggaccggcatcagctgggatctgggagtggaagacgcctccgagtctcgcctcctgacagtcagcgtgatggatctctcccaaatgtactctcccgttttcgagtacctgagcggcgacagacaggtggaagagtggcctaaggctacgtgcaccggggattgtcccgaacggtgcggatgtacatcctctacctgccttcataaagagtggcctcacagccgcaactggagatgcaatccgacatggtgttggggcgtcgggaccggatgcacgtgttgcggcctggacgtgaaggacctctttacagattatatgttcgttaaatggaaggtggaatacatcaaaaccgaggcgattgtctgtgtggagctgacctcccaggaacggcagtgcagcctgatcgaggccggcacaagatttaaccttgggcccgttaccattacactgtccgaacctcgcaacatccaacagaagctcccgcctgagattatcacgctgcatccccggattgaagagggattctttgacctcatgcacgtgcagaaggtcctgtctgctagcaccgtgtgtaaacttcagtcctgcacacacggcgtgccgggggatctgcaagtctatcatatcggaaatctgctcaagggcgacaaagttaacgggcacctgatccataagattgagcctcacttcaatacctcttggatgagctgggatggatgtgaccttgattactattgcaacatgggcgactggccctcctgtacatacaccggcgtgacgcagcataatcacgccgcctttgtgaacctgctcaatatcgaaaccgattatacaaagaacttccactttcatagcaagagagtcaccgctcacggggacacaccccagctggatctcaaggcccgccctacctacggagcgggcgagattacagtgctggttgaagtggctgacatggagcttcatacgaaaaagatcgagatttctgggctgaaattcgcctccctgacctgcacaggatgctacgcctgtagctctggcatctcctgcaaggtccggatccacgtggatgaacccgacgagctcaccgttcacgtgaaaagcgaagaccctgatattgtcgctgcctctagctccctgatggcgagaaaacttgagttcgggaccgactctacatttaaggctttcagcgccatgccgaagacgtccctgtgtttttatatcgtggaacgcgagtactgcaagagctgttcccgggaggatacccagaaatgcgtctctacaaagctcgaacaaccccagagcattctgatcgagcataaaggaaccattatcggcaagcagaataacacatgtaccacgaaaacaacctgctggctcgaatccgtgaagtctttcttttatggcctgaagaatatgcttagctccatcttcgggaacgtttttgtgggaattttctcttttctggcccctttcatcctgctcattctgtttttcatgttcggctggagaatcctgttttgtttcaaatgctgtcgccggaccagagggctttttaagtaccggcacctcaaagacgatgaggaaacaggatatcgcagaattatcgagcggctgaataacaagaaaggcaagagcaagctcctggacggggagcgccttgctgatagaaaaattgccgaactgttctccaccaagacacatatcggatga

SEQ ID NO: 13666 - RNA, 5055 nt, synthetic construct
  misc_feature 1..5055: note = derived and/or modified CDS sequence (opt5) from CCHFV(SPU415/85)__DQ211635.1__GP
  source 1..5055: mol_type = other RNA
atgtacacacccctggtgtgcgccgtcatctgtctccagctgtggaaccttggcgggacactggttttcattaatagaacgcaacacaacgagaccggaacagtggctacccctgaaggcacactccggccgcgcctgcccgtgagcaccgcccttcctacaaagtccgacagaccctctgtcgggcctgcggctagctcctctggactggagggcagcggggaacccaatacctccccttctatcacgaccaaaggactcacaccgcccgagaccacccctgccctgcccaccgccacggatacagacgctagctccaccggcgtggttgatgtgagcacacagatgaccaaggacattcctatgtctaccgcctatacaaatcccccgtccacgcctagcgctccctctacccctcagggcacacatcacaccgcccgggggctgctctccgtcgcgagcacaaaatctgaagaggtgtccatgagcacctcccccgccaagacgtctacagagaccagctcccctcccccggctaccagcgaaacacccaccccttctcccacaacgcaggttcctaccggaaacaacaatcccaacacatcccgccaaccgacccctagcgcccagcccgctatgtctaatcctgccacaagccccgcgcagcctaacctgtcccagtctgctcccccgaccgccgatcaaggcgtgcatcctagccccacgaatagatccaaacggaaccttgagatcgaaattatcctgaccctcagccaggggctgcgcaagtactatggaaagatccttaaactgctcgacctgacactggaggaggataccgaaggcctcctggagtggtgcaagagaaatcttgggctgacatgtgacgataactttttccagaaacggattgaagagtttttcctcaccggagaaggctactttaatgaggtcctgcagttcaaggtgccctctacgctttccagcacagagcctacccacacacgcccgcccaccgtggaaccttttaaatcttatttcgccaagggctttctgtccatgaacagcgggtacttctccgctaagtgctatcccagaacctctaacagcggactccaactgatcaatgtcacaaaacattccgccaagattgccgacacgcctggccccaaaatcaccaacctgaagacaattaattgtatcaacctccgggcttctgtttttaaagagcaccgcgaagtggagattaatgtgctgcttcctcaggtcgcggtgaacctgagcaattgccacgcccagatcaagtcccatgtttgtgattacagcctcgctaccgacgggatggtgagactgccccacatccatcacgaaggaacattcattccgggcacctacaaaatcgtcattgataagaagaacaaacaaaatgaccggtgcacgcttgtgacaaactgtgttatcaaggggcgcgaggtgagaaaaggacagtctgccctgcggcagtataagaccgagattagaatcggcaaagcctccagcggctctcgccggctcctgtccgaagagagcgacggggattgcatctctagaacccagctgctccgcacagaaaccacagagattcacagcgacaattacggaggccctggggataagatcacgatttgtaacggatccaccatcgtcgaccaacggctgggcagcgaacttgggtgctatacaattaatagagtgaagtcttttaaactgtgcgagaactccgctaccggcaagagctgtgagatcgattccacacccgtcaaatgccgccagggattctgtctcaagatcacccaggaaggccgggggcatgtgaaactgtctagaggaagcgagattgttctggacgcctgcgattccaattgtgaaatcatgattcctaagggcacgggggacatccttgtggattgctctggaggccagcaacacttcctcaaggacaacctgattgatctggggtgtcccaacatcccgctcctgggcaaaatggcgatttacatctgccgcatgagcaatcatcctaagaccacaatggcttttcttttctggttttccttcggatatgtcatcacctgtattctgtgcaaagtgatcttttacctcctgattgttgccggcacagtggggaagaaattcaagcagtatcgggagctgagaccccagacctgtacaatctgcgagaccattcctgtcaacgccatcgacgctgaaatgcacgaccttaattgctcttacaacatctgtccctactgcgccagccgcctcacgtccgatggactggctcggcatgtgatgcagtgtcccaagagaaaagagaaggtggaagagacagaactgtatctcaatctggagcggattccttgggttgtccgcaaacttctgcaagtgagcgagtctaccggcgtggccctcaagagatccagctggctgaccgtcctgcttgtgctcctgatcgtttctctgtccccggtgcagagcgcgcccattgggcacggaaaaacaatcgaaacctaccaggcccgggagggctatacgtctttttgcctcttcattctggggtccatcctttttgtcgtgagctgtctggttaagggcctcatcgactccgtgggaaacagcttctttcctggcctgtctatttgcaaaacatgtagcatcgggtccattaatggattcgaaatcgagtctcacaagtgctactgtagcctgttttgctgtccctattgcagacattgctccgctgatcgcgaaattcacaaacttcatctctctatctgtaagaagcggaaaaccggcagcaacgtcatgctggccgtgtgcaagagaatgtgtttccgcgctacaatcgaggtttccaatagagccctgctcattcggaacatcattaataccacattcgtggtctgcatcctgacccttgcggtgtgtgtggtctctacgagcgccgttgagatggaatccctgcctgctgggacctgggagaaagaagaggacctcacaaacttttgccaccaggaatgtcaagtgaccgagacagagtgcctgtgtccctacgaagccctggtgcttcgcaagcctctgttcctcgatagcattgtcaagggaatgaaaaatctgctcaactctacctccctggagacgagcctttctatcgaagctccgtggggcgccattaatgtgcagtccacatttaagcccaccgttagcgccgctaacatcgcgctgtcctggtctagcgtggagcacagagggaacaaaatcctcgtctccggccggagcgagtctattatgaagctggaggaacgcacaggaatctcctgggacctgggcgtggaagatgccagcgagtctaaacttctgaccgttagcgtgatggacctctcccagatgtattctcctgtcttcgaatacctgagcggggatagacaagtggaggagtggcccaaggctacctgcacaggagactgtcctgaacggtgcggctgcacgtcctctacctgtctccataaggagtggccccacagccgcaattggagatgcaacccgacatggtgttggggagttgggaccggctgcacatgttgcggcctggatgtgaaagacctttttaccgattacatgttcgtcaagtggaaagtggaatatattaagacggaggccatcgtgtgtgtcgaactgacatcccaggagcggcagtgcagcctcattgaggccgggacccgctttaatctgggacctgttaccatcacactgtctgaacccagaaacatccagcaaaaacttccccctgagattatcaccctgcatccccggattgaagagggcttctttgacctcatgcacgtgcagagagtgctgtccgctagcacagtctgtaagctccagtcctgcacgcatggggtgcctggagacctgcaggtttaccacatcggcaatcttctgaagggggataaagtgaacggacacctgattcataagatcgaaccgcacttcaatacctcttggatgagctgggacggctgtgatctcgactattactgcaacatgggcgattggccctcctgcacatataccggggtcacacaacataatcacgccgcgtttgtgaacctgcttaatatcgagaccgactacacgaaaaacttccattttcactctaagcgcgttaccgctcacggagatacacctcagctggacctcaaagcccggcccacctatggcgccggggaggtgacagtcctggtggaagtcgctgatatggagctccataccaagaaaattgaaatcagcggactgaagttcgcctcccttacatgtacgggctgctacgcgtgtagctctgggatttcctgcaaggtgaaaatccacgttgacgagcctgatgagctgaccgtgcatgtcaagagcgaagaccccgatattgtggctgccggatcttccctgatggccagaaaactcgagttcggcgctgacagcacatttaaggccttctctgctatgccgaaaaccagcctgtgtttttacatcgttgaacgcgagtattgcaagtcctgttctcgggaagacaccagaaagtgcgtgaatacaaaacttgatcgccctcagagcattctgatcgagcacaagggcacgatcattgggaaacagaacaatacctgtacagccaaggcgtcctgctggctcgagagcgtcaaatccttcttttacggactgaagaacatgctctctggcatcttcgggaacgtgtttattggaatcttcctgtttattgcccccttcgtgcttctgatcctgtttttcatgttcggctggcggatcctcttttgtttcaagtgctgcagacgcacccgggggctgtttaaatatagacaccttaaggacgatgaagagacaggataccggaaaattatcgaacgcctgaataacaagaaaggcaagaataagctcctggacggcgagagactcgctgatcggaaaattgccgaactgttcagcaccaagtcccatatcgggtga

SEQ ID NO: 13667 - RNA, 5055 nt, synthetic construct
  misc_feature 1..5055: note = derived and/or modified CDS sequence (opt5) from CCHFV(SPU 431/85)__KJ682812.1__GP
  source 1..5055: mol_type = other RNA
atgtacacacccctggtgtgcgccgtcatctgtctccagctgtggaaccttggcgggaccctggttagcacgaatagaacccaacacaacgagacaggaaccgtggctacacctgaaggcaccctccggccgcgcctgcccgtgtccacagcccttcctaccaagtctgacagacccagcgtcgggcctgcggcttcctctagcggactggagggctccggggaacccaatacgtctcctagcattaccacaaaaggactcaccccgcccgagacaacccctgccctgcccacggccacagataccgacgcttccagcacaggcgtggttgatgtgtctacccagatgaccaaggacatccctatgtccacagcctatacgaatcccccgagcaccccttctgctccctccacacctcagggcacccatcacacagcccgggggctgctcagcgtcgcgtctaccaaatccgaagaggtgagcatgtccacgtctcccgccaagacaagcaccgagacctcctctccccctccggctacatctgaaacccccacaccttcccccacgacccaggttcctacaggaaacaacaatcccaacaccagccgccaaccgacaccttctgcccagcccgctatgagcaatcctgccacctcccccgcgcagcctaacctgtctcagagcgctcccccgacggccgatcaaggcgtgcatccttcccccaccaatagaagcaaacggaaccttgagattgaaatcattctgacactctctcaggggctgcgcaagtactatggaaagatccttaaactgctcgacctgaccctggaggaggatacagaaggcctcctggagtggtgcaagagaaatcttgggctgacctgtgacgataacttctttcagaaacggatcgaagagttctttctcacgggagaaggctacttcaatgaggtcctgcagtttaaggtgccctccacacttagctctaccgagcctacacacacccgcccgcccaccgtggaacctttcaaatcctattttgccaagggcttcctgagcatgaactccgggtacttttctgctaagtgctatcccagaacaagcaactccggactccaactgattaatgtcacgaaacattctgccaagatcgccgacacccctggccccaaaattacaaacctgaagaccatcaattgtattaacctccgggctagcgttttcaaagagcaccgcgaagtggagatcaatgtgctgcttcctcaggtcgcggtgaacctgtccaattgccacgcccagattaagagccatgtttgtgattactctctcgctacagacgggatggtgagactgccccacatccatcacgaaggaacctttatcccgggcacgtacaaaattgtcatcgataagaagaacaaacaaaatgaccggtgcacacttgtgaccaactgtgttattaaggggcgcgaggtgagaaaaggacagtccgccctgcggcagtataagaccgagatcagaattggcaaagccagctctggctcccgccggctcctgagcgaagagtctgacggggattgcatcagcagaacacagctgctccgcaccgaaacaacggagatccactccgacaattacggaggccctggggataagattaccatctgtaacggaagcacaattgtcgaccaacggctgggctctgaacttgggtgctataccatcaatagagtgaagtccttcaaactgtgcgagaacagcgctacaggcaagtcctgtgagattgattctacccccgtcaaatgccgccagggattttgtctcaagatcacgcaggaaggccgggggcatgtgaaactgagcagaggatccgagatcgttctggacgcctgcgattctaattgtgaaattatgatccctaagggcaccggggacattcttgtggattgcagcggaggccagcaacacttcctcaaggacaacctgatcgatctggggtgtcccaacattccgctcctgggcaaaatggcgatctacatttgccgcatgtccaatcatcctaagacaaccatggctttcctgttttggttctcttttggatatgtcatcacatgtatcctttgcaaagtgattttctacctcctgatcgttgccggcaccgtggggaagaaatttaagcagtatcgggagctgagaccccagacatgtaccatttgcgagacgatccctgtcaacgccattgacgctgaaatgcacgaccttaattgcagctacaacatctgtccctactgcgcctcccgcctcacaagcgatggactggctcggcatgtgatgcagtgtcccaagagaaaagagaaggtggaagagaccgaactgtatctcaatctggagcggatcccttgggttgtccgcaaacttctgcaagtgtctgagtccaccggcgtggccctcaagagaagctcttggctgacagtcctgcttgtgctcctgattgtttccctgagcccggtgcagtctgcgcccatcgggcacggaaaaaccattgaaacgtaccaggcccgggagggctatacatccttctgcctctttatcctggggagcattcttttcgtcgtgtcctgtctggttaagggcctcatcgacagcgtgggaaacagctttttccctggcctgagcatctgcaaaacctgttccattgggtctatcaatggatttgaaattgagagccacaagtgctactgttccctgttctgctgtccctattgcagacattgccctgctgatcgcgaaatccacaaacttcatctctctatttgtaaaaagcggaaaacaggcagcaacgtcatgctggccgtgtgcaagagaatgtgttttcgcgctaccatcgaggtttccaatagagccctgctcatccggaacattatcaatacaaccttcgtggtctgcattctgacgcttgcggtgtgtgtggtctctaccagcgccgttgagatggaatccctgcccgctgggacatgggagaaagaagaggacctcaccaacttctgccaccaggaatgtcaagtgacagagaccgagtgcctgtgtccttacgaagccctggtgcttcgcaagccgctgtttctcgatagcatcgtcaagggaagaaagaatctgctcaactctacgtccctggagacaagcctttctattgaagctccctggggcgccatcaatgtgcagtccaccttcaagcctacagttagcgccgctaacattgcgctgtcctggtctagcgtggagcaccgggggaacaaaatcctcgtctccggccgcagcgagtctatcatgaagctggaagagagaaccggaatttcctgggacctgggcgtggaagatgccagcgagtctaaacttctgaccgttagcgtgatggacctctcccagatgtattctcccgtctttgaatacctgagcggggatcggcaagtggaggagtggcctaaggctacatgcacgggagactgtcccgaacgctgcggctgcacctcctctacatgtctccataaggagtggccgcacagcagaaattggcggtgcaaccctacctggtgttggggagttgggacaggctgcacctgttgcggcctggatgtgaaagaccttttcacggattacatgtttgtcaagtggaaagtggaatatatcaagacagaggccattgtgtgtgtcgaactgacctcccaggagcgccagtgcagcctcatcgaggccgggaccagattcaatctgggacccgttacaattaccctgtctgaaccccggaacatccagcaaaaacttcctcccgagatcattacactgcatcctagaatcgaagagggctttttcgacctcatgcacgtgcagcgcgtgctgtccgctagcacggtctgtaagctccagtcctgcacccatggggtgccgggagacctgcaggtttaccacattggcaatcttctgaagggggataaagtgaacggacacctgatccataagattgaaccccactttaatacatcttggatgagctgggacggctgtgatctcgactattactgcaacatgggcgattggccttcctgcacctatacaggggtcacccaacataatcacgccgcgttcgtgaacctgcttaatatcgagacggactacaccaaaaactttcatttccactctaagcgggttacagctcacggagatacaccccagctggacctcaaagccagacctacctatggcgccggggaggtgaccgtcctggtggaagtcgctgatatggagctccatacaaagaaaatcgaaattagcggactgaagtttgcctcccttacgtgtaccggctgctacgcgtgtagctctgggatctcctgcaaggtgaaaattcacgttgacgagcccgatgagctgacagtgcatgtcaagagcgaagacccggatatcgtggctgccggatcttccctgatggcccgcaaactcgagttcggcgctgacagcaccttcaaggccttttctgctatgcctaaaaccagcctgtgtttctacattgttgaacgggagtattgcaagtcctgttctagagaagacacacgcaagtgcgtgaatacgaaacttgatcggccccagagcatcctgattgagcacaagggcaccatcatcgggaaacagaacaatacatgtaccgccaaggcgtcctgctggctcgagagcgtcaaatcctttttctacggactgaagaacatgctctctggcatttttgggaacgtgttcatcggaatttttctgttcatcgccccttttgtgcttctgattctgttctttatgttcggctggagaatcctcttctgttttaagtgctgccgccggacaagagggctgttcaaatatcggcaccttaaggacgatgaagagaccggataccgcaaaatcattgaaagactgaataacaagaaaggcaagaataagctcctggacggcgagcggctcgctgatcgcaaaatcgccgaactgtttagcacgaagtcccatattgggtga

SEQ ID NO: 13668 - RNA, 5055 nt, synthetic construct
  misc_feature 1..5055: note = derived and/or modified CDS sequence (opt5) from CCHFV(8402)__AB069674.1__GP
  source 1..5055: mol_type = other RNA
atgtacacacccctgctctgcgccgtgctgtgtcttcagctgtggagcctcgagggctcccacgggctgtctaacaagacccaacatagcaatacgtccaccacaaaagctcctgaagtctctcaggagcttggactgccggttagcaccgtgtccacaatcacctctgatccccctagcattacatccgccgtgagcgtctctggctccgaagggagcggagacaccaacacgtctccctccgtgaccacacagggccctaccctccccgagacaaccctggaacctctgacgacaaccgacacagatgcgagctctaccgttgtggtcgacgtgtccacccagacagttaaggatacgccgatcagcaccacatatacctccctcccctctacacctagcgagcccaccacgcctcaagggacacaccataccgctagaggactgctttccgtgaccagcacaaaacccgaggaagcctctacccaggccaatccgggcaagatttccatggagacaaacggccctcggctggctatcagcgaaacgccctctttcagccctaccacacaggcccccaccgaaaattccaaccccattacatctaaacagctcatgctgagcgctcaacctgtcaccccgaatcccatgacgtcccctgtgcagcccgcccttagccagtctgacacctccacagcgatccaggatgtgcaccctagccccaccgggcgctctaagagaaacctggagatggaaatcattctcacactgtcccaaggactgaagaaatactatggcaagatcctcaaactgcttgacctgaccctcgaggaagatacggaggggctgcttgaatggtgcaagcggaatctgggactcgtctgtgacgataactttttccagaaacgcattgaggagtttttcctgacaggcaaggggcattttaatgaagttctgcagttcaagaccccgagcacactctcccctaccggacccgccagaaccggctctcctacagtggagccctttaaaagctacttcgctaagggctttctgtccatggactctgggtatttcagcgccaaatgctaccctcgggcttccaacagcggacttcaactgatcaatgtgacgcagcactctacccgcattacagatacccccggcccgaagatcacaaacctcaaaaccattaattgtatcaacctgaaggcctccgtctttaaagaacacagagagatcgaaattaacgtgcttctgcctcaggttgcggtgaatctcagctcttgccatgtcctgatcaagtcccacgtgtgtgactatagcctggacattgatgggcccgttcggctcccccgcatccatcacgagggaacgttcattcctggcacatacaagatcgtgatcgacaaaaagaacaaacagaatgatagatgcaccctggtcaccaactgtgtgattaaggggcgggagatccgcaaaggacaatctgtccttagacagtaccggacagaaattaagatcggcaaggccagctccggcagccgcagactgctctctgaggaatccggggacgattgcattagccggacccagctgctgagaacagagacggctgaaatccacaatgacaactatggaggcccgggggataaaatcaccatttgtaatggatccacagtggttgaccagcgccttggctctgagctcgggtgctacaccatcaaccgggtcaagagctttaaactgtgcgaaaattccgccacaggcaagtcttgtgaaattgatagcacccccgtgaaatgcagacaaggattctgtctgaagatcacgcaggagggccgcgggcatgtgaagctctcccggggatctgaagttgtgctggacgcttgcgatagctcctgtgagattatgatccctaaaggcaccggggacattcttgtcgactgcagcggaggccagcagcacttcctgaaggataacctcatcgacctggggtgtcccaatatccctctgcttggcaaaatggccatttatatctgcagaatgtctaaccatcccaagacaaccatggcctttctcttctggttttccttcggatacgtggtgacatgtattctgtgcaaagttatcttttatctgctcattgtcgtgggcaccctggggaagaagttcaaacaataccgcgagcttaagcctcagacatgtaccatctgcgaaacgacacccgtgaatgctatcgatgcggagatgcacgacctgaactgcagctataatatttgtccgtactgcgcctctcggctcacctccgatggactggctagacatgtcatgcagtgtcctaaacgcaaggagaaaatcgaggaaaccgagctgtaccttaacctcgagcggattccctgggtggttagaaagctgcttcaggtgagcgaatctacaggcgtcgccctcaaacgctccagctggctggtggttcttctggtgctcctgaccgtctccctgagccctgtgcaatctgcccccatcgggcacggaaagacggttgagacatatcagacccgggaaggctacacaagcatttgcctttttgtgctcgggtccatcctgttcatcgtctcttgtctgatgaagggcctcgtggacagcgtgggaaactcctttttcccgggcctgtctatttgcaaaacctgtagcatcgggtccgtcaatggatttgagattgaatctcacaagtgctattgtagccttttctgctgtccttactgcagacattgctccgctgatcgggagatccaccgcctgcatctcagcatttgtaaaaagagaaaaacaggctctaacgttatgctggccgtgtgcaagcggatgtgttttagagcgaccgtggaggtctccaataaggctctgcttatccgcaacatcattaatacgaccttcgtgctgtgcatcctcattctggccgtttgtgtggtcagcacatctgccgtggaaatggagtccctccccgctgggacctgggaacgggaggaagacctgacaaacttctgccaccaggagtgtcaagttaccgagacggaatgcctttgtccttatgaggccctggtgctcagaaaacccctgtttagcgattccatcgtcaagggaatgaaaaatctgcttaactctacaagcctggaaacctccctcagcattgaggctccctggggcgccatcaatgtgcagtctacattcaagcctaccgtttccgcggccaacattgctctgagctggtctagcgtggagcaccgcgggaataaaatcctcgtctccggcagatctgaaagcatcatgaagctggaggaacggaccggaatttcctgggaccttggcgtggaggatgcctctgaaagcaagctgctcacagtgtccgtcatggacctgagccagatgtactctccggtttttgagtatctgtccggggatcgccaggtggaggaatggcccaaagctacgtgcaccggagactgtcctgagagatgcggctgcacaagctccacctgtcttcataaggaatggccccactctcggaactggcgctgcaatcctacatggtgttggggagtggggaccggctgcacgtgttgcggcctggacgtcaaagatctcttcacagactacatgtttatcaagtggaaagtggagtacattaagaccgaagccatcgtttgtgtggagctgaccagccaagagagacagtgcacactcattgaagcggggacccggttcaacctgggacccgtcacaatcacgctttccgagcctcgcaatatccagcagaagctgccgcccgaaattgtgaccctgcatcctagaatcgaggaaggctttttcgatctcatgcacgttcaaaaagtgctgtctgccagcacagtctgtaagctgcagtcctgcacccatggggtgcccggagacctgcaggtctatcacattggcaacctcctgaaaggggataaggtgaacggacacctcatccataaaattgagcctcactttaatacaagctggatgtcttgggacggctgtgatctggactactattgcaacatgggcgattggccctcctgcacctacacgggggttacccagcataatcacgctgccttcgtgaacatgcttaatatcgagacagactataccaagaactttcatttccacagcaaacgggtcacagctcacggagataccccgcaactggacctgaaggcccgccctacatacggcgccggggaaatcacggtgctcgttgaggtggctgatatggaactgcataccaagaaaattgagatctctggacttaagtttgcgtccctgacatgtaccggctgctatgcctgtagctctgggattagctgcaaagtcagaatccacgtggacgagcccgacgaactcaccgtgcatgttaagtccgaggatcccgacattgtcgctgcctctagctccctgatggcccggaaactcgagttcggaacagatagcacgttcaaggctttttccgccatgcctaagacctctctgtgtttctacatcgtggagagagaatactgcaaaagctgttccaaggaggacacacagaaatgcgtgaataccaaacttgagcagccccaatctattctgatcgaacacaaaggcacaatcattggcaagcagagcaacacctgtacggcgaaggcttcctgctggctggagtctgtcaagagctttttctatgggctcaagaatatgctgtccggaatctttggcaacgtgttcattggggtttttcttttctttgcccctttcatcctgctcattctgtttttcatgttcggatggcgcatcctcttttgtttcaaatgctgccggagaacacgcggcctgtttaagtaccggcaccttaaagatgacgaagagaccgggtatagaaagatcattgaacgcctgaataacaagaaaggaaagaataaactgctcgatggcgagcggctggccgacagaaagatcgctgagcttttcagcaccaaaacacatattggctga

SEQ ID NO: 13669 - RNA, 5055 nt, synthetic construct
  misc_feature 1..5055: note = derived and/or modified CDS sequence (opt5) from CCHFV(SPU 383/87)__KJ682806.1__GP
  source 1..5055: mol_type = other RNA
atgtacacacccctgctctgcgccatcctgtgtcttcagctgtggagcctcgagggcatttatgggctgtccaacagaacacaacacaatgacacgtctaccatcaaggtgcctgaagagagccagaaaacatcccttccggctaacaccgcctctcccattacaagcgatcctccctccaccacatctaccgcgagcgcttccggacctgaaggcagcggggacacgtctacctcccctcccgtcacaacccagggaccgacaccccctgagaccacgcccgaacctcatacaaccatcgatattgacaagagctctacagccatcgccgatatctccacccagaccgttaaagacattcccacaccgacgacccacacaagcctgccttctaccctctccgctcccacaatccctcaagaggcccatcacaccgctcggggcctgctgagcattacgtccacaaagcccggggaggcctctacccccatcagccctggagaagcgtccaccgaggccagctctccgcagcccacaatttccgaaaccccttctccccctcccacagctcaggccccgacggagatcaatagccctaacaccagccgccagcccatgccttccacacaacccgctgcccctaattctgtgacccatcccgcgcagccgacacctagccagtccgatgtgcccaccgccgctcaggacattcaccccaaccctatcaatagaagcaaacggaacctcgagatggaaatcattctgacgctttctcaaggcctgaagaagtactatggcaaagtcctcaagctgcttgatctgaccctcgaggaagacacagaggggctgctggaatcctgcaaacgcaatctcggactgacctgtgatgacaacttctttcagaagagaatcgaggagttctttcttacaggcgaagggcacttcaatgaggtgctgcagtttaaaaccccgagcacgctctctcccacagaacctgcccgggttgagtcccccaccgtggaacctttcaagagctactttgctaagggattcctgtccatggattctggctattttagcgccaaatgctactccaagtctagcaactccgggcttcaactgattaatgtcacacagcatctcatccgcattaccgacacccccggacctaaaatcacaaacctgaagacgatcaattgtattaacctgaaagccctcgtgttcaaggagcacagagagatcgaaattaacgttctgcttccccaggtggctgtcaatctgagcaactgccatgtgctcatcaaatctcacgtgtgtgactattccctggatattgacggcccggtccggcttcctcgcatccaccatgagggcacctttatccccgggacatacaagattgttatcgataagaataacaaacagaatgacagatgcaccctggtgacaaactgtgtgattaagggacgggaaatccgcaaaggccaaagcgtcctcagacagtaccggaccgagattaagatcgggaaagcgtcttccggaagccgcagactgctgtctgaagagagcaatgatgactgcctctcccggacgcagctgcttagaacagagaacgccgaaattcacagcgataattatggcgggcctggagacaagatcaccatctgtaacggctctaccattgtggatcagcgcctgggctccgagctcgggtgctacacaatcaatcgggttaagagcttcaaactgtgcgaaaactccgctaccggaaagtcttgtgagattgacagcacacccgtgagatgccgccaaggcttttgtctgaaaatcacgcaggaggggcggggacatgtcaaactttccagaggctctgaagtggttctcgatgcctgcgacagctcctgtgagattatgatcccgaaagggaccggcgacatcctggtggattgctctggaggccagcagcacttcctgaaggacaatctcgtcgatctggggtgtcctaacattccccttctgggaaagatggccatctatatttgccgcatgagcaatcatcctaaaacaaccatggctttcctcttttggttctcctttggctacgtgatcacatgtattctgtgcaaggtcatcttctatctgcttgtggttgtggggaccctcgggaaaaagtttaaacaataccgggaactgaagccccagacgtgtaccatctgcgagacaaaccccgtcaacgccattgacgcggaaatgcacgatctgaattgcagctataacatctgtccttactgcgcttctagactcacctccgacggcctggcccgccacgtgattcagtgtccgaagcggaaagagaagatcgaggaaacagagctttacctgaatctcgaacggattccctgggttgtgcgcaaactgctgcaggtcagcgagtctaccggggtggcccttaagcggtccagctggctcgtgatcctgctggttctcctgacagtctctctttcccctgtgcaaagcgctcccatctcccatggcgaaaccgtggaggtctatcagacgagagagggatacacaagcatttgcctgttcgtgctcggctctatcctgtttctggttagctgtcttatgaaagggctcgtggattccgtcggaaactctttctttcctggcctgagcatttgcaagacctgttccatcgggtctattaatggattcgaaatcgagagccacaaatgctattgttccctgttttgctgtccctactgccggcattgctctgccgacattgaaatccaccgcctccacctgagcatctgtaagaagagaaaaaccggctccaacgtgatgcttgctgtttgcaagcggatgtgtttcagagccacagtggaggtcagcaataaagcgctgctcattcgcaacatcattaataccacgtttgtggtttgcatcctgattctggccgtgtgtgtcgtgtctacatccgctgtggaaatggagaaccttcctgccgggacctgggagaaggaagaggatctgacaaatttctgccatcaggaatgtcaagtcaccgagacagagtgcctctgtccgtatgaagctctggttctccggaaacccctgttccttgacagcatcgtgaagggcatgaagaacctgctcaattctacctccctggagacgagcctgtccatcgaagccccttggggagcgattaacgtgcagtctacctttaaacccacagtcagcgccgctaatatcgccctttcctggagctctgtggagcacagaggcaacaagattctggtttccgggcgcagcgaatctatcatgaaactcgaggagagaaccggaattagctgggatctgggcgtggaagacgcttccgagtctaagctcctgacagtcagcgtgatggatctttcccagatgtactctcctgttttcgaatatctgagcggggacagacaggtggaggaatggcccaaagctacctgcacgggagactgtccggagcgctgcggctgcacatccagcacctgtctccataaggagtggcctcactctagaaactggcggtgcaatcccacatggtgttggggagtcggcaccggatgcacctgttgcggcctggatgtgaaggacctgtttacagattacatgttcgttaaatggaaggtggactacatcaaaacggaagccatcgtctgtgtggagcttacctcccaagaacgccagtgcagcctgattgaggccgggacaagatttaacctcggacccgtgaccatcacactgtccgaacctcggaatattcagcagaagctgccccctgagatcgtcaccctccatccgcgcattgaggaaggcttctttgatcttatgcacatccaaaaagttctgtctgcgagcacggtgtgtaagctgcagtcctgcacacacggggtgcccggagacctccagatttatcatatcggcaacctgcttaagggcgataaagtcaatgggcacctgatccataagattgagcctcacttcaacacctcttggatgagctgggacggatgtgatctcgactactattgcaatatgggcgattggccctcctgcagctacaccggggtgacacagcataaccacgccgcttttgttaatatgctgaacatcgaaaccgactataccaaaaatttccactttcattctaagagagtgacggcccacggagatacccctcaactcgacctgaaagcccggcccacatacggcgctggggagattaccgtccttgtggaggttgccgacatggaactgcatacaaagaaaatcgagatttccggactgaagttcgcgagcctcacctgtacgggctgctatgcttgttcttccggcatcagctgcaaggtgcgcatccacgtcgatgaaccggacgagctgaccgtgcacgtcaaatctgaagatcctgacattgtggccgccagctcctctcttatggctagaaagctggagtttgggacagatagcaccttcaaagccttctccgcgatgcccaagacaagcctctgtttttacatcgttgagcgggaatactgcaaatcctgttctaaggaggacacccagaagtgcgtgaacacaaaactggaacagcctcaaagcattctcatcgagcataagggaacgattttcggcaaacagaatgatacctgtacagctaaggcctcctgctggctggaatctgtcaagagctttttctatgggcttaagaacatgctgtccggaatctttggcaatgtgttcatcggggtttttctgttcctcgccccctttattatgctgatccttttctttatgttcggatggcgcattctgttctgttttaagtgctgcagacggaccagaggcctcttcaaataccgccacctgaaggacgatgaggagatcggctatcggaaaattatcgaaagactcaacaacaagaaagggaagaataagctgcttgacggagagcgcctggctgatcggaaaattgccgaactgttttctaccaagacacatatcggctga

SEQ ID NO: 13670 - RNA, 5055 nt, synthetic construct
  misc_feature 1..5055: note = derived and/or modified CDS sequence (opt5) from CCHFV(SPU 497/88)__KJ682808.1__GP
  source 1..5055: mol_type = other RNA
atgtacacacccctgctctgcgccatcctgtgtcttcagctgtggagcctcgagggcatttatgggctgtccaacaagacccaacacaatgacacgtctaccatcaaagtgcctgaagagagccagaagacatcccttccggctaacattgcctctcccaccacaagcgatcctccctccgcgacctctacagctagcgcctccggacctgaaggcagcggggacacctctacgtcccccagcgtcaccacacagggacctaccccgctggagatcacacccgaacctcataccacgattgatatcgacaaatcttccacaagcatcgccgatatttctaccagaacagttaaggacatccccacccctaccacacacacgtccctccccagcaccccgtccgctcctacaattccccaggaggtgcatcacaccgcccggggcctgctgtctgtgacaagcaccaaacctgaggaggcttccacgctcacaagccccggggaagcctctaccgaagcgtccagcccccaacctaccatctctgagacaccgtctccccctcccaccacacaggcccctacggagattaataaccccaatacctcccgccagccgatgccttctacacagcccgctgcccctaacagcgtcacaccccctgtgcaacccaccttctcccagagcgatgtttctaccgctgcccaggacatccatccgtcccctacgaatagaagcaagcggaacctggaaatggagattatccttaccctgtctcagggactcaagaaatactatggcaaggtgctgaaacttctggatctcacactggaagaggacaccgaaggcctgctcgagtggtgcaagcgcaatctggggcttacatgtgatgacaactttttccagaaaagaatcgaggaatttttcctgaccggagagggccactttaatgaagtcctccaattcaagacgccctccacactgagccccaccgagcctgcgcgggtggaatccccgacagttgagccctttaagtcttacttcgccaaagggtttcttagcatggattccggatatttctctgctaagtgctaccctaaaagctccaacagcggcctgcagctcattaatgtgacccaacacctgatccgcattaccgacacacccgggcctaagatcacgaacctgaaaaccattaattgtatcaacctcaaggccctggtctttaaagagcatagagaaatcgagattaacgtgcttctgccccaggtggctgtcaatctctctaactgccacgttctgatcaagtcccatgtgtgtgactatagccttgatattgacggacctgtgcggctgccccgcatccaccacgaaggcacattcattccgggcacctacaagatcgtcatcgataaaaagacaaaacagaatgacagatgcaccctcgtgacgaactgtgttattaaggggcgggagatccgcaaaggacagtctgtgctgagacaataccggacagaaattaagatcggcaaggcctccagcgggtctcgcagactgctcagcgaggagtccaatgatgactgcctgagccggacccagcttctgagaaccgaaaacgccgagattcattctgataattatggaggccctggggacaaaatcacaatttgtaacggatccaccatcgtcgatcagcgcctcggcagcgaactgggctgctacacaatcaatcgggtgaagtcctttaaactgtgcgagaactctgctacgggaaagagctgtgagattgactccacccccgttagatgccgccaggggttctgtcttaaaatcacacaagaaggcaaggggcacgtgaagctctctcggggaagcgaggtcgtgctggatgcgtgcgactcctcttgtgaaattatgatccctaaaggcaccggggacattctggtcgattgcagcggcggacagcagcatttcctcaaggacaatctggtggatcttggctgtcccaacatcccgctgctcgggaaaatggccatctatatttgcagaatgtccaatcaccctaagacaaccatggtttttctgttctggtttagcttcggatacgtgatcacgtgtattctgtgcaaagtcatcttttatcttctcattgtggttggcaccctggggaagaagttcaaacagtaccgcgagctgaagccccaaacatgtaccatctgcgaaacaaaccctgtgaatgctatcgacgccgagatgcatgatctcaactgctcttataacatttgtccctactgcgcctcccggctgaccagcgacggacttgctagacacgtcatgcagtgtcccaaacgcaaggagaaaatcgaagagacagaactgtacctcaatctggagcggattccttgggtggtgagaaagctgcttcaggtttctgaatccaccggcgtcgccctcaaacgcagctcttggctggtgatcctgctcgtgctgcttacggtctccctgagcccggtgcagtccgcgcccattagccacggggagacagttgaggtgtatcaaacccgggaaggctacacctctatctgcctctttgtcctgggaggcatcctgttccttgtgagctgtctcatgaaggggctggttgattccgtgggaaacagctttttccctggcctgagcatttgcaagacatgttccatcgggtctattaatggatttgagatcgaaagccataaatgctattgttccctcttctgctgtccctactgcagacactgctctgctgacattgagatccataagctgcaccttagcatttgtaaaaagcggaaaacctggtccaacgtcatgctggccgtgtgcaagcgcatgtgttttagagccacggttgaagtgagcaataaggctctcctgatccggaacatcattaatacaaccttcgtcgtgtgcatcctgattcttgccatctgtgtggtctctacatccgctgttgagatggagaacctgcctgccggcacctgggaaaaagaggaagatctcacaaatttctgccaccaggagtgtcaggtgaccgagacggaatgcctgtgtccctatgaggcgctcgtgctgagaaagcctctttttctggacagcattgtcaaagggatgcgcaacctccttaattctacctccctggaaacaagcctttccatcgaggccccgtggggcgctatcaacgtgcaatctaccttcaagcccacagttagcgccgctaatattgccctgtcctggagctctgtggaacatcggggaaacaaaatcctcgtctccggcagaagcgagtctattatgaagctggaggaacgcaccgggatcagctgggatctcggagtggaggacgcgtccgaatctaagctgcttacggttagcgtgatggatctgtcccagatgtactctcctgtctttgagtatctcagcggcgacagacaggtggaagagtggcccaaagccacatgcaccggggactgtcctgagcggtgcggatgcacatccagcacctgtctgcacaaggaatggccccattctcgcaattggagatgcaacccgacctggtgttggggcgttgggacaggctgcacgtgttgcggactggatgtgaaagaccttttcaccgattacatgtttgtcaagtggaaagtggactacattaagacagaggctatcgtgtgtgtcgaactgacctcccaggagcggcaatgcagcctcatcgaagccggcacacgcttcaacctggggcctgttaccattacgctctccgagcccagaaatatccagcagaagctgccccctgagattgtgacacttcacccccggatcgaagagggatttttcgatctgatgcatattcagaaagtgctgtctgctagcaccgtctgtaagctccaatcctgcacccacggcgtgcctggggacctgcagatctatcacattggaaaccttctgaaaggcgataaggttaatggccatctcatccacaaaatcgaaccgcattttaacacatcttggatgagctgggacgggtgtgatctggactactattgcaatatgggagattggccctcctgcagctacaccggcgtgacacagcacaaccatgccgccttcgtcaatatgctcaacattgagacggactataccaagaattttcacttccactctaaacgcgtgacagctcatggggatacccctcagctggaccttaaggcgagacccacatacggagccggcgagatcaccgttctggtggaagtcgctgacatggagctgcacacgaagaaaattgaaatctccgggctcaagtttgccagcctgacctgtacaggatgctatgcctgttcttccggcattagctgcaaagtgcggatccatgtcgatgagcctgacgaacttaccgtgcacgttaagtctgaggatcccgacatcgtggctgccagctcctctctgatggcgcgcaaactcgagttcggcacagatagcaccttcaaggctttttccgccatgccgaagacaagcctgtgtttctacattgtcgaaagagagtactgcaaatcctgttctaaggaagacacgcaaaaatgcgtgaacaccaagctcgagcagcctcagagcatcctgattgaacacaaagggacaatcattggaaagcaaaatgatacctgtaccgcccgggcttcctgctggcttgagtctatcaagagctttttctatggcctgaaaaacatgctgtccgggatctttggaaatgttttcattggcatctttctcttctttgcccccttcattatgctgatcctgtttttcatgttcgggtggcgcattctgttttgtttcaagtgctgcagacggacaagaggactctttaaataccgccatctgaaggacgatgaggaagtgggctatcggaaaatcattgagagactcaacaataagaagggcaaaaacaagctgcttgacggggaacgcctggcggatcggaaaatcgctgagctgttctctacgaagacccacatcggatga

SEQ ID NO: 13671 - RNA, 5055 nt, synthetic construct
  misc_feature 1..5055: note = derived and/or modified CDS sequence (opt5) from CCHFV(88166)__AB069675.1__GP
  source 1..5055: mol_type = other RNA
atgtacacacccctgctctgcgccgtgctgtgtcttcagctgtggagcctcgagggctcccacgggctgtctaacaagacccaacatagcaatacgtccaccacaaaagctcctgaagtctctcaggagcttggactgccggttagcaccgtgtccacaatcacctctgatccccctagcattacatccgccgtgagcgtctctggctccgaagggagcggagacaccaacacgtctccctccgtgaccacacagggccctaccctccccgagacaaccctggaacctctgacgacaaccgacacagatgcgagctctaccgttgtggtcgacgtgtccacccagacagttaaggatacgccgatcagcaccacatatacctccctcccctctacacctagcgagcccaccacgcctcaagggacacaccataccgctagaggactgctttccgtgaccagcacaaaacccgaggaagcctctacccaggccaatccgggcaagatttccatggagacaaacagccctcggctggctatctctgaaacgcccagcttctcccctaccacacaggcccccaccgaaaattctaaccccattacaagcaaacagctcatgctgtccgctcaacctgtcaccccgaatcccatgacgagccctgtgcagcccgccctttctcagtccgacaccagcacagcgatccaggatatccacccttctcccaccggccgctccaagagaaacctggagatggaaattatcctcacactgagccaagggctgaagaaatactatggaaagattctcaaactgcttgacctgaccctcgaggaagatacggagggcctgcttgaatggtgcaagcggaatctggggctcgtgtgtgacgataactttttccagaaacgcatcgaggagtttttcctgacaggaaagggccattttaatgaagtcctgcagttcaagaccccgtccacactctctcctaccgggcccgccagaaccggaagccctacagttgagccctttaaatcctacttcgctaagggctttctgtctatggacagcggctatttctccgccaaatgctaccctcgggctagcaactctgggcttcaactgattaatgtgacgcagcactccacccgcatcacagatacccccggaccgaagattacaaacctcaaaaccatcaattgtatcaacctgaaggccagcgtgtttaaagaacacagagagattgaaatcaacgtccttctgcctcaggtggcggttaatctctcttcctgccatgtgctgattaagagccacgtctgtgactattctctggacatcgatggccccgtgcggctcccccgcattcatcacgaggggacgttcatccctggaacatacaagatcgttattgacaaaaagaacaaacagaatgatagatgcaccctggtgaccaactgtgtcatcaagggccgggagattcgcaaagggcaaagcgtgcttagacagtaccggacagaaatcaagattggaaaggcctccagcggctctcgcagactgctctccgaggaaagcggcgacgattgcatctcccggacccagctgctgagaacagagacggctgaaatccactctgacaattatgggggaccgggcgataaaattaccatctgtaacgggagcacagtcgtggaccagcgccttggatccgagctcggctgctacaccattaatcgggttaagtcttttaaactgtgcgagaacagcgccacagggaagtcctgtgaaatcgattctacccccgtgaaatgcagacaaggcttctgtctgaagattacgcaggagggacgcggccatgtcaagctcagccgggggtccgaagtggttctggacgcttgcgatagctcttgtgagatcatgattcctaaaggaaccggcgacatccttgtggactgctccgggggacagcagcacttcctgaaggataatctcatcgacctgggctgtcccaacattcctctgcttgggaaaatggccatctatatttgcagaatgagcaatcatcccaagacaaccatgggctttctcttctggttttctttcggatacgtcgtgacatgtatcctgtgcaaagtgatcttttatctgctcattgttgtcggcaccctggggaagaagttcaaacaataccgcgagcttaagcctcagacatgtaccatctgcgaaacgacacccgtgaacgccattgatgctgagatgcacgacctgaattgctcctataacatctgtccgtactgcgcgagccggctcacctctgatggactggccagacatgtgatgcagtgtcctaaacgcaaggaaaagattgaggaaaccgagctgtaccttaatctcgagcggatcccctgggtcgtgagaaagctgctgcaggtttccgaaagcacaggcgtggctctcaaacgctccagctggctggtcgtgcttctggttctcctgaccgtgtctctgagccctgtccaatccgcccccattgggcacggaaagacggtggagacatatcagacccgggaaggctacacatctatctgcctttttgttctcgggagcatcctgttcattgtgtcctgtctgatgaagggcctcgtcgactctgtgggaaacagctttttcccgggcctgtccatctgcaaaacctgttctattgggagcgtgaacggatttgagatcgaatcccacaagtgctattgtagccttttctgctgtccttactgcagacattgctctgccgatcgggagattcaccgcctgcatctctccatctgtaaaaagagaaaaacatggagcaatgtcatgctggctgtttgcaagcggatgtgttttagagccaccgtggaggtgtctaacaaggcgctgcttatccgcaatattatcaacacgaccttcgtcctgtgcattctcatcctggctgtgtgtgttgtgtccacaagcgccgtcgaaatggagtccctccccgccggcacctgggaacgggaggaagacctgacaaatttctgccaccaggagtgtcaagtgaccgagacggaatgcctttgtccttatgaggctctggttctcagaaaacccctgttttctgatagcattgtgaaggggatgaaaaacctgcttaattccacaagcctggaaacctctctctccatcgaggccccctggggagctattaacgtccagagcacattcaagcctaccatgtctgccgcgaatatcgccctgagctggtcctctgtggagcaccgcggcaacaaaatcctcgttagcgggagatccgaatctattatgaagctggaggaacggaccggcatcagctggaatcttggagtggaggacgcttccgaaagcaagctgctcacagtctctgtgatggatctgtcccagatgtacagcccggtgtttgagtatctgtccggcgaccgccaggtcgaggaatggcccaaagccacgtgcaccggggattgtcctgagagatgcggatgcacatctagcacctgtcttcataaggaatggccccactcccggaactggcgctgcaatcctacatggtgttggggcgttgggaccggatgcacgtgttgcggcctggacgtgaaagacctcttcacagattacatgtttattaagtggaaagtggagtacatcaagaccgaagctattgtctgtgtggagctgacctctcaagagagacagtgcacactcatcgaagccggcacccggttcaacctggggcccgttacaatcacgcttagcgagcctcgcaatattcagcagaagctgccgcccgaaatcgtgaccctgcatcctagaattgaggaaggatttttcgacctcatgcacgtccaaaaagtgctgtccgcgagcacagtttgtaaacttcagtcttgcacccatggcgtgcccggggatctgcaggtctatcacatcggaaacctcctgaaaggcgacaaggtgaacgggcacctcattcataaaatcgagcctcactttaatacatcctggatgagctgggatggatgtgacctggattactattgcaacatgggcgactggccctcttgcacctacacgggcgtcacccagcataatcacgccgctttcgtgaacatgcttaatatcgagacagattataccaagaactttcatttccactccaaacgggttacagcccacggggacaccccgcaactggatctgaaggctcgccctacatacggagccggcgaaattacggtgctcgtcgaggtggccgacatggaactgcataccaagaaaatcgagattagcgggcttaagtttgcttctctgacatgtaccggatgctatgcgtgtagctccggcatctcttgcaaagttcggattcacgtggatgagcccgacgaactcaccgtccatgttaagagcgaggaccccgatctggtggccgcttccagctccctcatggccagaaaactggagttcgggacagactctacgttcaaggcctttagcgctatgcctaagacctccctttgtttctacatcgtggagagagaatactgcaaatcttgtagcaaggaggatacacagaaatgcgtcaataccaagctggagcagccccaatccattctgatcgaacacaaaggaacaatcattggcaagcagaacaatacctgtacggccaaggcgtcttgctggctcgagagcgtgaaatcctttttctatggcctgaagaacatgcttagcgggatctttggaaatgtgttcattggcgtctttctgttctttgctcctttcatcctcctgattctctttttcatgttcgggtggcgcatcctgttttgtttcaaatgctgccggagaacacgcggactttttaagtaccggcacctgaaagacgatgaagagaccggctatagaaagatcattgaacgcctgaacaataagaaagggaagaacaaactcctggacggagagcggcttgccgatagaaagatcgccgagctgttctctaccaaaacacatattggctga

SEQ ID NO: 13672 - RNA, 5055 nt, synthetic construct
  misc_feature 1..5055: note = derived and/or modified CDS sequence (opt5) from CCHFV(strain BA88166)__AF338470.1__GP
  source 1..5055: mol_type = other RNA
atgtacacacccctgctctgcgccgtgctgtgtcttcagctgtggagcctcgagggctcccacgggctgtctaacaagacccaacatagcaatacgtccaccacaaaagctcctgaagtctctcaggagcttggactgccggttagcaccgtgtccacaatcacctctgatccccctagcattacatccgccgtgagcgtctctggctccgaagggagcggagacaccaacacgtctccctccgtgaccacacagggccctaccctccccgagacaaccctggaacctctgacgacaaccgacacagatgcgagctctaccgttgtggtcgacgtgtccacccagacagttaaggatacgccgatcagcaccacatatacctccctcccctctacacctagcgagcccaccacgcctcaagggacacaccataccgctagaggactgctttccgtgaccagcacaaaacccgaggaagcctctacccaggccaatccgggcaagatttccatggagacaaacagccctcggctggctatctctgaaacgcccagcttctcccctaccacacaggcccccaccgaaaattctaaccccattacaagcaaacagctcatgctgtccgctcaacctgtcaccccgaatcccatgacgagccctgtgcagcccgccctttctcagtccgacaccagcacagcgatccaggatatccacccttctcccaccggccgctccaagagaaacctggagatggaaattatcctcacactgagccaagggctgaagaaatactatggaaagattctcaaactgcttgacctgaccctcgaggaagatacggagggcctgcttgaatggtgcaagcggaatctggggctcgtgtgtgacgataactttttccagaaacgcatcgaggagtttttcctgacaggaaagggccattttaatgaagtcctgcagttcaagaccccgtccacactctctcctaccgggcccgccagaaccggaagccctacagttgagccctttaaatcctacttcgctaagggctttctgtctatggacagcggctatttctccgccaaatgctaccctcgggctagcaactctgggcttcaactgattaatgtgacgcagcactccacccgcatcacagatacccccggaccgaagattacaaacctcaaaaccatcaattgtatcaacctgaaggccagcgtgtttaaagaacacagagagattgaaatcaacgtccttctgcctcaggtggcggttaatctctcttcctgccatgtgctgattaagagccacgtctgtgactattctctggacatcgatggccccgtgcggctcccccgcattcatcacgaggggacgttcatccctggaacatacaagatcgttattgacaaaaagaacaaacagaatgatagatgcaccctggtgaccaactgtgtcatcaagggccgggagattcgcaaagggcaaagcgtgcttagacagtaccggacagaaatcaagattggaaaggcctccagcggctctcgcagactgctctccgaggaaagcggcgacgattgcatctcccggacccagctgctgagaacagagacggctgaaatccactctgacaattatgggggaccgggcgataaaattaccatctgtaacgggagcacagtcgtggaccagcgccttggatccgagctcggctgctacaccattaatcgggttaagtcttttaaactgtgcgagaacagcgccacagggaagtcctgtgaaatcgattctacccccgtgaaatgcagacaaggcttctgtctgaagattacgcaggagggacgcggccatgtcaagctcagccgggggtccgaagtggttctggacgcttgcgatagctcttgtgagatcatgattcctaaaggaaccggcgacatccttgtggactgctccgggggacagcagcacttcctgaaggataatctcatcgacctgggctgtcccaacattcctctgcttgggaaaatggccatctatatttgcagaatgagcaatcatcccaagacaaccatgggctttctcttctggttttctttcggatacgtcgtgacatgtatcctgtgcaaaggcatcttttatctgctcattgtggttgggaccctgggaaagaagttcaaacaataccgcgagcttaagcctcagacatgtaccatctgcgaaacgacacccgtcaacgccattgatgctgagatgcacgacctgaattgctcctataacatctgtccgtactgcgcgagccggctcacctctgatggcctggccagacatgtgatgcagtgtcctaaacgcaaggagaaaattgaggaaaccgagctgtaccttaatctcgagcggatcccctgggtggtcagaaagctgctccaggtgtccgaaagcacaggggttgctctgaaacgctccagctggctggtggtccttctggtgctcctgaccgtttctctgagccctgtgcaatccgcccccattggacacggcaagacggtcgagacatatcagacccgggaagggtacacatctatctgcctttttgtgctcggcagcatcctgttcattgtttcctgtctgatgaagggactcgtggactctgtcggcaacagctttttcccggggctgtccatctgcaaaacctgttctattggaagcgtgaacggctttgagatcgaatcccacaagtgctattgtagccttttctgctgtccttactgcagacattgctctgccgatcgggagattcaccgcctgcatctctccatctgtaaaaagagaaaaacatggagcaatgtgatgctggctgtctgcaagcggatgtgttttagagccaccgttgaggtgtctaacaaggcgctgcttatccgcaatattatcaacacgaccttcgtgctgtgcattctcatcctggctgtctgtgtggtttccacaagcgccgtggaaatggagtccctccccgccgggacctgggaacgggaggaagacctgacaaatttctgccaccaggagtgtcaagtcaccgagacggaatgcctttgtccttatgaggctctggtgctcagaaaacccctgtacctggattctattgttaagggaatgaaaaaccttctgaatagcacatccctcgaaaccagcctgtctatcgaggccccctggggcgctattaacgtgcagtccacatttaagcctaccatgagcgccgcgaatatcgccctctcttggagctccgtcgagcaccgcgggaacaaaatcctggtgtctggcagaagcgaatccattatgaaacttgaggaacggaccggaatctcttggaatctgggcgttgaggacgctagcgaatccaagctcctgacagtgagcgtcatggatctgtctcagatgtattccccggtgttcgagtaccttagcggggaccgccaggtggaggaatggcccaaagccacgtgcaccggagattgtcctgagagatgcggctgcacatcctctacctgtctgcataaggaatggccccacagccggaactggcgctgcaatcctacatggtgttggggagtcgggaccggctgcacgtgttgcggcctcgacgttaaagacctgtttacagattacatgttcattaagtggaaagtggagtatatcaagaccgaagctattgtgtgtgtcgagctcacctcccaagagagacagtgcacactgatcgaagccgggacccggtttaaccttggacccgtgatcattacactgtctgagcctcgcaatatccagcagaagctgccgcccgaaattgttacgctccatcctagaatcgaggaaggcttctttgacctgatgcacgtgcaaaaagtccttagcgcgtccaccgtgtgtaagctgcagagctgcacacatggggttcccggagatctccaggtgtaccacattggcaacctgctcaaaggggacaaggtcaacggacacctgatccataaaatcgagcctcacttcaatacctcttggatgtcctgggatggctgtgaccttgattattactgcaacatgggcgactggcccagctgcacatataccggggtgacgcagcataatcacgccgcttttgtcaacatgctgaatattgagaccgattacacaaagaacttccattttcactctaaacgggtgaccgcccacggagacacaccgcaactggatctcaaggctcgccctacctatggcgccggggaaatcacagttctggtggaggtcgccgacatggaacttcatacgaagaaaattgagatctccggactgaagttcgctagcctcacctgtacaggctgctacgcgtgttctagcgggatttcctgcaaagtgagaatccacgttgatgagcccgacgaactgaccgtgcatgtcaagtctgaggaccccgatattgtggccgctagctccagcctcatggcccggaaactggaatttggaaccgactccacattcaaggccttctctgctatgcctaagacgagcctttgtttttacatcgtggagagagaatattgcaaatcctgttctaaggaggatacccagaaatgcgttaatacaaagctggagcagccccaaagcatcctgattgaacacaaaggcaccatcattggcaagcagaacaatacatgtaccgccaaggcgtcctgctggctcgagtctgtcaagagcttcttttacgggctgaagaacatgctttccggaatcttcggcaatgtgtttattggggtgttcctgtttttcgctccttttatcctcctgatcctcttctttatgttcggatggcgcattctgttctgttttaaatgctgccggagaacgcgcggccttttcaagtatcggcacctgaaagacgatgaagagacagggtacagaaagatcattgaacgcctgaacaataagaaaggaaagaacaaactcctggacggcgagcggcttgccgatagaaagatcgccgagctgtttagcaccaaaacccatattggctga

SEQ ID NO: 13673 - RNA, 5055 nt, synthetic construct
  misc_feature 1..5055: note = derived and/or modified CDS sequence (opt5) from CCHFV(SPU 130/89)__KJ682807.1__GP
  source 1..5055: mol_type = other RNA
atgtacacacccctgctctgcgccatcctgtgtcttcagctgtggagcctcgagggcatttatgggctgtccaacaagacccaacacaatgacaactctacgaccaaagctcctgaagagagccataagacatcccttccggccaataccgcgtctcccatcacaagcgatcctccctccaccacatctaccacgagcgcttccggacctgaaggcagcggggacacctctacatctccccctgtgaccacacagggaccggccagccccgagaccacgcctgaaccccacacaaccattgatatcgacaaatcttccacagccattgctgatatcagcacccagaccgtcaaggacatccctacacccacgacccatacatctctgccgtccaccctcagcgcccctacaattccccaggaggctcaccataccgccagaggcctgctgtccgttacgcggcacaaacctggggaggcgtctaagcccacaagccccggagaagcctccaccgaggctagctcctcccaacctaccatcagcgaaacaccgtctccccctcccaccacacaggcccctacggagattaacaatcccaacaccagccgccagccgatgccttccacacagcccgctgccccttctagcgtgacccaccccgcgcaacctacaccctcccagagcgatgtgccgaccgccgctcaggacatccatccttctcccacgaatagatccaagcggaacctcgagatggaaattatcctgacccttagccagggcctgaaaaagtactatggcaaagtcctcaagctgcttgatctgacactcgaggaagacaccgaggggctgctggaatggtgcaaacgcaatctcggactgacatgtgatgacaacttctttcaaaagagaattgaggagttctttcttaccggcgaagggcacttcaatgaggtgctgcagtttaagacgccctctacactctcccctaccgaaccggcccgggttgagagccccacagtggaacctttcaaatcctactttgctaagggattcctgtctatggatagcggctatttttccgccaaatgctaccccaagtctagcaactccgggcttcagctgatcaatgtcacccaacatctcatccgcattaccgacacacctggacccaaaatcacgaacctgaagaccattaattgtatcaacctgaaagccctcgtgttcaaggagcacagagagattgaaatcaacgttctgcttcctcaggtggctgtcaatctgagcaactgccacgtgctcatcaagtctcatgtgtgtgactattccctggatattgacggccccgtccggcttccgagcatccaccatgagggcacatttattcctgggacctacaaaatcgttattgataagaaaaataagcagaacgaccgctgcacactggtgaccaattgtgtgatcaaaggaagagaaatccggaagggccagtctgtcctccgccaatacagaacggagattaagatcgggaaagcgtccagcggatctcggcgcctgctgagcgaggaacccaactatgattgcctctccagaacacagctgcttcggaccgagaatgccgaaattcacagcgacaactacggcgggcctggagataagatcaccatttgtaatggctctacaatcgtggaccagagactgggctccgagctcgggtgctataccattaaccgcgttaagagcttcaagctgtgcgaaaattccgctacaggaaaatcttgtgagatcgatagcacgcccgtgcggtgcagacagggcttttgtctgaagatcacccaagaggggcgcggacatgtcaaactttcccggggctctgaagtggttctcgacgcctgcgatagctcctgtgagattatgatcccgaaagggacaggcgacattctggtggactgctctggaggccagcagcacttcctgaaggataacctcgtcgacctggggtgtcctaatatcccccttctgggaaaaatggccatttacatctgcagaatgagcaaccaccctaagaccacaatggctttcctcttttggttctcctttggctatgtgatcacctgtattctgtgcaaagtcatcttctacctgcttattgtggttgggacgctcggaaagaagtttaaacagtatcgcgaactgaagccccaaacctgtacaatctgcgagaccaatcccgtgaacgccattgatgcggaaatgcatgacctgaactgcagctacaatatctgtccttactgcgcttctcggctcacatccgatggcctggccagacacgtcatgcagtgtccgaaacgcaaggagaaaatcgaggaaaccgagctttatctgaacctcgaacggattccctgggtggttagaaagctgctccaggtgagcgagtctacaggggtcgcccttaaacgctccagctggctcgtggtgctgctggttctcctgaccgtctctctttcccctgtgcagagcgctcccatctcccatggcgaaacggtggaggtctaccaaacacgggagggatataccagcatttgcctgttcgtgctcggctctatcctgtttctggttagctgtcttatgaaggggctcgtggactccgtcggaaattctttctttcctggcctgagcatttgcaagacctgttccatcgggtctatcaacggattcgaaattgagagccacaaatgctactgttccctgttttgctgtccctattgcagacactgctctgccgatatcgaaattcataagctccacctgagcatctgtaaaaagcggaaaacaggctccaatgtgatgcttgctgtttgcaagcgcatgtgtttcagagccaccgtggaggtcagcaacaaggcgctgctcattcggaatatcattaacacgacatttgtggtttgcatcctgatcctggccgtgtgtgtcgtgtctacctccgctgtggaaatggagaatcttcctgccgggacatgggagaaagaagaggacctgaccaacttctgccatcaggaatgtcaggtcacagagaccgagtgcctctgtccgtacgaagctctggttctcagaaagcccctgagccttgattctattgtgaaaggcatgaagaatctgctcaactccacgagcctggagacctccctgtctatcgaagccccttggggagcgattaatgtgcaaagcacattcaaacccaccgtctccgccgctaacatcgcccttagctggtcttccgtggagcaccgcggcaataagattctggttagcgggcggtctgaaagcatcatgaagctcgaggagagaacaggaatctcctgggacctgggcgtggaagatgcttctgagagcaaactcctgaccgtctccgtgatggacctttctcagatgtatagccctgtttttgaatacctgtccggggatcgccaggtggaggaatggcccaaggccacgtgcacaggagactgtccggagagatgcggctgcaccagctctacatgtctccataaagagtggcctcactcccggaactggcgctgcaaccccacctggtgttggggcgtcgggaccggatgcacatgttgcggcctggacgtgaaggatctgttcacggactacatgtttgttaaatggaaggtggattatattaagaccgaagccatcgtctgtgtggagcttacaagccaggaaagacaatgctccctgattgaggctgggacccggttcaatctcggacccgtgacaatcaccctgtctgaacctcgcaacattcagcagaaactgccccctgagatcgtcacgctgcacccgagaatcgaggaaggctttttcgaccttatgcatattcagaaggttctgagcgcgtccacagtgtgtaaactgcaatcttgcacccacggggtgcccggagatctccagatctaccatattggcaatctgcttaagggcgacaaagtcaacgggcacctgatccataagattgagcctcactttaataccagctggatgtcctgggatggatgtgacctcgattattactgcaacatgggcgactggcccagctgctcttatacaggggtgacccagcacaatcatgccgctttcgttaacatgctgaatatcgaaacagattacacgaaaaactttcacttccattccaagcgggtgaccgcccacggagacacacctcagctcgatctgaaggcccgccccacctatggcgctggggagattacagtccttgtggaggttgccgacatggaactgcacaccaaaaaggtggagatcagcggactgaaatttgcgtctctcacgtgtaccggctgctacgcttgttccagcggcatctcttgcaaggtccggattcatgtggacgaaccggatgagctgacagtccacgtgaaaagcgaagaccctgatatcgttgccgcctcctctagccttatggctagaaagctggagttcgggaccgactccacatttaaggccttcagcgcgatgcccaaaacctccctctgtttctacattgtggagcgcgaacattgcaagtcttgtagcaaagaggatacacaaagatgcgtcaatacgaagctggaacagcctcagtccatcctcattgagcacaaaggaaccatcatcggcaagcaaaacgacacatgtaccgctaaggcctcttgctggctggaaagcattaaatcctttttctatgggcttaagaatatgctgtctggaatctttggcaacgtgttcattggggtttttctgttcctcgccccctttatcattctgatccttttctttatgttcggatggcggatcctgttttgtttcaaatgctgcagacgcacccggggcctcctgaagtacagacatctcaaagatgacgaggagattggctatcgcaagatcattgaacggctgaataacaagaaagggaagaacaaacttctggatggagagagactggctgaccgcaagatcgccgaactcttcagcacaaaaacgcacattggctga

SEQ ID NO: 13674 - RNA, 5052 nt, synthetic construct
  misc_feature 1..5052: note = derived and/or modified CDS sequence (opt5) from CCHFV(4701-ST-2009)__KR814872.1__GP
  source 1..5052: mol_type = other RNA
atgcacaccctgctcgtgtgcttcatcctgtaccttcagctgagcggcctcgggggagcccatggccaatccaacgctacagagcacaatgggacgaacaccacaaccgcccccggaacatctcagagccctaagccgcccgcgtccaccacactgcctcatacccccgaatctagcacggtcaaacttaccacacctacctccgagacagaaggctctggggagaccacgccccctccgaatacaacccagggactgcccctcacaggcaccacccctgaaagaagcgctacaacggccacctccacaagctctaccgacaacatgaactccacaacccaggttacggataatacacccaccagcaccgtgtctatttcccctagcagctccagctccatgccctctacaccgcaaggcacccaccatcctgtgcggagcctgctgtccgtcagctctcccaagacagtgacgacccctacacccatgtcccccggggagatgagccctgagacctctagccagcactccgccatgtctcgcgttccgacactctataccgctacccaggtgagcaccgaaaatacagacagatccacgccccggcagagcgagtcttccgtccaacctgccacacagagccccatcacctctcctgctcagacgattctgcttatgtccgccgcgcccaaagccatccaggatatgcacccgagccctacaaaccgctccaagagaaatctggaagtggagattatcctcaccctgtctcaaggacttaaaaagtactatggcaagatcctgaaactcctgcatctgacactcgaggaagacaccgaggggctgcttgaatggtgtaagcggaacctgggaagcaattgcgatgacgatttcttccagaaacgcattgaggaatttttcatcaccggcgaggggtactttaacgaggttctccagttcaagacactgtccacgctttctcccaccgaacctagccacgtgagactgcccacagctgagccttttaaatcctatttcgccaagggatttctcagcattgactctggctacttctccgctaagtgttatccccggagctctacctccggcctgcaactgatcaatgtcacacagcatccggcccgcattgcggaaacccctgggcccaaaacgacaagcctcaagaccatcaactgcattaatctgagagcctctgtgtttaaagagcaccgggaagtggagatcaacgtccttctgccccagatcgctgttaacctcagcaattgtcacgtggtgattaactcccatgtctgcgattacagcctggacaccgatggacctgtgcgccttccgagaatccaccatgagggcacattcattcccgggacctacaagatcgttattgaccggaaaaataagctgaacgatcgctgttctctcgtgacaaattgcgtcatcaaaggaagagaagtgcggaagggccagtccgttctgagacaatataagacggagatcaaaattgggaaggccagcaccggatcccgcaaactgctctctgaggaacctggcgacgactgtatcagccggacacagctgcttaagaccgaaacagctgagattcacgatgacaactacggcgggcccggagataaaatcaccatttgcaatggctccacggtggtcgaccagagactggggtctgagctcggatgttataccatcaaccgcgtcaagagctttaagctgtgcgaaaattccgccacaggcaaaacctgcgagatcgattctacacctgtgaagtgtcggcaggggttctgcctgaaaattacccaagaaggcagaggacatgtgaaacttagccgcggctccgaggttgtgctcgacgcctgtgatagctcttgcgagatcatgattcccaaggggacaggagacatcctggtcgattgttccggcgggcagcagcacttcctgaaggacaacctcattgatctgggatgccctcacatcccccttctgggcaagatggctatttacatctgtcggatgagcaatcatccgagaaccacgatggcgtttctcttctggttttctttcgggtatgtgatcacatgcatcttttgtaaagccctgttctactccctgattattatcggcacccttggaaagaaaattaagcagtatcgcgaactcaaacctcaaacctgcacaatctgtgagaccgctcccgttaacgccatcgacgccgaaatgcacgacctgaattgcagctacaacatttgcccttactgtgcttctcggctgacgtccgatggcctcgccagacatgtgacacagtgccccaagcgcaaggagaaagtcgaagagaccgagctgtatcttaatctggaacggatcccgtggattgtgagaaagctccttcaggtgagcgagtccacaggggttgcgctgaaacggagctcttggcttatcgtcctcctggtgctgctcaccgtgagcctgtcccctgtccagtctgctcccgtgggacacggcaagacaattgaaacctaccaaacgcgcgaggggtttaccagcatctgtcttttcatgctgggatccatcctctttattgtttcttgcctggtgaaaggcctggtcgacagcgtgtccgattctttctttcctgggcttagcgtttgtaagacatgctccatcggcagcattaacggattcgaaatcgagtctcacaaatgttattgctccctcttttgttgcccctactgtagacattgcagcgccgaccgggagattcaccagctgcatctgtctatctgcaagaagagaaaaaccggctccaacgtgatgctcgccgtctgtaagcgcatgtgcttcaaagctacaatcgaagccagccggagagctctgcttattcgctccatcattaataccacgttcgtgatgtgtatcctgacactcgccatttgcgttgtgtctaccagcgcggtcgagatggaagatctgcccgccgggacatgggagagagaagaggacctgaccaacttttgtcaccaggagtgccaagtgaccgaaacagagtgtctttgcccttatgaagctctggtgctccggaagccgctgttcctcgattccatcgtcaaaggaatgaagaatctgcttaacagcacgtctctggagacctccctcagcattgaggccccctggggcgctatcaatgttcagtctacatttaagcctaccgtgagcacagccaacatcgcgctgtcctggtctagcgtggaacatcgcgggaataaaattctggtcaccggaagatccgagtctatcatgaaacttgaggaacggacgggcgtgagctgggacctgggggttgaagatgcctccgagagcaagctcctgacagtgtctattatggacctctcccagatgtacagccccgtcttcgagtatctgtccggcgatcgccaggtggaagagtggcctaaggctacctgtaccggagactgccccgaaagatgtggctgcacatcttctacctgccttcacaaagagtggcctcactcccggaactggcgctgtaatccgacatggtgctggggagttggaacgggctgtacctgctgtggggtggatgtcaaggacctgtttacagaccatatgttcatcaagtggaaagtggaatacattaagaccgaggccatcgtttgcgtggagctcacatctcaagaaagacagtgtagcctgatcgaggctggaacccggtttaacctgggccccgtcacgattaccctttccgaacctcgcaatatccagcagaaactgccccctgagattatcacactccaccccaagattgaagagggcttctttgatctgatgcatgtgcaaaaagtgctcagcgcctctaccgtctgcaagctgcagtcctgtacacacgggatcccgggagaccttcagatctaccatattggcaacctgctgaagggggatagagttaatggacacctcatccacaaaattgagcctcatttcaacaccagctggatgtcttgggacggctgcgatctggactattactgtaatatgggggattggccctcctgcacatatacgggagtgacccagcacaaccatgccgcttttgtgaaccttctgaatatcgaaacagactacaccaagaccttccactttcacagcaaacgggtcacagcgcatggcgatacgccccaactcgacctgaaggccagacctacctatggcgctggggagattacagtgctcgttgaagtggccgatatggagctgcacaccaaaaaggtcgagatctctggacttaaattcgccagcctgacatgcaccggctgttacgcttgctcctctgggattagctgtaaggtgcgcatccatgttgacgaacccgatgagctgacggtgcacgtcaagtccagcgaccctgacgtggtcgccgcgtccacatctctcatggctcggaaactggaatttggaaccgatagcacctttaaggccttctccgccatgccgaaaacatctctttgcttttatatcgtggagagagaatactgtaagagctgctccgaggacgataccaaaaagtgtgttgacacaaagctggagcagccccagtctattctcatcgaacataaaggcaccattatcgggaagcaaaacgatacgtgcacagctaaagccagctgttggctggagtccgtcaagagcttcttttacggactcaaaaatatgctgggctctgtgttcggcgggtttttcgtggggattcttctgtttctggcgcctttcgttctcctggtgctgtttttcatgttcggctggaagatcctgttttgcttcaagtgttgccgccggaccagagggctctttaaatatcgccacctgaaggacgatgaagagacaggataccggagaatcattgaacgcctcaactccaaaaagggcaaaaatcggctgcttgacggggagagactggctgatcggaagatcgccgagctgttcagcaccaagacgcacattggatga

SEQ ID NO: 13675 - RNA, 5052 nt, synthetic construct
  misc_feature 1..5052: note = derived and/or modified CDS sequence (opt5) from CCHFV(36-ST-2014)__KR814857.1__GP
  source 1..5052: mol_type = other RNA
atgcacaccctgctcgtgtgcttcatcctgtaccttcagctgagcggcctcgggggagcccatggccaatccaacgctacagagcacaatgggacgaacaccacaaccgtccccggaacatctcagagccctaagccgcccgcctccaccacactgcctcatacccccgaatctagcacggttaaacttaccacacctacctccgagacagaaggctctggggagaccacgccccctccgaatacaacccagggactgccccctcccggcacaacccctgaaagacccgcgaccacagctacgagcatgtccagcaccgacaacatgaactctacaacccaggtgacagataataccccgacgtccacagtgagcatttctccttccagctctccctccatgcctagcacctcccaaggcatccactatcccgtccggtctctcctgagcgtgtccagccccaagaccgttacaacccctacaccgatgtctcccggggagatgtcccctgagacgagctctcagcatagcgccatgtcccgcattcccaccctgtacacagccacccaggtgtctacagaaaataccaacagaagcacgcctcggcagtccgagagctctgctcaacccgccacccagtccccgacaaccagccctacacagaccatcctcctgatgtctgctgcccccaaagcgattcaggacatgcacccttcccccacgaatcgcagcaagagaaaccttgaagtcgagatcatcctgacactctcccaaggactgaaaaagtattacggcaagattcttaaactgctccacctgaccctggaggaagatacagaggggctcctggaatggtgtaagcggaatcttggatctaactgcgacgatgactttttccagaaacgcatcgaggaatttttcattaccggcgaggggtattttaatgaggtgctgcagttcaagaccctcagcacactgtcccctacggaaccctctcatgttagacttccgaccgccgagccttttaaaagctacttcgctaagggatttctgtccatcgatagcggctatttctctgccaagtgttacccccggtccagcacatctggcctccaactgattaacgtgacccagcaccccgctcgcatcgccgaaacacctgggccgaaaaccacgtccctgaagacaattaattgcatcaacctcagagcgagcgtctttaaagagcatcgggaagtggagatcaacgtgctgcttccccagattgccgtcaatctgtctaactgtcacgttgtgatcaatagccacgtgtgcgactactccctcgataccgacggacctgtccgcctgccccggattcatcacgagggcaccttcatccctgggacatataagattgtgatcgataaaaagaacaaacttaatgaccggtgtagcctggttaccaactgcgtgatcaagggacgcgaagtcagaaagggccagtctgtgctccggcaatacaaaacagagattaagatcgggaaagcgtccacgggaagcagaaagctgctgtccgaggaacccggcgatgactgtatttctcgcacccagctcctgaaaacagaaaccgccgagatccatgacgataattatggcgggcctggagacaagattacaatctgcaacggcagcaccatcgttgatcagcggcttgggtccgagctgggatgttacacgattaatagagtgaagtcttttaaactctgcgaaaacagcgctaccggcaagacatgcgagatcgactccacccccgtcaaatgtcgccaggggttctgcctgaagattacacaagaaggccggggacacgtgaaactgtctagaggcagcgaggtcgtgcttgatgcctgtgactccagctgcgagatcatgattccgaaggggaccggagatatcctcgttgactgttctggcgggcagcagcatttcctgaaggataatctgattgacctcggatgccctcacatccccctgcttggcaaaatggccatctatatttgtcgcatgtccaaccaccctcggacaaccatggcttttctgttctggtttagcttcgggtacgtgatcacgtgcatcttttgtaaggctctcttctattctctgattattatcggcacactggggaaaaagatcaaacagtacagagaacttaagccccaaacctgcaccatttgtgagacagccccggtcaatgctatcgatgccgaaatgcatgacctcaactgctcctacaatatttgcccttattgtgccagccgcctgacctctgacggcctggctcggcacgtgacgcagtgccccaagagaaaagagaaggttgaagagacagagctctacctgaaccttgaacgcatcccttggattgtgcggaaactgctccaggtctccgagagcaccggggtggccctgaagagatccagctggctgatcgtgcttctcgttctgctgacagtctctctcagccccgtgcagtccgcgcccgtgggacatggcaaaaccatcgaaacatatcaaacccgggaggggtttacgaacatttgtctgttcatgcttggatctatcctgtttattgtcagctgcctcgtgaagggcctggttgattccgtgtctgacagcttctttcctgggctgtccgtctgtaaaacctgctctatcggcagcattaatggattcgaaatcgagtcccacaagtgttactgcagcctcttttgttgcccgtattgtcgccactgctctgctgatagagagatccatcagcttcacctgggcatttgcaagaaacggaagacagggtccaacgtgatgctggccgtttgtaaaagaatgtgcttcaaggccaccatcgaagctagccgccgggccctcctgattagatctatcattaatacaaccttcgtgatctgtattcttacgctggctatctgcgtcgtgtccacaagcgccgttgagatggaaaacctccccgcgggaacctgggagcgcgaagaggacctgacaaatttttgtcatcaggagtgccaagtgtccgaaaccgagtgtctgtgcccttacgaagcccttgtcctgagaaaacccctcttcctggattctatcgtgaagggcatgaagaacctcctgaatagcacctcccttgagacaagcctgtctattgaggctccttggggagccatcaacgtgcagtccacgtttaaacccaccgtcagcacagctaatattgccctctcttggagctccgttgaacaccggggaaacaagatcctggtgaccggccgctctgagagcattatgaaactggaagagagaacaggggtgtcctgggaccttggcgtcgaagatgcgtctgagagcaagctgctcaccgtgtccatcatggacctgagccagatgtattctcctgttttcgagtacctctccggagatagacaggtggaagagtggccgaaagccacgtgtacaggcgactgccccgaacgctgtgggtgcaccagctctacctgcctgcataaggagtggcctcactccagaaattggcggtgtaaccccacatggtgctggggagtcggcaccgggtgtacatgctgtggagtggatgttaaggacctttttacggatcacatgttcatcaaatggaaggtggaatacattaaaaccgaggctatcgtctgcgtggagctgacaagccaagaacgccagtgttccctcattgaggccggcaccagatttaatctgggccctgttacaatcaccctgtctgaaccccggaacattcagcagaaacttccgcctgagatcatcacgctgcatcccaaaattgaagaggggttctttgacctcatgcacgtgcaaaaggtcctgagcgcttccaccgtgtgcaagctccagagctgtacacatggaatccccggcgacctgcagatttatcacatcgggaatcttctgaaaggagatcgcctgaacggccatctcattcacaagatcgagcctcacttcaacacctcttggatgtcctgggacgggtgcgatctggactactattgtaatatgggagattggcccagctgcacatacaccggcgtgacacagcataaccacgccgcctttgtcaatcttctgaacattgaaacggactataccaaaacattccattttcactctaagagagttaccgctcacggcgatacccctcaactcgacctgaaagcgcggccgacatacggggccggagagatcacggtgctcgtggaagtcgctgatatggagctgcataccaagaaagtggagatctccggccttaagttcgccagcctggcctgcacagggtgttatgcttgctctagcggaatttcctgtaaggttagaatccacgtggacgaacccgatgagctgaccgtccatgtgaaatctagcgaccctgatgttgtggccgcgtccacaagcctcatggctcgcaagctggagttcggcaccgactccacgtttaaagccttctctgccatgcccaagacaagcctttgcttttacattgtcgaacgggaatactgtaaatcctgctctgaggacgataccaagaagtgtgtggacaccaaactggatcagcctcagagcatcctcattgagcacaaggggacaatcatcggaaaacaaaatgatacctgcacagctaaggcctcctgttggctggaatctgtcaagagcttcttttatggcctcaagaacatgctgggctccgtgttcgggaactttttcgttggcattcttctgtttctggcgcccttcgtgctcctggtccttttctttatgtgcggatggaagttcctgttttgtttcaaatgctgcagacgcacccgggggctctttaagtacagacatctgaaagacgacgaggaaacgggatatcgccggatcattgagagactcaatagcaagaaaggcaagaatcgcctgcttgatggggaacggctggctgacagaaagatcgccgagctgttctctacaaaatcccacattggatga

SEQ ID NO: 13676 - RNA, 5055 nt, synthetic construct
  misc_feature 1..5055: note = derived and/or modified CDS sequence (opt5) from CCHFV(Matin)__AF467769.2__GP
  source 1..5055: mol_type = other RNA
atgtacaccctgctcctgtgcgccatcctttgtagccagctgtggtcctctgagggcattcacgggctcagcaacgaaacacaacatggaaatgcttccacgatcaaggcccccgaggtgtctcagggcctggggcttcctgtcagcaccgcgccgcccattacatccgaccctccctctatcaccagcgctgcctccgttagcggacctgaaggctctggggatacaaacacctcccctcccgtgacaacccagggactgacgctcccggagaccacactggaactgctcaccacaaccaatacgggcgccagctctacagtgattgtcgacgtgtccacccagacagttaaagatacccccgtgagcaccgctcacacatctcctcccggcacgccttccgcccccaccacaccgcaagggacccatcacacagctagaggactgcttagcgtcacctccacgaagtctgaggaggccagcacacagaccaaccctaaaaagacctccatggaaacaaatagccccggccctgcgacctctgagacaccctcccccagccctacgacccaggccccgacagaaaacaataaccccaatacccctcggcagcccacacctcccacccaaccggctacgccttctcccgtgaccagccctgccctgctcgcttcctctcagggggacacaagcaccgccgttcaggatgtgcatccctcccctacaaaccgcagcaaaagaaatctggagatggagatcatccttaccctgtctcagggactcaagaagtattacggcaaaattctgaagctgctcgacctgacgcttgaagaggatacagaagggctgctcgagtggtgcaaacggaacctgggacttgtctgtgacgattccttctttcaaaagcgcatcgaagagttctttctgaccggcgagggccacttcaatgaagtgctccagtttaaaacacccagcaccctgtctccgaccgagcctgcgagagccgggtcccccacagtggaacccttcaagagctattttgctcggggactgctctccatggactctggctacttcagcgccaagtgctatcctcgcgcttccaactctgggctgcagcttattaatatcacgcaacacagcgccagaattaccgatacaccgggacccaaaatcaccaacctgaagacaattaactgtatcaatctcaaagcctccacctttaaggagcatcgggaaatcgagattaacgtcctgcttcctcaggttgctgtgaatctgagctcttgccacgtgctcatcaaatcccatgtctgtgactacagcctggatattgacggccccgtgcgcctgcctagaatccaccacgaggggacgttcattcccggaacatataagatcgttatcgacaaaaagaacaagcagaatgatcggtgcaccattgtgaccaactgtgtcatcaaaggccgcgaaattagaaagggccagtctgtgctccggcaatacaaaacagagatcaagattgggaaagcgtccagcggatctcgcagactgcttagcgaagagtccggcgacgattgcatcagccggacccagctgctcagaacagaaacggccgagatccattctgactcctacgggggacctggcgataagattaccatctgtaatgggagcacagttgtggaccagcgcctgggctccgagctgggatgctataccattaaccgggtcaagtcttttaaactttgcgaaaatagcgctacaggcaagtcctgtgagatcgattctacccccgtgaaatgcagacaggggttctgtctcaagattacgcaagaaggacgcggccacgtcaaactgagccgggggtccgaggtggttctggacgcctgcgattctagctgtgagatcatgattccgaagggaaccggcgacatcctcgtggattgctccgggggccagcagcattttctgaaggacaaccttatcgacctgggatgtcctaatattcccctcctgggcaaaatggccatctacatttgcagaatgagcaaccaccctaagacaaccatggtcttcctgttctggttttctttcgggtatgtgatcacatgtattctttgcaaagttatcttttacctcctgatcgtggtcggaaccctgggcaagaaattcaagcagtatcgcgaactcaagccccaaacatgtaccatttgcgagacgacaccggtgaatgctatcgatgccgaaatgcatgacctgaactgctcctacaatatttgtccttattgcgcgagccggcttacctctgatgggctggctagacacgtgatgcagtgtcccaaacgcaaggagaaaatcgaagagaccgagctctacctgaacctggaacggattccttgggttgtcagaaagctgctccaggtgtccgagagcacaggagtggccctgaaaagatcttcctggctggtcgtgctcctggttcttctgaccgtgagcctctcccccgtccagagcgcccccatcggccacgggaagacggtggaaacataccaaatccgggagggctatacctctgtttgcctgtttgtgctgggaagcattcttttcatcgtctcctgtctcatgaaaggcctggtggactctgatgggaacagctttttccctggactgtccatttgcaagacatgttctatcggcagcattaatgggtttgaaatcgagtcccataagtgctactgttctctcttctgctgtccgtattgcagacactgcagcaccgaccgggagatccataaactgcacctttccatttgtaagaaacgcaagacaggaagcaacgttatgctggctgtgtgcaaaagaatgtgttttcgggccaccgtcgaagtgtctaataaggctctcctgatcagatccattatcaacacgaccttcgtggtctgcattctgatccttgccgtttgtgtggtgagcacatctgcggtcgagatggaatccctgcccgccggcacctgggagcgcgaagaggatctcattaatttttgccaccaggagtgtcaggtgacagaaaccgagtgcctgtgtccttacgaagctctcgttctgcggaagccccttttcctggacagcatcatcaaagggatgaagaacctccttaattccacgtctctggagacaagcctttccattgaggccccttggggcgctatcaacgtgcaaagcaccttcaaacccacaatgtctgccgcgaatattgccctgtcctggagctctgtcgaacatagaggaaacaagatcctcgtgagcggccgctccgagtctattatgaaactggaagagagaaccgggatcagctgggatctcggagttgaagacgcttccgagtctaagctgcttaccgtgagcgtcatggatctgtcccagatgtatagccctgtgtttgagtacctctctggcgaccggcaggttgaagagtggccgaaggccacatgcacgggggattgtcccgaacgctgcggatgcacctccagcacatgtctgcacaaagagtggcctcattccagaaattggcggtgcaaccccacctggtgttggggcgtgggcacagggtgcacctgttgcggactggacgtcaaggaccttttcacggattatatgtttgtgaaatggaaggtggaatacatcaaaacagaggtcattgtttgtgtggagctgacctctcaggaacgccaatgcagcctcatcgaggctggcaccagattcaatctggggcctgtgacaattaccctctccgaaccccggaacatccagcagaagctgccgcctgagattgtcacacttcacccccgcatcgaagagggatttttcgacctgatgcatgtgcagaaggttctgtctgccagcacggtgtgtaaactccaatcctgcacccacggcgtccccggggatcttcaggtgtaccacatcggaaatcttctgaagggcgacaaagttaacggccatctcattcacaagatcgagcctcattttaacacaagctggatgtcttgggatgggtgtgacctggattattactgcaatatgggagactggccctcctgcagctataccggcgtgacacagcacaaccatgccgctttcgtcaatatgctctctattgaaaccgattacacgaaaaactttcacttccactccaagagagtgaccgcgcatggggacacacctcagctggatcttaaagcccggccgacctatggagctggcgagatcacagtcctggtggaagttgccgacatggagctgcacaccaagaagattgagatcagcgggctcaaatttgcctctctgacatgtacgggatgctacgcttgtagctccggcatttcttgcaaggtgcgcatccatgtcgatgaacccgacgagcttaccgtgcacgttaaaagcgaagaccctgatatcgtggccgcgtccagctccctgatggctagaaagctcgagttcggcacagactctacctttaaagccttcagcgccatgcccaagacctccctgtgtttctatattgtcgaacgggagtactgcaagtcttgtagcaaagaggatacacaaaagtgcgtgaatacgaaactcgaacagcctcagtccatcctgattgagcacaaggggaccatcattggaaaacaaaacgacacatgtaccgctaaggcctcttgctggcttgaaagcgtgaagtcctttttctacggcctgaaaaatatgctgagcgggatctttggaaacgttttcatcggcatttttctcttcctggcgccctttgctctgctgatcctcttctttatgttcgggtggcgcattctgttttgtttcaagtgctgccgccggacaagaggactcttcaaatatcgccatctgaaggatgacgaggaaaccggctaccggaaaatcattgagagacttaataacaagaagggcaaaaataagctgctggatggggagcgcctcgccgaccggaaaatcgccgaactgttttctacgaagacacacgtcggatga

SEQ ID NO: 13677 - RNA, 5052 nt, synthetic construct
  misc_feature 1..5052: note = derived and/or modified CDS sequence (opt5) from CCHFV(UCCR4405)__KY484029.1__GP
  source 1..5052: mol_type = other RNA
atgcacgccctgctcgtgtgcttcatcctgtaccttcagctgagcggcctcgggggagctcatagacaatccaacgccaccgagcacaatggcacaaacacgaccacagcgcccgggacctctcagagccctaagccgcccgtctccacaaccctgcctcatacacccgaagcctctaccattaaacttacgacccctacaagcgagaccgaaggatccggcgagacaacgccccctccgaataccacacaggggctgcccctccctggaaccacacccgaacggtctgccaccaccgccacaagcacgtccagcaccgacgatatgaactctacaacccagatgacagacaatacccctacgtccacagttagcatcggcctgtcttccagcccctctatgccgtccaccagccaaggcattcactatcctgtgcgctccctgctctctgtgagctcccccaagaccgctacaacccctacacccatgagccccggggaggtctctcctgagacgtccagccagcattctgccatgagcagaatcccgaccctgtacacagctacccaggtgtccacagaaaacaccaatcggtctattccccgccagagcgagtccagcgttcaacctgccacgcagtctcccatcacctcccctgcgcagacaatccttctgatgagcgccgctcccaccgccattcaggatatgcacccgtctcctaaaaacagatccaagcggaatctcgaagtggagatcattctgacacttagccaaggactgaaaaagtattacggcaagatcctcaaactgctgcacctcaccctggaggaagacacggaggggcttctggaatggtgtaagcgcaacctcggatccaattgcgatgacgactttttccagaaaagaattgaggaatttttcatcacaggcgaggggtattttaacgaggtcctgcagttcaagaccccctctacacttagccctaccgaaccctcccatgtgcggctgcctaccgctgagccctttaaatcttacttcgccaagggatttctcagcattgattccggctatttcagcgcgaagtgttacccgagatcttccacaagcggcctgcaactgatcaatgttacgcagcaccctgcccgcatcgctgaaacccccgggcccaaaacaacctctctcaagacaattaactgcatcaatctgcgggcctccgtgtttaaagagcatcgcgaagtcgagattaacgtgcttctgcctcagatcgctgtgaacctcagcaattgtcacgtcgttattaactctcacgtgtgcgattacagcctggacaccgatggaccggtgagacttccccggatccatcacgagggcgccttcatccctgggacgtataagattgtcatcgacaaaaagaataaactgaacgatcgctgttccctcgtgacaaattgcgttattaagggaagagaagtgcggaagggccagagcgtcctgagacaatacaaaaccgagatcaagattgggaaagcctctaccggatcccgcaagctgctcagcgaggaacccggcgacgactgtatctcccggacacagctgcttaaaaccgaaacagctgagatccatgatgacaactatggcgggcctggagataagattacgatctgcaatggctctaccattgtggaccagagactggggagcgagctcggatgttacacaatcaaccgcgttaagtcctttaaactgtgcgaaaattctgcgaccggcaagacatgcgagattgatagcacccccgtgaaatgtcggcaggggttctgcctgaagatcacgcaagaaggcagaggacacgtcaaactttcccgcggctctgaggtggtcctcgacgcctgtgatagctcctgcgaggtgatgattcctaaggggaccggagacatcctggttgattgtagcggcgggcagcagcatttcctgaaggacaacctcatcgatctgggatgcccccacattccgcttctgggcaaaatggctatctatatttgtcggatgtctaatcaccctagaacaaccatggcctttctcttctggttttccttcgggtacgtgatcacatgcatcttttgtaaggccctgttctatagcctgattatcattggcacccttgggaaaaagatcaaacagtaccgcgaactcaagccccaaacatgcaccatttgtgagacggctcctgtcaacgccatcgacgcggaaatgcatgacctgaagtgctcttacaatatttgcccctattgtgcttcccggctgacaagcgatggcctcgccagacacgtgacccagtgcccgaaacgcaaggagaaagttgaagagaccgagctgtaccttaacctggaacggatcccttggatcgtgagaaagctcctgcaggtctctgagtccacaggggtggccctgaaacggagctcctggcttattgtgctcctggttctgctcaccgtcagcctgtctcccgtgcagagcgctcctgtgggacatggcaagacgatcgaaacatatcaaacccgcgaggggtttacatccatttgtcttttcatgctgggatctatcctctttattgtcagctgcctggtgaaaggcctggttgactccgtgtctgatagcttctttcccgggctttccgtctgtaagacctgctctatcggcagcatcaatggattcgaaattgagtcccacaagtgttactgcagcctcttttgttgcccctattgtagacactactctgccgaccgggagatccatcagctgcacctgtccatttgcaaaaagagaaaaacaggcagcaacgtgatgctcgctgtttgcaagcgcatgtgtttcaaagccaccatcgaagcgtctcggagagccctgcttattcgctccatcattaacacgaccttcgtgatctgcatcctgattctcgctatctgtgtcgtgagcacatccgccgttgagatggaaaatctgcctgctgggacctgggagagagaagaggatctgacaaacttttgccatcaggagtgtcaagtgaccgaaacggagtgcctttgtccgtatgaagccctggtcctccggaagcccctgttcctcgactctacagtgaagggaatgaaaaatctgcttaacagcacctccctggagacaagcctctctattgaggcgccttggggcgccatcaatgtgcagtccacctttaagcccaccgtcagcacagctaacattgccctgtcttggagctccgttgaacaccgcgggaataaaatcctggtgacgggaagatctgagagcatcatgaaacttgaggaacggaccggcgtgtcctgggatctgggggtcgaagacgcttctgagagcaagctcctgacagtgtccattatggatctcagccagatgtactctcctgttttcgagtacctgtccggcgaccgccaggtggaagagtggcccaaggctacctgcacaggagattgtcctgaaagatgcggctgtaccagctccacgtgccttcataaggagtggccgcactctcggaactggcgctgcaatcccacatggtgttggggagtcggaaccggctgcacctgttgcggggtggacgttaaagatctgtttacagaccacatgttcgtgaagtggaaagtcgaatatatcaagaccgaggccattgtgtgtgttgagctcacaagccaagaaagacagtgctccctgatcgaggctggaacgcggtttaacctgggccctgtgaccattacactttctgaaccccgcaatatccagcagaaactgcctcccgagatcattaccctccatccgaagatcgaagagggcttctttgacctgatgcacgtccaaaaggtgctcagcgcgtccacagtgtgtaaactgcagagctgcacccatgggattcctggagatcttcagatctaccacattggcaacctgctgaagggggacagagtcaatggacatctcatccacaaaattgagccccacttcaacacgtcttggatgtcctgggatggctgtgacctggattattactgcaatatggggaactggcccagctgtacctatacaggagttacccagcataaccacgccgcttttgtgaatcttctgaacatcgaaacagactacaccaagacattccattttcactctaaacgggtgacggcccacggcgatacccctcaactcgacctgaaggccagacccacatatggcgctggggagatcaccgtcctcgtggaagttgccgatatggagctgcataccaaaaaggtggagatttccggacttaagttcgcgagcctggtctgcacaggctgctacgcttgttctagcgggatctcctgcaaagtgcgcattcacgttgacgaacctgatgagctgacggtgcatgtcaagtctagcgacccggatgtggtcgccgcctccaccagcctcatggctcggaaactggagttcggaacagactccatctttaaggccttctctgcgatgcccaaaaccagcctttgtttttacattgtggaaagagaatattgcaagtcctgttctgaggacgatacaaagaaatgcgttgacaccaagctggagcagcctcagagcatcctcatcgaacacaaaggcacgattatcgggaagcaaaatgatacatgtaccgctaaagcctcctgctggctggagtctgtcaagagcttcttttacggactcaagaacatgctgggctccgtgttcggcaactttttcgtggggattcttctgtttctggcccccttcgttctcctggtgcttttctttatgttcggatggaaaatcctgttttgtttcaagtgctgtcgccggaccagaggcctctttaaatatcgccatctgaaggacgatgaagagacagggtaccggagaattatcgaacgcctcaatagcaaaaagggaaagaatcggctgcttgacggcgagagactggctgatcggaaaatcgccgagctgttctctaccaagacacacattgggtga

SEQ ID NO: 13678 - RNA, 5052 nt, synthetic construct
  misc_feature 1..5052: note = derived and/or modified CDS sequence (opt5) from CCHFV(Drosdov)__DQ211630.1__GP
  source 1..5052: mol_type = other RNA
atgcacgccctgctcgtgtgcttcatcctgtaccttcagctgagcggcctcgggggagctcatagacaatccaacgccaccgagcacaatggcacaaacacgaccacagcgcccgggacctctcagagccctaagccgcccgtctccacaaccctgcctcatacacccgaagcctctaccattaaacttacgacccctacaagcgagaccgaaggatccggcgagacaacgccccctccgaataccacacaggggctgcccctccctggaaccacacccgaacggtctgccaccaccgccacaagcacgtccagcaccgacgatatgaactctacaacccagatgacagacaatacccctacgtccacagttagcatcggcctgtcttccagcccctctatgccgtccaccagccaaggcattcactatcctgtgcgctccctgctctctgtgagctcccccaagaccgctacaacccctacacccatgagccccggggaggtctctcctgagacgtccagccagcattctgccatgagcagaatcccgaccctgtacacagctacccaggtgtccacagaaaacaccaatcggtctattccccgccagagcgagtccagcgttcaacctgccacgcagtctcccatcacctcccctgcgcagacaatccttctgatgagcgccgctcccaccgccattcaggatatgcacccgtctcctaaaaacagatccaagcggaatctcgaagtggagatcattctgacacttagccaaggactgaaaaagtattacggcaagatcctcaaactgctgcacctcaccctggaggaagacacggaggggcttctggaatggtgtaagcgcaacctcggatccaattgcgatgacgactttttccagaaaagaattgaggaatttttcatcacaggcgaggggtattttaacgaggtcctgcagttcaagaccccctctacacttagccctaccgaaccctcccatgtgcggctgcctaccgctgagccctttaaatcttacttcgccaagggatttctcagcattgattccggctatttcagcgcgaagtgttacccgagatcttccacaagcggcctgcaactgatcaatgttacgcagcaccctgcccgcatcgctgaaacccccgggcccaaaacaacctctctcaagacaattaactgcatcaatctgcgggcctccgtgtttaaagagcatcgcgaagtcgagattaacgtgcttctgcctcagatcgctgtgaacctcagcaattgtcacgtcgttattaactctcacgtgtgcgattacagcctggacaccgatggaccggtgagacttccccggatccatcacgagggcgccttcatccctgggacgtataagattgtcatcgacaaaaagaataaactgaacgatcgctgttccctcgtgacaaattgcgttattaagggaagagaagtgcggaagggccagagcgtcctgagacaatacaaaaccgagatcaagattgggaaagcctctaccggatcccgcaagctgctcagcgaggaacccggcgacgactgtatctcccggacacagctgcttaaaaccgaaacagctgagatccatgatgacaactatggcgggcctggagataagattacgatctgcaatggctctaccattgtggaccagagactggggagcgagctcggatgttacacaatcaaccgcgttaagtcctttaaactgtgcgaaaattctgcgaccggcaagacatgcgagattgatagcacccccgtgaaatgtcggcaggggttctgcctgaagatcacgcaagaaggcagaggacacgtcaaactttcccgcggctctgaggtggtcctcgacgcctgtgatagctcctgcgaggtgatgattcctaaggggaccggagacatcctggttgattgtagcggcgggcagcagcatttcctgaaggacaacctcatcgatctgggatgcccccacattccgcttctgggcaaaatggctatctatatttgtcggatgtctaatcaccctagaacaaccatggcctttctcttctggttttccttcgggtacgtgatcacatgcatcttttgtaaggccctgttctatagcctgattatcattggcacccttgggaaaaagatcaaacagtaccgcgaactcaagccccaaacatgcaccatttgtgagacggctcctgtcaacgccatcgacgcggaaatgcatgacctgaagtgctcttacaatatttgcccctattgtgcttcccggctgacaagcgatggcctcgccagacacgtgacccagtgcccgaaacgcaaggagaaagttgaagagaccgagctgtaccttaacctggaacggatcccttggatcgtgagaaagctcctgcaggtctctgagtccacaggggtggccctgaaacggagctcctggcttattgtgctcctggttctgctcaccgtcagcctgtctcccgtgcagagcgctcctgtgggacatggcaagacgatcgaaacatatcaaacccgcgaggggtttacatccatttgtcttttcatgctgggatctatcctctttattgtcagctgcctggtgaaaggcctggttgactccgtgtctgatagcttctttcccgggctttccgtctgtaagacctgctctatcggcagcatcaatggattcgaaattgagtcccacaagtgttactgcagcctcttttgttgcccctattgtagacactactctgccgaccgggagatccatcagctgcacctgtccatttgcaaaaagagaaaaacaggcagcaacgtgatgctcgctgtttgcaagcgcatgtgtttcaaagccaccatcgaagcgtctcggagagccctgcttattcgctccatcattaacacgaccttcgtgatctgcatcctgattctcgctatctgtgtcgtgagcacatccgccgttgagatggaaaatctgcctgctgggacctgggagagagaagaggatctgacaaacttttgccatcaggagtgtcaagtgaccgaaacggagtgcctttgtccgtatgaagccctggtcctccggaagcccctgttcctcgactctacagtgaagggaatgaaaaatctgcttaacagcacctccctggagacaagcctctctattgaggcgccttggggcgccatcaatgtgcagtccacctttaagcccaccgtcagcacagctaacattgccctgtcttggagctccgttgaacaccgcgggaataaaatcctggtgacgggaagatctgagagcatcatgaaacttgaggaacggaccggcgtgtcctgggatctgggggtcgaagacgcttctgagagcaagctcctgacagtgtccattatggatctcagccagatgtactctcctgttttcgagtacctgtccggcgaccgccaggtggaagagtggcccaaggctacctgcacaggagattgtcctgaaagatgcggctgtaccagctccacgtgccttcataaggagtggccgcactctcggaactggcgctgcaatcccacatggtgttggggagtcggaaccggctgcacctgttgcggggtggacgttaaagatctgtttacagaccacatgttcgtgaagtggaaagtcgaatatatgaagaccgaggccatcgtgtgtgttgagctcacaagccaagaaagacagtgctccctgattgaggctggaacgcggtttaacctgggccctgtgaccatcacactttctgaaccccgcaatattcagcagaaactgcctcccgagatcatcaccctccatccgaagattgaagagggcttctttgacctgatgcacgtccaaaaggtgctcagcgcgtccacagtgtgtaaactgcagagctgcacccatgggatccctggagatcttcagatttaccacatcggcaacctgctgaagggggacagagtcaatggacatctcattcacaaaatcgagccccacttcaacacgtcttggatgtcctgggatggctgtgacctggattattactgcaatatggggaactggcccagctgtacctatacaggagttacccagcataaccacgccgcttttgtgaatcttctgaacattgaaacagactacaccaagacattccattttcactctaaacgggtgacggcccacggcgatacccctcaactcgacctgaaggccagacccacatatggcgctggggagatcaccgtcctcgtggaagttgccgatatggagctgcataccaaaaaggtggagatctccggacttaagttcgcgagcctggtctgcacaggctgctacgcttgttctagcgggatttcctgcaaagtgcgcatccacgttgacgaacctgatgagctgacggtgcatgtcaagtctagcgacccggatgtggtcgccgcctccaccagcctcatggctcggaaactggagttcggaacagactccatttttaaggccttctctgcgatgcccaaaaccagcctttgtttttacatcgtggaaagagaatattgcaagtcctgttctgaggacgatacaaagaaatgcgttgacaccaagctggagcagcctcagagcattctcatcgaacacaaaggcacgatcattgggaagcaaaatgatacatgtaccgctaaagcctcctgctggctggagtctgtcaagagcttcttttacggactcaagaacatgctgggctccgtgttcggcaactttttcgtggggatccttctgtttctggcccccttcgttctcctggtgcttttctttatgttcggatggaaaattctgttttgtttcaagtgctgtcgccggaccagaggcctctttaaatatcgccatctgaaggacgatgaagagacagggtaccggagaatcattgaacgcctcaatagcaaaaagggaaagaatcggctgcttgacggcgagagactggctgatcggaaaatcgccgagctgttctctaccaagacacacatcgggtga

SEQ ID NO: 13679 - RNA, 5052 nt, synthetic construct
  misc_feature 1..5052: note = derived and/or modified CDS sequence (opt5) from CCHFV(44-ST-2010)__KR814859.1__GP
  source 1..5052: mol_type = other RNA
atgcacaccctgctcgtgtgcttcatcctgtaccttcagctgagcggcctcgggggagcccatggccaatccaacgctacagagcacaatgggacgaacaccacaaccgtccccggaacatctcagagccctaagccgcccgcctccaccacactgcctcatacccccgaatctagcacggttaaacttaccacacctacctccgagacagaaggctctggggagaccacgccccctccgaatacaacccagggactgccccctcccggcacaacccctgaaagacccgcgaccacagctacgagcatgtccagcaccgacaacatgaactctacaacccaggtgacagataataccccgacgtccacagtgagcatttctccttccagctctccctccatgcctagcacctcccaaggcatccactatcccgtccggtctctcctgagcgtgtccagccccaagaccgttacaacccctacaccgatgtctcccggggagatgtcccctgagacgagctctcagcatagcgccatgtcccgcattcccaccctgtacacagccacccaggtgtctacagaaaataccaacagaagcacgcctcggcagtccgagagctctgctcaacccgccacccagtccccgacaaccagccctacacagaccatcctcctgatgtctgctgcccccaaagcgattcaggacatgcacccttcccccacgaatcgcagcaagagaaaccttgaagtcgagatcatcctgacactctcccaaggactgaaaaagtattacggcaagattcttaaactgctccacctgaccctggaggaagatacagaggggctcctggaatggtgtaagcggaatcttggatctaactgcgacgatgactttttccagaaacgcatcgaggaatttttcattaccggcgaggggtattttaatgaggtgctgcagttcaagaccctcagcacactgtcccctacggaaccctctcatgttagacttccgaccgccgagccttttaaaagctacttcgctaagggatttctgtccatcgatagcggctatttctctgccaagtgttacccccggtccagcacatctggcctccaactgattaacgtgacccagcaccccgctcgcatcgccgaaacacctgggccgaaaaccacgtccctgaagacaattaattgcatcaacctcagagcgagcgtctttaaagagcatcgggaagtggagatcaacgtgctgcttccccagattgccgtcaatctgtctaactgtcacgttgtgatcaatagccacgtgtgcgactactccctcgataccgacggacctgtccgcctgccccggattcatcacgagggcaccttcatccctgggacatataagattgtgatcgataaaaagaacaaacttaatgaccggtgtagcctggttaccaactgcgtgatcaagggacgcgaagtcagaaagggccagtctgtgctccggcaatacaaaacagagattaagatcgggaaagctagcacgggaagcagaaagctgctgtccgaggaacccggcgatgactgtatttctcgcacccagctcctgaaaacagaaaccgccgagatccatgacgataattatggcgggcctggagacaagattacaatctgcaacggcagcaccatcgttgatcagcggcttgggtccgagctgggatgttacacgattaatagagtgaagtcttttaaactctgcgaaaacagcgctaccggcaagacatgcgagatcgactccacccccgtcaaatgtcgccaggggttctgcctgaagattacacaagaaggccggggacacgtgaaactgtctagaggcagcgaggtcgtgcttgatgcctgtgactccagctgcgagatcatgattccgaaggggaccggagatatcctcgttgactgttctggcgggcagcagcatttcctgaaggataatctgattgacctcggatgccctcacatccccctgcttggcaaaatggccatctatatttgtcgcatgtccaaccaccctcggacaaccatggcttttctgctctggttcagctttgggtacgtgatcacgtgcattttctgtaaggcgctgttttattctctgatcattatcggcacacttggaaagaagatcaaacagtacagagaactcaagccccaaacctgcaccatttgtgagacagccccggtcaatgctatcgatgccgaaatgcatgacctgaactgctcctacaatatttgcccttattgtgccagccgcctgacctctgacggcctcgctcggcacgtgacgcagtgccccaagagaaaagagaaggttgaagagacagagctgtaccttaacctggaacgcatcccttggattgtgcggaaactcctgcaggtctccgagagcaccggggtggccctgaagagatccagctggcttatcgtgctcctggttctgctcacagtctctctgagccccgtgcagtccgcgcccgtgggacatggcaaaaccatcgaaacatatcaaacccgggaggggttcacgaacatttgtctttttatgctgggatctatcctcttcattgtcagctgcctggtgaagggcctggttgattccgtgtctgacagctttttccctgggctttccgtctgtaaaacctgctcttttggcagcatcaatggattcgaaattgagtcccacaagtgttactgcagcctcttttgttgcccgtattgtcgccactgctctgctgatagagagatccatcagctgcacctgggcatctgcaagaaacggaagacagggtccaacgtgatgctcgccgtttgtaaaagaatgtgcttcaaggccaccattgaagctagccgccgggccctgcttatcagatctattatcaatacaaccttcgtgatttgtatcctgacgctcgctatttgcgtcgtgtccacaagcgccgttgagatggaaaacctgcccgcgggaacctgggagcgcgaagaggacctgacaaatttttgtcatcaggagtgccaagtgtccgaaaccgagtgtctttgcccttacgaagccctggtcctcagaaaacccctgttcctcgattctatcgtgaagggcatgaagaacctgcttaatagcacctccctggagacaagcctctctatcgaggctccttggggagccattaacgtgcagtccacgtttaaacccaccgtcagcacagctaatatcgccctgtcttggagctccgttgaacaccggggaaacaagattctggtgaccggccgctctgagagcatcatgaaacttgaagagagaacaggggtgtcctgggacctgggcgtcgaagatgcgtctgagagcaagctcctgaccgtgtccattatggacctcagccagatgtattctcctgttttcgagtacctgtccggagatagacaggtggaagagtggccgaaagccacgtgtacaggcgactgccccgaacgctgtgggtgcaccagctctacctgccttcataaggagtggcctcactccagaaattggcggtgtaaccccacatggtgctggggagtcggcaccgggtgtacatgctgtggagtggatgttaaggacctgtttacggatcacatgttcatcaaatggaaggtggaatacatcaaaaccgaggctattgtctgcgtggagctcacaagccaagaacgccagtgttccctgatcgaggccggcaccagatttaatctgggccctgttacaattaccctttctgaaccccggaacatccagcagaagctgccgcctgagattatcacgctccatcccaaaatcgaagaggggttctttgacctgatgcacgtgcaaaaggtcctcagcgcttccaccgtgtgcaagctgcagagctgtacacatgggattcccggcgaccttcagatctatcacattgggaatctgctgaaaggagatcgcctcaacggccatctgatccacaagattgagcctcacttcaacacctcttggatgtcctgggacgggtgcgatcttgactactattgtaatatgggagattggcccagctgcacatacaccggcgtgacacagcataaccacgccgcctttgtcaatctgctcaacatcgaaacggactataccaaaacattccattttcactctaagagagttaccgctcacggcgatacccctcaactggacctcaaagcgcggccgacatacggggccggagagattacggtgctggtggaagtcgctgatatggagcttcataccaagaaagtggagatctccggcctgaagttcgccagcctggcctgcacagggtgttatgcttgctctagcggaatctcctgtaaggttcgcattcacgtggacgaacccgatgagctcaccgtccatgtgaaatctagcgaccctgatgttgtggccgcgtccacaagcctgatggctagaaaacttgagttcggcaccgactccacgtttaaagccttctctgccatgcccaagacaagcctgtgcttttacatcgtcgaacgggaatactgtaaatcctgctctgaggacgataccaagaagtgtgtggacaccaaactcgatcagcctcagagcattctgatcgagcacaaggggacaattatcggaaaacaaaatgatacctgcacagctaaggcctcctgttggctcgaatctgtcaaatccttcttttatggcctgaagaacatgcttggctccgtgttcgggaactttttcgttggaatcctgctgtttctcgcgcccttcgtgctgcttgtcctgtttttcatgtgcggctggaagattctcttctgttttaaatgctgcagacgcacccgggggctgttcaagtacagacatctcaaagacgacgaggaaacgggatatcgccggatcattgagagactgaatagcaagaaaggcaagaatcgccttctggatggggaacggctggctgacagaaagatcgccgagctcttttctacaaaatcccacattggatga

SEQ ID NO: 13680 - RNA, 5052 nt, synthetic construct
  misc_feature 1..5052: note = derived and/or modified CDS sequence (opt5) from CCHFV(3756-ST-2007)__KR814866.1__GP
  source 1..5052: mol_type = other RNA
atgcacaccctgctcgtgtgcttcatcctgtaccttcagctgagcggcctcgggggagcccatggccaatccaacgctacagagcacaatagaacgaacaccacaaccgtccccgggacatctcagagccctaagccgcccgcctccaccacactgcctcatacccccgaatctagcacggttaaacttaccacacctacctccgagacagaaggatctggcgagaccacgccccctccgaatacaacccaggggctgcccctccctggaacaacccccgaacggagcgcgaccacagctacgtccaccagctctacagacaacatgaataccacaacccaggtgacggataacacacctacctccaccgtgagcatttctccctccagctctccgtccatgcctagcacatcccaaggcatccactatcccgtccgctctctgctgagcgtgtccagccctaagaccgttacaacgcccacccccatgtctcctggcgagatgtccccggagacaagctctcagcatagcgccatgtcccggattcccaccctctacacagccacccaggtgtctacggaaaatatcaacagaagcacccctcgccagtccgagagctctgtccaacccgctacacagtcccctattaccagccccgcccagacaatcctgcttatgtctgctgccccgaaagcgatccaggacatgcacccttcccccaccaatagaagcaagcggaacctggaagtggagattatcctcacgctgtcccaagggcttaaaaagtattacggaaagattctgaaactcctgcacctgacactcgaggaagataccgagggcctgcttgaatggtgtaagcgcaatctggggtctaactgcgacgatgactttttccagaaaagaatcgaggaatttttcattacaggagagggctattttaatgaggttctccagttcaagaccctgagcaccctttcccctacagaaccctctcatgtgcggctgcctacggccgagccctttaaaagctacttcgctaaggggtttctctccatcgatagcggatatttctctgccaagtgttacccgcgctccagcacctctggcctgcaactgattaacgtcacacagcaccctgctagaatcgccgaaacccccggccccaaaacaacctccctcaagacgatcaattgcattaacctgcgggcgagcgtgtttaaagagcatcgcgaagtggagatcaacgtccttctgcctcagattgccgttaatctctctaactgtcacgtggtgatcaatagccacgtctgcgactactccctggatacagacgggccggtgagacttccccggattcatcacgagggaaccttcatccctggcacctataagatcgttattgatcgcaaaaacaagctgaatgacagatgtagcctcgtgacaaactgcgtcatcaaagggcgggaagtgagaaagggacagtctgttctgcgccaatacaagaccgagattaaaatcggcaaggcttccacagggagccggaaactgctctccgaggaacccggagatgactgtatttctagaacgcagctgcttaagaccgaaacagccgagatccatgacgataattatggcggccctggggacaaaatcaccatttgcaacggaagcacaatcgtggatcagcgcctgggctccgagctcgggtgttacaccattaatcgggtcaagtcttttaagctgtgcgaaaacagcgctacgggaaaaacctgcgagatcgactccacacccgtgaagtgtagacagggcttctgcctgaaaattacccaagaagggcgcggccacgtcaaactttctcggggaagcgaggtggttctcgatgcctgtgactccagctgcgagatcatgattcctaaaggcacaggggatatcctggtggactgttctggaggccagcagcatttcctgaaggataatctcatcgacctggggtgcccccacattccgcttctgggaaagatggccatctatatttgtagaatgtccaaccaccctcgcaccacaatggcttttctcttctggtttagcttcggctacgtcattacctgcatcttttgtaaagcgctgttctattctctgatcatcattgggacgcttggcaagaaaatcaagcagtaccgggaactcaaaccccaaacatgcaccatttgtgagaccgcccctgtgaatgctatcgatgccgaaatgcatgacctgaactgctcctacaatatttgcccctattgtgccagcagactgacatctgacggactcgctcgccacgttacccagtgcccgaagcggaaggagaaagtggaagagacggagctgtaccttaacctggaaagaatcccttggatcgtccggaagctccttcaggtgtccgagagcacaggcgtggccctgaaacgctccagctggcttattgttctcctggtcctgctcaccgtgtctctgagccccgtgcagtccgcgcctgtcgggcatggaaagacaatcgaaacctatcaaacaagagagggctttacctctatttgtcttttcatgctggggagcatcctctttattgtgtcctgcctggttaaaggactggtggattctgtcagcgactccttctttcccggcctttctgtgtgtaagacgtgcagcatcgggtccatcaacggcttcgaaattgagagccacaaatgttactgctctctcttttgttgcccctattgtcggcactgctccgctgatagagagatccatcagctgcacctgagcatttgcaagaagcgcaaaaccggatctaatgttatgctcgccgtgtgtaagcggatgtgcttcaaagccacaatcgaggcttccagacgcgccctgcttattagaagcatcattaacaccacattcgtcatctgtatcctgaccctcgctatttgcgtggtttccacgtctgccgtggaaatggaagacctgcctgcgggcacatgggagcgggaagaggatctgaccaatttttgtcatcaggagtgccaagtcacagaaaccgagtgtctttgcccgtacgaagccctggtgctccgcaagcccctgttcctcgacagcatcgtgaaagggatgaagaacctgcttaattccaccagcctggagacatctctctccattgaggctccttggggagccatcaacgtccagagcacgtttaagcccaccgtttctacagctaatattgccctgagctggtcctctgtggaacacagaggcaacaaaatcctggtgaccgggcggagcgagtccatcatgaaacttgaggaacgcacaggagtctcttgggatctgggcgtggaagacgcgagcgagtccaagctcctgaccgttagcattatggatctctctcagatgtattcccctgtgttcgagtacctgagcggggacagacaggtcgaagagtggcccaaggccacgtgtacaggcgattgccctgaacggtgtggatgcacctcctctacctgccttcataaagagtggccgcacagccgcaattggagatgtaaccccacatggtgctggggcgtggggaccggatgtacatgctgtggcgttgacgtgaaggatctgtttacggaccacatgttcatcaagtggaaagtcgaatacattaagaccgaggctatcgtgtgcgttgagctcacatcccaagaacggcagtgttctctgattgaggccgggacccgctttaatctgggacctgtgacaatcacccttagcgaacccagaaacatccagcagaaactgcctcccgagattatcacgctccatccgaagattgaagagggcttctttgacctgatgcacgtccaaaaagtgctctccgctagcaccgtgtgcaagctgcagtcttgtacacatggcatccctggggatcttcagatttatcacatcggaaatctgctgaagggcgaccgggtcaacgggcatctcattcacaaaatcgagccccacttcaatacctcctggatgagctgggatggatgcgacctggattactattgtaacatgggcgactggccctcttgcacatacaccggggttacacagcataaccacgccgcctttgtgaatcttctgaacatcgaaacggattataccaagacattccattttcactccaaaagagtgaccgctcacggagacacccctcaactcgatctgaaggcgcgccccacatacggcgccggcgagattacggtcctcgtggaagttgctgacatggagctgcataccaaaaaggtggagatcagcgggcttaaattcgcctctctgacatgcaccggatgttatgcctgcagctccggcatttcttgtaaggtccggatccacgtggatgaacctgacgagctgacagttcatgtcaagagctccgatccggacgtggtggctgccagcacctccctcatggcgagaaaactggagttcgggacggactctacatttaaggctttcagcgccatgcccaaaacctccctttgcttttacattgtcgaacgcgaatactgtaagtcttgcagcgaggatgacaccaaaaagtgtgtggatacaaagctggagcagcctcagtccatcctcatcgaacacaaaggaaccattatcggcaagcaaaatgacacatgcaccgccaaggcttcttgttggctggagagcgttaagtccttcttttatgggctcaaaaacatgctgggaagcgtgttcggctcctttttcgtcggcattcttctgtttctgacgcccttcgtgctcctggttctgtttttcatgttcgggtggaagatcctgttttgcttcaagtgttgccggagaacacgcggactctttaaataccggcatctgaaggatgacgaagagaccggctatagacgcattatcgaacggctcaattctaaaaaggggaaaaacagactgcttgatggagagcggctggccgaccgcaagatcgcggagctgttcagcacaaagacccacattggctga

SEQ ID NO: 13681 - RNA, 5052 nt, synthetic construct
  misc_feature 1..5052: note = derived and/or modified CDS sequence (opt5) from CCHFV(47-ST-2013)__KR814861.1__GP
  source 1..5052: mol_type = other RNA
atgcacaccctgctcgcctgcttcatcctgtaccttcagctgagcggcctcgggggagctcatggccaatccaacgccacagagcacaatgggacgaacaccacaaccgtgcccggaacatctcagagccctaagccgcccgcgtccaccacactgcctcatacccccgaatctagcacggtcaaacttaccacacctacctccgagacagaaggctctggggagaccacgccccctccgaatacaacccagggactgccccctcccggcacaacccctgaaagaagcgctaccacagccacgtccaccagctctacagacaacatgaactccaccacacagatgaccggcaatacgcccacaccgaccgttaatatgagcccttcttccagcccctctatgccttccaccagccaagggattcactatcccgtgcggtccctcctgtctgtgcccagccctaagacagccaccacaccgacgcccgtctcccctggagagatgagccccgagacctcttcccagcatagcgctacatctcgcatccctaccctgtacacagccacccaggtgagcacggaaaacaccaatagatccacaccccggcagtctaaaagctccgttcaaccggctacccagagccctattacaccccctgcccagaccatcctcctgatgtctgcggcccccaaggctattcaggatatgcacccttcccccacgaaccgcagcaaaagaaatcttgaggtggaaatcatcctgacactctctcaaggcctgaagaagtattacgggaaaattcttaagctgctccacctgaccctggaggaggacacagaaggactcctggagtggtgtaaacggaaccttggctccaattgcgatgacgactttttccagaagcgcatcgaagagtttttcattaccggggaaggatattttaacgaggtcctgcagttcaaaaccctcagcacactgtccccgacggagccttctcatgtgagacttcccaccgccgaaccctttaagagctactatgctaagggcttcctgtccctcgactctggctactttagcgccaaatgttaccctcggtccagcacatctgggctgcaactgatcaatgttacccagcacccggcgcgcattgccgagacacccggacctaagaccacgtccctcaaaacaatcaactgcattaacctgagagctagcgtgttcaaggaacatcgggaggtcgaaatcaatgtgcttctgccccagatcgccgtgaacctctctaattgtcacgtcgttattaactcccacgtgtgcgattatcctctggacaccgatggccccgtgcgccttcctagaatccatcacgaggggacctttattcccggaacatacaaaatcgtcattgacaagaaaaataagctgaacgatcggtgtagcctcgtgaccaattgcgttatcaagggccgcgaggtgagaaaagggcagtctgtcctgcggcaatataagacagaaatcaaaattggaaaggctagcacgggctccagaaaactgctcagcgaggaaccgggcgacgattgtatctctcgcacccagctgcttaagacagagaccgccgaaattcatgacgacaactacgggggacctggcgataagatcacaatttgcaatgggtccaccatcgtggaccagcggctgggaagcgagctcggctgttatacgatcaacagagttaaatccttcaagctgtgcaaaaattctgccaccgggaagacatgcgagattgatagcacccccgtgaaatgtcgccagggcttttgcctgaagatcacacaagaaggacggggccacgtcaagctgtccagagggtctgaggtggtcctcgacgcttgtgatagctcctgcgaaattatgatccctaaaggaaccggcgacattctggtggattgttctgggggacagcagcatttcctgaaggacaacctcatcgatctgggctgcccccacattccgcttctggggaaaatggcgatctacatctgtcgcatgagcaatcaccctcggacaaccatggccttcctcttttggttctcctttggctatgttattacgtgcatcttctgtaaggctctgttttacagcctgattatcattggaacacttggcaaaaagatcaagcagtacagagagctcaaaccccaaacctgcaccatctgtgagacagcccctgtgaacgccattgacgctgaaatgcatgatctgaattgctcttataacatctgcccctactgtgcctcccgcctgaccagcgacgggctcgcgcggcacgtcacgcagtgccccaagagaaaagagaaggtggaagagacagaactgtatcttaacctggagcgcattccttggatcgttcggaaactccttcaggtgtctgagtccaccggagtcgctctgaagagaagctcttggcttattgtgctcctggtgctgctcacagtttccctgagcccggtccagtccgcccccgtgggccatgggaaaaccatcgaaacataccaaacccgggagggattcacgagcatctgtctttttatgctgggctctattctcttcatcgtgagctgcctggtcaaggggctggtggactccgtttctgatagctttttccctggcctttccgtgtgtagaacctgctctattggaagcatcaatggctttgaaattgagtcccacaagtgttattgctctctcttctgttgcccctactgtcgccactgcagcgccgaccgggaaatccatcagctgcacctgtccatctgcaaaaagagaaaaacagggagcaacgtcatgctcgctgtgtgtaagcgcatgtgctttaaagccaccattgaggcttctcggagagccctgttcatccgctccattatcaatacaaccttcgttacgtgtattcttacactggcgatctgcgtggtcagcacctctgccgtggagatggaagatctccctgctggaacatgggagagagaagaggacctgaccaacttttgtcatcaggaatgccaagttaccgagacagagtgtctgtgcccctatgaagcccttgtgctgcggaagcctctcttcctggattccattgtcaagggcatgaaaaatctcctgaacagcacgtcccttgagacctctctgagcatcgaagctccgtggggagccatcaatgtgcagtccacatttaagcccaccgtgagcacagcgaacattgccctctcttggtccagcgtcgagcaccgcggaaataaaatcctggttaccggcagatctgagagcattatgaagctggaggaacggacgggggtgtcctgggaccttggcgtggaagatgcttctgagagcaaactgctcacagtctccatcatggacctgtctcagatgtacagccctgtgttcgaatacctctccggagatcgccaggttgaggagtggcccaaggccacctgtaccggcgaatgccctgagagatgtgggtgcacaagctctacctgcctgcataaggaatggccccactcccggaactggcgctgtaatccgacatggtgctggggagtgggcacggggtgtacctgctgtggagtcgacgtgaaagatctttttacagaccacatgttcattaagtggaaagttgagtatatcaagaccgaagctatcgtgtgcgtcgagctgacaagccaagagagacagtgttccctcattgaagccggcacccggtttaacctgggccctgtgacgatcaccctgtctgagccccgcaatattcagcagaaacttccccctgaaatcattacactgcatcccaagatcgaggaagggttctttgatctcatgcacgttcaaaaggtgctgagcgcctccaccgtctgcaaactccagtcttgtacacatggaatccctggcgacctgcagatttaccacatcgggaaccttctgaagggagacagagtgaatggccatctgattcacaaaatcgagccgcacttcaacaccagctggatgtcctgggatgggtgcgacctcgattattactgtaacatgggagactggcccagctgcacatatacgggcgtgacccagcataatcacgctgcgtttgtcaacctgcttaatattgagacagattacaccaagaccttccattttcactctaaacgggttacagcccacggcgacacgcctcaactggatctcaaggctagacccacctatggggccggagaaatcacagtgctggtggaggtcgccgacatggaactccataccaaaaaggtggaggtttccggcctgaagttcgctagccttgcctgcacagggtgttacgcgtgttcttccggaattagctgcaaagtgcgcatccacgtcgatgagcctgacgaactgaccgtgcatgttaagtctagcgatcccgacgtggtcgctgcctccacgtctctgatggcccggaaactcgagttcggcacagatagcacctttaaggctttctccgccatgccgaaaaccagcctgtgcttttacatcgtggaaagagagtattgtaagtcctgctctgaagacgacacaaagaaatgtgtcgataccaaacttgagcagcctcagagcattctgatcgagcacaaagggacaattatcggaaagcaaaacgatacctgcacggcgaaggcttcctgttggctcgaatctgttaagagcttcttttacggcctgaagaatatgctcggctccgtgttcgggaactttttcgtggggattctgctttttctggcccccttcgtcctgctcgtgctgtttttcatgttcggctggaaaatcctgttttgcttcaagtgttgccgccggacaagagggctgtttaaatatcgccatctcaaggatgacgaggaaaccggataccggagaatcattgagcgccttaattctaaaaagggcaagaaccggctcctggatggggaaagacttgccgaccggaaaatcgctgagctgttcagcacaaagacccacattggatga

SEQ ID NO: 13682 - RNA, 5052 nt, synthetic construct
  misc_feature 1..5052: note = derived and/or modified CDS sequence (opt5) from CCHFV(1-CR/HU-2015)__KU161584.1__GP
  source 1..5052: mol_type = other RNA
atgcacaccctgctcgtgtgcttcatcctgtaccttcagctgctcggccttgggggagcccatgagcaaagcaacgctacagaccacaatagaacgaacaccattacagccccctccacctctcagaatcctaagccgcccgcgagcacaacccctccccatacacctgaatcctctaccatcaaacttattacgagcaccggcgaggctgaagggtccggagagacaacaccccctctgaacaccacccagggcccgtttccccctgaaacgacatctgagcaccccgccagcaccgccacaaatacctccagcaccaactctatgaactccacaacgcagatgaccgataatacactcaccagcacagtctctacctccctgagcatctctccttccacgcccagcacatcccaagggattcattatccggttcggtctctgctcagcgtgtccagccctaagaccgctgccacccccacacctatgtctacccgcgagatgtccagcgaaacatctagccagcactccgctatgtctagaacgcccaccttccacacagccacccaggtgagcacagagaatgcgaaccggtccacgccccgccagagcgaatcttccgcccaacctgctacccagagcccgatgacctctcccgcccagtccatctttctggtcagcgctgcccctacaaccatccagaatattcatccctcccctacaaacagatctaaacggaatcttgagatggagatcattctgaccctcccccaaggactgaagaaatactatggcaagatccttaagctgctccacctgacgctggaagaggacacagaaggcctcctggagtggtgtaaacgcaaccttgggagcaattgcgatgacgagttctttcagaagagaattgaagagttctttatcaccggagaaggctacttcaacgaggtgctgcagtttaaaacactctccaccctgtctccgaccgaacctagccatgcgcggccccctacagccgagcccttcaagtcctattttgctaaagggttccttagcattgattctggatacttttccgccaagtgttatcctcgcagctctacgtccggcctgcaactcatcaacatcacccagcaccccgctagaattgccgaaacaccggggcctaagaccacaagcctgaaaaccatcaattgcattaacctgcgggcctctgttttcaaggagcaccgcgaggtggaaatcaatgtcctcctgccccagattgctgtgaaccttagcaattgtcatgttgtgatcaactcccacgtctgcgactacagcctggatacggacggacccgtgagactccctcggatctaccatgagggcacattcattccgggcacctataaaatcgtgattgataagaaaaataagctgaacgaccgctgtacccttgtcacaaattgcgttatcaaagggagagaagtgcggaagggacagtctgtgctgagacaatacaagaccgagattaaaatcggcaaggcgtccacagggagccgcaaactcctgtccgaggaacccggagatgactgtatctctcggacgcagctgctcagaaccgagacagccgaaattcacgatgacaactatggcgggcctggagacaagatcaccatttgcaatggcagcacaatcgtcgatcagcgcctgggctccgagcttgggtgttacaccattaaccgggtgaaatcttttaagctgtgcgaaaatagcgctacgggaaagacctgcgagatcgactccacacccgttaaatgtagacagggcttctgcctcaagattacccaagaggggcgcggacatgtgaaactgtctcggggcagcgaagtcgtgctggatgcctgtgactccagctgcgaggttatgatccctaaggggacaggcgatatccttgtggactgttctggaggccagcagcactttctcaaagataacctgattgacctggggtgcccccacatccctctcctgggaaagatggccatttatatctgtagaatgtccaatcatccccgcaccacaatggctttcctgttttggttcagctttggctacgtcattacctgcatcttctgtaaggccctgttttattctctcatcattatcgggacgctggggaaaaagattaaacagtaccgggaactgaagccgcaaacatgcaccatctgtgagaccgcgcctgtgaacgctattgatgccgaaatgcacgaccttaactgctcctacaatatctgcccctattgtgccagcagactcacatctgatggcctggctcgccatgtcacccagtgccctaaacggaaggagaaggtggaggaaacggagctgtacctcaacctggaaagaatcccctggattgttcggaaacttcttcaggtgtccgagagcacaggggtcgccctcaagcgctccagctggctgatcgtgctgcttgttctcctgaccgtgtctctgagcccggtccagtccgctcctgtgggccacggaaaaacaattgaaacctatcaaacaagagagggcttcacctctatctgtctctttatgctggggagcattcttttcatcgtgtcctgcctggttaagggactcgtcgactctgtgagcgactcctttttccccggcctgtctgtgtgtcggacgtgcagcatcgggtccattaatggattcgagatcgaaagccacaaatgttactgctctctgttttgttgcccttattgtagacattgctccgccgatcgcgagattcaccagcttcatctcagcatctgcaagaaacggaagaccggctctaacgtcatgctggcggtgtgtaagagaatgtgcttccgcgccacaatggaggcttccagacgggccctgctcattcgcagcatcattaataccacatttgttatctgtatcctgacccttacgatttgcgtggtctccacatctgctgtggaaatggaaaacctgcccgccgggacctgggagagagaggaagacctcacaaatttctgtcaccaggagtgccaagttaccgaaaccgagtgtctgtgcccctacgaggcgctggtgcttcggaaacctctgtttctcgatagcatcgtcaagggcatgaaaaacctgctcaattccacaagcctggaaacgtctctttccattgaggccccgtggggagctatcaacgtgcagagcaccttcaagcccacagtttctaccgccaatattgctctgagctggtcctctgtggaacatcgcggcaacaaaatcctcgtcacagggagaagcgagtccatcatgaagctggaggaacggaccggagtgtcttgggacctgggcgtggaggatgccagcgaatccaaacttctgacggtcagcattatggacctctctcagatgtattcccctgtttttgagtacctgagcggggatcgccaggtggaagagtggcccaaggccacatgtaccggagactgccctgaaagatgtggctgcacctcctctacatgcctccacaaggagtggccccacagccggaattggcgctgtaaccctacctggtgctggggagtgggcacaggatgtacgtgctgtggcgtcgatgtgaaagacctgttcaccgatcatatgtttgttaagtggaaagtggagtacatcaagacagaagctattgtctgcgtggagcttacctcccaagaaagacagtgttctctgatcgaggcggggacacggttcaatctcggaccggttaccattacgctgagcgaacccagaaacatccagcagaagctgcctcccgagatcattacccttcaccctaaaatcgaggaaggctttttcgacctgatgcatgtgcaaaaggtcctctccgccagcacagtgtgcaaactgcagtcttgtacccacgggattcccggagatctccaggtttatcatatcggcaacctgcttaagggcgaccgcgtgaatgggcacctgattcacaaaatcgagccgcattttaacacatcctggatgagctgggacggatgcgatctggactactattgtaatatgggcgattggccttcttgcacctacacaggggtcacgcagcacaaccatgctgccttcgtgaatctcctgaacattgaaaccgactatacaaagaccttccactttcactccaagcgggtgaccgcccatggagatacaccccaacttgacctgaaagctagacccacgtacggcgccggggagatcaccgtcctcgttgaggtggcggatatggaactgcacacaaagaaagtggagatcagcggactcaagttcgcttctctggcctgcaccggctgttatgcctgcagctccggcatttcttgtaaagtccgcatccatgtggacgaacctgatgagcttacagttcacgtcaagagctccgaccccgatgtggtggctgccagcacctccctgatggcgcggaaactggaatttgggacggactctacattcaaggcttttagcgccatgcctaagacctccctctgcttctacattgttgagagagagtactgtaaatcttgcagcgaagatgacaccaagaaatgtgtggacacaaagctggagcagccgcagtccatccttattgaacataaaggaaccatcatcggcaagcaaaatgatacatgcaccgccaaggcttcttgttggctggagagcgtcaaatcctttttctatgggctcaagaacatgctgggaagcgtgtttggcaatttctttattgggatcctcctgttccttgcccccttcgtcctgctggtgctctttttcatgtttggatggaaaattctgttctgctttaagtgttgccgccggacgagaggccttttcaaataccgccacctgaaggacgatgaagagacaggctatcggagaatcattgagcggctcaacaataagaaagggaagaaccgcctgctcgacggagaaagactggctgatcggaaaatcgccgagctgttttctaccaagacacacatcggctga

SEQ ID NO: 13683 - RNA, 5049 nt, synthetic construct
  misc_feature 1..5049: note = derived and/or modified CDS sequence (opt5) from CCHFV(3820-ST-2007)__KR814868.1__GP
  source 1..5049: mol_type = other RNA
atgcacaccctgctcgtgtgcttcatcctgtaccttcagctgagcggcctcgggggagcccatggccaatccaacgctacagagcacaatgggacgaacaccacaaccgtccccggaacatctcagagccctaagccgcccgcctccaccacactgcctcatacccccgaatctagcacggttaaacttaccacacctacctccgagacagaaggctctggggagaccacgccccctaatacaacccagggactgccgctccccggcacaacccctgaaagaagcgcgaccacagctacgtccaccagctctacagacaacatgaactccaccacacaggtgaccgataatacgcccacaagcaccgtgtctatttccccttcttcttccagctccatgccctctaccagccaaggcatccaccatccggtccggtccctgctgagcgtgtcttcccctaagacagttaccacacccacgcctatgagccccggggagatgtctcccgagaccagctcccagcactctgccatgagccgcgtgcctacactctataccgccacacagatttccaccgaaaatacggacagaagcaccccgcggcagtctgagtccagcgtccaacccgctacacagtctcctatcacctcccccgcccagacaattctgcttatgagcgctgcccctaaagcgatccaggatatgcacccctccccgaccaaccgctctaagagaaatctggaagtggagatcattctcacgctgagccaaggacttaaaaagtactatggcaagatcctgaaactcctgcatctgacactcgaggaagacaccgaggggctgcttgaatggtgtaagcggaacctgggatccaattgcgatgacgactttttccagaaacgcattgaggaatttttcatcacaggcgaggggtactttaacgaggttctccagttcaagaccctgtctacccttagccctacagaaccctcccacgtgagactgcctacggccgagccctttaaaagctatttcgctaagggatttctctctattgattccggctacttcagcgccaagtgttatcctcggtcttccaccagcggcctgcaactgatcaatgtcacacagcatcccgctcgcattgccgaaaccccggggcctaaaacaacctctctcaagacgatcaactgcatcaatctgagagcgagcgtgtttaaagagcaccgggaagtggagattaacgtccttctgccccagatcgccgttaacctctccaattgtcacgtggtgattaacagccatgtctgcgattactctctggacacagatggacccgtgcgccttcctagaatccaccatgagggcaccttcattccggggacctacaagatcgttatcgaccggaaaaataagctgaacgatcgctgttccctcgtgacaaattgcgtcattaaaggaagagaagtgcggaagggccagagcgttctgagacaatataagaccgagatcaaaattgggaagacatccacgggatctcgcaaactgctcagcgaggaacccggcgacgactgtatctcccggacccagctgcttaagacagaaaccgctgagattcacgatgacaactacggctctcctggggataaaatcacaatctgcaatggaagcaccattgtggaccagagactgggctccgagctcgggtgttatacgatcaaccgcgtcaagtcttttaagctgtgcgaaaatagcgccaccggaaaaacatgcgagattgattccacccccgtgaagtgtcggcagggcttctgcctgaaaatcacacaagaagggagaggccatgtcaaacttagccgcggatctgaggtggttctcgacgcttgtgattccagctgcgagattatgatccctaagggcaccggggacattctggtggattgttctggaggccagcagcacttcctgaaggacaacctcatcgatctggggtgcccccacatccctcttctgggaaagatggccatttacatctgtcggatgtccaatcatcccagaacaaccatggcctttctcttctggtttagcttcggctatgtcattacgtgcatcttttgtaaagctctgttctactctctgattatcatcgggacacttggcaagaaaattaagcagtatcgcgaactcaaaccgcaaacctgcaccatctgtgagacagcgcctgtgaacgccattgacgctgaaatgcacgacctgaattgctcctacaacatctgcccctactgtgccagccggctgacctccgatggactcgccagacatgttacgcagtgccctaagcgcaaggagaaagtggaagagacagagctgtatcttaatctggaacggattccctggatcgtcagaaagctccttcaggtgagcgagtctaccggcgtggctctgaaacggagctcctggcttatcgttctcctggtcctgctcgccgtgtctctgagcccggtgcagtccgcgcctgtcgggcacggaaagacaattgaaacctaccaaacacgcgagggctttacctctatctgtcttttcatgctggggagcattctctttatcgtgtcctgcctggttaaaggactggtggactctgtcagcgattccttctttcccggccttagcgtgtgtaagacgtgctctattgggtccatcaacggcttcgaaatcgagagccacaaatgttattgctctctcttttgttgcccttactgtagacattgctccgctgaccgggagattcaccagctgcatctgagcatctgcaagaagagaaaaaccggatccaacgttatgctcgccgtgtgtaagcgcatgtgcttcaaagccacaattgaggcttctcggagagccctgcttatccgcagcattatcaataccacattcgtcatgtgtattctgaccctcgctatctgcgtggtttccacgagcgccgtggaaatggaagatctgcccgcgggcacatgggagagagaagaggacctgaccaacttttgtcaccaggagtgccaagtcacagaaaccgagtgtctttgcccctatgaagccctggtgctccggaagcctctgttcctcgattctatcgtgaaagggatgaagaatctgcttaactccaccagcctggagacatctctcagcattgaggctccgtggggagccatcaatgtccagtccacgtttaagcccaccgtttctacagctaacattgccctgagctggtcctctgtggaacatcgcggcaataaaatcctggtgaccgggagaagcgagtccattatgaaacttgaggaacggacaggagtcagctgggacctgggcgtggaagatgcgtctgagtccaagctcctgaccgttagcatcatggacctctcccagatgtactctcctgtgttcgagtatctgagcggggatcgccaggtcgaagagtggcccaaggccacgtgtacaggcgactgccctgaaagatgtggatgcacctcctctacctgccttcacaaagagtggccccacagccggaactggcgctgtaatcctacatggtgctggggcgtggggaccggatgtacatgctgtggcgttgatgtgaaggacctgtttacggaccatatgttcatcaagtggaaagtcgaatacattaagaccgaggctatcgtgtgcgttgagctcacatcccaagaaagacagtgtagcctgattgaggccgggacccggtttaacctgggaccggtgacaatcaccctttctgaaccccgcaatattcagcagaaactgcctcccgagatcatcacgctccaccctaagattgaagagggcttctttgatctgatgcatgtccaaaaagtgctctccgctagcaccgtgtgcaagctgcagtcttgtacacacggcatccccggggaccttcagatttaccatatcggaaacctgctgaagggcgatagagtcaatgggcacctcattcacaaaatcgagccgcatttcaacacctcctggatgagctgggacggatgcgatctggactattactgtaatatgggcgattggccttcttgcacatataccggggttacacagcacaaccatgccgcctttgtgaaccttctgaatattgaaacggactacaccaagacattccactttcacagcaaacgggtgaccgctcatggagatacaccccaactcgacctgaaggcgagacccacctatggcgccggcgagatcacggtcctcgtggaagttgctgatatggagctgcacaccaaaaaggtggagatctccgggcttaaattcgcctctctgacatgcaccggatgttacgcctgcagctccggcattagctgtaaggtccgcatccatgtggacgaacctgatgagctgacagttcacgtgaagtcctctgaccccgacgtcgtggctgccagcacctccctcatggcgcggaaactggagttcgggacggattctacatttaaggctttcagcgccatgcctaaaacctccctttgcttttatattgtcgaaagagaatactgtaagtcttgcagcgaggacgataccaaaaagtgtgtggacacaaagctggagcagccgcagtccatcctcattgaacataaaggaaccatcatcggcaagcaaaacgatacatgcaccgccaaagctagctgttggctggagtctgttaagtccttcttttacgggctcaaaaatatgctgggaagcgtgttcggcagctttttcgtcggcattcttctgtttctggcccccttcgtgctcctggttctgtttttcatgttcgggtggaagatcctgttttgcttcaagtgttgccgccggacgagaggactctttaaatatcgccacctgaaggacgatgaagagacaggctaccggagaattatcgaacgcctcaactccaaaaaggggaaaaatcggctgcttgacggagagagactggcggatcggaagattgctgagctgttcagcaccaagacacacatcggctga

SEQ ID NO: 13684 - RNA, 5052 nt, synthetic construct
  misc_feature 1..5052: note = derived and/or modified CDS sequence (opt5) from CCHFV(Ast199)__KX056051.1__GP
  source 1..5052: mol_type = other RNA
atgcacacccttctcgtgtgcttcatcctgtaccttcagctgagcggcctcgggggagcccatgtccaatccaacgctacagagcacaatggcacgaacaccacaaccgttcccgggacatctcagagccctaagccgcccgcctccaccacactgcctcatacccccgaatctagcacggtgaaacttaccacacctacctccgagacagaaggatctggcgagaccacgccccctccgaatacaacccaggggctgccccctcccggaacaacccctgaaagacccgcgaccacagctacgaccacaagctccaccgacaacatgaatagcacaacccaggtgacggataacacaccgacctctaccgtctccattagcccttcttccaatcccagcatgccttctacatcccaaggcatccactatcccgtgcggagcctcctgtccgtttctagccccaagaccgtgacaacgcctaccccgatgtcccccggcgagatgagccctgagacatcttcccagcatagcgccatgtctcgcattcccaccctgtacacagccgctcaggtcagcaccgaaaacacgaatagatccacccctcggcagtctgagagctccgcccaacccgctacacagagcccgaccacatttcctgcccagaccatccccctcatgtctgcggcccctaaagctattcaggacatgcacccctcccctacgaaccgcagcaagagaaatctggaagtggagatcatccttacactgtctcaagggctcaaaaagtattacggaaagattctgaaacttctgcacctcaccctggaggaagatacagagggcctgctcgaatggtgtaagcggaacctggggtccaattgcgacgatgacttctttcagaaacgcatcgaggagttctttattaccggagaaggctatttcaacgaggttcttcagtttaagacccccagcacactgtccccgacggaaccttctcatgtgagactccccaccgccgagcccttcaaaagctactttgctaaggggttcctgtccatcgattctggatattttagcgccaagtgttaccctcggtccagcacatctggccttcaactgattaatgtcacccagcacccggcgcgcatcgccgaaacacccggccctaaaaccacgtccctcaagacaattaactgcatcaacctgagagctagcgtgttcaaagagcatcgggaagtggagatcaatgtcctgctcccccagattgccgttaacctgtctaattgtcacgtggtgatcaactcccacgtctgcgactacagccttgataccgacgggcctgtgcgcctgccccggattcatcacgagggaacctttatccctggcacatataagattgttatcgataaaaagaataaactcaacgacagatgttctctggtgaccaattgcgtcatcaaggggcgcgaagtgagaaagggacagagcgttcttcggcaatacaaaacagagattaagatcggcaaggcttccacggggagcagaaaactgctctctgaggaacccggagatgactgtatttcccgcacccagctgctgaaaacagaaaccgccgagatccatgacgataactatggcggcccgggggacaagattacaatctgcaatggaagcaccatcgtggatcagcggctcggctccgagctggggtgttacacgattaacagagtcaagtctttcaaactttgcgaaaatagcgccaccggaaagacatgcgagatcgactccacccctgtgaaatgtcgccagggcttctgcctgaagattacacaagaagggcggggccacgtcaaactctctagaggaagcgaggtggttctggatgcttgtgactcctcttgcgagatcatgattcccaagggcaccggggatatcctggtggactgtagcggaggccagcagcattttcttaaggataacctcattgacctggggtgccctcacatccccctgctcggaaaaatggcgatctatatttgtcgcatgtccaatcacccgcggacaaccatggccttcctgttttggttcagctttggctacgtcatcacgtgcattttctgtaaggctctgttttattctcttatcattatcgggacactcggcaaaaagatcaaacagtacagagaactgaagcctcaaacctgcaccatttgtgagacagcccccgtgaacgccatcgatgctgaaatgcatgacctgaattgctcctacaacatttgcccttattgtgccagccgccttacctctgacggactcgcgcggcacgttacgcagtgccccaagagaaaagagaaggtggaagagacagagctgtacctgaacctcgaacgcatcccctggattgtccggaaactgcttcaggtgtccgagagcaccggcgtggctctgaagagatgttcttggctcatcgttctgctggtccttctcacagtgtccctgagccctgtgcagtccgccccggtcgggcatggaaaaaccatcgaaacatatcaaacccgggagggcttcacgaatatttgcctgtttatgctcgggagcatcctgttcattgtgtcttgtcttgttaagggactggtggatagcgtctccgacagctttttccccggcctctctgtgtgcaaaacctgttccatcgggtctattaacggctttgaaatcgagagccacaagtgctactgttccctgttctgctgtccttattgccgccactgctctgccgatagagagatccatcagctgcaccttggaatttgtaagaaacggaagacaggcagcaatgttatgctcgctgtgtgcaaaagaatgtgtttcaaggccaccatcgaggcttcccgccgggccctgctgattagaagcatcattaacacaacctttgtcatctgcattctcacgctggcgatctgtgtggtttctacatccgccgtggaaatggaaaatcttcccgctgggacctgggagcgcgaagaggacctgacaaacttctgccatcaggagtgtcaagtcaccgaaaccgagtgcctctgtccttacgaagccctggtgctgagaaaacccctttttctggatagcatcgtgaagggaatgaagaatctcctgaactctacatccctcgagacgagcctgtccattgaggctccttggggcgccatcaatgtccagtctaccttcaaaccgacagttagcaccgcgaacattgccctttcctggagctctgtggaacaccgggggaataagatcctggtgacaggacgctccgagagcattatgaaactcgaagagagaaccggcgtctcttgggacctgggggtggaagatgctagcgagtccaagctgcttacggtttctatcatggacctgagccagatgtattcccccgtgtttgagtacctctctggcgatcggcaggtcgaagagtggcctaaagccacatgcaccggagactgtcccgaacgctgcggctgcaccagctccacatgtctgcataaggagtggcctcacagcagaaactggcggtgcaatcccacctggtgttggggagtggggacaggctgcacgtgttgcggggttgatgtgaaggacctcttcaccgatcacatgtttatcaaatggaaggtcgaatacattaaaacagaggctatcgtgtgtgttgagctgacctctcaagaacgccagtgctcccttattgaggccggaacaagattcaacctgggcccggtgaccatcacgctcagcgaacctcggaatattcagcagaagctgcctcccgagatcatcaccctgcatcccaaaattgaagagggctttttcgaccttatgcacgtccaaaaggtgctgtccgcctctacagtgtgtaagctccagagctgcacccatgggatccccggagacctgcagatttatcacatcggcaacctcctgaaaggggatcgccttaacggacatctgattcacaagatcgagcctcactttaatacatcctggatgtcttgggacggctgtgatctggactactattgcaacatgggggattggccgagctgcacctacacaggagtcacgcagcataatcacgctgcgttcgttaacctcctgaatattgaaaccgactatacaaaaacctttcatttccactccaagagagtgaccgcccacggcgatacaccccaacttgacctgaaagctcggcctacgtacggcgccggggagatcaccgtgctcgtcgaagtggccgatatggagctgcatacaaagaaagttgaggtgagcggactcaagttcgcttctctggcctgtaccggctgctatgcgtgttccagcgggatctcttgcaaggtccgcattcacgtggacgaacccgatgagcttacagttcatgtgaaatccagcgaccctgatgtcgtggctgcctctaccagcctgatggccagaaagctggaatttggaacggactccacattcaaggctttttctgccatgcccaaaaccagcctctgtttctacatcgtcgagcgggaatactgcaaatcctgtagcgaggacgataccaagaagtgcgtggacacaaaactggagcagccgcagtccattcttatcgaacacaagggcaccattatcgggaaacaaaacgatacatgtaccgcgaaggcttcttgctggctggagagcgttaaatcctttttctatggactcaagaatatgctgggctctgtgtttggcaacttctttgtcgggatcctcctgttccttgccccttttgtgctgctggttctcttcttcatttttggatggaagatcctgttctgttttaaatgctgcagacgcacgcggggccttttcaagtacagacatctgaaagacgatgaagagacagggtatcgcaagattatcgaacggctcaatagcaaaaagggaaagaacagactgctcgacggcgagcgcctggccgatcggaaaattgctgagctgttttccaccaagacacacatcgggtga

SEQ ID NO: 13685 - RNA, 5052 nt, synthetic construct
  misc_feature 1..5052: note = derived and/or modified CDS sequence (opt5) from CCHFV(Turkey200310849)__DQ211636.1__GP
  source 1..5052: mol_type = other RNA
atgcacaccctgctcgtgtgcttcatcctgtaccttcagctgctctgtctgggcggggcccatggacaacttaacacaacggagcacaatggcaccaacaatacaaccgctcccggggccagccagtcccctaagccgcccatgtctacaacccctccccatgcgcctgaaagctccacaattaaacccaccacgcctatctctgaggctgaaggaagcggcgagaccacatccaccccgaacacaacccaggggctgtctagccccgaaacgacatccgagagacctgccaccacagccattagcacctcttccaccgacagcacaaatcccacgacccagatgacagataacacccctacactcaccgtctctacgtccccctctagctccccgagcacaccttccacaccccaaggaatctatcaccctgctcggtctctgctgagcgtttccagccccaagaccgtgaccacccccacacctacgtctccgggcgagatgtccagcgaaacctctagccagcattccgccatgtctcgcattcccacacctcacaccgctacaagagtgagcaccgagaatacgaaccactccacaccccggcagagcgaatcttccgcccagcaaaccacccctagccccatgacatctccggcgcagtccatcctcctgatgagcgccgctcctaccgccgtccaggacatccatccctcccctacgaatcgctctaaaagaaaccttgagacagagattatcctgaccctcagccagggcctgaagaaatactatgggaagattcttaagctgctccacctgacactggaagaggataccgaaggactcctggagtggtgcaaacggaatcttggctccaactgtgacgatgactttttccaaaagcgcatcgaagagtttttcatgaccggggagggatactttaatgaagtgctgcagttcaaaacactctctacgctgagccccaccgagccttcccatgctagacttcccacagccgaaccgtttaagagctatttcgcgaaaggctttctgtctattgattccgggtacttcagcgccaagtgctatcctcggtcttccgctagcggactccagctgatcaacgttacccaacaccccgcccgcattgctgagacacccggccctaagaccacgtctctgaaaacaatcaattgtatcaacctcagagccagcgtgtttaaggaacaccgggagattgagatcaacgtcctgcttccgcagattgccgtgaatctgtccaactgccatgttgtgatcaatagccacgtctgtgactactctctcgataccgacggccccgtgcgcctgcctagaatttaccatgaagggaccttcatccccggaacatataaaatcgtgattgataagaaaaacaaacttaatgaccggtgcaccctggtcacaaactgtgttatcaagggccgcgaggtgagaaaggggcagtccgtgctccggcagtacaagacggaaattaaaatcggaaaggctagcaccggctttagaaaactgctgtccgaggaacctggggatgactgcatttctcgcacacaactcctgcggaccgagacagcggagatccacgacgataattatggaggccccggcgacaagatcaccatttgtaacgggagcacgatcgtcgatcagagacttggatccgaactgggctgctacaccattaatcgcgtgaaatctttcaagctctgcgagaacagcgccacagggaagacctgtgaagttgactccacacctgtgaaatgccggcagggattctgtctgaagatcacccaggagggcagagggcatgtcaaactgtctcgcggcagcgaggtggttcttgatgcttgcgactccagctgtgaagtgatgattcccaagggaacaggcgatatcctcgtcgactgctctgggggacaacagcactttctgaaagataatctgattgacctcggctgtccgcacatccctctgcttgggaagatggccatctatatttgccggatgtccaaccatcccagaaccacgatggccttcctgttttggttcagctttggatacgtgatcacatgtatttcttgcaaggctctcttctattccctgatcattatcggcaccctggggaaaaagatcaaacagtaccgcgagcttaagcctcagacctgtacaatttgcgaaaccgcccccgtcaatgcgatcgatgctgagatgcacgacctcaactgcagctacaatatttgtccgtattgcgcctctcggctgacgtccgacggcctggccagacatgtgacacaatgtcctaaacgcaaggaaaaggttgaggagaccgaactctacctgaaccttgagcggatcccctggattgtgagaaaactgctccaggtcagcgaatccacaggagtggctctgaagcggagctcttggctgatcgttcttctcgtgctgctgaccgtcagcctctcccctgtgcagtctgcccccgtgggccacgggaaaacaatcgagatttatcagacccgcgaaggatttgctagcatctgcctgttcatgcttggctccattctgtttatcgtttcttgtctcgtcaaggggctggtggatagcgtgtccgactctttctttcccggactgagcgtctgcaaaacgtgttccattggcagcgtgaacgggttcgagatcgagtctcacaagtgctactgttccctcttttgctgtccttattgcagacattgcagcgccgatcgggaaatccaccaactccatctgtctatttgtaaaaagagaaagaccggctccaatgttatgctggcggtgtgcaaacgcatgtgtttccgggccacaatcgaggctagcagacgcgccctcctgattagatccatcattaacaccacattcgtcatctgcattcttaccctgacgatctgtgtggtttctacaagcgctgtggaaatggagaatctcccggccggaacctgggaacgggaggaggacctgacaaacttttgccaccaggaatgtcaggtcaccgagaccgaatgcctgtgtccctacgaggcgcttgtgctgcgcaagcctctcttcctggattccatcgttaaaggcatgaagaatctcctgaacagcacatctcttgagacgtccctgagcattgaagccccctggggagctatcaatgtgcaatctacctttaaacctgccgtcagcacagctaacattgccctctcctggtctagcgtggagcatagagggaataagatcctggtgaccggccggtccgaatctattatgaagctggaggaacgcacaggggtcagctgggaccttggagttgaggatgcctccgagagcaaactgctcaccgtgtctatcatggacctgtcccagatgtatagccccgtgttcgaatacctctccggcgatagacaggtcgaggaatggcctaaggctacgtgcacaggggactgtccggagcggtgcggctgcacctctagcacctgtctgcacaaagaatggccccactcccgcaactggagatgcaatcctacatggtgttggggagtgggcaccgggtgcacatgttgcggagttgatgtgaaggacctttttacggatcatatgttcgtcaaatggaaggtggagtacatcaagaccgaggcgattgtttgtgtggaactgacatctcaggagcggcaatgcagcctcatcgaagccggcacccgctttaacctggggcccgtcacaattaccctgtccgagcctagaaatatccagcagaaacttcccccggaaattatcacgctgcaccctaagatcgaggagggattctttgacctcatgcatgtgcagaaagttctgagcgcttctaccgtgtgtaagctccaatcctgcacacacggcattcccggcgacctgcaggtctatcatatcgggaaccttctgaaaggagatcgggtgaatggccacctgattcacaagatcgaaagccatttcaacacctcttggatgtcctgggacgggtgtgatctcgactactattgcaacatgggagattggcccagctgcacatacaccggcgtgacacagcacaatcatgccgcctttgtcaacctgcttaatattgagacggactataccaagacattccactttcactctaaaagagttaccgctcatggggatacccctcagctggacctcaaggcccgccccacatacggagcgggcgaaatcacggtgctggtggaggtcgctgatatggagctccacaccaaaaaggtggaaattagcggcctgaaattcgcctcccttgcctgtacagggtgctatgcttgttctagcggaatctcctgcaaggttcggatccatgtggacgagcctgatgaactgaccgtccacgtgaaaagctccgacccggatgttgtggccgcgtctacaagcctgatggctagaaagctcgagttcggcaccgactccacgtttaaggccttctctgccatgcccaaaacaagcctgtgtttttacattgtcgaacgcgagtactgcaagtcctgttctgaggacgatacccaaaaatgcgtggacacccggcttgaacagcctcagagcatcctgattgagcataaggggacaatcattggaaaacaaaacgatacctgtacagctaaggcctcctgctggctcgaaagcgtcaagtctttcttttatggcctgaaaaatatgctcgggtccgtgttcggaaacctgtttatcggcatccttctgttcctggctccctttgttctcctggtgcttttctttatgttcggctggaagattctgttctgttttaaatgctgcagacgcacccgggggcttttcaagtacagacacctgaaagacgatgaggaaacgggatatcgccggatcattgagagactcaatagcaagaagggcaaaaaccggctgcttgacggggatcgcctggccgacagaaagatcgcggagctgttttctacaaaaacccacattggatga

SEQ ID NO: 13686 - RNA, 5052 nt, synthetic construct
  misc_feature 1..5052: note = derived and/or modified CDS sequence (opt5) from CCHFV(5170-R-2011)__KR814873.1__GP
  source 1..5052: mol_type = other RNA
atgcacaccctgctcgtgtgcttcatcctgtaccttcagctgagcggcctcgggggagcccatggccaatccaacgagacagaacacaatgggacgaacaccacaaccgtccccggaacatctcagagccctaagccgcccgcttccaccacactgcagcatacccctgagtctagcacggttaaacttaccacacccacctccgaaacagagggctctggggaaaccacgcctccccctaatacaacccagggactgccgccccctggcacaacccccgagagaagcgccaccacagcgacgtccaccagctctacagacaacatgaatagcaccacacaagtgaccgataacacgcctacaagcaccgtgtctatttcccccagcagctccccgagcatgccttccacctctcagggcatccactatcccattcggagcctcctgtccgtcagctctcctaagacagtgaccacacccacgcccatctcccctggggagatgagcccggaaacctctagccagcattccgctatgtctcgcattcccacactgtacaccgccacacaggttagcaccgagaatacgaacagatccacccctcggcaaagcgaatcttccgtgcagcccgccacacagagccctatcacctctcccgctcagacaatcctcctgatgtccgccgctccgaaagccattcaagacatgcaccctagccccaccaatcgctccaagagaaaccttgaggtcgagatcattctgacgctctctcagggactgaaaaagtattacggcaagatccttaaactgctccacctgacactggaagaggataccgaagggctcctggagtggtgtaagcggaatcttggaagcaactgcgacgatgactttttccagaaacgcattgaagagtttttcatcacaggcgaggggtattttaatgaagtgctgcaattcaagaccctctccaccctgtctcctacagagcttagccatgttagactgcccacggcggaaccttttaaatcctacttcgccaagggatttctcagcattgattctggctatttctccgctaagtgttacccccggagctctacctccggcctgcagctgatcaacgtgacacagcacccggcccgcatcgctgagacccctgggcccaaaacaaccagcctcaagacgattaattgcatcaacctgagagcctctgtctttaaagaacatcgggaggtggagattaacgtgcttctgccccagatcgcggtcaatctcagcaactgtcacgttgtgattaattcccacgtgtgcgactacagcctggatacagacggacctgtccgccttccgagaatccatcacgaaggcaccttcatccccgggacctataagattgtgatcgataaaaagaacaaactgaatgaccggtgttctctcgttacaaactgcgtgattaagggacgcgaggtcagaaagggccaatccgtgctgcggcagtacaaaaccgaaatcaagattgggaaagccagcacaggatccagaaagctgctctctgaggaacctggcgatgactgtatcagccgcacgcagctgcttaaaaccgagacagctgagatccatgacgataattatggcgggcccggagacaagattaccatctgcaacggctccacaattgttgatcagcggctggggtctgaactcggatgttacaccatcaatagagtgaagtcctttaaactgtgcgagaactccgccacgggcaagacctgcgaaattgactctacacctgtcaaatgtcgccaagggttctgcctgaagatcacccaggagggccggggacacgtgaaacttagcagaggctccgaggtcgtgctcgatgtttgtgacagctcttgcgaaattatgatccccaaggggacaggagatatcctggtggactgttccggcgggcagcagcatttcctgaaggataatctcattgacctgggatgccctcacatcccccttctgggcaaaatggctatttatatctgtcgcatgagcaaccacccgcggaccacaatggcctttctcttctggttttctttcgggtacgtcattacctgcatcttttgtaaggccctgttctattccctgatcattatcggcacgcttgggaaaaagattaaacaatacagagagctcaagcctcagacatgcaccatctgtgaaaccgctcccgtgaatgcgattgatgccgagatgcatgacctgaactgcagctacaatatctgcccttattgtgcttctcgcctgacatccgaaggcctcgcccggcacgttacccagtgccccaagagaaaagagaaggtggaggaaacggagctgtaccttaacctggaacgcatcccgtggattgtccggaaactccttcaggtgagcgagtccacaggggtggccctgaagagaagctcttggcttatcgttctcctggtcctgctcaccgtgagcctgtcccctgtgcaatctgctcccgtcggacatggcaaaacaattgaaacctatcagacacgggaggggtttaccagcatctgtcttttcatgctgggatccattctctttatcgtgtcttgcctggttaagggcctggtggacagcgtctccgattctttctttcctgggcttagcgtgtgtaaaacgtgctccatcggcagcattaacggattcgagatcgaatctcacaagtgttactgctccctcttttgttgcccctattgtcgccactgcagcgccgacagagagattcatcagctgcacctgtctatctgcaagaaacggaagaccggctccaatgttatgctcgcggtgtgtaaaagaatgtgcttcaaggctacaattgaagccagccgccgggccctgcttatcagatccattatcaacaccacattcgtcatctgtattctgaccctcgctatctgcgtggtttctacgagcgccgtggagatggaagatctgcccgctgggacatgggagcgcgaggaagacctgaccaatttttgtcatcaagagtgccaggtcacagaaaccgagtgtctttgcccttacgaggccctggtgctcagaaaaccgctgttcctcgattccattgtgaagggaatgaagaacctgcttaatagcacctctctggaaacatccctcagcatcgaggcgccctggggcgccattaacgtccagtctacgtttaaacctaccgttagcacagctaatatcgccctgtcctggtctagcgtggaacaccgggggaacaagatcctggtgaccggacgctccgagtctattatgaaacttgaagagagaacaggcgtcagctgggacctgggggtggaggatgcttccgaaagcaagctcctgaccgtttctatcatggacctctcccagatgtatagccccgtgttcgagtacctgtccggcgatcggcaagtcgaagagtggcctaaagccacgtgtacaggagactgccccgaacgctgtggctgcacctcttctacctgccttcataaggagtggcctcactccagaaattggcggtgtaacccgacatggtgctggggagtgggaaccggctgtacatgctgtggggttgatgtgaaggacctgtttacggatcacatgttcattaaatggaaggtcgagtacatcaaaaccgaagcgattgtgtgcgttgagctcacatctcaggaacgccagtgtagcctgatcgaggccggaaccagatttaatctgggccccgtgacaatcaccctttccgaacctcggaacattcagcaaaagctgccccctgagatcattacgctccatcccaaaatcgaggaaggcttctttgacctgatgcacgtccagaaggtgctcagcgcttctaccgtgtgcaagctgcagtcctgtacacatgggattccgggagaccttcagatctatcacattggcaatctgctgaaaggggatcgcgtcaacggacatctcatccacaagatcgagcctcacttcaataccagctggatgtcttgggacggctgcgatctggactactattgtaacatgggggattggccctcctgcacatacaccggagttacacaacataaccacgccgcttttgtgaatcttctgaacattgaaacggactataccaaaacattccattttcacagcaagagagtgaccgcccacggcgatacaccccagctcgacctgaaagcccggcctacctacggcgctggggagatcacggtcctcgtggaggttgcggatatggaactgcataccaagaaagtggagatttctggacttaagttcgccagcctgacatgcaccggctgttatgcttgctcctctgggatcagctgtaaggtccgcattcacgtggacgaacccgatgagctgacagttcatgtgaaatccagcgaccctgatgtcgtggccgcctccacctctctcatggctagaaagctggagttcggaacggacagcacatttaaagccttctccgcgatgccgaagacctctctttgcttttacatcgtcgaacgggagtactgtaaaagctgctccgaagacgataccaagaagtgtgtggacacaaaactggagcagccccaatctatcctcattgaacacaagggcaccatcattgggaaacagaatgatacatgcaccgctaaggccagctgttggctggagtccgttaagagcttcttttatggactcaaaaacatgctgggctctgtgttcggctcctttttcgtcgggatccttctgtttctggcccctttcgtgctcctggttctgtttttcatgttcggatggaagattctgttttgcttcaaatgttgcagacgcacgcggggcctctttaagtacagacatctgaaagacgatgaagagacagggtatcgccggatcatcgagagactcaatagcaagaaaggaaagaaccgcctgcttgacggcgaacggctggctgatagaaagattgccgagctgttctctaccaaaacacacatcgggtga

SEQ ID NO: 13687 - RNA, 5055 nt, synthetic construct
  misc_feature 1..5055: note = derived and/or modified CDS sequence (opt5) from CCHFV(SCT ex Afghanistan)__KC344856.1__GP
  source 1..5055: mol_type = other RNA
atgtacaccctgctcgtgtgcgccatcctgtgtccccagccttggagccttgagggcacacacgtcccgctgaacgggacgaagcataatggaaccggcattacagctgcccccgggggatcccaaggccctacctctcccgcgagcacagctgtttccctcacccctgaccccttcacaaccgaacctacggcctctgccgtggagctggaaagctccggggagggacacacctctcttagcgtgacaacccagggcctgacatccccggaaaccacgcccggcctccctacagtcaccgatacaggggtgagctctacctccatctttggaattggcatcagagttgctggggacacccccacaagcacgacccatacaggactgccttcttcccccagcatgccgtctaccgcccagggccctcaccatgctgtgcgggggctgctctccgtcagctccacacgccccggagaggcctctaccattacggtgcctggcgaggcgggcacagaagccaacagctccagctctgctatctccaaaaagcccgcccccagccctaccgctgaggccatcaccgaagcgaataactctagcaatccgagacagcccgagctgtccacacaacctgccattcccgggcttgttacctctagcgctcagcctatcctgctccagtccgccacaagcacggctgcccaggatatttatccctctccgaccaaccggtccaaacgcaatctggagatggaaatcattcttacactgagccaaggactcaagaaatactatggcaagatcctgcggattctggacctcaccctggaggaagatacagaggggcttctggaatggtgcaagagaaacctcggactgacctgtaatgacaacttctttcaggagcgcatcgaggagttctttcttacgggcgaagggcacttcaatgaagtgctgcagtttaaaaccccttctacactctcccccaccgagcctacacacaccagaacgcccacagtcaagcctttcaaaagctactttgcccggggattcctgtccatcgattctggctattttagcgctaagtgctactccaaaacctctaacagcggcctgcagctcattaatatcacacaacatcccgcgcgcattgccgacaccccggggcctaagatcaccaacctgaaggctattaattgtatcaaccttaaagcctccgtgttcaaggaacacagagagatcgagattaacgtgctgctcccccaggtcgccgttaatctgagcaactgccatgtgcttatcaaatctcacgtgtgtgattattccctggacattgatggagctgtccggctcccccacgtgcatcacaagggcacatttatccctgggacgtacaaaattgttatcgacaagcgcaataaacagaacgatagatgcaccctggtgacaaattgtgtcatcaagggaaaggaaattcggaaaggccaaagcgccctgcgccagtacagaaccgagatccggattgggaaggcgtctgctggctccagacgcctcctgagcgaagagtctggagacgactgcatcagccggacacagcttctgagaaccgaaacggccgaggtgcataacgataattatggcgggccgggagacaaaattacaatctgtaacggctccaccattgttgatcagcgcctcgggagcgagctgggatgctacaccatcaatcgggtgaagtctttcaaactgtgcgaaaactccgccacaggcaagagctgtaagatcgactccacccccgtcaaatgcagacaagggttctgtcttaagattacacaggagggccgcggacacgtgaaactctctcggggcagcgaagtcgtgctggatgcttgcgactcctcttgtgagatcatgattcctaaggggacgggagatatcctggttgactgcagcggcgggcagcagcattttctcaaagataatctgattgaccttggatgtcccaacatccctctgctcggcaagatggccatctatatttgcagaatgtccaatcaccccaagaccacaatggctttcctgttttggttctcttttgggtacgtgatcacctgtattttctgcaaagtcatcttttatctgcttattgtggttggcacactcggaaagaaattcaagcaataccgcgagctgaaacctcagacctgtacgatctgcgaaaccacacccaccaacgccatcgatgcggagatgcacgacctgaattgcagctataacatttgtccgtactgcgcctcccggctcacaagcgacggcctggctagacatgtgacccagtgtcctaagcgcaaggaaaaagtcgaggaaacagagctttacctgaacctcgagcggatcccctggattgtgagaaagctgcttcaggtgtctgaatccaccggggttgccctgaaacggagctcttggctcatcgtcctgctggtgctcctgacggtgtcccttagccctgtccaatctgctcccattggacacggcaagacaatcgagacctatcagacccgcgaagggtacatctccgtgtgcctgtttgttctcggaggcattctgttcgtggtcagctgtctgatcaaagggcttgtggattccgttggcaatagctttttcccgggactctctatttgcaagacatgtagcatcggctccgtgaacgggtttgagattgaatctcataaatgctattgtagcctgctgtgctgtccttactgcagacactgctccaccgaccgggagatccaccagctccatctgtctatttgtaagaagagacgcacgggaggcaatgtcatgcttgccgtgtgcaaacggatgtgtttcagagcgacaatggaggttagcaacaaggtgctgttcatccgcaatatcattaacaccacatttgtcatctgcattctcatcctggccgtgtgtgtggtctccacctctgctgttgaaatggagagcctgcccgccgggacatgggaaagagaggaagatcttaccaatttctgccaccaggagtgtcaagtgacggagaccgaatgcctgtgtccttatgaggctctcgtgctgcggaaacccctctttctgaactccattgtcaagggaatgaaaaatcttctgaacagcacaaatctcgaaacctctctgtccatcgaggccccctggggcgccatcaacgtgcagagcacattcaagcctaccgtttctacggctaatattgcgctgtcctggagctccgtggagcatcgcggcaacaagatccttgtctctgggagaagcgaatccattatgaaactggaggaacggacaggaatcagctgggacctcggcgtggaggatgcctctgaatccaagagcctgaccgtttctgtgatggacctcagccagatgtactccccggtctttgagtatctgtctggggatcgccaagtggaggaatggcccaaagctacatgcaccggagactgtcctgagagatgcggctgcaccagctccacatgtcttcacaaggaatggccccattctcggaattggcgctgcaaccctacgtggtgttggggagttgggaccggctgcacatgttgcggcctggatgtgaaagacctcttcaccgattacatgtttgtcaagtggaaggtggagtacattaaaacagaagccatcgtgtgtgtcgagctgaccagccaggagagacagtgctccctgatcgaagccgggacgcggttcaaccttggacccgttacaattaccctgagcgagcctcgcaatatccagcaaaagctcccgcccgaaattatcaccctgcaccctagaattgaggaaggctttttcgacctcatgcacgtgcagaaagtgctgtctgcttccacagtctgtaaacttcagagctgcacccatggggtgcccggagatctgcaggtttatcacatcggcaacctgctcaaaggggacaagctgaatggacatatgattcacaagatcgagcctcattttaacacatcctggatgtcttgggacggctgtgatcttgactactattgcaatatgggcgattggcccagctgcacgtacaccggggtgacacaacacaaccacgccgcgttcgtcaatctgctcaacatcgagaccgactatacaaagaattttcatttccactccaagcgggtgaccgctcatggagatacgccgcagctggacctcaaagccagacctacctacggcgccggggaaattacagttctggtggaggtcgctgatatggaacttcacaccaagaaaatcgacatttctggactgaagttcgccagcctgacatgtgcgggctgctatgcttgttccagcgggatctcttgcaaagtgcgcattcacgtcgatgagcccgacgagctcaccgtgcatgttaagtccgaagatcccgacatcgtggccgccagcacatctctgatcgctcggaaacttgagctgggaacggattccacctttaaagccttcagcgctatgcctaagacatctctctgtttttacattgtcgaaagagagtactgcaaaagctgttccaaggaagacacccagaaatgcgtgaacaccaagctggagcacccccagggcatcctcattgagcataagggcacaatcattgggaaacaaaatgacacgtgtaccgccaaggcgggatgctggctggaatctgttaagagcttcttttatggccttaagaacatgctgtccgggatcttcggaaatgtgtttatcggcattttcctgtttctcgcccctttcgtcctgcttatcctgtttttcatgttcgggtggcgcctcctgttttgtttcaaatgctgccggagaacacgcggactctttaagtaccggcacctgaaggaggatgaagagagcggctatagacgcattatcgaacggcttaacaataaaaagggcaaaaacaagctgctggacggggagagactcgctgatcggcgcattgccgagctgttctccaccaaaacacatatcggatga

SEQ ID NO: 13688 - RNA, 5055 nt, synthetic construct
  misc_feature 1..5055: note = derived and/or modified CDS sequence (opt5) from CCHFV(SPU 44/08)__KJ682805.1__GP
  source 1..5055: mol_type = other RNA
atgtacacacccctgctctgcgccatcctgtgtcttcagctgtggagcctcgagggcatttatgggctgtccaacaatacccaacacaacgacacgtctaccatcaaggtgcctgaagagagccagaaaacatcccttccggctaataccgcctctcccattacaagcgatcctccccctaccacacccaccgcgtccgcttctggacctgaaggcagcggggacacgtccaccagcccgcccgtcacaacccagggacctacaccccctgagaccacgcccgaaccgcatacaaccatcgatattgacaagtcttccacagccatcgccgatatcagcacccagaccgttaaaaacattcctacacccacggctcacacctctctgccttccacactcagcgcccccaccatgccccaagaggctcatcacacagccagaggcctgctgtctgtgacctccacgaagcctggggaggcgagcacaccgacctcccccggagaagcctctaccgaggctagctcccctcagcccacaatccgggaaaccccttctcccccgcctacaacgcagacccccacagagattaataaccctaataccagccgccagcccatgccttccacacaacccgccgctccgagctctgtgacccatcctgcccagcccacgcccagccagtccgacgtccctaccgcggcccaggatatccacccgtctcccacaaacagaagcaaacggaatctcgagatggaaattatcctgaccctttcccaaggcctgaagaagtactatggcaaagtgctcaagctgcttgacctgacactcgaggaagataccgaggggctgctggaatggtgcaaacgcaacctcggactgacgtgtgacgataatttctttcagaagagaattgaggagttctttcttacaggcgaagggcacttcaacgaggttctgcagtttaaaacccctagcacactctctcccaccgaacctgctcgggtggagtcccccaccgtcgaacctttcaagagctactttgccaagggattcctgcttatggactctggctatttttccgctaaatgctaccccaagagctccaattctgggctgcaactcatcaacgtgacacagcatctgatccgcattacggataccccgggacctaaaatcacaaatctgaagaccattaactgtatcaacctcaaagccctggttttcaaggagcacagagagattgaaatcaatgtgcttctgccccaggtcgccgtgaacctcagcaattgccatgtgctgatcaaatcccacgtctgtgactattctattgacatcgatggccctgttcggcttccccgcattcaccatgagggcacatttatcccggggacctacaagattgtgatcgacaagaaaaacaagcagaatgatagatgcacgctggtgacaaactgtgtcatcaaaggacgggaaattcgcaagggccaaagcgtgctcagacagtaccggaccgagatcaaaattgggaaggcttccagcggatctcgcagactgctgtccgaagagagcaatgacgattgcctctctcggacccagctgcttagaacagagaacgcggaaatccactccgacaattatggcgggcctggagataagattaccatctgtaacggcagcacaattgttgaccagcgcctgggctctgagctcgggtgctacacgatcaatcgggtgaaatccttcaagctgtgcgaaaacagcgccaccggaaaaagctgtgagatcgattctacacccgtcagatgccgccaaggcttttgtctgaagattacccaggaggggcggggacatgtgaaactttccagaggcagcgaagttgtgctcgacgcttgcgattcctcttgtgagatcatgattcctaaggggacaggcgacatcctggtcgactgcagcggaggccagcagcacttcctgaaggataatctcgtggacctggggtgtcccaacattccccttctgggaaaaatggccatctatatctgccgcatgtccaatcatcctaagaccacgatggccttcctcttttggttctcttttggctacgtcattacctgtatcctgtgcaaagctattttctatctgcttatcgtggttgggacactcggaaagaaatttaagcaataccgggaactgaagccgcagacctgtacaatttgcgagaccaaccccgtgaacgccatcgatgcggaaatgcacgacctgaattgcagctataacatctgtccttactgcgcttccagactcacatctgatggcctggcccgccacgtcatgcagtgtcccaaacggaaggagaaaattgaggaaaccgagctttacctgaatctcgaaagaatcccttgggtggttcgcaagctgctccaggtgagcgagtccacgggggtcgcccttaaacggagctcttggctcgtgattctgctggtgctcctgacagtttcccttagccccgtccaatctgctcctatctcccatggcgaaaccgtggaggtgtatcagaccagagagggatacacaagcatttgcctgttcgtcctcggctctatcctgtttctggtgtcctgtcttatgcgggggctcgttgacagcgtgtccaacagcttctttccgggactgtctatctgcaagacctgtagcattggctccatcaatgggttcgaaattgagtctcacaaatgctattgtagcctgttttgctgtccctactgccgccattgctccgccgatatcgaaattcacaagctccacctgtctatctgtaagaaaagaaagacgggaagcaacgtcatgcttgctgtgtgcaaacggatgtgtttcagagccacagttgaggtgtccaataaggcgctgctcattcgcaacatcatcaataccacatttgtcgtgtgcattctgatcctggccgtttgtgtggtctctaccagcgctgtggaaatggagaaccttcctgccggcacatgggagaaagaagaggacctgaccaatttctgccatcaggaatgtcaagtgacggagaccgagtgcctctgtccctatgaagctctggtcctccggaagcctctgttccttgattccattgttaaggggatgaaaaacctgctcaatagcacatctctggagacctccctgagcatcgaagccccctggggcgcgattaacgtgcagtctacatttaagccgaccgtgtccgccgctaatatcgcccttagctggtcctctgtcgagcacagaggaaacaaaatcctggtgagcggccgctccgaaagcattatgaagctcgaggagagaacggggatctcttgggacctgggagttgaagatgcttccgagagcaaactcctgacagtgtctgtcatggaccttagccagatgtactcccctgtgttcgaatatctgtctggcgatcggcaggttgaggaatggcccaaggctacctgcacaggggactgtcccgagcgctgcggatgcaccagctccacctgtctccataaggagtggcctcactctagaaactggcggtgcaatcccacatggtgttggggcgtggggacgggctgcacctgttgcggactggacgtcaaagatctgtttacagactacatgttcgtgaagtggaaagttgattacattaagaccgaagccatcgtgtgtgtcgagcttacaagccaagaacgccagtgctccctgattgaggccggcaccagatttaacctcgggcctgtgacgatcacactgagcgaaccgcggaatatccagcagaaactgccccctgagattgtgaccctgcatccccgcatcgaggaaggattctttgaccttatgcacattcaaaaggtcctgtctgcgtccaccgtttgtaagctgcagagctgcacacacggcgtgcctggggatctccagatctatcatattggaaacctgcttaaaggcgacaaggtgaatggccacctgatccataaaattgagccccacttcaacacctcctggatgtcttgggatgggtgtgacctcgattactattgcaatatgggagactggccgagctgctcctacacaggcgtcacgcagcataaccacgccgcttttgtgaatatgctgaacatcgaaaccgattatacaaagaatttccactttcattctaaaagagttaccgcccacggggacacacctcaactcgatctgaaggcccggcccacctacggagctggcgagatcacggtgcttgtcgaggtggccgacatggaactgcataccaaaaagattgagatcagcgggctgaagttcgcgtccctcacatgtaccggatgctatgcttgtagctctggcatttcctgcaaagttcgcatccacgtggacgaacctgatgagctgacagtccacgtcaagagcgaagaccccgatattgtggccgcctcttccagccttatggctagaaaactggagtttggcaccgactctacattcaaggccttcagcgcgatgcctaaaacgtccctctgtttttacatcgtggagcgggaatactgcaagtcttgtagcaaggaggatacccagaaatgcgttaacacaaagctggaacagccccaatccatcctcattgagcataaagggaccatcattggaaagcagaatgacacctgtacagctaaagccagctgctggctggaatccatcaagtctttcttttatggccttaagaacatgctgagcgggattttcggaaatgtgtttatcggcatcttcctgtttctcgccccgttcattatgctgatcctgtttttcatgtttgggtggcgcattcttttctgtttcaaatgctgcagacggacgagaggactctttaagtaccgccacctgaaagatgacgaggagatcggctatcggaagattatcgaaagactcaacaacaaaaagggcaagaataaactgcttgatggggagcgcctggctgaccggaagattgccgaactgttctccaccaaaacacatatcggatga

SEQ ID NO: 13689 - RNA, 5052 nt, synthetic construct
  misc_feature 1..5052: note = derived and/or modified CDS sequence (opt5) from CCHFV(K323_27)__KX013472.1__GP
  source 1..5052: mol_type = other RNA
atgcacaccctgctcgtgtgcttcatcctgtaccttcagctgagcggcctcgggggagcccatggccaatccaacgctacagagcacaatgggacgaacaccacaaccgtccccggaacatctcagagccctaagccgcccgcctccaccacactgcctcatacccccgaatctagcacggttaaacttaccacacctacctccgagacagaaggctctggggagaccacgccccctccgaatacaacccagggactgcccctccctggcacaacccccgaaagaagcgcgaccacagctacgtccaccagctctacagacaacatgaatagcaccacacaggtgaccgataacacgcctacaagcaccgtgtctatttccccctcctcttccccgagcatgccttccacctctcaaggcatccaccatcccgtccggagcctgctgtccgtgagctctcctaagacagttaccacacccacgcccatgtcccctggggagatgagcccggagacctctagccagcactccgccatgtctcgcattcccacactctataccgccacacaggtgagcaccgaaaatacggacagatccacccctcggcagagcgagtcttccgtccaacccgctacacagagccctatcacctctcccgcccagacaattctgcttatgtccgctgccccgaaagcgatccaggatatgcaccctagccccaccaaccgctccaagagaaatctggaagtggagatcattctcacgctgtctcaaggacttaaaaagtactatggcaagatcctgaaactcctgcatctgacactcgaggaagacaccgaggggctgcttgaatggtgtaagcggaacctgggaagcaattgcgatgacgactttttccagaaacgcattgaggaatttttcatcacaggcgaggggtactttaacgaggttctccagttcaagaccctgtccaccctttctcctacagaaagctcccacgtgagactgcccacggccgagccttttaaaagctatttcgctaagggatttctctctattgattccggctacttcagcgccaagtgttatccccggtcttccaccagcggcctgcaactgatcaatgtcacacagcatccggctcgcattgccgaaacccctgggcccaaaacaacctctctcaagacgatcaactgcatcaatctgagagcgagcgtgtttaaagagcaccgggaagtggagattaacgtccttctgccccagatcgccgttaacctctccaattgtcacgtggtgattagctctcatgtctgcgattactccctggacacagatggacctgtgcgccttccgagaatccaccatgagggcaccttcattcccgggacctacaagatcgttatcgaccggaaagataagctgaacgaccgctgtagcctcgtgacaaattgcgtcattaaaggaagagaagtgcggaagggccagtccgttctgagacaatataagaccgagatcaaaattgggaaggcttctacaggaagccgcaaactgctctccgaggagcctggcgacgattgtatctctcggacgcagctgcttaagaccgaaacagccgagattcacgacgataactacggcgggcccggagacaaaatcaccatctgcaatggcagcacaattgtggatcagagactggggtccgagctcggatgttataccatcaaccgcgtcaagtcttttaagctgtgcgaaaatagcgctacgggcaaaacctgcgagattgactccacacctgtgaagtgtcggcaggggttctgcctgaaaatcacccaagaaggcagaggacatgtcaaacttagccgcggctctgaggtggttctcgatgcctgtgactccagctgcgagattatgatccccaaggggacaggagatattctggtggactgttctggcgggcagcagcacttcctgaaggataacctcatcgacctgggatgccctcacatcccccttctgggcaagatggccatttacatctgtcggatgtccaatcatccgagaaccacaatggcttttctcttctggtttagcttcgggtatgtcattacctgcatcttttgtaaagcgctgttctacctgcttattatcatcggcacgctcggaaagaaaattaagcagtatcgcgaactgaaacctcaaacatgcaccatctgtgagaccgcccccgtgaacgctattgacgccgaaatgcacgatctgaattgctcttacaacatctgcccttactgtgcctcccggctcacaagcgacggcctggctagacatgttacccagtgccccaagcgcaaggagaaagtggaagagacggagctttatctgaatctcgaacggattccgtggatcgtcagaaagctgctccaggtgtccgagagcacaggggtggcccttaaacggtctagctggctcaccgttctgctggtcctcctgacagtgtccctttctcctgtgcagagcgcgcccgtcggacacggcaacaccatcgaaacataccaaacccgcgaggggtttacgtccatttgtctgttcatgctcggatctatcctgtttattgtgagctgcctggttaagggccttgtggattccgtctctgacagcttctttcctgggctctccgtgtgtaaaacctgcagcatcggctctattaatggattcgaaatcgagtcccacaagtgttattgcagcctgttttgttgcccccattgtagacaccggtctgctgatagagagatccatcagctgcacctctccatttgcaaaaagcgcaagacaggcagcaacgttatgctggccgtgtgcaaacggatgtgtcccaaggccaccatcgaagctagcagacgcgcccttcctattagatctatcattaacacaaccctggtcatgtgcatcctcacgctggctatttgtgtggttagcacatccgccgtggagatggaagacctgccggcggggacctgggagcgggaagaggatcttacaaatttctgccatcaggagtgtcaagtcaccgaaaccgagtgcctgtgtccctacgaagccctcgtgctgcgcaaacctctcttcctggacagcatcgctaagggaatgaaaaaccttcttaattctacatccctcgagacgagcctgtctatcgaggccccctggggcgctattaacgtgcagagcacctttaagcctacagtctccaccgccaatatcgcgctgtcttggagctccgttgaacacagagggaacaagattcttgtgacaggacggtctgagagcatcatgaaactggaggaacgcaccggcgtgtcctgggatctcggggtcgaagacgccagcgagtctaagctgctcacggtgtccattatggatctgagccagatgtattcccccgttttcgagtacctttctggcgacagacaggtggaagagtggcctaaagctacatgcaccggagattgtccggaacggtgcggctgtaccagctccacatgcctgcacaaggagtggccccattctcgcaattggagatgcaaccctacctggtgttggggagtcggaacaggctgcacgtgttgcggggtggacgttaaagacctctttaccgatcacatgttcatcaagtggaaggtggaatatatcaaaacagaggccattgtctgtgtggagctgaccggacaagaacggcagtgcagcctgatcgaggctggcacacgctttaatcttggccccgttaccattacgctgtccgaacctagaaacatccagcagaagctgcccccggagattatcaccctgcatcctaaaatcgaagaggggttctttgacctcatgcacgtgcaaaaggtcctgagcgcctctacagtgtgtaaacttcagtcctgcacccatgggattcccggcgatctgcagatctaccacattgggaatctgctcaagggagaccgggtgaacggccacctgatccataagattgagccccacttcaatacaagctggatgtcttgggatgggtgtgaccttgattactattgcaacatgggagactggccttcctgtacctacacaggcgtcacgcagcataatcacgccgcttttgttaacctgctcaacatcgaaaccgattatacaaaaaccttccactttcatagcaagagagtgaccgcgcacggcgacacaccccaactggatctcaaagcccgccctacgtacggggctggagagattaccgtgctggtcgaagtggccgacatggagcttcatacaaagaaagttgagatctctggcctgaagttcgccagcctgacctgcacagggtgctatgcttgttcctctggaatcagctgcaaagtgcggattcacgtcgatgaaccggacgagctcaccgtgcatgttaagtccagcgaccccgatgtggtcgccgcgtccacgtctctgatggctagaaagctggaatttggcacagacagcaccttcaaagccttctccgccatgcctaagacctctctgtgtttttacatcgtggagcgcgaatattgcaaaagctgttccgaggatgacacaaagaaatgcgtcgataccaagctcgagcagccccagtctattctgatcgaacacaaggggacaattatcggaaaacaaaatgacacctgtacggctaaggccagctgctggctcgagtccgtgaaatccttcttttacggcctgaagaacatgcttggctctgttttcgggtcctttttcgtgggaatcctgctgtttctcgcgcctttcgtcctgcttgtgctgtttttcatgtttggctggaaaattctcttctgtttcaagtgctgtcggagaacacgcgggctgtttaagtaccggcacctcaatgatgacgaagagaccggatatagacgcatcattgaacggctgaacagcaaaaagggcaaaaatagacttctggatggggagcggctggctgaccgcaagatcgccgaactcttctctacaaaaacccatattggatga

SEQ ID NO: 13690 - RNA, 5052 nt, synthetic construct
  misc_feature 1..5052: note = derived and/or modified CDS sequence (opt5) from CCHFV(1231-CR/TI-2015)__KU161585.1__GP
  source 1..5052: mol_type = other RNA
atgcacaccctgctcgtgtgcttcatcctgtaccttcagctgctcggccttgggggagcccatgagcaaagcaacgctacagaccacaatagaacgaacaccattacagccccctccacctctcagaatcctaagccgcccgcgagcacaacccctccccatacacctgaatcctctaccatcaaacttattacgagcaccggcgaggctgaagggtccggagagacaacaccccctctgaacaccacccagggcccgtttccccctgaaacgacatctgagcaccccgccagcaccgccacaaatacctccagcaccaactctatgaactccacaacgcagatgaccgataagacactcaccagcacagtctctacctccctgagcatctctccttccacgcccagcacatcccaagggattcattatccgatccggtctctgctcagcgtttccagccctcgcaccgctgccacccccacacctatgtctaccagagagatgtccagcgaaacaaattctcagcacagcgctgtgtcccggacgcccaccttccacacagccacccaggtgtctacagagaatgacaaccgcagcacccccagacagtccgaaagctctgcgcaacctgccacgcagtccccgatgaccagccccgctcagtctatcctgcttgtctccgccgctcctacaaccattcagaatatccatcccagccctacaaaccggtccaaacgcaatctggagatggagattatcctcaccctgccccaaggacttaagaaatactatggcaagattctgaagctcctgcacctgacgctcgaagaggatacagaaggcctgcttgagtggtgtaaaagaaacctggggtctaattgcgacgatgaatttttccagaagcggatcgaggagtttttcattaccggagaaggctactttaacgaggtgctccagttcaaaacactgagcaccctttccccgatggaaccttctcatgccagaccccctaccgcggagccctttaagagctatttcgccaaagggtttctgtccatcgacagcggatacttctctgctaagtgttatcctcgctcctctagctccggcctccaactgatcaacattacacagcaccccgcccggatcgctgaaacgccggggcctaagaccacaagcctgaaaaccattaattgcatcaacctccgcgcctctgtttttaaggagcacagagaggtggaaattaatgtcctgcttccccagatcgccgtgaacctgagcaattgtcatgttgtgatcaactcccacgtctgcgattacagcctcgacacagatggacccgtgcggctgcctcgcatttaccatgagggcaccttcatcccgggcacgtataaaattgtgatcgacaagaaaaataaacttaacgatagatgtacactggtcaccaattgcgttaccaaggggcgggaagtgagaaagggacagtctgtgctccgccaatacaagacagagattaaaatcggcaaggcttccaccgggagccggaaactgctgtccgaggaacccggagacgattgtatctctagaacacagctcctgcgcacggagaccgcggaaattcacgacgacaactatggcgggcctggagataagatcacaatttgcaatggcagcaccatcgtcgaccagcggcttggctccgagctggggtgttacacaattaacagagtgaaatctttcaagctctgcgaaaatagcgccaccggaaagacgtgcgagatcgattccacccccgttaaatgtcgccagggcttttgcctgaagattacacaagaggggcggggacatgtgaaactgtctagaggcagcgaagtcgtgcttgacgcttgtgattccagctgcgaggttatgatccctaaggggaccggcgacatcctcgtggattgttctggaggccagcagcacttcctgaaagacaacctgattgatctcgggtgcccccacatccctctgcttggaaagatggccatttatatctgtcgcatgtccaatcatccccggacaaccatggcctttctgttctggtttagcttcggctacgtcattacatgcatcttttgtaaggctctcttctattctctgatcattatcgggaccctggggaaaaagattaaacagtacagagaacttaagccgcaaacgtgcacaatctgtgagaccgcccctgtgaacgcgattgacgctgaaatgcacgatctcaactgctcctacaatatctgcccctattgtgccagccgcctgacctctgacggcctggcccggcatgtcacacagtgccctaaaagaaaggagaaggtggaggaaaccgagctctacctgaaccttgaacggatcccctggattgttcgcaaactgctccaggtgtccgagagcacgggggtcgctctgaagagatccagctggctgatcgtgcttctcgttctgctgacagtgtctctcagcccggtccagtccgcccctgtgggccacggaaaaaccattgaaacatatcaaacccgggagggctttacatctatctgtctgttcatgcttgggagcattctgtttatcgtgtcctgcctcgttaagggactggtcgagtctgtgagcgactccttctttcccggcctgtctgtgtgtagaacctgcagcatcgggtccattaatggattcgaaatcgagagccacaaatgttactgctctcttttctgttgcccttattgtcgccattgctccgctgatcgggaaattcaccagctccatctgagcatctgcaagaaaagaaagacgggctctaacgtcatgctggccgtgtgtaagcgcatgtgctttagagcgaccatggaggcctcccggcgcgctctcctgattagaagcatcattaatacaaccttcgttatctgtatccttacactgaccatttgcgtggtctccacgtctgccgtggaaatggagaacctccccgctgggacatgggagcgggaagaggacctgaccaatttttgtcaccaggaatgccaagttacagagaccgagtgtctgtgcccctacgaagcccttgtgctgcgcaaacctctcttcctggatagcatcgtcaagggcatgaaaaacctccttaattccaccagcctggagacatctctgtccattgaagcgccgtggggagccatcaacgtgcagagcacgtttaagcccaccgtttctacagctaatattgccctcagctggtcctctgtggagcatagaggcaacaaaatcctggtcaccgggcggagcgaatccatcatgaagctggaggagcgcacaggagtgtcttgggaccttggcgtggaagatgctagcgagtccaagctgctcaccgtcagcattatggacctgtctcagatgtattcccctgttttcgaatacctcagcggggatagacaggtggaggaatggcccaaagccacgtgtacaggagactgccctgagcggtgtggctgcacctcctctacctgcctgcacaaggagtggccccacagccgcaattggagatgtaaccctacatggtgctggggagtgggcaccggatgtacatgctgtggcgtcgatgtgaaagacctttttacggatcatatgttcgttaagtggaaagtggaatacatcaagaccgaggccattgtctgcgtggaactgacatcccaagagcggcagtgttctctcatcgaagctgggaccagatttaatctgggaccggttacaattaccctgagcgagccccgcaacatccagcagaaacttcctcccgagatcattacgctgcaccctaagatcgaagagggcttctttgacctcatgcatgtgcaaaaggtcctgtccgcgagcaccgtgtgcaaactccagtcttgtacacacgggattcccggagatctgcaggtttatcatatcggcaaccttctgaagggcgaccgggtgaatgggcacctgattcacaaaatcgaaccgcatttcaacacctcctggatgagctgggacggatgcgatctcgactactattgtaatatgggcgattggccttcttgcacatacaccggggtcacacagcacaaccatgccgcttttgtgaatctgcttaacattgagacggactataccaagacattccacttccactccaagagagtgaccgcccatggagatacaccccaactggacctcaaagcccgccccacctacggcgctggggagatcacggtcctggttgaagtggccgatatggagctccacaccaagaaagtggaaatcagcggactgaagtttgcgtctcttgcttgcacaggctgttatgcctgcagctccggcatttcttgtaaagtccggatccatgtggacgagcctgatgaactgaccgttcacgtcaagagctccgaccccgatgtggtggccgctagcacatccctgatggccagaaaactcgagttcgggaccgactctacgtttaaggcgttcagcgctatgcctaagacatccctgtgcttttacattgttgagcgcgaatactgtaaatcttgcagcgaggatgacaccaagaaatgtgtggacaccaaacttgaacagccgcagtccatcctgattgagcataagggaacaatcatcggcaagcaaaatgatacctgcacagccaaggcctcttgttggctcgaaagcgtcaaatccttcttttatgggctgaagaacatgctcggaagcgtgttcggcaactttttcattgggatcctgctttttctggctcccttcgtcctgctcgtgctgttctttatgttcggatggaaaattctgttttgcttcaagtgttgccggagaacccgcggcctgtttaaataccggcacctcaaggacgatgaggagacgggctatagacggatcattgaacgcctgaataataagaaagggaagaacagactcctggacggagagcggcttgccgatcgcaaaatcgctgaactgttctctacaaagacccacatcggctga

SEQ ID NO: 13691 - RNA, 5052 nt, synthetic construct
  misc_feature 1..5052: note = derived and/or modified CDS sequence (opt5) from CCHFV(K229_194)__KX013463.1__GP
  source 1..5052: mol_type = other RNA
atgcacaccctgctcgtgtgcttcatcctgtaccttcagctgagcggcctcgggggagcccatggccaatccaacgctacagagcacaatgggacgaacaccacaaccgtccccggaacatctcagagccctaagccgcccgcctccaccacactgcctcatacccccgaatctagcacggttaaacttaccacacctacctccgagacagaaggctctggggagaccacgccccctccgaatacaacccagggactgccccctcccggcacaacccctgaaagacccgcgaccacagctacgagcacctccagcacagacaacatgaactctaccacacaggtgaccgataatacgccgatttccacagtgagcatctctccttccagctctccctccatgcctagcacctcccaaggcattcactatcccgtccggtctctcctgagcgtgtccagccccaagaccgttacaacccctacaccgatgtctcccggggagatgtcccctgagacgagctctcagcatagcgccatgtcccgcatccccaccctgtacacagccacccaggtgtctacagaaaataccaacagaagcacgcctcggcagtccgagagctctgctcaacccgccacccagtccccgacaaccagccctacacagaccattctcctgatgtctgctgcccccaaagcgatccaggacatgcacccttcccccacgaatcgcagcaagagaaaccttgaagtcgagatcattctgacactctcccaaggactgaaaaagtattacggcaagatccttaaactgctccacctgaccctggaggaagatacagaggggctcctggaatggtgtaagcggaatcttggatctaactgcgacgatgactttttccagaaacgcattgaggaatttttcatcaccggcgaggggtattttaatgaggtgctgcagttcaagaccctcaacacactgagccctacggaaccctcccatgttagacttccgaccgccgagccttttaaatcttacttcgctaagggatttctgagcgtggattccggctatttcagcgccaagtgttacccccggtcttccacaagcggcctccaactgattaatgtcacccagcaccccgctcgcatcgccgaaacacctgggccgaaaaccacgtctctgaagacaattaactgcatcaacctcagagcgtccgtgtttaaagagcatcgggaagtggagatcaatgtcctgcttccccagattgccgttaacctgagcaattgtcacgtggtgatcaactctcacgtctgcgactacagcctcgataccgacggacctgtgcgcctgccccggattcatcacgagggcaccttcatccctgggacatataagattgttatcgataaaaagaataaacttaacgacagatgttccctggtgaccaattgcgtcatcaagggacgcgaagtgagaaagggccagagcgttctccggcaatacaaaacagagattaagatcgggaaggcttctacgggatccagaaaactgctgagcgaggaacccggcgatgactgtatttcccgcacccagctcctgaaaacagaaaccgccgagatccatgacgataactatggcgggcctggagacaagattacaatctgcaatggctctaccatcgtggatcagcggcttgggagcgagctgggatgttacacgattaacagagtcaagtcctttaaactctgcgaaaattctgctaccggcaagacatgcgagatcgacagcacccccgtgaaatgtcgccaggggttctgcctgaagattacacaagaaggccggggacacgtcaaactgtccagaggctctgaggtggttcttgatgcctgtgacagctcctgcgagatcatgattccgaaggggaccggagatatcctcgtggactgtagcggcgggcagcagcatttcctgaagggaaacctgattgatctcggctgccctcacatccccctgcttgggaaaatggccatctatatttgtcgcatgtctaatcaccctcggacaaccatggcttttctgttctggttttccttcggctacgtcatcacgtgcatcttttgtaaggctctcttctatagcctgattattatcggaacactgggcaaaaagatcaaacagtacagagaacttaagccccaaacctgcaccatttgtgagacagccccggtgaacgctatcgacgccgaaatgcatgatctcaattgctcttacaacatttgcccttattgtgcctcccgcctgaccagcgacgggctggctcggcacgttacgcagtgccccaagagaaaagagaaggtggaagagacagagctctacctgaaccttgaacgcatcccttggattgtccggaaactgctccaggtgtctgagtccaccggagtggccctgaagagaagctcctggctgatcgttcttctcgtcctgctgacagtgagcctctctcccgtgcagagcgcgcccgtcggccatgggaaaaccatcgaaacatatcaaacccgggagggatttacgaatatttgtctgttcatgcttggctccatcctgtttattgtgtcttgcctcgttaaggggctggtggacagcgtctccgattctttctttcctggcctgagcgtgtgtaaaacctgctccatcggatctattaacggcttcgaaatcgagagccacaagtgttactgctcccttttctgttgcccgtattgtcgccactgcagcgctgacagagagatccatcagctccacctggggatttgcaagaaacggaagacaggatctaatgttatgctggccgtgtgtaaaagaatgtgctttaaggccaccatcgaggcttcccgccgggccctcctgattagaagcatcattaacacaaccttcgtcatctgtattcttacgctggctatctgcgtggtttctacatccgccgtggaaatggaaaatctccccgcgggcacctgggagcgcgaagaggatctgaccagcttttgtcatcaggagtgccaagtcacagaaaccgagtgtctgtgcccttacgaagcccttgtgctgagaaaacccctcttcctggactccatcgtgaaggggaagaaaaacctccttaattctacaagccttgagacgtccctgagcattgaggctccttggggagccatcaacgtccagtctacctttaagcccacagtttccaccgctaatattgccctcagctggtctagcgtggaacaccggggcaacaaaatcctggtgacagggcgctccgagtctattatgaagctggaagagagaaccggcgtcagctgggatcttggagtggaagacgcgtccgagtctaaactgctcacggttagcatcatggatctgtcccagatgtatagccctgtgttcgagtacctctctggcgaccggcaggtcgaagagtggccgaaggccacatgtaccggggattgccccgaacgctgtggatgcacctccagcacatgcctgcataaggagtggcctcactccagaaattggcggtgtaaccccacctggtgctggggcgtggggacaggatgtacgtgctgtggcgttgacgtgaaagatctttttaccgaccacatgttcatcaagtggaaagtcgaatacattaagacagaggctatcgtgtgcgttgagctgacctctcaagaacgccagtgtagcctcattgaggccggcacaagatttaatctggggcctgtgaccatcacgctgtccgaaccccggaacattcagcagaaacttccgcctgagatcatcaccctgcatcccaagattgaagagggattctttgatctcatgcacgtccaaaaggtgctgtctgctagcacagtgtgcaaactccagtcctgtacccatggcatccccggggacctgcagatttatcacatcggaaatcttctgaagggcgaccgcctgaacgggcatctcattcacaaaatcgagcctcacttcaacacaagctggatgtcttgggatggatgcgacctggattactattgtaatatgggcgactggccctcctgcacctacacaggcgtcacgcagcataaccacgccgcctttgttaatcttctgaacattgaaaccgattatacaaagaccttccattttcacagcaaaagagtgaccgctcacggggacacacctcaactcgatctgaaggcgcggccgacgtacggagccggcgagatcaccgtgctcgtcgaagtggctgacatggagctgcataccaaaaaggttgagatctctgggcttaagttcgcctccctggcctgcacaggatgttatagctgctctagcggcatttcctgtaaagtgagaatccacgtcgatgaacccgacgagctgacagtgcatgttaagtctagcgatcctgacgtggtcgctgcctccaccagcctcatggcgcgcaaactggagttcgggacggattccacatttaaggctttctctgccatgcccaaaaccagcctttgcttttacattgtggaacgggaatactgtaagtcctgctctgaggacgacaccaagaaatgtgtcgatacaaagctggagcagcctcagagcatcctcattgaacacaaaggaaccatcatcggcaagcaaaatgacacatgcaccgccaaagcgtcctgttggctggagtctgttaagagcttcttttatggcctcaagaacatgctggggtccgtgttcggaaactttttcgtgggcattcttctgtttctggcccccttcgtcctcctggtgctgtttttcatgttcgggtggaaaatcctgttttgcttcaagtgttgcagacgcacgcggggactctttaaatacagacatctgaaggatgacgaagagacaggctatcgcaaaattatcgaacggctcaatagcaagaaggggaaaaatagactgcttgatggagagcgcctggcggaccggaagattgctgagctgttctctaccaaaacacacatcggctga

SEQ ID NO: 13692 - RNA, 5052 nt, synthetic construct
  misc_feature 1..5052: note = derived and/or modified CDS sequence (opt5) from CCHFV(K315_14)__KX013469.1__GP
  source 1..5052: mol_type = other RNA
atgcacaccctgctcgtgtgcttcatcctgtaccttcagctgagcggcctcgggggagcccatggccaatccaacgagacagaacacaatgggacgaacaccacaaccgtccccggaacatctcagagccctaagccgcccgcttccaccacactgcagcatacccctgagtctagcacggttaaacttaccacacccacctccgaaacagagggctctggggaaaccacgcctccccctaatacaacccagggactgccgccccctggcacaacccccgagagaagcgccaccacagcgacgtccaccagctctacagacaacatgaactccaccacacaagtgaccgataatacgcctacaagcaccgtgtctatttcccccagcagctccccgagcatgccttccacctctcagggcatccactatcccattcggagcctcctgtccgtcagctctcctaagacagtgaccacacccacgcccatctcccctggggagatgagcccggaaacctctagccagcattccgctatgtctcgcattcccacactgtacaccgccacacaggttagcaccgagaatacgaacagatccacccctcggcaaagcgaatcttccgtgcagcccgccacacagagccctatcacctctcccgctcagacaatcctcctgatgtccgccgctccgaaagccattcaagacatgcaccctagccccaccaatcgctccaagagaaaccttgaggtcgagatcattctgacgctctctcagggactgaaaaagtattacggcaagatccttaaactgctccacctgacactggaagaggataccgaagggctcctggagtggtgtaagcggaatcttggaagcaactgcgacgatgactttttccagaaacgcattgaagagtttttcatcacaggcgaggggtattttaatgaagtgctgcaattcaagaccctctccaccctgtctcctacagagcccagccatgttagacttcctacggcggaaccctttaaatcctacttcgccaagggatttctgagcattgattctggctatttctccgctaagtgttacccgcggagctctacctccggcctccagctgatcaacgtgacacagcaccctgcccgcatcgctgagacccccgggcccaaaacaaccagcctgaagacgattaattgcatcaacctcagagcctctgtctttaaagaacatcgggaggtggagattaacgtgctgcttcctcagatcgcggtcaatctgagcaactgtcacgttgtgattaattcccacgtgtgcgactacagcctcgatacagacggaccggtccgcctgcccagaatccatcacgaaggcaccttcatccctgggacctataagattgtgatcgataaaaagaacaaacttaatgaccggtgttctctggttacaaactgcgtgattaagggacgcgaggtcagaaagggccaatccgtgctccggcagtacaaaaccgaaatcagaattgggaaggccagcacaggatcccgcaaactgctgtctgaggaacccggcgatgactgtatcagccggacgcagctcctgaagaccgagacagctgagatccatgacgataattatggcgggcctggagacaaaattaccatctgcaacggctccacagttgtggatcagagacttgggtctgaactgggatgttacaccattaatcgcgtcaagagctttaagctctgcaaaaactccgccacgggcaagacctgcgagatcgactctacacccgtgaaatgtcggcaagggttctgcctgaagattacccaggaaggcagaggacacgtcaaactgagccgcggctccgaggtggttcttgatgtgtgtgacagctcttgcgagatcatgattcctaaggggacaggagatatcctcgtcgactgttccggcgggcagcagcatttcctgaaggataatctgatcgacctcggatgcccccacattccgctgcttggcaaaatggctatctatatttgtcggatgagcaaccaccctagaaccacaatggcctttctgttctggttttctttcgggtacgtgattacctgcatcttttgtaaggccctcttctattccctgatcatcattggcacgctggggaaaaagatcaaacaataccgcgaacttaagccccagacatgcaccatttgtgagaccgctcctgttaatgcgatcgatgccgaaatgcatgacctcaactgcagctacaatatttgcccctattgtgcttctcggctgacatccgagggcctggccagacacgtgacccagtgcccgaagcgcaaagaaaaggtcgaggagacggaactctacctgaaccttgagcggatcccttggatcgtgagaaaactgctccaggtgagcgaatccacaggggttgccctgaagcggagctcttggctgattgtccttctcgtgctgctgaccgtgagcctctcccccgtccaatctgctcctgtgggacatggcaaaacaatcgagacctatcagacacgcgaagggtttaccagcatttgtctgttcatgcttggatccatcctgtttattgtttcttgcctcgtgaagggcctggtctacagcgtgtccgactctttctttcccgggctgagcgtttgtaaaacgtgctccatcggcagcatcaacggattcgagattgagtctcacaagtgttattgctccctcttttgttgcccctactgtagacactgcagcgccgatcgggaaatccatcagcttcacctgtctatttgcaagaaaagaaagaccggctccaatgtgatgctggcggtctgtaaacgcatgtgcttcaaggctacaatcgaggccagccggagagccctcctgattcgctccatcattaacaccacattcgtgatctgtatccttaccctggctatttgcgttgtgtctacgagcgccgtcgaaatggaggacctccctgctgggacatgggaaagagaggaggatctgaccaatttttgtcatcaagaatgccaggtgacagagaccgaatgtctgtgcccgtatgaggcccttgtgctgcggaaacccctcttcctggactccatcgtcaagggaatgaagaaactcctgaacagcacctctcttgagacatccctgagcattgaagcgccttggggcgccatcaatgttcagtctacgtttaagcccaccgtgagcacagctaacattgccctctcctggtctagcgtggagcaccgcgggaataaaatcctggtcaccggaagatccgaatctatcatgaagctggaggaacggacaggcgtgagctgggatcttggggttgaggacgcttccgagagcaaactgctcaccgtgtctattatggatctgtcccagatgtacagccctgtcttcgaatacctctccggcgaccgccaagtggaggaatggcccaaggccacgtgtacaggagattgccctgagagatgtggctgcacctcttctacctgcctgcataaggaatggccgcactcccggaactggcgctgtaatcccacatggtgctggggagttggaaccggctgtacatgctgtggggtggacgtcaaagatctttttacggaccacatgttcatcaagtggaaagtggagtatattaagaccgaggcgatcgtttgcgtggaactgacatctcaggagagacagtgtagcctcattgaagccggaacccggtttaacctgggccctgtcacaatcaccctgtccgagccccgcaatatccagcaaaaacttcctcccgaaattatcacgctgcatccgaagattgaggagggcttctttgatctcatgcacgtgcagaaggtgctgagcgcttctaccgtctgcaaactccagtcctgtacacatgggatccctggagacctgcagatttaccacatcggcaaccttctgaagggggacagagttaatggacatctgattcacaaaatcgaaccccacttcaacaccagctggatgtcttgggatggctgcgacctcgattattactgtaatatgggggactggccctcctgcacatataccggagtgacacaacataaccacgccgcttttgtgaacctgcttaatatcgagacggattacaccaagacattccattttcacagcaaacgggtcaccgcccacggcgacacccctcagctggatctcaaggccagacccacatatggcgctggggaaattacggtgctggttgaggtggcggacatggagctccataccaaaaaggtcgaaatctctggactgaagttcgccagccttacatgcaccggctgttacgcttgctcctctgggattagctgtaaagtgcgcatccacgttgatgagcctgacgaactgacagtgcatgtcaagtccagcgatccggacgtggtcgccgcctccacctctctgatggctcggaaactcgagttcggaacggatagcacatttaaggccttctccgcgatgcccaaaacctctctgtgcttttacattgtggaaagagagtattgtaagagctgctccgaggacgacaccaagaaatgtgttgatacaaaacttgaacagcctcaatctatcctgatcgagcacaagggcaccattatcgggaagcagaacgacacatgcaccgctaaagccagctgttggctcgaatccgtcaagagcttcttttacggactgaagaatatgctcggctctgtgttcggctcctttttcgtggggattctgctttttctggcccccttcgttctgctcgtgctgtttttcatgttcggatggaaaatcctgttttgcttcaagtgttgccgccggacgagaggcctttttaaatatcgccatctcaaggatgacgaggaaacagggtaccggagaattatcgagcgcctgaacagcaaaaagggaaagaatcggctcctggatggcgagagacttgctgaccggaaaatcgccgaactgttctctaccaagacacacattgggtga

SEQ ID NO: 13693 - RNA, 5055 nt, synthetic construct
  misc_feature 1..5055: note = derived and/or modified CDS sequence (opt5) from CCHFV(BA8402)__AF350449.1__GP
  source 1..5055: mol_type = other RNA
atgtacacacccctgctctgcgccgtgctgtgtcttcagctgtggagcctcgagggctcccacgggctgtctaacaagacccaacatagcaatacgtccaccacaaaagctcctgaagtctctcaggagcttggactgccggttagcaccgtgtccacaatcacctctgaaccccctagcattacatccgccgtgagcgtctctggctccgaggggagcggagacaccaacacgtctccctccgtgaccacacagggccctaccctccccgaaacaaccctggagcctctgacgacaaccgatacagacgcgagctctaccgttgtggtcgatgtgtccacccagacagttaaggacacgccgatcagcaccacatatacctccctcccctctacacctagcgagcccaccacgcctcaagggacacaccataccgctagaggactgctttccgtgaccagcacaaaacccgaagaggcctctccgcaggccaatcctggcaagatttccatggaaaccaacggcccccggctggctatcagcgagacaccttctttcagccccacgacccaggcccccacagaaaattccaaccctattacctctaaacagctcatgctgagcgctcaaccggtcacacccaatcctatgacctcccccgtgcagcctgcccttagccagtctgatacgtccaccgcgatccaggacgtgcaccccagcccgacagggcgctctaagagaaacctggaaatggagatcattctcaccctgtcccaaggactgaagaaatactatggcaagatcctcaaactgcttgatctgacactcgaagaggacaccgaagggctgcttgagtggtgcaagcggaatctgggactcgtctgtgatgacaactttttccagaaacgcattgaggaatttttcctgacgggcaaggggcattttaatgaggttctgcagttcaagacacctagcaccctctcccccacaggacctgccagaaccggctctcccaccgtggaaccttttaaaagctacttcgctaagggctttctgtccatggattctgggtatttcagcgccaaatgctacccccgggcttccaacagcggacttcaactgatcaatgtgacacagcactctacgcgcattaccgacacaccgggccctaagatcaccaacctcaaaacaattaattgtatcaacctgaaggcctccgtctttaaagagcacagagaaatcgagattaacgtgcttctgccccaggttgcggtgaatctcagctcttgccatgtcctgatcaagtcccacgtgtgtgattatagcctggacattgacgggcccgttcggctccctcgcatccatcacgagggaaccttcattccgggcacgtacaagatcgtgatcgataaaaagaacaaacagaatgacagatgcacactggtcaccaactgtgtgattaaggggcgggaaatccgcaaaggacaatctgtccttagacagtaccggaccgagattaagatcggcaaggccagctccggcagccgcagactgctctctgaagagtccggggatgactgcattagccggacacagctgctgagaaccgaaacagctgagatccacaatgataactatggaggccccggggacaaaatcacgatttgtaatggatccaccgtggttgatcagcgccttggctctgagctcgggtgctacacaatcaaccgggtgaatagctttaacctgtgcgaaaataccgccacaggcaagtcctgtgagattgactctacccctgtcaaatgcagacaaggattctgtctgaagatcacgcaggaaggccgcgggcatgtgaaactcagccggggatccgaggttgtgctggatgcttgcgagtctagctgtgaaattatgatccccaagggcaccggggacattcttgtcgattgctccggaggccagcagcacttcctgaaggacaacctcatcgacctggggtgtcctaatatccccctgcttggcaaaatggccatttatatctgcagaatgagcaaccatcctaagacaaccatggcctttctcttctggttttctttcggatacgtggtgacatgtattctgtgcaaagttatcttttatctgctcattgtcgtgggcaccctggggaagaaattcaagcaataccgcgagcttaagccccagacatgtaccatctgcgaaacgacaccggtgaatgctatcgatgcggagatgcacgacctgaactgctcctataacatttgtccttactgcgccagccggcccacctctgatggactcgctagacatgtcatgcagtgtcctaaacgcaaggagaaaatcgaggagaccgccctgtacctgaatcttgaacggattccctgggtggttagaaagctcctccaggtgtccgagagcacaggcgtcgccctgaaacggtcttcctggctggtggttctgcttgtgctgctcaccgtcagcctgtccccggtgcaaagcgctcctatcgggcacggaaagacggttgaaacatatcagacccgcgagggctacacatctatttgcctgtttgtgcttgggagcatcctcttcatcgtctcctgtctgatgaaaggcctggtggactctgtgggaaacagctttttccccggcctctccatttgcaagacctgttctatcgggagcgtcaatggatttgaaattgagtcccacaagtgctattgttctctgttctgctgtccttactgcagacattgcagcgccgatcgggagatccaccgccttcatctgtccatttgtaaaaagagaaaaacaggcagcaacgttatgctcgcggtgtgcaagcggatgtgttttagagctaccgtggaagtctctaataaagccctgctgatccgcaacatcattaatacgaccttcgtgctttgcatcctgattctcgccgtttgtgtggtctccacaagcgctgtggagatggaatctctgcccgccgggacctgggagcgggaagaggacctcacaaacttctgccaccaggagtgtcaagttaccgaaacggagtgcctgtgtccctatgaagctcttgtgctgagaaagcctctcttttccgatagcatcgtcaagggaatgaaaaatctgctgaactccacatctcttgagaccagcctgtccattgaggccccgtggggcgcgatcaatgtgcagagcacattcaagcccaccgtttctgccgctaacattgccctctcctggagctctgtggaacaccgcgggaataaaatcctggtcagcggcagatccgagtctatcatgaagctcgaggaacggaccggaattagctgggacctgggcgtggaagatgcttccgagtctaaacttctgacagtgagcgtcatggacctctcccagatgtacagccctgtttttgagtatctgtctggggatcgccaggtggaagagtggcccaaggccacgtgcaccggagactgtcctgaaagatgcggctgcacatccagcacctgtctgcataaggagtggccccactcccggaactggcgctgcaatcctacatggtgttggggagtggggaccggctgcacgtgttgcggccttgatgtcaaagacctgttcacagactacatgtttatcaagtggaaagtggaatacattaagaccgaggcgatcgtttgtgtggagctcacctctcaagaaagacagtgcacactgattgaggccgggacccggttcaacctcggaccggtcacaatcacgctgagcgaaccccgcaacatccagcagaaacttcctcccgagattgtgaccctgcatcctagaatcgaagagggctttttcgatctgatgcacgttcaaaaggtgctctccgcttctacagtctgtaagctgcagagctgcacccatggggtgcccggagaccttcaggtctatcacattggcaatctgctcaaaggggataaggtgaacggacacctgatccataaaattgagccgcactttaatacatcctggatgagctgggacggctgtgatctccattactattgcaacatgggcgactggccttcttgcacctacacgggggttacccagcacaatcatgccgctttcgtgaacatgctgaatatcgaaacagattataccaagaactttcacttccactccaaacgggtcacagcccatggagacacaccccaacttgatctgaaggcccgccccacctacggcgctggggagatcacggtgctggttgaagtggcggacatggagctccacaccaaaaagattgagatcagcggactgaagtttgcctctcttacatgtaccggctgctatgcttgttccagcgggatttcttgcaaagtcagaatccatgtggatgaacctgacgagctgaccgtgcacgttaagagcgaagatcccgacattgtcgccgcctcctctagcctcatggctcggaaactggagttcggaacagactccacgttcaaggcctttagcgcgatgcctaaaacctccctctgtttctacatcgtggaaagagagtactgcgagtcttgtagcaaggaagatacacagaagtgcgtgaataccaaactggagcagccgcaatccattcttatcgaacacaagggcacaatcattggcaaacagtctaacacctgtacggctaaggccagctgctggctggagtccgtcaaatctttcttttatgggctgaagaatatgctcagcggaatctttggcaacgtgttcattggggtttttctgttctttgcccccttcatccttctgattctctttttcatgttcggatggcgcatcctgttttgtttcaagtgctgccggagaacacgcggcctctttaaataccggcatctgaaggacgatgaagagaccgggtatagaaaaatcattgagcgccttaataacaagaaaggaaagaataagctgctggacggcgaacggctcgctgatagaaaaatcgccgagctgttctccaccaagacacacattggctga

SEQ ID NO: 13694 - RNA, 5055 nt, synthetic construct
  misc_feature 1..5055: note = derived and/or modified CDS sequence (opt5) from CCHFV(UCCR4459)__KY484032.1__GP
  source 1..5055: mol_type = other RNA
atgtacacacccctgctctgcgccgtgctgtgtcttcagctgtggagcctcgagggctcccacgggctgtctaacaagacccaacatagcaatacgtccaccacaaaagctcctgaagtctctcaggagttcggacttccggttagcaccgtgtccacaatcacctctgatccccctagcattacatccgccgtgagcgtctctggctccgaagggagcggagacaccaacacgtctccctccgtgaccacacagggcctgaccctccctgagacaaccctggaactgctcacgacaaccgacacagatgcgagctctaccgttgtggtcgacgtgtccacccagacagttaaggatacgcccatcagcaccacacacacctccctgccttctacaccgagcgctaccacgacaccccaagggacccatcacaccgccagaggacttctgtccgtgacaagcaccaaacctgagggcgcctctacacaggctaatcccgagaagatttccatggaaacgaacagccctcggctcgccatctctgagacccccagcttttccccgacaacccaggctcctacagaaaattctaaccccattaccagcaaacagctgatcttctccgcccaacctgtcacgcccaatcccgtgacccctccggtgcagcccgcgcttagccagtctgacacatccaccgccatccaggatattcatcctagccccacatctcgctccaagagaaacctggagatggagatcattctcaccctgagccaaggcctgaagaaatattacgggaagatcctcaaactgcttgacctgacgctcgaagaggatacagaaggactgcttgagtggtgcaagcggaatctgggcctcgtctgtgacgatgactttttccagaaacgcattgaagagtttttcctgaccggggagggacactttaacgaagttctgcagttcaagacaccttccaccctctctcccaccggcccggctagaacagggagccctacggtggagccctttaagtcctatttcgccaaaggatttctgtctatggatagcggctacttctccgctaagtgctatcctcgggccagcaattctggccttcaactgatcaacgtgacccagcactccacacgcattaccgacacacccgggcctaaagtcaccaatctcaagacgatcaactgtatcaatctgaaagcgagcgtgtttaaggaacatagagagattgaaatcaacgttcttctgccccaggtggccgtcaacctctcttcctgccacgtgctgattaaaagccatgtttgtgactactctctggatatcgacggaccggtgcggctccctcgcattcaccacgagggcacattcatccccgggacctataagctggtcatcgataagaaaaataagcagaacgacagatgcacccttattacaaattgtgtgatcaaaggacgggagattcgcaagggccaaagcgtcctgagacagtaccggaccgaaatcaaaattgggaaggcttccagcggatctcgcagactcctgtccgaggaaagcggcgatgactgcatctcccggacacagctgtctagaacggagaccgccgaaatccatagcgataactacggcgggcccggagacaagattacaatctgtaatggctccaccattgtggatcagcgccttgggtctgagctcggatgctatacaatcaaccgggttaagagcttcaagctgtgcgaaaattccgctaccggcaaatcttgtgagattgacagcacgcctatcaagtgcagacaagggttttgtctgaaaattacccaggagggccgcggacacgtgaagctctcccggggcagcgaagtcgtgctggatgcctgcgactcttcctgtgagatcatgatcccgaaggggacaggagacattcttgttgattgcagcggcgggcagcagcatttcctgaaagacaacctcatcgatctgggatgtcccaatattcctctgcttggcaagatggccatctacatttgcagaatgtctaaccaccccaaaaccacaatggcttttctcttctggttttccttcgggtatgtgatcacctgtatcctgtgcaaggtcatcttttacctgctcattgtggtgggcacactggggaaaaagttcaagcaatatcgcgagcttaaacctcagacctgtacgatttgcgaaacaacccccgttaatgcgatcgacgccgagatgcatgatctgaactgcagctacaatatttgtccttattgcgcttctcggctcacctccgacggcctggccagacacgtcatgcagtgtcccaagcgcaaagaaaaggtggaggaaacagagctgtaccttaacctcgagcggatcccgtgggtggtcagaaaactgcttcaggtgagcgaatccaccggggttgccctcaagcgcagctcttggctggtggtccttctggtgctcctgacggttagcctgtcccctgtgcaatctgctcccatcggacacggcaaaacagtcgagacctaccagacacgggaagggtataccagcatttgcctttttgtgctcggatccatcctgttcattgtttcttgtctgatgaagggcctcgtggatagcgtcggaaattcctttttccctggcctgtctatctgcaagacatgtagcattggatccatcaacggctttgagatcgaaagccataaatgctactgttctcttttctgctgtccctattgcagacactgctccgccgaccgggagattcataagctgcacctcagcatctgtaaaaagcgcaaaaccgggtctaacgtgatgctggcggtgtgcaagagaatgtgtttccgggctacggtcgaggtttccaataaggccctgcttattagaaacatcattaataccacatttgtggtgtgcatcctgattctcgccgtctgtgtggttagcacctccgctgtggaaatggagtctctgccggccggaacatgggaacgcgaggaagatctcaccaacttctgccaccaggagtgtcaagtcacggagacagaatgcctgtgtccttacgaggctcttgtgctgcggaaacccctctttagcgactccatcgttaagggcatgaaaaatctgctgaacagcacctctcttgaaacatccctgagcatcgaggccccttggggagcgattaatgtgcagtctaccttcaagcccaccgtcagcgccgctaacatcgccctctcctggtctagcgtggagcatagagggaataaaattctggtttccggccgctctgaaagcatcatgaagctcgaggaaagaacagggatttcctgggatctgggcgtggaggacgctagcgaatctaaacttctgacggtctccatcatggatctcagccagatgtattcccccgtgtttgagtacctgtctggagacagacaggtggaggaatggcctaaagcgacctgcacaggcgactgtccggagcgctgcgggtgcaccagctccacatgtctgcacaaggaatggccccattctagaaactggcggtgcaatcctacctggtgttggggagtcggcacggggtgcacatgttgcggacttgatgttaaagacctgttcaccgattatatgtttgtgaagtggaaagtggagtacatcaagaccgaagccattgtctgtgtggagctcacaagccaagagcgccagtgctccctgatcgaagccggcaccagattcaacctcggccccgttacaattacgctgagcgagcctcggaatatccagcagaaacttccccctgaaattgtgaccctgcacccgcgcatcgaggaagggtttttcgacctgatgcatgtcaagaaggtgctctctgcttccacagtttgtaaactgcaaagctgcacccacggagtgcccggcgatcttcaggtctaccacatcgggaacctgctcaagggagacaaagtgaatggccatctgattcacaagatcgagcctcattttaacacatcttggatgtcctgggatgggtgtgacctcgattattactgcaacatgggagactggcccagctgctcttataccggcgtcacgcagcacaatcatgccgctttcgtgaacatgctgaatattgagaccgattacacaaaaatctttcacttccacagcaagagagttaccgcccatggcgacacacctcagcttgatctgaaggcccggcccacctatggggctggagaaattacagtgctggtcgaggtggcggacatggaactccacacgaaaaagatcgagatttccggcctgaaattcgcctctcttacctgtacagggtgctacgcttgtagctccggaatcagctgcaaggttcgcatccatgtggacgagccggatgaactgaccgtccacgtgaaatccgaggaccctgatattgtggccgcctctagctccctcatggctagaaagctggaatttggcaccgactctacattcaaggcctttagcgcgatgcccaaaacgtccctctgtttctatatcgttgagcgggaatactgcaagtcttgtagcaaagaggatacccaaaagtgcgtcaacacaaaactggagcagccccagtccattcttatcgaacacaaggggaccattatcggaaagcaaaatgacacatgtaccagcaaagctggctgctggctggagtctgtgaagtcctttttctacggcctgaaaaacatgctcagcgggatctttggaaatgtgttcattggcatctttctgttccttgccccttttattctgctcatcctgttcttcatgtttgggtggcggattctcttctgttttaagtgctgccgccggacgagaggactgttcaaatatcgccatcttaaggatgacgaagagacaggctaccggaagatcatcgaaagactgaacaataaaaaggggaaaaacaagctgctcgatggagagcgcctggccgaccggaaaattgctgagctgttttctaccaagacccacatcggctga

SEQ ID NO: 13695 - RNA, 5052 nt, synthetic construct
  misc_feature 1..5052: note = derived and/or modified CDS sequence (opt5) from CCHFV(Ast149)__KX056054.1__GP
  source 1..5052: mol_type = other RNA
atgcacacccttctcgtgtgcttcatcctgtaccttcagctgagcggcctcgggggagcccatggccaatccaacgctacagagcacaatgggacgaacaccacaaccgcccccggaacatctcagagccctaagccgcccgcgtccaccacacctccccatacccctgaatctagcacggtcaaactgaccacacccacctccgagacagaaggctctggggagaccacgcctccgcccaatacaacccagggacttcctccccctggcacaacccccgaaagaccggctaccacagccacgagcacctccagcacagacaacatgaactctaccacacaggttaccgataatacgcctacatccaccgtgagcacctctccctccagctctccttccatgcccagcacatcccaaggcattcactatcccgtgcggtctctgctcagcgtctccagccctaagaccgtgacaacgccgacccccatgtctcctggggagatgtcccccgagacaagctctcagcatagcgccatgtcccgcatccctaccctgtacacagctgcccaggtttctaccgaaaatgctaacagaagcacgccccggcagtccgagagctctgcccaaccggcgacccagtcccctacaacctttcccgcccagacaattctgctcatgagcgctgcccctaaagctatccaggacatgcacccctctcctaccaatcgctccaagagaaacctggaagtggagattatccttacgctgagccaaggactcaaaaagtattacggcaagatcctgaaacttctgcacctcacactggaggaagataccgaggggctgctcgaatggtgtaagcggaatctgggatccaactgcgacgatgacttctttcagaaacgcattgaggagttctttatcacaggcgaggggtatttcaatgaggtccttcagtttaagaccctgtctaccctcagccccacagaaccgtcccatgtgagactgcctacggccgagcccttcaaatcttactttgcgaagggattccttagcattgattccggctattttagcgccaagtgttacccccggtcttccaccagcggcctgcaactcatcaacgttacacagcaccctgctcgcattgccgaaaccccggggcccaaaacaacctctctgaagacgatcaattgcattaacctgagagcttccgtgttcaaagagcatcgggaagtcgagatcaacgtgctcctgcctcagatcgccgtgaatcttagcaactgtcacgtcgttatttactctcacgtgtgcgactatagcctggatacagacggacccgtgcgcctccctagaatccatcacgagggcacctttattcccgggacctacaagatcgtcattgataaaaagaataaactgaacgaccggtgttcccttgtgacaaattgcgttatcaagggacgcgaagtgagaaagggccagagcgtcctgcggcaatataaaaccgagatcaagattgggaaagcctctacaggatccagaaagctcctgagcgaagaacctggcgatgactgtatctcccgcacgcagctgctcaaaaccgaaacagctgagattcatgacgataactacggcgggcccggagacaagatcaccatttgcaatggctctacaatcgtggatcagcggctggggagcgagcttggatgttataccatcaacagagttaagtccttcaaactgtgcgaaaattctgcgacgggcaagacctgcgagattgacagcacaccggtgaaatgtcgccaggggttctgcctcaagatcacccaagaaggccggggacacgtcaaactgtccagaggctctgaggtggtcctggatgcctgtgacagctcctgcgagattatgatccctaaggggacaggagatattcttgtggactgtagcggcgggcagcagcattttctcaaggataacctgatcgacctgggatgcccccacattcctctcctgggcaaaatggctatctacatctgtcgcatgtctaatcacccccggaccacaatggccttcctgttttggttctcctttgggtatgttattacctgcatcttctgtaaggccctgttttacagcctcattatcattggcacgctggggaaaaagatcaaacagtacagagaactgaagccgcaaacatgcaccatctgtgagaccgctcctgtgaacgccattgatgcggaaatgcatgaccttaattgctcttataacatctgcccctactgtgcttcccgcctcacaagcgacggcctggcccggcacgtcacccagtgccctaagagaaaagagaaggtggaagagacggagctgtatctcaatctggaacgcattccctggatcgttcggaaacttcttcaggtgtctgagtccacaggggtcgccctcaagagaagctcctggctgattgtgctgcttgtgctcctgaccgttagcctgtctcccgtccagagcgctcctgtgggacatggcaaaacaatcgaaacctaccaaacacgggaggggttcaccaacatctgtctctttatgctgggatccattcttttcatcgtgtcttgcctggtcaagggcctcgtggatagcgtttccgactcctttttcccggggctgagcgtgtgtaaaacgtgctccattggctctatcaacggatttgaaattgagagccacaagtgttattgctccctgttctgttgcccctactgtcgccactgcagcgccgatagagagatccatcagcttcacctcggcatctgcaagaaacggaagaccgggtctaatgtcatgctggctgtgtgtaaaagaatgtgcttcaaggccacaattgaagcgtcccgccgggccctgcctatcagaagcattatcaacaccacatttgttatttgtatcctcaccctggctatttgcgtggtctctacgtccgccgtggagatggaaaatcttcccgctggaacatgggagcgcgaagaggacctgaccaacttctgtcatcaggagtgccaagttacagaaaccgagtgtctctgcccttatgaagccctggtgctgagaaaacccctttttctggatagcatcgtcaagggcatgaagaatctcctgaactccacctctctcgagacaagcctgtccatcgaggcgccttggggagccattaatgtgcagagcacgttcaaaccgaccgtgtctacagctaacatcgccctttcctggagctctgtcgaacaccggggaaataagattctggttaccggccgcagcgagtccatcatgaaactcgaagagagaacaggggtgtcttgggacctgggcgtggaagatgctagcgagtccaagctgcttaccgtctctattatggacctgagccagatgtactcccccgtgtttgagtacctcagcggagatcggcaggttgaagagtggcctaaagccacgtgtacaggcgactgccccgaacgctgtgggtgcacctcttctacctgcctgcataaggagtggcctcacagcagaaactggcggtgtaatcccacatggtgctggggagtgggcaccgggtgtacatgctgtggagtcgatgtgaaggacctcttcacggatcacatgtttatcaaatggaaggttgaatatatcaaaaccgaggccattgtgtgcgtcgagctgacatcccaagaacgccagtgttctcttatcgaggctggcaccagattcaacctgggcccggtgacaattaccctcagcgaacctcggaatatccagcagaagctgcctcccgagattatcacgctgcatcccaaaatcgaagaggggtttttcgaccttatgcacgttcaaaaggtgctgtccgcgtctaccgtctgcaagctccagagctgtacacatggcattcccggagacctgcagatctaccacattgggaacctcctgaaaggagatcgccttaatggccatctgatccacaagattgagcctcactttaacacctcctggatgagctgggacgggtgcgatctggactattactgtaacatgggagattggccgtcttgcacatataccggcgtgacacagcataatcacgccgctttcgtgaacctcctgaatatcgaaacggactacaccaaaacatttcatttccactccaagagagtcaccgcccacggcgatacaccccaacttgacctgaaagcccggcctacctatggggctggagagattacggttctcgtggaagtggccgatatggagctgcataccaagaaagtcgaggtgagcggcctcaagttcgcgtctctggcttgcacagggtgttacgcctgctccagcggaatctcttgtaaggttagaatccacgtggacgaacccgatgagcttaccgtccatgtgaaaagctccgaccctgatgttgtggccgcttctacaagcctgatggcccgcaagctggaatttggcaccgactccacgttcaaagcgtttagcgctatgcccaagacatccctctgcttctacattgtcgagcgggaatattgtaaatcttgcagcgaggacgataccaagaagtgtgtggacaccaaactggagcagccgcagtccatccttattgaacacaaggggacaatcattggaaaacaaaacgatacctgcacagccaaggcctcttgttggctggagagcgtcaaatcctttttctacggcctcaagaatatgctgggctctgtgtttgggaacttctttgttggaatcctcctgttccttgctccttttgtgctgctggccctcttcttcatctttggctggaagattctgttctgctttaaatgttgcagacgcacccgggggcttttcaagtatagacatctgaaagacgatgaagagacgggataccgcaagatcattgaacggctcaatagcaaaaagggcaagaacagactgctcgacggggagcgcctggctgatcggaaaatcgccgagctgttttccacaaagacccacattggatga

SEQ ID NO: 13696 - RNA, 5052 nt, synthetic construct
  misc_feature 1..5052: note = derived and/or modified CDS sequence (opt5) from CCHFV(Ast137)__KX056057.1__GP
  source 1..5052: mol_type = other RNA
atgcacaccctgctcgtgtgcttcatcctgtaccttcagctgagcggcctcgggggagcccatggccaatccaacgctacagagcacaatgggacgaacaccacaaccgtccccggaacatctcagagccctaagccgcccgcctccaccacactgcctcatacccccgaatctagcacggttaaacttaccacacctacctccgagacagaaggctctggggagaccacgccccctccgaatacaacccagggactgccccctcccggcacaacccctgaaagacccgcgaccacagctacgagcacctccagcacagacaacatgaactctaccacacaggtgaccgataatacgccgacatccaccgtgagcatttctccttccagctctccctccatgcctagcacctcccaaggcatccactatcccgtccggtctctcctgagcgtgtccagccccaagacagttaccacacctacgccgatgtctcccggggagatgtcccctgagaccagctctcagcatagcgccatgtcccgcattcccacactgtacaccgccgctcaggtgtctacagaaaataccaacagaagcacgcctcggcagtccgagagctctgcccaacccgctacccagtccccgacaacctttcctgcccagacaatcctcctgatgagcgcggcccccaaagctattcaggacatgcacccttctcccaccaatcgctccaagagaaaccttgaagtcgagatcatcctgacgctcagccaaggactgaaaaagtattacggcaagattcttaaactgctccacctgacactggaggaagataccgaggggctcctggaatggtgtaagcggaatcttggatccaactgcgacgatgacttctttcagaaacgcatcgaggagttctttattacaggcgaagggtatttcaatgaggtgctgcagtttaagaccctctctaccctgagccctacagaaccctcccatgttagacttccgacggccgagcctttcaaatcttactttgctaagggattcctgagcatcgattccggctattttagcgccaagtgttacccccggtcttccaccagcggcctccaactgattaacgtgacacagcaccccgcgcgcatcgccgaaacccctgggccgaaaacaacctctctgaagacgattaattgcatcaacctcagagcttccgtcttcaaagagcatcgggaagtggagatcaacgtgctgcttccccagattgccgtcaatctgagcaactgtcacgttgtgatcaattctcacgtgtgcgactacagcctcgatacagacggacctgtccgcctgcccagaatccatcacgagggcacctttatccctgggacctataagattgtgatcgataaaaagaacaaacttaatgaccggtgttccctggttacaaactgcgtgatcaagggacgcgaagtcagaaagggccagagcgtgctccggcaatacaaaaccgagattaagatcgggaaggcttctacaggatccagaaagctgctgagcgaggaacccggcgatgactgtatttcccgcacgcagctcctgaaaaccgaaacagccgagatccatgacgataattatggcgggcctggagacaagattaccatctgcaacggctctacaatcgttgatcagcggcttgggagcgagctgggatgttacaccattaatagagtgaagtccttcaaactctgcgaaaactctgccacgggcaagacctgcgagatcgacagcacacccgtcaaatgtcgccaggggttctgcctgaagattacccaagaaggccggggacacgtgaaactgtccagaggctctgaggtcgtgcttgatgcttgtgacagctcctgcgagatcatgattccgaaggggacaggagatatcctcgttgactgtagcggcgggcagcagcattttctgaaggataatctgattgacctcggatgccctcacatccccctgcttggcaaaatggcgatccacatttgtcgcatgtctaaccatcctcggaccacaatggccttcctgttttggttctcctttgggtatgtgattacctgcattttctgtaaggctctcttttacagcctgatcattatcggcacgctggggaaaaagatcaaacagtatagagaacttaagccccaaacatgcaccatttgtgagaccgccccggtcaatgccatcgatgctgaaatgcacgacctcaactgctcttacaatatttgcccttactgtgcctcccgcctgacaagcgacggcctggcgcggcatgtgacccagtgccccaagagaaaagagaaggttgaagagacggagctctatctgaaccttgaacgcatcccttggattgtgcggaaactgctccaggtctctgagtccacaggggtggctctgaagagaagctcctggctgatcgtgcttctcgttctgctgaccgtcagcctctctcccgtgcagagcgcccccgtgggacacggcaaaacaatcgaaacctaccaaacacgggaggggttcaccaacatttgtctgtttatgcttggatccatcctgttcattgtctcttatctcgtgaagggcctggttgatagcgtgtccgacagctttttccctgggctgtctgtctgcaaaacgtgttccatcggctctattaatggatttgaaatcgagagccacaagtgctactgttcccttttctgctgtccgtattgccgccattgtagcgccgatagagagatccaccagctccatctgggcatttgcaagaaacggaagaccgggtctaacgtgatgctggctgtttgcaaaagaatgtgtttcaaggccacaatcgaggcttcccgccgggccctcctgattagaagcatcattaataccacatttgtgatctgcattcttaccctggcgatctgtgtcgtgtctacgtccgccgttgaaatggaaaacctccccgctggaacatgggagcgcgaagaggacctgaccaatttctgccaccaggagtgtcaagtgacagaaaccgagtgcctgtgtccttacgaagcccttgtcctgagaaaacccctctttctggatagcatcgtgaagggcaccaagaacctccttaattccacatctctggagacgagcctgtccattgaggctccttggggagccatcaacgtgcagagcaccttcaaacccacagtctctaccgcgaatattgccctctcctggagctctgttgaacatcggggaaacaagatcctggtgacaggccgcagcgagtccattatgaaactggaagagagaaccggggtgtcttgggaccttggcgtcgaagatgctagcgagtccaagctgctcacggtgtctatcatggacctgagccagatgtattcccctgtttttgagtacctcagcggagatagacaggtggaagagtggccgaaagccacatgcaccggcgactgtcccgaacgctgcgggtgtacctcttccacatgcctgcacaaggagtggcctcacagcagaaattggcggtgcaaccccacctggtgttggggagtcggcacagggtgcacgtgttgcggagtggatgttaaggaccttttcaccgatcatatgtttatcaaatggaaggtggaatacattaaaacagaggctatcgtctgtgtggagctgacctcccaagaacgccagtgctctctcattgaggccggcacaagattcaatctgggccctgttaccatcacgctgagcgaaccccggaacattcagcagaaacttccgcctgagatcatcaccctgcaccccaaaattgaagaggggtttttcgacctcatgcatgtgcaaaaggtcctgtccgcctctacagtgtgtaagctccagagctgcacccacggaatccccggcgacctgcagatttatcatatcgggaatcttctgaaaggagatcgcctgaacggccacctcattcacaagatcgagcctcattttaacacatcctggatgagctgggacgggtgtgatctggactactattgcaatatgggagattggccctcttgtacctacacaggcgtgacgcagcacaaccatgctgcgttcgtcaatcttctgaacattgaaaccgactatacaaaaacctttcacttccactccaagagagttaccgcccatggcgatacacctcaactcgacctgaaagctcggccgacgtacggggccggagagatcaccgtgctcgtggaagtcgccgatatggagctgcacacaaagaaagtggaggttagcggccttaagttcgcttctctggcctgcaccgggtgctatgcgtgttccagcggaatctcttgcaaggtgcggattcatgtcgacgaacccgatgagctgacagtgcacgttaaaagctccgaccctgatgtggtcgctgcctctaccagcctcatggcccgcaagctggaatttggcacggactccacattcaaggcttttagcgccatgcccaaaacctccctttgtttctacatcgtggagcgggaatactgcaaatcttgtagcgaggacgataccaagaagtgcgtcgacacaaaactggagcagcctcagtccattctcatcgaacataaggggaccattatcggaaaacaaaatgatacatgtaccgcgaaggcttcttgctggctggagagcgtgaaatcctttttctatggcctcaagaacatgctgggctctgtttttgggaatttctttgtgggaatccttctgttcctggccccctttgtcctcctggtgcttttcttcatttttggctggaagatcctgttctgttttaaatgctgtagacgcacgcggggactcttcaagtacagacacctgaaagacgatgaagagacagggtatcgcaagattatcgaacggctcaacagcaaaaagggcaagaatagactgcttgacggggagcgcctggccgatcggaaaattgctgagctgttttccaccaagacacacatcggatga

SEQ ID NO: 13697 - RNA, 5055 nt, synthetic construct
  misc_feature 1..5055: note = derived and/or modified CDS sequence (opt5) from CCHFV(C-68031)__DQ211629.1__GP
  source 1..5055: mol_type = other RNA
atgtacaccccgctgctctgcgccgtgctgtgtcttcagctgtggagcctcgagggctcccacgggctgtctaacaagacacaacatagcaatacgtccaccacaaaagctcctgaagtctctcaggagttcggacttccggttagcaccgtgtccacaatcacctctgatccccctagcattacatccgccgtgagcgtctctggctccgaagggagcggagacaccaacacgtctccctccgtgaccacacagggcctgaccctccctgagacaaccctggaactgctcacgacaaccgacacagatgcgagctctaccgttgtggtcgacgtgtccacccagacagttaaggatacgcccatcagcaccacacacacctccctgccttctacaccgagcgctcccaccacgcctcaagggacacatcacaccgccagaggacttctgtccgtgaccagcacaaaacccgagggcgcctctacccaggctaatcctgagaagatttccatggaaacaaacagcccccggctcgccatctctgagacgccgagcttttcccctaccacacaggctcccaccgaaaattctaaccctattacaagcaaacagctgatcctttccgcccaacccgtcacccccaatcctgtgacgccgcccgtgcagcctgcgctgagccagtctgacacctccacagccatccaggatattcatcccagccctacctctcgctccaagagaaacctcgagatggagatcattctgacactgagccaaggcctcaagaaatattacgggaagatcctgaaacttctggacctcaccctggaagaggatacggaaggacttctggagtggtgcaagcggaatctcggcctggtctgtgacgatgacttctttcagaaacgcattgaagagttctttctgacaggggagggacacttcaacgaagttctccagtttaagaccccctccacactgtctccgaccggccctgctagaaccgggagccccacagtggagcctttcaagtcctattttgccaaaggattcctttctatggatagcggctacttttccgctaagtgctatccccgggccagcaattctggcctgcaactcatcaacgtgacgcagcactccacccgcattacagacacccctgggcccaaagtcacaaatctgaagaccatcaactgtatcaatcttaaagcgagcgtgttcaaggaacatagagagattgaaatcaacgttctgctcccccaggtggccgtcaacctgtcttcctgccacgtgctgattaaaagccatgtttgtgactactctctcgatatcgacggacctgtgcggctgccccgcattcaccacgagggcacgtttatccccgggacatataaacttgtcatcgataagaaaaataagcagaacgacagatgcaccctgattaccaattgtgtgatcaaaggacgggagattcgcaagggccaaagcgtcctcagacagtaccggacagaaatcaaaattgggaaggcttccagcggatctcgcagactgctgtccgaggaaagcggcgatgactgcatctcccggacccagctttctagaacagagacggccgaaatccatagcgataactacggcgggcctggagacaagattaccatctgtaatggctccacaattgtggatcagcgcctcgggtctgagctgggatgctataccatcaaccgggttaagagcttcaagctgtgcgaaaattccgctacaggcaaatcttgtgaaattgacagcaccccgatcaagtgcagacaagggttctgtctcaaaattacgcaggagggccgcggacacgtgaagctgtcccggggcagcgaagtcgtgcttgatgcctgcgactcttcctgtgagatcatgatccccaaggggaccggagacattctggttgattgcagcggcgggcagcagcattttctcaaagacaacctgatcgatctgggatgtcctaatattccccttctcggcaagatggccatctacatttgcagaatgtctaaccaccctaaaacaaccatggctttcctgttttggttctcctttgggtatgtgatcacatgtatcctgtgcaaggtcattttctacctcctgatcgtggtgggcacccttgggaaaaagtttaagcaatatcgcgagctgaaaccccagacatgtaccatttgcgaaacgacacctgttaatgcgatcgacgccgagatgcatgatctcaactgcagctacaatatttgtccctattgcgcttctcggctgacctccgacggcctggccagacacgtcatgcagtgtccgaagcgcaaagaaaaggtggaggaaaccgagctttacctcaacctggagcggatcccttgggtggtcagaaaactgctccaggtgagcgaatccacaggggttgccctgaagcgcagctcttggcttgtggtcctgctcgtgctgctgaccgttagcctttcccccgtgcaatctgctcctatcggacacggcaaaacggtcgagacataccagacccgggaagggtatacaagcatttgcctcttcgtgctgggatccatcctgtttattgtttcttgtctcatgaagggcctggtggatagcgtcggaaattccttctttcccggcctttctatctgcaagacctgtagcattggatccatcaacggcttcgagacagaaagccataaatgctactgttctctgttttgctgtccgtattgcagacactgctccgccgaccgggagatccataagctccacctgagcatttgtaaaaagcgcaaaaccgggtctaacgtgatgctggcggtgtgcaagagaatgtgtttccgggctacggtcgaggtttccaataaggcccttctgatcagaaacattatcaataccacattcgtggtgtgcattctcatcctggccgtctgtgtggttagcacctccgctgtggaaatggagtctctccctgccggaacatgggaacgcgaggaagatctgaccaacttttgccaccaggagtgtcaagtcacggagacagaatgcctttgtccctacgaggctctggtgctccggaaacctctgttcagcgactccattgttaagggcatgaaaaatctgcttaacagcacctctctggaaacatccctcagcatcgaggccccctggggagcgatcaatgtgcagtctacctttaagcccaccgtcagcgccgctaacattgccctgtcctggtctagcgtggagcatagagggaataaaatcctcgtttccggccgctctgaaagcattatgaagctggaggaaagaacagggatctcctgggatcttggcgtggaggacgctagcgaatctaagctgctcacggtctccattatggatctgagccagatgtattcccctgtgttcgagtacctgtctggagaccgccaggtggaggaatggccgaaagcgacctgcacaggcgactgtcccgagcggtgcgggtgcaccagctccacatgtcttcacaaggaatggcctcattctagaaactggcggtgcaatcccacctggtgttggggagtcggcacggggtgcacatgttgcggactggatgttaaagacctctttaccgattatatgttcgtgaagtggaaagtggagtacatcaagaccgaagccatcgtctgtgtggagctgacaagccaagagcgccagtgctccctcattgaagccggcaccagatttaacctgggccctgttacaatcacgcttagcgagccccggaatattcagcagaagctgcctccggaaatcgtgaccctgcacccccgcattgaggaagggttctttgacctcatgcatgtcaaaaaggtgctgtctgcttccacagtttgtaaacttcaaagctgcacccacggagtgcctggcgatctgcaggtctaccacatcgggaacctcctgaagggagacaaagtgaatggccatctcatccacaagattgagccccatttcaacacatcttggatgtcctgggatgggtgtgacctggattattactgcaacatgggagactggcctagctgctcttataccggcgtcacgcagcacaatcatgccgcttttgtgaacatgcttaatatcgagaccgattacacaaaaattttccactttcacagcaagagagttaccgcccatggcgacacaccccagctggatctgaaggcccggccgacctatggggctggagaaatcacagtgctcgtcgaggtggcggacatggaactgcacacgaaaaagattgagatctccggccttaaattcgcctctctgacctgtacagggtgctacgcttgtagctccggaattagctgcaaggttcgcatccatgtggacgagcctgatgaactcaccgtccacgtgaaatccgaggaccccgatatcgtggccgcctctagctccctgatggctagaaagctcgagttcggcaccgactctacatttaaggccttcagcgcgatgcccaaaacgtccctgtgtttttatattgttgagcgggaatactgcaagtcttgtagcaaagaggatacccaaaagtgcgtcaacacaaaacttgagcagcctcagtccatcctgattgaacacaaggggaccatcattggaaagcaaaatgacacatgtaccagcaaagctggctgctggctggagtctgtgaagtccttcttttacggcctcaaaaacatgctgagcgggatcttcggaaatgtgtttatcggcattttcctttttctggcccccttcatcctcctgattctctttttcatgttcgggtggagaatcctgttttgtttcaagtgctgccgccggacgagaggactttttaaatatcgccatctgaaggatgacgaagagacaggctaccggaagattatcgaaagactgaacaataaaaaggggaaaaacaagctcctggatggagagcgccttgccgaccggaaaatcgctgagctgttctctaccaagacccacattggctga

SEQ ID NO: 13698 - RNA, 5052 nt, synthetic construct
  misc_feature 1..5052: note = derived and/or modified CDS sequence (opt5) from CCHFV(K340_6)__KX013475.1__GP
  source 1..5052: mol_type = other RNA
atgcacaccctgctcgtgtgcttcatcctgtaccttcagctgagcggcctcgggggagcccatgtccaatccaacgctacagagcacaatggcacgaacaccacaaccgcccccgggacatctcagagccctaagccgcccgcgtccaccacactgcctcatacccccgaatctagcacggttaaacctaccacacccacctccgagacagaaggatctggcgagaccacgcctccgcccaatacaacccaggggcttcctcccacaggaaccacccctgaaagaagcgctacaacggccacctccacaagctctaccgacaacatgaactccacaacccaggtgacggatagcacacccacctctaccgtgtccacaagcccgtcttccagctcctctatgcctagcacctcccaaggcattcaccatcccgtccggagcctgctctctgtgtccagccctaagacagttacgacccccacacccatgtctcctggcgagatgagcccggagacctcctctcagcacagcgccatgtcccgcgtgcccacactgtataccgctacgcaggtcagcaccgaaaatacagacagatctacccctcggcagtccgagagctctgtgcaacccgccacacagtcccctatcaccagccccgctcagacgattctgctcatgtccgccgcgccgaaagccatccaggatatgcacccttctcccacaaatcgcagcaagagaaacctggaagttgagattatccttaccctgtcccaagggctcaaaaagtactatggaaagatcctgaaacttctgcatctcacactggaggaagacaccgagggcctgctcgaatggtgtaagcggaatctggggtctaactgcgatgacgatttcttccagaaacgcattgaggaatttttcatcaccggagagggctactttaatgaggtgcttcagttcaagacactgagcacgctctcccctaccgaacccagccacgtcagactgcctacagctgagccctttaaatcttatttcgccaaggggtttctttccattgacagcggatacttctctgctaagtgttatccgcggtccagcacctctggcctgcaactcatcaacgtgacacagcatcctgcccgcattgcggaaacccccggccccaaaacgacaagcctgaagaccatcaattgcattaacctgagagcctccgtgtttaaagagcaccgggaagtcgagatcaatgttctcctgcctcagatcgctgtgaaccttagcaactgtcacgtggtcattaattctcatgtgtgcgattactccctggacaccgatgggccggttcgcctccccagaatccaccatgagggaacattcattcctggcacctacaagatcgtgattgaccggaaaaacaagctgaatgatcgctgtagccttgtcacaaactgcgtgatcaaagggagagaagttcggaagggacagtccgtgctgagacaatataagacggagatcaaaattggcaaggcctctaccgggagccgcaaactcctgtccgaggagcccggagacgactgtatctctcggacacagctgctcaagaccgaaacagctgagattcacgatgacaattacggcggccctggggataaaatcaccatttgcaacggaagcacgatcgtcgaccagagactgggctccgagcttgggtgttataccatcaatcgcgtgaagtcttttaagctgtgcgaaaacagcacaaccggaaaaacatgcgagattgattccacccccgtcaagtgtcggcagggcttctgcctcaaaatcacacaagaagggagaggccatgtgaagctgagccgcggatctgaggttgtgctggacgcctgtgattccagctgcgagattatgatccctaaaggcaccggggacattcttgtcgattgttctggaggccagcagcacttcctcaaggacaatctgatcgatctggggtgcccccacattccgcctctcggaaagatggccatctacatctgtcggatgtccaaccatcccagaacgacaatggcttttctgttctggtttagcttcggctatgtgattacctgcatcttttgtaaagcgcttttctactctctgattatcattgggaccctcggcaagaaaatcaagcagtatcgcgaactgaaacctcaaacatgcaccatctgtgagacggcccccgttaatgctattgacgccgaaatgcacgacctgaactgctcctacaatatctgcccgtactgtgccagccggcttacatccgatggactcgctagacatgtgacccagtgccctaagcgcaaggagaaagtcgaagagacagagctgtatctgaacctcgaacggattccctggatcgtgagaaagctgcttcaggtgagcgagtctaccggcgttgccctgaaacggagctcctggctcattgtcctgctggtgcttctcacagtgtctctgagccctgtccagtccgcgcccgtggggcacggaaagaccatcgaaacgtaccaaacccgcgagggctttacatctatctgtctgttcatgctcgggagcattctgtttatcgtttcctgccttgtgaaaggactggtcgactctgtgagcgattccttctttcccggcctcagcgtttgtaagacctgctctattgggtccatcaatggcttcgaaattgagagccacaaatgttattgctctctgttttgttgcccttactgtagacattgctccgctgaccgggagatccaccagctgcatcttagcatctgcaagaagagaaaaacaggatccaacgtgatgctcgccgtctgtaagcgcatgtgcttcaaagccaccattgaggcttctcggagagccctgctgatccgcagcattatcaacacgacattcgtgatgtgtattctcaccctggctatctgcgttgtgtccacaagcgccgtcgaaatggaagatcttccggcgggcacctgggagagagaagaggacctgaccaatttttgtcaccaggagtgccaagtgacagaaacggagtgtctctgcccctatgaagccctggtgctgcggaagcctctttctctggattccattgtcaaagggatgaagaacctcctgaatagcacctctctcgagacaagcctgtccatcgaggctccctggggagccatcaacgttcagtctaccttcaagcctacagtgagcaccgctaatattgccctttcctggtctagcgtggaacatcgcggcaacaaaatcctggtcacggggagatccgagagcattatgaagctcgaggaacggacaggagtgtcttgggacctgggcgttgaagatgcgtccgagagcaaactgcttaccgtgtccatcatggacctgtctcagatgtacagccccgtctttgagtatctctccggggatcgccaggtggaagagtggcctaaggccacctgtacaggcgactgcccggaaagatgtggatgcacctctagcacatgcctgcacaaagagtggccccactcccggaattggcgctgtaaccctacgtggtgctggggcgttgggaccggatgtacatgctgtggcgtggatgtcaaggacctcttcaccgaccatatgtttattaagtggaaagtggaatacatcaagacagaggctatcgtttgcgtggagctgaccagccaagaaagacagtgttctcttattgaggccgggacgcggttcaatctgggacccgtcaccatcacactctccgaacctcgcaacattcagcagaaactgcccccggagatcattaccctgcaccctaagatcgaagagggctttttcgatcttatgcatgtgcaaaaagtgctgagcgcttctacagtctgcaagctccagtcctgtacccacggcatccccggggacctgcagatttaccatatcggaaatctcctgaagggcgatagagttaacgggcaccttattcacaaaatcgagccccattttaatacaagctggatgtcttgggacggatgcgatctggactattactgtaacatgggcgattggcctagctgcacgtataccggggtgacacagcacaatcatgccgccttcgtgaacctgctcaacattgaaaccgactacaccaagacatttcacttccactccaaacgggtcacggctcatggagatacaccccaactggaccttaaggcgagacctacctatggcgccggcgagatcaccgtgctggttgaagtgacagatatggagctccacaccaaaaaggtcgagatttctgggctgaaatttgctagcctcacgtgcacaggatgttacgcctgctccagcggcatctcctgtaaggtgcgcatccatgttgacgaaccggatgagctgaccgtgcacgtcaagtctagcgaccccgacgtggtcgccgcttccacctctcttatggcccggaaactggaatttgggacagatagcaccttcaaggcgttttccgctatgcctaaaacatctctgtgcttctatattgtggagagagaatactgtaagagctgctccgaggacgataccaaaaagtgtgttgacacgaagctcgagcagccccagagcatcctgattgaacataaaggaacaatcattggcaagcaaaatgatacctgcacagccaaagcctcttgttggcttgagtccgtcaagagctttttctacgggctgaaaaacatgctcggatctgtgtttggctccttctttgtgggcatcctcctgttcctggctccttttgttcttctggtgctgttctttatgttcgggtggaagatcctcttctgctttaagtgttgccgccggaccagaggactgttcaaatatcgccactttaaggacgatgaagagacgggctaccggagaattatcgaacgccttaatagcaaaaaggggaaaaaccggctgctcgacggagagagactggccgatcggaagattgcggaactcttctctaccaagacacacatcggctga

SEQ ID NO: 13699 - RNA, 5055 nt, synthetic construct
  misc_feature 1..5055: note = derived and/or modified CDS sequence (opt5) from CCHFV(Hy13)__AY900145.1__GP
  source 1..5055: mol_type = other RNA
atgtacacacccctgctctgcgccgtgctgtgtcttcagctgtggagcctcgagggctcccacgggctgtctaacaagacccaacatagcaatacgtccaccacaaaagctcctgaagtctctcaggagttcggacttccggttagcaccgtgtccacaatcacctctgatccccctagcattacatccgccgtgagcgtctctggctccgaagggagcggagataccaacacgtctccctccgtgaccacacagggcctgaccctccctgagacaaccctggaactgctcacgacaaccgacacagatgcgagctctaccgttgtggtcgacgtgtccacccagacagttaaggatacgcccatcagcaccacacacacctccctgccttctacaccgagcgctaccacgacaccccaagggacccatcacaccgccagaggacttctgtccgtgacaagcaccaaacctgagggcgcctctacacaggctaatcccgagaagatttccatggaaacgaacagccctcggctcgccatctctgagacccccagcttttccccgacaacccaggctcctacagaaaattctaaccccattaccagcaaacagctgatcttctccgcccaacctgtcacgcccaatcccgtgacccctccggtgcagcccgcgcttagccagtctgacacatccaccgccatccaggatattcatcctagccccacatctcgctccaagagaaacctggagatggagatcattctcaccctgagccaaggcctgaagaaatattacgggaagatcctcaaactgcttgacctgacgctcgaagaggatacagaaggactgcttgagtggtgcaagcggaatctgggcctcgtctgtgacgctgactttttccagaaacgcattgaagagtttttcctgaccggggagggacactttaacgaagttctgcagttcaagacaccttccaccctctctcccaccggcccggccagaacagggagccctacggtggagccctttaagtcctatttcgctaaaggatttctgtctatggacagcggctacttctccgccaagtgctatcctcgggcgagcaattctggccttcaactgatcaacgtgacccagcactccacacgcattaccgatacacccgggcctaaagtcaccaatctcaagacgatcaactgtatcaatctgaaagccagcgtgtttaaggaacatagagagattgaaatcaacgttcttctgccccaggtggctgtcaacctctcttcctgccacgtgctgattaaaagccatgtttgtgactactctctggacatcgatggaccggtgcggctccctcgcattcaccacgagggcacattcatccccgggacctataagctggtcatcgacaagaaaaataagcagaacgatagatgcacccttattacaaattgtgtgatcaaaggacgggagattcgcaagggccaaagcgtcctgagacagtaccggaccgaaatcaaaattgggaaggcctccagcggatctcgcagactcctgtccgaggaaagcggcgacgattgcatctcccggacacagctgtctagaacggagaccgctgaaatccatagcgacaactacggcgggcccggagataagattacaatctgtaatggctccaccattgtggaccagcgccttgggtctgagctcggatgctatacaatcaaccgggttaagagcttcaagctgtgcgaaaattccgccaccggcaaatcttgtgagattgatagcacgcctatcaagtgcagacaagggttttgtctgaaaattacccaggagggccgcggacacgtgaagctctcccggggcagcgaagtcgtgctggacgcctgcgattcttcctgtgagatcatgatcccgaaggggacaggagacattcttgttgactgcagcggcgggcagcagcatttcctgaaagataacctcatcgacctgggatgtcccaatattcctctgcttggcaagatggctatctacatttgcagaatgtctaaccaccccaaaaccacaatggcgtttctcttctggttttccttcgggtatgtgatcacctgtatcctgtgcaaggtcatcttttacctgctcattgtggtgggcacactggggaaaaagttcaagcaatatcgcgagcttaaacctcagacctgtacgatttgcgaaacaacccccgttaatgccatcgatgctgagatgcatgacctgaactgcagctacaatatttgtccttattgcgcctctcggctcacctccgatggcctggccagacacgtcatgcagtgtcccaagcgcaaagaaaaggtggaggaaacagagctgtaccttaacctcgagcggatcccgtgggtggtcagaaaactgctccaggtgagcgaatccaccggggttgctctgaagcgcagctcttggctggtggtccttctggtgctcctgacggttagcctgtcccctgtgcaatctgcccccatcggacacggcaaaacagtcgagacctaccagacacgggaagggtataccagcatttgcctttttgtgctcggatccatcctgttcattgtttcttgtctgatgaagggcctcgtggacagcgtcggaaattcctttttccctggctctagcatctgcaagacatgttccattggaagcatcaacggctttgagatcgaatctcataaatgctactgttccctgttctgctgtccctattgcagacactgcagcgcggatcgggagattcataaacttcacctgtctatctgtaaaaagcgcaaaaccgggtccaacgtgatgctcgctgtgtgcaagagaatgtgtttccgggccacggtcgaggttagcaataaggccctgctgattagaaacatcattaataccacatttgtggtgtgcatccttattctggctgtctgtgtggtttccacctctgccgtggaaatggagagcctcccggctggaacatgggaacgcgaggaagacctgaccaacttctgccaccaggagtgtcaagccacggagacagaatgcctctgtccttacgaggcgctggtccttcggaaacccctgttttccgatagcatcgtgaagggcatgaaaaatctcctgaactctacctccctggaaacaagcctttctatcgaggccccttggggagctattaatgttcagagcaccttcaagcccaccgtgtccgccgctaacatcgccctgtcttggagctccgtcgagcatagagggaataaaattctcgtgtctggccgcagcgaatccatcatgaagctggaggaaagaacagggattagctgggacctcggcgttgaggatgcgtctgaatccaagctgcttacggtgagcatcatggacctgtcccagatgtattctcccgtctttgagtacctcagcggagatagacaggtggaggaatggcctaaagctacctgcacaggcgactgtccggagcgctgcgggtgcacctcctctacatgtctgcacaaggaatggccccatagcagaaactggcggtgcaatcctacctggtgttggggagtgggcacggggtgcacatgttgcggactggacgtcaaagatcttttcaccgaccacatgtttgttaagtggaaagtggagtatatcaagaccgaagccattgtgtgtgtcgagctgacatcccaagagcgccagtgcagcctcatcgaagccggcaccagattcaacctgggccccgtgacaattacgctctctgagcctcggaatatccagcagaagctgccccctgaaattgttacccttcatccgcgcatcgaggaagggtttttcgatctgatgcacgtgaaaaaggtcctgtccgctagcacagtgtgtaaactccaatcttgcacccacggagttcccggcgaccttcaggtgtaccatatcgggaacctgctgaagggagataaagtcaatggccacctcattcataagatcgagcctcactttaacacatcctggatgagctgggacgggtgtgatctggactactattgcaacatgggagattggccctcttgcagctacaccggcgtgacgcagcataatcacgccgccttcgtcaacatgctcaatattgagaccgactatacaaaaatctttcacttccattccaagagagtgaccgctcacggcgatacacctcagctggaccttaaggcgcggcccacctacggggccggagaaattacagttctggtggaggtcgctgatatggaactgcatacgaaaaagatcgagatttctggcctcaaattcgccagcctgacctgtacagggtgctatgcctgttccagcggaatctcctgcaaggtgcgcatccacgttgacgagccggacgaacttaccgtgcacgtcaaatctgaggatcctgacattgtggctgccagctcctctctgatggcgagaaagctcgaatttggcaccgatagcacattcaaggctttttccgccatgcccaaaacgtctctgtgtttctacatcgtggagcgggaatattgcaagagctgttccaaagaggacacccaaaagtgcgttaacacaaaactcgagcagccccagagcattctgatcgaacataaggggaccattatcggaaagcaaaatgatacatgtacctctaaagccggctgctggcttgagtccgtcaagagctttttctacggcctgaaaaacatgctgtctgggatctttggaaatgtgttcattggcatctttctcttcctggctccttttattcttctgatcctcttcttcatgtttgggtggcggattctgttctgttttaagtgctgccgccggacgagaggactcttcaaataccgccacctgaaggacgatgaagagacaggctatcggaagatcatcgaaagacttaacaataaaaaggggaaaaacaagctgctggacggagagcgcctcgccgatcggaaaattgcggagctgttttccaccaagacccatatcggctga

SEQ ID NO: 13700 - RNA, 5052 nt, synthetic construct
  misc_feature 1..5052: note = derived and/or modified CDS sequence (opt5) from CCHFV(4574-ST-2008)__KR814870.1__GP
  source 1..5052: mol_type = other RNA
atgcacaccctgctcgtgtgcttcatcctgtaccttcagctgctcggccccgggggagcccatggccaacctaacgctacagagcacaatagaacgaacaccacaaccgccccgagcacatcccagtctcccaagcctcccgtcagcaccgcgcctccccatgctctggaatcccctacaattaaatctaccacgccgaccagcgagacagaagggtccggagagaccacatctccccctaataccacgcagggccccagccttcctgaaacaacccccaagcggccggccacaaccgccacctccacacctagcacggacaacaccaattctacaacccacgttacagataacaatcccacctccacgatcagcacatctccttccagctctccctccacccccagcacccctcgcgggattcatcacccggctagaaacctgctctccgtgtctagccccaaaacagccaccacacctacgcccacctcccctggagagatcagctctgagacatccagcctgcactctgctatgagccggacctccacactgtataccgccacgcaggcgtctaccgaaaatgccaaccatagcgctccccgccaatccgagagcccggcccagcctacaaccacatctctcatgacctcccccgctcagagcattctggtgatgtctgccgcgcctacggccatccagaatatccacccctcccctacaaacagaagcaagcggaatcttgaaatggagattatcctgaccctctcccaaggcctgaaaaagtactatggcaagattcttaaactgctccatctgacactggaggaagacaccgaggggctcctggaatggtgtaagcgcaaccttggatctaattgcgaggatgactttttccagaaaagaatcgaagagtttttcatgaccggcgaggggtactttaacgaagtcctgcagttcaagacactcagcacgctgtcccccaccgagccgtctcacgctcggcctcccacagtggaaccctttaaaagctatttcgccaagggatttctttccattgatagcggctacttctctgctaagtgttatcctcgctccagcacctctgggctgcagctcatcaacgttacacaacacccggccagaattgccgagacccccggacctaaaacgacatccctgaagaccatcaattgcatcaacctgcgggctagcgtgtttaaagaacatcgcgagattgagatcaatgtcctcctgccccagattgcggtgaacctttctaattgtcacgttgtgatcaacagccatgtctgcgactactccctggataccgacggccctgtgagactcccccacatttaccatgaaggcacattcatccctgggacctataagatcgtgattgataaaaagaataaactgaacgaccggtgtacacttgtcacgaattgcgttatcaagggacgcgaggtgagaaagggccagagcgtgctgcggcaatacaaaaccgaaattaagatcgggaaagtctctacaggatccagaaagctcctgagcgaggaatccggcgatgactgtatttctcgcacccagctgctccggacagagaccgccgagatccacgatgacaactatgggggacccggcgacaaaatcacgatttgcaatggcagcaccatcgtggatcagagactggggtccgaacttggatgttacacaattaaccgcgttaagtcttttaagctgtgcgagaatagcgctaccggcaaaacatgcgaaatcgactccaccccggtgaagtgtcggcaggggttctgcctcaaaattacacaagagggaagaggccacgtcaagctgtctcgcgggagcgaggtggttctggatgcctgtgactccagctgcgaagtgatgatccctaaaggcaccggagatattcttgtcgactgttctggcgggcagcagcatttcctcaaggataacctgatcgacctgggatgcccccacatccctctcctgggcaagatggccatttatatctgtcggatgtccaatcatcccagaacgacaatggcttttcttttctggtttagcttcgggtacgtgattacctgcctgttttgtaaagccctcttctattctctgatcattatcggaaccctgggcaagaaaatcaagcagtaccgcgagcttcggccgcaaacatgcaccatttgtgaaacggcgcctgtcaacgctatcgatgccgagatgcacgacctcaactgctcctacaatatttgcccctattgtgccagcagactgacatctgatgggctggctcgccacgtgcctcagtgccccaaacggaaggaaaaggttgaggagaccgaactctacctgaaccttgagagaatcccctggattgtgcggaaactgctccaggtctccgaaagcacaggcgtggccctgaagcgctccagctggctgatcgttcttctcgtgctgctgaccgtctctctcagccctgtgcagtccgctccggtgggacatggcaaaacaatcgagacctatcaaacgagagaagggtttacctctatttgtctgttcatgcttggaagcatcctgtttctcgtttcctgcctggtcaagggcctggtggactctgtgagcgactccttctttcccgggctttctgtctgtaaaacatgcagcattggatccatcaatggcttcgagattgagagccacaagtgttactgctctctcctgtgttgcccttattgtcggcattgctccgccgatagagaaatccaccagctgcatctcagcatctgcaaaaagcgcaagaccgggtctaacgtgatgctggcggtttgtaaacggatgtgctttagagccacaattgaggcttcccgcagagcccttctgatccggagcattatcaataccacgttcgtgatttgtatcctcacactgaccatttgcgtcgtgtccacatctgctgttgaaatggagaacctgcccagcggcacctgggaaaaggaggaggaccttaccaatttctgtcaccaggaatgccaggtgacagagacggaatgtctgtgcccttacgaggccctcgtcctgcgcaaacccctctttctggattccatcgtgaagggaatgaaaaaccttctgaatagcacctctctcgagacatccctgagcatcgaagcgccttggggcgccattaacgttcaatctaccttcaagccgacagtgagcaccgctaatatcgccctgtcctggtctagcgtcgagcacagagggaacaagattcttgtgacgggacggtccgaatctatcatgaaactggaggaacgcacaggcgtgagctgggacctcggggtcgaggatgcttccgagagcaagctgctcaccgtttctattatggacctgtcccagatgtatagccccgtgtttgaatacctttccggagatagacaggtggaggaatggcctaaagccacctgtacaggcgactgccccgagcggtgtgggtgcacctctagcacatgcctgcataaggaatggcctcactcccgcaattggagatgtaaccccacgtggtgctggggcgtcggaaccggctgtacatgctgtggggtggatgttaaagacctcttcaccgatcatatgtttgtgaagtggaaggtcgagtacatcaaaacagaggccatcgtgtgcgttgaactgacctctcaagagcggcagtgtagcctgattgaagctggaacgcgcttcaatcttggcccggtgaccatcacactgtccgagcctagaaacattcagcagaagctccctcccgaaatcattaccctgcaccccaaagtcgaggaggggtttttcgacctcatgcatgtgcaaaaggttctgagcgcgtctacagtgtgcaaacttcagtcctgtacccacggaatccccggcgatctgcaggtctatcacatcggcaacctgctcaagggggaccgggtgaatggacatctgattcacaagatcgaacctcattttaacacaagctggatgtcttgggacggctgcgatcttgactactattgtaatatgggggattggccgtcctgcacgtacaccggagtgacacagcacaaccacgccgctttcgtcaatctgctcaacattgagaccgactataccaaaacatttcatttccacagcaagagagttacggcccatggcgatacaccccaactggacctcaaagcccgccctacctacggggctggagaaatcaccgtgctggtggaggtcgccgatatggagcttcacacaaagaaagtggaaatttctggcctgaagtttgcgagcctggcttgcaccggctgttatgcctgctcctctgggatcagctgtaaagttcggattcatgtggacgagcccgatgaactcacggtccacgtgaagtccagcgaccctgatgttgtggccgcttccacatctctgatggccagaaaacttgagttcggaaccgacagcaccttcaaggcgttttccgctatgcccaagacatctctgtgcttctacatcgtcgaacgcgagtactgtaaaagctgctccgaggaagatacccagaagtgtgtggacacaaaactcgagcagccgcagtctatcctgattgaacacaagggcaccatcattgggaagcaaaatgacacgtgcacagccaaagccagctgttggctcgagtccgtcaagagctttttctatggactgaaaaacatgcttggctctgtgtttgggaatttctttatcggcattctgctgttcctcgctccttttgttctgcttgtgctgttctttatgttcggatggaagatcctcttctgctttaaatgttgccggagagcccgcggcctgctcaagtaccggcatctgaaggatgacgaagagaccgggtatagaaaaatcattgagcgccttaacaataagaaaggaaagaaccggctgctggatggcgaaagactcgctgaccggaaaatcgccgagctgttctccacaaagacccacattgggtga

SEQ ID NO: 13701 - RNA, 5052 nt, synthetic construct
  misc_feature 1..5052: note = derived and/or modified CDS sequence (opt5) from CCHFV(75-ST-2010)__KR814864.1__GP
  source 1..5052: mol_type = other RNA
atgcacaccctgctcgtgtgcttcatcctgtaccttcagctgctcggccccgggggagcccatggccaacctaacgctacagagcacaatagaacgaacaccacaaccgccccgagcacatcccagtctcccaagcctcccgtcagcaccgcgcctccccatgctctggaatcccctacaattaaatctaccacgccgaccagcgagacagaagggtccggagagaccacaccccctcccaataccacgcagggcccttctcttcccgaaacaaccccggagcggcctgccacaaccgccaccagcacaccctccacggacaacaccaatagcacaacccacgttacagataacaatcctacctctacgatctccacaagcccctcttccagcccctctaccccttccaccccgcgcgggattcatcaccccgctagaaacctgctcagcgtgtcctctcctaagacagccaccacacccacgcctaccagccccggagagatctccagcgaaacatcttccctgcacagcgctatgtctcggaccagcacactgtataccgccacgcaggcgtccaccgagaatgccaaccattctgctccgcgccaaagcgaatcccctgcccagcccacaaccacaagcctcatgacctctcctgctcagtccattctggtgatgagcgccgcgcccacggccatccagaatatccacccttctcccacaaacagatccaaacggaatcttgagatggagattatcctgaccctcagccaaggcctgaagaaatactatggcaagattcttaagctgctccatctgacactggaagaggacaccgaagggctcctggagtggtgtaaacgcaaccttggatccaattgcgatgacgactttttccagaagagaatcgaagagtttttcatgaccggcgaggggtactttaacgaagtcctgcagttcaaaacactctctacgctgagcccgaccgagccttcccacgctcggcctcccacagtggaaccctttaagtcttatttcgccaaaggatttcttagcattgattccggctacttcagcgctaagtgttatccgagatcttccaccagcgggctgcagctcatcaacgttacacaacaccccgcccgcattgccgagacccctggacccaagacgacatctctgaaaaccatcaattgcatcaacctgcgggcttccgtgtttaaggaacatcgcgagattgagatcaatgtcctcctgcctcagattgcggtgaaccttagcaattgtcacgttgtgatcaactctcatgtctgcgattacagcctggacaccgatggccccgtgagactccctcacatttaccatgaaggcacattcatccccgggacctataaaatcgtgattgacaagaaaaataagctgaacgatcggtgtacacttgtcacgaattgcgttatcaaaggacgcgaggtgagaaagggccagtccgtgctgcggcaatacaagaccgaaattaaaatcgggaaggtcagcacaggatctagaaaactcctgtccgaggaaagcggcgacgattgtatttcccgcacccagctgctccggacagagaccgccgagatccacgacgacaactatgggggaccgggcgataagatcacgatttgcaatggctctaccatcgtggaccagagactggggagcgaacttggatgttacacaattaaccgcgttaaatcctttaagctgtgcgaaaattctgctaccggcaagacatgcgagatcgatagcacccctgtgaaatgtcggcaggggttctgcctcaagattacacaagagggaagaggccacgtcaaactgtcccgcgggtctgaggtggttctggacgcctgtgatagctcctgcgaagtgatgatccccaagggcaccggagacattcttgtcgattgtagcggcgggcagcagcatttcctcaaagacaacctgatcgatctgggatgccctcacatccccctcctgggcaagatggccatttatatctgtcggatgtctaatcatccgagaacgacaatggcttttcttttctggttttccttcgggtacgtgattacctgcctgttttgtaaggccctcttctatagcctgatcattatcggaaccctgggcaaaaagatcaaacagtaccgcgagcttcggcctcaaacatgcaccatttgtgaaacggcgcccgtcaacgctatcgacgccgagatgcacgatctcaactgctcttacaatatttgcccttattgtgcctccagactgacaagcgacgggctggctcgccacgtgccccagtgccccaagcggaaagaaaaggttgaggagaccgaactctacctgaaccttgagagaatcccttggattgtgcggaagctgctccaggtctctgaatccacaggcgtggccctgaaacgcagctcctggctgatcgttcttctcgtgctgctgaccgtcagcctctctccggtgcagagcgctcccgtgggacatggcaagacaatcgagacctatcaaacgagagaagggtttacctccatttgtctgttcatgcttggatctatcctgtttctcgttagctgcctggtcaaaggcctggtggactccgtgtctgatagcttctttcctgggctttccgtctgtaagacatgctctattggaagcatcaatggcttcgagattgagtcccacaaatgttactgcagcctcctgtgttgcccctattgtcggcattgctctgccgacagagaaatccaccagctgcatctctccatctgcaagaaacgcaagaccgggagcaacgtgatgctggcggtttgtaagcggatgtgctttagagccacaattgaggcttctcgcagagcccttctgatccggtccattatcaataccacgttcgtgatttgtatcctcacactgaccatttgcgtcgtgagcacatccgctgttgaaatggagaacctgccttctggcacctgggaaaaagaggaggatcttaccaatttctgtcaccaggaatgccaggtgacagagacggaatgtctgtgcccctacgaggccctcgtcctgcgcaagcctctctttctggacagcatcgtgaaaggaatgaagaaccttctcaattccaccagcctcgagacatctctgtccatcgaagcgccgtggggcgccattaacgttcaaagcaccttcaaacccacagtgtctaccgctaatatcgccctgagctggtcctctgtcgagcacagagggaacaagattcttgtgacgggacggagcgaatccatcatgaagctggaggaacgcacaggcgtgtcttgggatctcggggtcgaggacgctagcgagtccaaactgctcaccgttagcattatggatctgtctcagatgtattcccctgtgtttgaataccttagcggagacagacaggtggaggaatggcccaaggccacctgtacaggcgattgccctgagcggtgtgggtgcacctcctctacatgcctgcataaagaatggccccacagccgcaattggagatgtaacccgacgtggtgctggggcgtcggaaccggctgtacatgctgtggggtggacgttaaggatctcttcaccgaccatatgtttgtgaaatggaaggtcgagtacatcaagacagaggccatcgtgtgcgttgaactgacctcccaagagcggcagtgttctctgattgaagctggaacgcgcttcaatcttggccctgtgaccatcacactgagcgagcccagaaacattcagcagaaactgccccctgaaatcattaccctgcaccccaaggtcgaggaggggtttttcgatctcatgcatgtgcaaaaagttctgtccgcgagcacagtgtgcaaacttcagtcttgtacccacggaatccctggcgacctgcaggtctatcacatcggcaacctgctcaaaggggaccgggtgaatggacatctgattcacaagatcgaaccgcattttaacacatcctggatgagctgggatggctgcgaccttgattactattgtaatatgggggactggccctcttgcacgtacaccggagtgacacagcacaaccacgccgctttcgtcaatctgctcaacattgagaccgattataccaagacatttcatttccactccaaaagagttacggcccatggcgacacccctcaactggatctcaaggcccgccccacatacggggctggagaaatcaccgtgctggtggaggtcgccgacatggagcttcacacaaagaaggtggaaattagcggcctgaaatttgcgtctctggcttgcaccggctgttatgcctgcagctccgggatctcttgtaaggttcggattcatgtggatgagcctgacgaactcacggtccacgtgaaaagctccgatcccgacgttgtggccgctagcacatccctgatggccagaaaacttgagttcggaaccgattctaccttcaaggcgtttagcgctatgccgaaaacatccctgtgcttctacatcgtcgaacgcgagtactgtaagtcttgcagcgaggaagacacccagaaatgtgtggacacaaagctcgagcagcctcagtccatcctgattgaacacaaaggcaccatcattgggaagcaaaatgatacgtgcacagccaaggcctcttgttggctcgagagcgtcaaatcctttttctatggactgaagaacatgcttggcagcgtgtttgggaatttctttatcggcattctgctgttcctcgctccctttgttctgcttgtgctgttctttatgttcggatggaaaatcctcttctgctttaagtgttgccggagagcccgcggcctgctcaaataccggcatctgaaggacgatgaagagaccgggtatagaaagatcattgagcgccttaacaataaaaagggaaagaaccggctgctggacggcgaaagactcgctgatcggaagatcgccgagctgttctctacaaaaacccacattgggtga

SEQ ID NO: 13702 - RNA, 5052 nt, synthetic construct
  misc_feature 1..5052: note = derived and/or modified CDS sequence (opt5) from CCHFV(37-R-2013)__KR814858.1__GP
  source 1..5052: mol_type = other RNA
atgcacaccctgctcgtgtgcttcatcctgtaccttcagctgctcggcctgggaggagcccatagacaaagcaacgctacagagcacaatggcacgaacaccacaaccgccccctccacatctcagagccctaagccgcccgtctccaccgcgcctccccatgctcctgaaacatctaccattaaacccacgacccctgccagcgagacagaagggtccggagagaccacaccgccccctaataccacgcagggcccctctcctcccgaagccacaccggagcggcctgctaccacagttaccagcaccccctccacagacaacacgaatagcaccacacacgccaccgataacaatcctacatctaccatctccacgagcccctcttccagcccctctacaccttccaccccgcaggggattcatcaccccgctcgcaaccttctgagcgtgtcctctcctaagaccgccacaacccccacacctacgagccccggagacatctccagcgagacctcttccctccacagcgcgatgtctagaacaccgaccctgcatacagccacccaagctagcacggaaaatgccaaccactccgctcctcggcagtctgagagctccgcccagcagaccacaaccagccccatgacatctcctgcgcaacccattctggtgatgtccgccgctcctaccgccatccagaatatccatcccagcccgacgaaccgctctaaaagaaatctcgaaatggagattatcctgacactttcccagggcctgaagaaatattacggcaagattctcaagctgcttcacctgaccctcgaggaagatacagaggggctgctggaatggtgtaaacggaacctcggaagcaattgcgacgatgactttttccagaagcgcatcgaggaatttttcatgaccggcgaggggtattttaacgaggtcctgcaattcaaaaccctttccacactgtctcctacggaacccagccacgctagaccccctaccgtggagccgtttaagtcctacttcgccaaaggatttctctctattgatagcggctatttctccgccaagtgttacccccggctgacaaccagcgggcttcagctgatcaacgttacacagcatcctgctcgcattgcggaaacccccggacctaagacgacatctctcaaaaccatcaattgcatcaacctgagagcctccgtgtttaaggagcaccgggaaattgagatcaatgtcctgctcccccaaattgctgtgaacctgagcaattgtcatgttgtgatcaactctcacgtctgcgactattcccttgataccgacggccctgtgcgcctgccccatatttaccacgagggcacattcatcccggggacctacaaaatcgtgattgataagaaaaataagctcaacgacagatgtacactggtcacgaattgcgttatcaaaggacgggaagtgcgcaagggccagagcgtgcttagacagtataagaccgagattaaaatcgggaaggcctctacaggaagccggaaactgctctccgaagaacctggcgatgactgtattagcagaacccagctgctgcgcacagaaaccgccgagatccacgacgataactacgggggacccggcgacaagatcacgatttgcaatggctctaccatcgtcgatcaacggctcgggtccgagctgggatgttatacaattaacagagtgaaatcctttaaactttgcgaaaatagcgctaccggcaagacatgcgagatcgactctacccctgttaaatgtcgccaggggttctgcctgaagattacacaggaaggacggggccatgtgaaactcagcagagggtccgaggtcgtgctggatgcctgtgacacctcttgcgaggttatgatccccaagggcacgggagatattctggtggactgtagcggcgggcagcaacacttccttaaagataacctcatcgacctgggatgcccgcatatccctctgctcggcaagatggcgatttacatctgtcgcatgtccaatcacccccggacaaccatggcttttctgttctggttttctttcgggtatgtcattacctgcatcttttgtaaggcccttttctacagcctgattatcatcggaacactcggcaaaaagattaaacagtatagagaactgaagcctcagacctgcacgatctgtgagacagcccccgtgaacgctattgatgccgaaatgcacgacctgaactgctcctacaatatctgcccctactgtgctagccgccttacctctgacgggctcgcccggcatgtccctcagtgcccgaaaagaaaggagaaggtggaagagacagagctgtatctgaacctcgaacgcattccctggatcgttcggaaactgcttcaagtgtccgagagcaccggcgtcgcgctgaagagatcttcctggctcatcgtgctgctggttcttctcacagtgagcctgtctcctgtccagtccgcccccgtgggacacggcaaaaccattgaaacgtaccagacccgggaggggtttacaagcgtgtgtctgttcatgctcggatccatcctgtttcttgttagctgcctggtcaagggcctcgtggattctgtgagcgactccttctttcctgggctgtctgtctgtaaaacctgcagcattggatccatcaatggcttcgaaattgagtctcataagtgttattgcagcctgttttgttgcccctactgtcgccactgctccgctgatagagagatccatcagcttcacctctctatctgcaaaaagcggaagatggggagcaacgtgatgctggccgtttgtaaaagaatgtgcttccgcgctacaattgaagcctcccggagagcgctgctcatccgcagcattatcaataccacgttcgtgatttgtatcctgacacttaccatttgcgtcgtgtctacatccgccgttgagatggaaaacctgcctagcggcacctgggagagagaagaggacctcaccaatttttgtcaccaagagtgccaggtgacagaaacggagtgtctgtgcccgtatgaagctctggtccttcggaagcccctgttcctcgattctatcgtgaaaggaatgaagaacctgctcaattccaccagcctggagacatccctttctatcgaggccccttggggcgctattaacgttcagagcacctttaaacccacagtgtccaccgccaatatcgccctgagctggtcttccgtcgaacatcgcgggaacaagattctcgtgacgggaagaagcgagtctatcatgaagctggaggagcggacaggcgtgagctgggacctgggggtcgatgacgcttccgaatctaaacttctgaccgttagcattatggatctctcccaaatgtactctcctgtgttcgagtatctgagcggagaccgccaggtggaggaatggcccaaggcgacctgtacaggcgattgcccggagagatgtgggtgcacctccagcacatgcctccacaaagaatggcctcattctcggaattggcgctgtaaccccacgtggtgctggggcgtcggaaccggctgtacatgctgtggggtggacgttaaggatctgtttaccgaccacatgttcgtgaaatggaaggtcgagtacatcaagacagaagccatcgtgtgcgttgagcttacctcccaggagagacagtgtagcctgattgaagctggaacgcggtttaatctcggccccgtgaccatcacactgtccgagcctcgcaacattcaacagaaactgccccctgaaatcattacccttcatccgaaggtcgaggaagggttctttgacctgatgcacgtgcagaaagttctctctgccagcacagtgtgcaagctgcagtcctgtacccacggaatccccggcgatctccaagtctaccatatcggcaacctgcttaaaggggacagagtgaatggacacctgattcataagatcgagcctcacttcaacacatcttggatgagctgggatggctgcgacctggattattactgtaatatgggggactggccctcctgcacgtataccggagtgacacagcacaaccatgccgcttttgtcaatctcctgaacattgagaccgattacaccaagacattccactttcatagcaaacgggttacggcccacggcgacacccctcagcttgatctgaaggcgagacccacatatggggctggagaaatcaccgtgctcgtggaggtcgccgacatggaactgcatacaaagaaggtggagatttctggcctcaaattcgcctccctggcttgcaccggctgttacgcctgcagctctgggatctcctgtaaggttcgcattcacgtggatgagccggacgaacttacggtccacgtgaaaagcaatgatcctgacgttgtggcggcttctacaagcctgatggcccggaagctggagttcggaaccgactccacctttaaggccttctctgctatgcccaaaacaagcctctgcttttatatcgtcgaaagagagtactgtaagtcctgcagcgaagaggatacccagaaatgtgtggacacaaagctggagcaacctcagtccatccttattgaacataaaggcaccatcattgggaagcagaacgtcacgtgcacagccaaggcttcttgttggctggagagcgtgaaatccttcttttacggactcaagaatatgctgggctctgttttcgggaactttttcatcgggattctcctgtttcttgcccccttcgtgctgctggtcctctttttcatgttcggctggaaaatcctgttttgcttcaagtgttgccgccggaccagaggccttctgaaatatcgcctcctgaaggatgacgaagagacagggtaccggagaatcattgaacgcctcaataacaagaaaggaaagaatcggctgcttgatggcgagagactggcggaccggaaaatcgccgagctgtttagcaccaagacgcacattgggtga

SEQ ID NO: 13703 - RNA, 5052 nt, synthetic construct
  misc_feature 1..5052: note = derived and/or modified CDS sequence (opt5) from CCHFV(Kashmanov)__DQ211631.1__GP
  source 1..5052: mol_type = other RNA
atgcacaccctgctcgtgtgcttcatcctgtaccttcagctgctcggccttgggggagcccatggccaaagcaacgctacagagcacaatgggacgaacaccacaaccgccccctccacatctcagagccctaagccgcttgtctccaccgcgccccctcatgctctggaatctagcacaattaaacccaccacgcctgcctccgagaccgaaggatctggcgagacaacaccccctccgaatacaacccaggggcccagccctcccgaaacgacacctgagagacccgccaccacagctacctccaccccgagcacagacaacaccaattctaccacacacgttaccgataacaatcctacatccaccatcagcacgtctccctccagctctccttccacacccagcacgccccagggcattcatcaccctgcccggaacctcctgtccgtgtctagcccgaagaccgctacaacccccacacctacgtcccccggagagatcagctctgaagcctccagcctgcactctgcgatgagccgcacctccacactctataccgccacacaagtgtctaccgagaatgctaaccatagcgcccctagacagtccgaaagctctgctcagcccacgaccacatccccgatgaccagccctgcccagtctattctggtcatgtccgcggcccccatcgctatccaaaatattcaccctagccccacaaaccggtccaaacgcaatcttgagatggagatcattctgaccctctctcagggcctgaagaaatactatgggaagatccttaagctgctccatctgacgctggaagaggacacagaaggactcctggagtggtgtaaaagaaaccttggcagcaattgcgatgacgactttttccagaagcggattgaagagtttttcatgaccggggagggatactttaacgaagtgctgcagttcaaaacactctccaccctgtctcctaccgagcccagccacgccggcccgcctacagttgaaccctttaagtcctatttcgctaaagggtttcttagcatcgattctggatacttctccgccaagtgttatccccgcagctctacgtccggcctgcaactcattaacgtgacccagcaccctgccagaatcgctgagacaccgggccccaagaccacaagcctgaaaaccatcaattgcattaacctgcgggcgtctgtctttaaggaacatcgcgagatcgagattaatgtgctcctgcctcagatcgccgttaaccttagcaattgtcacgtggtcattaactcccatgtgtgcgattacagcctggacacggatgggcccgtgagactccctcacatctaccatgaaggaacattcatccccggcacctataaaattgtcatcgacaagaaaaataagctgaacgatcggtgtacccttgttacaaattgcgtgattaaagggcgcgaggtgagaaagggacaatctgtcctgcggcagtacaagaccgaaatcaaaattggcaaggcttccacagggagccgcaaactcctgtccgaggaacctggagacgattgtatctctagaacgcagctgctccggaccgagacagccgagatccacgacgacaactatggcggccccggggataagattaccatctgcaatggaagcacaattgtggaccagagactgggctccgaacttgggtgttacaccatcaaccgcgttaaatcttttaagctgtgcgagaatagcgccacgggaaagacctgcgaaattgattccacaccggtgaaatgtcggcaaggcttctgcctcaagatcacccaggaggggagaggccacgtcaaactgtctcgcggaagcgaggtggttctggacgcttgtgattccagctgcgaagtgatgattcctaagggcacaggggacatccttgtcgattgttctggaggccagcagcatttcctcaaagacaacctgatcgatctggggtgcccccacattcctctcctgggaaagatggccatctatatttgtcggatgtccaatcatcccagaaccacaatggcgtttcttttctggtttagcttcggctacgtgattacctgcatcttttgtaaggctctgttctattctctcatcatcattgggacgctgggcaaaaagatcaaacaataccgcgagctgaagccgcagacatgcaccatttgtgaaaccgcccctgtcaacgccatcgacgctgagatgcacgatcttaactgctcctacaatatttgcccctattgtgccagccggctcacatctgacggactggctagacacgtgcctcagtgccccaaacgcaaggaaaaggttgaggagaccgaactgtacctcaacctggagcggatcccctggatcgtgagaaaacttctgcaggtctccgaaagcacgggcgtggccctcaagcgctccagctggctgattgttctgcttgtgctcctgacagtctctctgagccctgtgcaatccgcgccggtggggcatggaaaaaccatcgagacatatcagacccgggaaggctttacatctatttgtctcttcatgctggggagcatcctttttctggtttcctgcctcgtcaagggactggtggactctgtgagcgattccttctttcccggcctgtctgtctgtaaaacctgcacgattgggagcatcaatggcttcgagatcgagtcccacaagtgttactgcagcctgttttgttgcccttattgtagacattgctctgccgaccgggaaattcaccagctccatctgtccatctgcaaaaagcgcaagaccggaagcaacgtgatgctggctgtttgtaaaagaatgtgcttccgggccacaattgaggcttctagacgcgccctcctgatccggtccattatcaataccacattcgtgatttgtatccttaccctgacgatctgcgtcgtgagcacatccgcggttgaaatggagaacctcccctctggcacctgggaaagagaggaggatctgacaaatttttgtcaccaggaatgccaagtgaccgagaccgaatgtctgtgcccttacgaggcccttgtcctgcgcaagcccctcttcctggacagcattgtgaaagggatgaagaactccctcaatagcacatctctggagacgtcccttagcatcgaagctccttggggagccattaacgttcagtctacctttaaaccgacagtgagcaccgctaatatcgccctgtcctggtctagcgtcgagcacagaggcaacaagattctcgtgacagggcggtccgaatctatcatgaagctggaggaacgcaccggagtgagctgggatctgggcgtcgaggacgcctccgagagcaaacttctgacggtttctatcatggatctctcccagatgtatagccccgtgttcgaatacctgtccggggacagacaagtggaggaatggcctaaggctacatgtaccggcgattgccccgagcggtgtggatgcacctctagcacatgcctccataaagaatggcctcactcccgcaattggagatgtaaccccacctggtgctggggcgtcgggacaggatgtacgtgctgtggcgtggacgttaaggatctgtttaccgaccatatgttcgtgaaatggaaggtcgagtacattaagacagaggcgatcgtgtgcgttgaacttacctctcaggagcggcagtgtagcctgattgaagccgggacacgctttaatctcggaccggtgaccatcacgctgtccgagcctagaaacattcagcaaaaactgcctcccgaaatcatcacccttcaccccaaggtcgaggagggcttctttgatctgatgcatgtgcagaaagttctcagcgcttctacagtgtgcaagctgcagtcctgtacccacggcattcccggggacctccaggtctatcacatcggaaacctgcttaaaggcgaccggattaatgggcatctgatccacaagattgaacctcatttcaacacaagctggatgtcttgggatggatgcgacctggattactattgtaatatgggcgactggccgtcctgcacctacacaggggtgacgcaacacaaccacgccgcctttgtgaatctcctgaacatcgagaccgattatacaaagaccttccattttcacagcaaacgcgtcaccgctcatggagacacaccccagcttgatctgaaggccagacctacgtacggcgcgggcgaaattaccgttctcgtggaggtggctgacatggagctgcacaccaaaaaggtcgaaatctctgggctcaaattcgccagcctggcctgcaccggatgttatgcttgctcctctggcatcagctgtaaggtgcggattcatgttgatgagcccgacgaacttacagtgcacgtcaaatccagcgatcctgacgtggttgccgcgtccacctctctgatggctagaaagctggagttcgggacggatagcacatttaaggccttctccgccatgcccaaaacctctctctgcttttacatcgtggaacgcgagtactgtaagagctgctccgaggaagacacccagaaatgtgtcgacacaaagctggagcagccgcaatctattcttatcgaacacaaaggaaccattatcggcaagcagaatgatacatgcaccgctaaggccagctgttggctggagtccgtgaaatctttcttttatgggctcaagaacatgctgggaagcgtcttcggcaactttttcatcggcattctcctgtttcttgctcctttcgtgctgctggttctctttttcatgttcgggtggaaaatcctgttttgcttcaagtgttgccggagaacgcgcggacttctgaaataccggcatctcaaggacgatgaagagacaggctatagacgcattatcgagcggctgaataataagaaagggaagaacagactcctggacggagaacgccttgccgatcggaaaattgcggagctgttttccaccaagacacacatcggctga

SEQ ID NO: 13704 - RNA, 5052 nt, synthetic construct
  misc_feature 1..5052: note = derived and/or modified CDS sequence (opt5) from CCHFV(Haskovo-V46/13)__KR092379.1__GP
  source 1..5052: mol_type = other RNA
atgcacaccctgctcgtgtgcttcatcctgtaccttcagctgctcggccttgggggagcccatggccaaagcaacacaacggagcacaatgggaccaacaatacaaccgctcccggaacatcccagtctcctaagccgcatatgagcaccacaccccctcacgcccccgaatcctctaccattaaacctacgacccccacaagcgagaccgaaggctccggggagacaacccctccgtctaacacgacacagggacccagccctcccgaaaccacatccgagagacctgcgaccaccgctatcagcacatcttccacggacaatatgaaccccaccagccagatgacagataataccccgacatctaccgtctccattagcccttcttccagcccctccacgccttctacaccccaaggcatgcatcaccccgcccggagccttctgtccgttagctctcctaagaccgccaccacaccgacccccacatcccctgtggaggtgggcagcgaaacgtctagccagcactccgctatgtctagcacccccacacctcataccgccacacaggtctccaccgagaacacgaatcacagcacccccagacagtctgaaccgtccgctcaacagacaacccctagccccatgccttctcccgcccagtccacactcctgatgagcgcggcccctaccgctgtgcagaacacgcatccctccccgacaaatagatctaaacggaacctggagatggagatcattctcaccctgagccaagggcttaagaaatattacggaaagatcctgaagctcctgcaccttacactggaagaggacaccgaaggcctcctggagtggtgtaaacgcaatctggggtccaactgcgatgacgactttttccagaagagaatcgaagagtttttcatgaccggagagggctattttaatgaagttctccagttcaaaacactgtctacgcttagccctatggagccctcccacgccgaactgcccaccgctgagccttttaagagctacttcgccaaagggtttctctctattgattccggatatttcagcgcgaagtgttacccgcggtcttccacaagcggcctgcaacttatcaacgtgacccagcatcccgcccgcattgctgaaacacctggccccaagaccacgtctctgaaagccatcaactgcattaatctcagagctagcgtctttaaggagcaccgggagatcgaaattaacgtgctgctgcctcagatcgccgttaatctctccaactgtcatgtggtcatcaatagccacgtgtgcgattattctctggacacagatgggcccgtgcgccttcctcatatttaccacgagggaaccttcatccccggcacctacaaaattgtcatcgacaagaaaaacaagctgaatgatagatgtacactcgttaccaactgcgtgattaaagggcgggaagtgcgcaagggacagtccgtcctgagacaatataagacagagatcaaaatcggcaaggccagcacggggtcccggaaacttctgtctgaggaactcggagacgattgtattagccgcacccagctgctgagaacagagaccgctgaaatccacgacgacaattacggcggcccgggggataagattacaatctgcaacggatccaccattgtggaccagcggctcggctctgagctggggtgttatacgatcaatagaggaaagagctttaaactttgcgaaaactccgcgaccggcaagacatgcgagatcgattctacccctgttaaatgtcgccaggggttctgcctgaagattacacaagagggccggggacatgtgaaactcagcagaggctccgaagtcgtgctggacgcctgtgatagctcttgcgaggttatgatccccaaggggaccggagacattctggtggattgttccggcgggcagcagcacttccttaaagacaatctcatcgatctgggatgccctcatattcccctgctcggcaagatggctatctacatttgtcgcatgagcaaccacccgcggacaaccatggcctttctgttctggttttctttcgggtatgtcatcacgtgcatcttttgtaaggcccttttctactccctgattatcattggcacactcgggaaaaagatcaaacagtatagagaactgaagcctcaaacctgcaccatttgtgagacaacccccgtgaatgctatcgacgccgaaatgcacgatctgaactgcagctacaacatctgcccttactgtgcgtctcgccttacgtccgacggcctcgctcggcatgtcacacagtgccccaaaagaaaggagaaggtggaggaaaccgagctgtatctgaatctcgaacgcattccctggatcgttcggaaactgcttcaggtgagcgagtccacaggggtcgccctgaagagaagctcttggctcattgtgctgctggttcttctccctgtgagcctgtccccggtccagtctgcccccgtgggacacggcaaaaccatcgaaacataccaaacccgcgaggggtttacgagcatttgtctgttcatgctcggatccatcctgtttatcgtgtcttgccttgttaagggcctggtcgacagcgtgggggattccttctttcctggcctctctgtgtgtaaaacctgcagcattggatccatcaacggcttcgagattgaaagccataagtgttattgctctctgttttgttgcccctactgtcggcactgctccgctgacagagagatccatcagctgcaccttagcatttgcaaaaagcggaagacagggtctaatgtcatgctcgccgtgtgtaaacgcatgtgcttcagagctaccatcgaagcctcccggagagcgctgctgatccgcagcattatcaacacaaccttcgccatgtgtattctcacgctgacaatctgcgttgtgtccacctctgctgtcgagatggaaaatcttcctgccggaacatgggagcgggaggaagatctgaccaacttttgtcaccaggagtgccaagtgaccgaaacagagtgtctctgcccctatgaggctctggttctgagaaagcctcttttcctggacagcattgtgaaaggcatgaagaatctcctgaactccacgagcctcgaaacctctctgtccatcgaggccccgtggggagcgattaatgtccagagcacatttaaacccaccgtgtctacagccaacatcgctcttagctggtcctctgttgaacatcgcggaaataagatcctggtgaccggcagaagcgagtccattatgaagctcgaggaacggacgggggtctcttgggatctgggcgtggaggacgccagcgaatccaaactgcttacagtgagcatcatggatctgtctcagatgtactcccctgtcttcgagtatctcagcggagaccgccaggttgaagagtggcccaaggctacctgtaccggcgattgccctgaaagatgtgggtgcacatcctctacctgcctgcacaaagagtggccccatagccggaactggcgctgtaatccgacatggtgctggggagtgggcacggggtgtacctgctgtggagtggacgtcaaggatctctttacagaccacatgttcgtgaaatggaaggttgagtacattaagaccgaagccatcgtgtgcgtcgagctgacatcccaagaaagacagtgttctcttattgaggccggcacccggtttaacctgggccctgtgacgatcaccctcagcgaaccccgcaatatccagcagaaactgccccctgagattatcacactgcatcccaagattgaggaagggttctttgatcttatgcacgttcaaaaagtgctgtccgctagcaccgtctgcaagctccagtcttgtacacacggaatccctggcgacctccaggtgtaccatattgggaacctgctgaaaggagacagagttaacggccaccttatccataagatcgagccgcacttcaatacctcctggatgagctgggatgggtgcgacctggattattactgtaacatgggagactggccctcttgcacatatacgggcgtgacccagcacaatcatgcggcctttgtcaacctgctcaatattgaaacagattacaccaagaccttccactttcattccaaacgggtgacagctcacggcgacacgcctcaactggatcttaaggcccgccccacctatggggccggagagatcacagtgctggtcgaggttgctgacatggaactccataccaaaaaggtggagattagcggcctgaaattcgcctctctcacatgcaccgggtgttacgcgtgcagctccggaatctcttgtaaggtgcgcattcacgtcgatgaacctgacgagctgacggtgcacgttaaaagctccgatcccgacgtggtcgctgccggcacaagccttatggcccggaagctggagttcgggaccgattccacctttaaggctttctctgccatgccgaaaacaagcctgtgcttttatatcgtggaaagagagtactgtaagtcctgctctgaagacgacacccagaaatgtgttgatacaaagctcgagcagcctcaaagcattctgatcgaacataaaggaaccatcattggcaagcagaacgacacgtgcacagcgcgcgcttcctgttggcttgagtctgtcaagagcttcttttacggcctgaaaaatatgctcgggtccgtgttcggaaactttctgatcggcattctcctgttccttgccccctttgtgctgctggtcctcttctttatgttcgggtggaagatcctgttctgctttaaatgttgccggagaacccgcggacttttcaagtatcggcacctgaaagatgacgaagagacaggctacagacgcattatcgagcggctcaatagcaagaaggggaaaaacagactgctcgatggagaacgcctggccgaccggaagatcgctgagctgttttctaccaaaacgcatattggctga

SEQ ID NO: 13705 - RNA, 5052 nt, synthetic construct
  misc_feature 1..5052: note = derived and/or modified CDS sequence (opt5) from CCHFV(Min)__KX013481.1__GP
  source 1..5052: mol_type = other RNA
atgcacaccctgctcgtgtgcttcatcctgtaccttcagctgctcggccttgggggagcccatggccaaagcaacgctacagagcacaatgggacgaacaccacaaccgccccctccacatctcagagccctaagccgcttgtctccaccgcgccccctcatgctctggaatctagcacaattaaacccaccacgcctgcctccgagaccgaaggatctggcgagacaacaccccctccgaatacaacccaggggcccagccctcccgaaacgacacctgagagacccgccaccacagctacctccaccccgagcacagacaacaccaattctaccacacacgttaccgataacaatcctacatccaccatcagcacgtctccctccagctctccttccacacccagcacgccccaggggattcatcaccctgcccggaacctcctgtccgtgtctagcctgaagaccgctacaaccccgacacccacgtcccctggcgagatcagctctgaaacctccagcctccactctgccatgagccgcacatccaccctgtatacagcgacccaagtgtctacggagaatgccaaccatagcgctcccagacagtccgaaagctctgcccagcctaccacaacctcccccatgacaagcccggctcagtctattcttgtcatgtccgccgcgcctatcgccatccaaaatattcaccccagccctaccaaccggtccaaacgcaatctggagatggagatcattctcacgctgtctcagggccttaagaaatactatgggaagatcctgaagctcctgcatctgacactcgaagaggacaccgaaggactgcttgagtggtgtaaaagaaacctgggcagcaattgcgatgacgactttttccagaagcggattgaagagtttttcatgacaggggagggatactttaacgaagtgctccagttcaaaaccctgtccaccctttctcccacagagcctagccacgctagacccccgacggttgaaccttttaagtcctatttcgccaaaggctttctgagcatcgattctgggtacttctccgctaagtgttatcccagaagctctacctccggactccaactgattaacgtgacacagcaccccgcccggatcgccgagacccctggcccgaagacaaccagcctgaaaacgatcaattgcattaacctccgcgcttctgtctttaaggaacatagagagatcgagattaatgtgctgcttccccagatcgcggttaacctgagcaattgtcacgtggtcattaactcccatgtgtgcgattacagcctcgacacagatggccctgtgcggctgccccacatctaccatgaagggaccttcatccctggaacctataaaattgtcatcgacaagaaaaataaacttaacgatcgctgtacactggttaccaattgcgtgattaagggcagagaggtgcggaaggggcaatctgtcctccgccagtacaagacagaaatcaaaattggaaaggcctccacgggcagcagaaaactgctgtccgaggaacccggggacgattgtatctctcggacccagctcctgagaacagagaccgctgagatccacgacgacaactatggaggccctggcgataagattacaatctgcaatgggagcaccattgtggaccagcgccttggatccgaactgggctgttacacgatcaaccgggttaaatcttttaagctctgcgagaatagcgccaccgggaagacatgcgaaattgattccacccccgtgaaatgtagacaaggattctgcctgaagatcacacaggagggccgcgggcacgtcaaactgtctcggggcagcgaggtggttcttgacgcctgtgattccagctgcgaagtgatgattccgaagggaaccggcgacatcctcgtcgattgttctgggggacagcagcatttcctgaaagacaacctgatcgatctcggctgccctcacattcccctgcttgggaagatggctatctatatttgtagaatgtccaatcatcctcgcacaaccatggcctttctgttctggtttagcttcggatacgtgatcacgtgcatcttttgtaaggctctcttctattctctgattatcattggcacactggggaaaaagatcaaacaataccgggagcttaagccccagacctgcaccatttgtgaaacagcgccggtcaacgccatcgacgccgagatgcacgatctcaactgctcctacaatatttgcccttattgtgctagcagactgacctctgacggcctggcccgccacgtgccccagtgccctaaacggaaggaaaaggttgaggagacggaactctacctgaaccttgagagaatcccctggatcgtgcgcaaactgctccaggtctccgaaagcacaggagtggctctgaagcggtccagctggctgattgttcttctcgtgctgctgaccgtctctctcagccccgtgcaatccgcccctgtgggccatgggaaaacaatcgagacctatcagacaagagaaggatttacctctatttgtctgttcatgcttggcagcatcctgtttctcgtttcctgcctggtcaaggggctggtggactctgtgagcgattccttctttccgggactttctgtctgtaaaacgtgcaccattggcagcatcaatgggttcgagatcgagtcccacaagtgttactgcagcctcttttgttgcccctattgtcggcattgctctgcggaccgcgaaattcaccagctgcatctgtccatctgcaaaaagagaaagacaggcagcaacgtgatgctcgccgtttgtaaacggatgtgcttcagagctaccattgaggcctctcgccgggctctgcttatcagatccattatcaatacaaccttcgtgatttgtatcctgacgctcacaatctgcgtcgtgagcacctccgccgttgaaatggagaacctgccttctggaacatgggaacgcgaggaggatctgaccaatttttgtcaccaggaatgccaagtgaccgagacagaatgtctttgcccctacgaggcgctggtcctcagaaagcctctgttcctcgacagcattgtgaaaggcacgaagaacctgcttaattccaccagcctggagacatctctctccatcgaagccccctggggagctattaacgttcagagcacctttaaacctacagtgtctaccgccaatatcgctctgagctggtcctctgtcgagcaccggggaaacaagattctggtgacgggccgcagcgaatccatcatgaaacttgaggaaagaacaggggtgtcttgggatctgggagtcgaggacgccagcgagtccaagctcctgaccgttagcatcatggatctctctcagatgtattccccggtgttcgaatacctgagcggcgaccggcaagtggaggaatggcccaaggccacctgtacaggggattgccctgagcgctgtggctgcacctcctctacatgccttcataaagaatggccccacagcagaaattggcggtgtaaccctacgtggtgctggggagtcggcaccgggtgtacatgctgtggagtggacgttaaggatctgtttaccgaccatatgttcgtgaaatggaaggtcgagtacattaagacagaggctatcgtgtgcgttgaactcacctcccaggagcgccagtgttctctgattgaagcgggcacgagatttaatctggggcccgtgaccatcacacttagcgagccgcggaacattcagcaaaaactgcctcccgaaatcatcaccctccaccccaaggtcgaggagggattctttgatctgatgcatgtgcagaaagttctctccgccagcacagtgtgcaagctgcagtcttgtacccacggcattcctggcgaccttcaggtctatcacatcgggaacctgctgaaaggagaccgcattaatggccatctcatccacaagattgaaccccatttcaacacatcctggatgagctgggatgggtgcgacctggattactattgtaatatgggagactggccttcttgcacgtacaccggcgtgacacaacacaaccacgctgcctttgtgaatcttctgaacatcgagaccgattataccaagacattccattttcactccaaaagagtcacggcccatggggacaccccgcagctcgatctgaaggctcggcccacatacggagccggcgaaattaccgttctcgtggaggtggcggacatggagctgcacaccaaaaaggtcgaaatcagcggccttaaattcgcttctctggcctgcaccgggtgttatgcctgcagctccggaatctcttgtaaggtgcgcattcatgttgatgagcctgacgaactgacggtgcacgtcaaaagctccgatcccgacgtggttgctgccagcacatccctcatggcgcgcaagctggagttcggcaccgattctacctttaaggctttcagcgccatgcctaaaacatccctttgcttttacatcgtggaacgggagtactgtaagtcttgcagcgaggaagacacccagaaatgtgtcgacacaaagctggagcagccccaatccattctcatcgaacacaaagggaccattatcggaaagcagaatgatacgtgcacagccaaggcttcttgttggctggagagcgtgaaatccttcttttatggcctcaagaacatgctggggagcgtcttcggaaactttttcatcggcattcttctgtttctggccccgttcgtgctcctggttctgtttttcatgttcggctggaaaatcctgttttgcttcaagtgttgcagacgcacccgggggctcctgaaatacagacatctcaaggacgatgaagagacaggatatcgccggattatcgagagactgaataataagaaaggcaagaaccgccttctggacggggaacggctggctgatagaaaaattgccgagctcttttctaccaagacgcacatcggatga

SEQ ID NO: 13706 - RNA, 5052 nt, synthetic construct
  misc_feature 1..5052: note = derived and/or modified CDS sequence (opt5) from CCHFV(Kosovo/9553/2001)__AY675511.1__GP
  source 1..5052: mol_type = other RNA
atgcacaccctgctcgtgtgcttcatcctgtaccttcagctgctcggcctgggaggagcccatggccaaagcaacgctacagagcacaatgggacgaacaccacaaccgcccccggaacatcccagtctcctaagccgcccgcgagcaccacaccttcccatgctcccgaatctagcaccattaaacttacgacccctacatccgagaccgaaggctctggggagacaacgccccctaccagcacaacccagggatccccgcccctggaaacaacccctgagagaagcaccacaacggccacctctacatccggcaccgacaatatgaacagcacaacccagatgacggataatacacccaccctcaccgcctctacatcccctagctcctcccccagcaccccgtccacatctcaaggcctgcactatcctgtccggagcctgctctccgttagctctcccaagacggtgaccacacctacccccatgtcccccggggagatgagctctgaaacaagctcccagcattctgctatgagccgcacccctacgccgcacaccgccacacaggtgtccaccgagaacgctaatagaagcacatctcggcagtccgaaagctctgcccaacccgcgacccagtcccctgtcacgagccccgcccagtccatcctgcttatgtctgctacacctaccacaattcagaacatccaccccagcccgaccaatcgctccaaaagaaacctggagatggagattatcctcaccctgtctcaaggacttaagaaatactatggcaagatcctgaagctcctgcatctgacactcgaagaggacacggaagggctgcttgagtggtgtaaacggaatctgggaagcaactgcgatgacgactttttccagaagcgcattgaagagtttttcatcaccggcgaggggtactttaatgaagtgctccagttcaaaacactgtccacccctagccccacagagccttctcacgccagacttcccaccgctgaaccttttaagtcctatttcgccaaaggatttctgagcattgattctggctacttctccgcgaagtgttatccccggagctctacgagcggcctccaactgatcaacgttacacagcatccggcccgcattgctgagacccctgggcccaagatcacctccctgaaaacaattaattgcatcaacctcagagccagcgtgtttaaggaacaccgggaggtcgagatcaacgtgctgcttccccagattgctgttaatctgtctaactgtcacgtggtcatcaattcccatgtgtgcgattacagcctcgacaccgatggacctgtgcgcctgccgagaatttaccacgaaggcacattcatgcccgggacgtataaaatcgtcattgaccggaagaacaaacttaatgatcgctgtaccctggttacaaactgcgtgatcaagggaagagaggtgcggaaaggccagtccgtcctcagacaatacaagaccgaaatcaagattgggaaagcccctacaggatctcgcaagctgctgagcgaggaacccggcgacgattgtatctcccggacccagctcctgagaacggagaccgccgagattcatgacgacaattatggcgggcctggagataaaatcacaatttgcaacggctctaccatcgtggaccagcgccttgggagcgaactgggatgttacacaatcaatcgggttaagtcctttaaactctgcgagaactctgctaccggcaagacatgcgaaattgatagcacccccgtgaagtgtagacaggggttctgcctgaaaatcacgcaagagggccgcggacacgtcaagctgtcccggggcagcgaggtggttcttgacgcgtgtgattcttcctgcgaagtgatgattcctaaagggacaggagacatcctcgtcgattgtagcggcgggcagcagcatttcctgaaggacaatctgattgatctcggatgcccccacatcccgctgcttggcaaaatggccatttatatcgctagaatgtctaaccaccctaagaccaccatggcctttctgttctggttttccctcgggtacgtgatcacatgtattctgtgcaaggccctgttctatagccttatcattatcggcaccctcgggaaaaagattaaacagtaccgcgagctgaagccccaaacgtgtacaatctgcgaaaccgctcctgtcaatgccatcgacgcggagatgcatgatctgaactgttcttacaatatttgcccctattgcgcttcccggctcacaagcgacggcctggccagacacgtgaaacagtgtccgaagcgcaaggaaaaagttgaggagaccgaactttacctgaacctcgagcggatcccttgggtggtcagaaagctgctccaggtgtccgaaagcacaggggttgcccttaaacggtctagctggctcattgtgctgctggtcctcctgaccgtgtccctttctcccgtgcagagcgctcctgttggacatggcaagacgatcgagacctatcaaacacgcgaagggtttacctccatttgcctgttcatgctcggatctatcctgtttatcgtcagctgtctggtgaaaggccttgtggactccgtctctgatagcttctttcccgggctctccgtgtgcaagacatgtagcattggctctatcaacggattcgagattgagtcccacaaatgctactgtagcctgttttgctgtccctattgcagacactgttctgccgaccgggaaatccatcagctgcacctctccatttgcaagaagagaaaaaccggcagcaatgttatgctggctgtgtgcaagcgcatgtgtttccgggccacgatcgaggcgtccagacgcgcccttctgatcagatctattatcaacacaacctttgtcatttgcatcctcacactgaccatttgtgtggctagcacctccgccgttgaaatggagacactgcctgctgccacgtgggaacgggaggaggatcttaccaatttctgccatcaggaatgtcaagtgccggagacagaatgcctgtgtccctacgaggcgctcgtcctgcgcaaacctctcttcctggacagcatcgtgaaggggatgaaaaaccttctcaattctacctccctggagacaagcctgtctattgaagccccctggggagctatcaacgttcagagcacctttaagcctacggtgtccacagccaatatcgctctgtcttggagctccgtcgagcacagaggcaacaagattcttgtgaccgggcggtctgaaagcatcatgaaactggaggaacgcaccggagtgtcctgggatctcggcgtcgaggacgccagcgagtctaagctgctcacagtttccattatggatctgagccagatgtattcccccgtgttcgaatacctttctggggacagacaggtggaggaatggcctaaagctacctgcacaggcgattgtccggagcggtgcggatgtacgagctctacctgcctgcataaggaatggccccactctcgcaattggagatgcaaccctacatggtgttggggcgtcgggaccggatgcacatgttgcggcgtggacgttaaagatctctttaccgaccacatgttcgtgaagtggaaggtcgagtacatcaaaacggaggccattgtgtgtgttgaactgaccagccaagagcggcagtgctccctgatcgaagcggggacacgctttaatcttggacccgtgaccatcacactgagcgagcctagaaacattcagcagaagctgcccccggaaatcattaccctgcatcctaaaatcgaggagggcttctttgatctcatgcacgtccaaaaggtgctgtctgcctccacagtttgtaaacttcagagctgcacgcatggcattcccggggacctccaggtgtatcacatcggaaatctgctgaagggcgaccgggtcaacgggcatctgatccacaagattgaaccccacttcaatacctcttggatgtcctgggatggatgtgaccttgattactattgcaacatgggcgactggcctagctgtacatacaccggggtgacccagcataaccacgctgcctttgtgaatctgctcaacatcgagacagattatacgaaaaccttccattttcactctaagagagtcacagcccacggagacacaccccaactggatctcaaagctcgccctacctacggcgccggcgaaattaccgttctggtggaggtggcggacatggagcttcatacgaagaaagtcgaaatcagcgggctgaagttcgcttccctggcctgcacaggatgctatgcctgttctagcggcatttcctgcaaagtgcggatccacgttgatgagccggacgaactcaccgtgcatgtcaagagctccgatcccgacgtggttgctgcctctaccagcctgatggcgagaaaacttgagtttgggacagattccaccttcaaggctttctctgccatgcctaagacaagcctgtgtttttacattgtggaaaaagagtactgcaagtcctgttctgaggacgacaccaaaaagtgcgtcgatacgaagctcgaacagccccagagcatcctgatcgagcaccgcggaacaattatcggcaaacctaatgacacctgtcccgccaagacatcctgctggctcgaaagcgtgaaatctttcttttatgggctgaagaacatgcttggatccgtcttcggcaactttttcattggcatcctgctgtttctcgctccgttctttctgtggatgcttagcttcatgtttgggtggaaaattctgttctgtttcaagtgctgtcggagaacccgcggactctttaagtaccggcatctgaaagatgacgaggaaacgggctatagacgcatcatcgagcggctcaataataagaaagggaagaacagactgcttgatggagagcggctggccgaccgcaaaattgctgaactgttctctaccaagacacacatcggctga

SEQ ID NO: 13707 - RNA, 5052 nt, synthetic construct
  misc_feature 1..5052: note = derived and/or modified CDS sequence (opt5) from CCHFV(4495-ST-2008)__KR814869.1__GP
  source 1..5052: mol_type = other RNA
atgcacaccctgctcgtgtgcttcatcctgtaccttcagctgctcggccccgggggagcccatggccaacctaacgctacagagcacaatagaacgaacaccacaaccgccccgagcacatcccagtctcccaagcctcccgtcagcaccgcgcctccccatgctctggagtcccctacaattaaatctaccacgccgaccagcgagacagaagggtccggagagaccacaccccctcccaataccacgcagggcccttctcccccggaaacaacccctgagcggcccgccacaaccgccaccagcacaccttccacggacaacaccaatagcacaacccacgttacagataacaatcccacctctacgatctccacaagcccctcttccagcccttctaccccgtccacaccccgcgggattcatcaccctgctagaaaccttctgagcgtgtcctctcccaagaccgccaccacacctacgcccaccagcccgggagagatctccagcgaaacatcttccctccacagcgctatgtctcggaccagcacactgtataccgccacgcaggcgtccaccgagaatgccaaccattctacacctcgccaaagcgaatcccccgctcagcctaccacaaccagcctgatgacgtctcccgcccagtccattctcgtgatgagcgctgcccctacagcgatccagaatatccacccctctccgaccaacagatccaaacggaatctggagatggagattatccttacactgagccaaggcctcaagaaatactatggcaagattctgaaacttctgcatctcaccctggaagaggacaccgaagggctgctcgagtggtgtaagcgcaacctgggatccaattgcgatgacgactttttccagaagagaatcgaagagtttttcatgacaggcgaggggtactttaacgaagtccttcagttcaaaacgctgtctaccctcagccctacagagccctcccacgcccggccccctaccgtggaaccgtttaagtcttatttcgctaaaggatttctgagcattgattccggctacttcagcgccaagtgttatcccagatcttccacaagcgggcttcagctgatcaacgttacccaacaccctgctcgcattgccgagacgcccggacctaagacaacctctctcaaaaccatcaattgcatcaacctgcgggcctccgtgtttaaggaacatcgcgagattgagatcaatgtcctgctcccccagattgctgtgaacctgagcaattgtcacgttgtgatcaactctcatgtctgcgattacagccttgacacagatggccctgtgagactgccccacatttaccatgaaggcaccttcatcccggggacatataaaatcgtgattgacaagaaaaataagctcaacgatcggtgtacgctggtcaccaattgcgttatcaaaggacgcgaggtgagaaagggccagtccgtgcttcggcaatacaagacagaaattaaaatcgggaaggtcagcaccggatctagaaaactgctctccgaggaaagcggcgacgattgtatttcccgcacacagctgctgcggaccgagacggcggagatccacgacgacaactatgggggacctggcgataagatcaccatttgcaatggctctacaatcgtggaccagagactcgggagcgaactgggatgttacaccattaaccgcgttaaatcctttaaactttgcgaaaattctgccacaggcaagacctgcgagatcgatagcacacccgtgaagtgtcggcaggggttctgcctgaagattacccaagagggaagaggccacgtcaaactctcccgcgggtctgaggtggttctggacgcttgtgatagctcctgcgaagtgatgatccctaagggcacgggagacattctggtcgattgtagcggcgggcagcagcatttccttaaagacaacctcatcgatctgggatgcccccacatcccgctgctcggcaagatggccatttatatctgtcggatgtctaatcatcctagaacaaccatggcctttctgttctggttttccttcgggtacgtgattacctgcctgttttgtaaggctcttttctatagcctcatcattatcggaacactgggcaaaaagatcaaacagtaccgcgagctgcggccccaaacctgcacgatttgtgaaacagcccctgtcaacgcgatcgacgctgagatgcacgatcttaactgctcttacaatatttgcccctattgtgcctccagactcaccagcgacgggctggcccgccacgtgccccagtgccctaagcggaaagaaaaggttgaggagacagaactgtacctcaacctggagagaatcccgtggattgtgcggaaacttctgcaggtctctgaatccaccggcgtggctctcaagcgcagctcctggctgatcgttctgcttgtgctcctgacagtcagcctgtctcccgtgcagagcgcccctgtgggacatggcaagaccatcgagacgtatcaaaccagagaagggtttacatccatttgtctcttcatgctgggatctatcctttttctggttagctgcctcgtcaaaggcctggtggactccgtgtctgatagcttctttcccgggctgtccgtctgtaagacctgctctattggaagcatcaatggcttcgagattgagtcccacaaatgttactgcagccttctctgttgcccttattgtcggcattgctctgctgacagagaaatccaccagctgcatctgtccatctgcaagaaacgcaagacagggagcaacgtgatgctcgccgtttgtaagcggatgtgctttagagcgaccattgaggcctctcgcagagctctgcttatccggtccattatcaatacgacattcgtgatttgtatcctgaccctcacaatttgcgtcgtgagcacctccgccgttgaaatggagaacctgccctctggcacctgggaaaaagaggaggatctgacaaatttctgtcaccaggaatgccaggtgacggagaccgaatgtctttgcccttacgaggctctggtcctccgcaagccgctgtttctcgacagcatcgtgaaaggaatgaagaacctgcttaattccacaagcctggagacctctctctccatcgaagccccctggggcgcgattaacgttcaaagcacattcaaacctaccgtgtctacggccaatatcgctctgagctggtcctctgtcgagcacagagggaacaagattctggtgacaggacggagcgaatccatcatgaaacttgaggaacgcaccggcatttcttgggatctgggggtggaggacgccagcgagtccaagctcctgaccgtcagcatcatggatctctctcagatgtattcccccgtttttgaatacctgagcggagacagacaggtggaggaatggcctaaggctacatgtaccggcgattgccccgagcggtgtgggtgcacatcctctacgtgccttcataaagaatggccgcacagccgcaattggagatgtaaccctacctggtgctggggcgtgggaacaggctgtacctgctgtggggtcgacgtgaaggatctgttcacagaccatatgtttgttaaatggaaggtggagtacatcaagaccgaggccattgtctgcgtggaactcacgtcccaagagcggcagtgttctctgatcgaagccggaacccgcttcaatctgggccccgttacaattacccttagcgagcccagaaacatccagcagaaactgcctcccgaaattatcacactccaccctaaggtggaggaggggtttttcgatctgatgcatgtccaaaaagtgctctccgctagcaccgtttgcaagctgcagtcttgtacacacggaatcccgggcgaccttcaggtgtatcacattggcaacctgctgaaaggggaccgggtcaatggacatctcatccacaagattgaaccccattttaacacgtcctggatgagctgggatggctgcgacctggattactattgtaatatgggggactggccttcttgcacctacacaggagtgacccagcacaaccacgcggccttcgtgaatcttctgaacatcgagaccgattatacaaagacgtttcatttccactccaaaagagtcaccgctcatggcgacacaccccaactcgatctgaaggcccgccctacctacggggccggagaaattacagttctcgtggaggtggctgacatggagctgcacaccaaaaaggtcgaaatcagcggccttaaatttgcctctctggcgtgcacgggctgttatgcttgcagctccgggatttcttgtaaggtgcggatccatgttgatgagcccgacgaactgacagtgcacgtcaaaagctccgatccggacgtggttgccgccagcacctccctcatggctagaaagctggagttcggaaccgattctacattcaaggcctttagcgcgatgcctaaaacctccctttgcttctacatcgtggaacgcgagtactgtaagtcttgcagcgaggaagacacacagcggtgtgtcgacaccaaactggagcagccccagtccattctcatcgaacacaagggcacgattatcgggaaacaaaatgatacatgcaccgctaaggcctcttgttggctggagagcgtgaagtcctttttctatggactcaaaaacatgctgggcagcgtctttgggaatttctttattggaatccttctgttcctggccccttttgtgctcctggttcttttctttatgttcggctggaagatcctgttctgctttaaatgttgcagacgcgctcggggcctcctgaagtacagacatctcaaagacgatgaagagacagggtatcgcaagattatcgagcggctgaacaataagaaaggaaagaacagacttctggacggcgaacggctggccgatcgcaaaattgctgaactcttctctaccaagacgcacatcgggtga

SEQ ID NO: 13708 - RNA, 5052 nt, synthetic construct
  misc_feature 1..5052: note = derived and/or modified CDS sequence (opt5) from CCHFV(Mamon)__KX013478.1__GP
  source 1..5052: mol_type = other RNA
atgcacaccctgctcgtgtgcttcatcctgtaccttcagctgctcggccttgggggagcccatggccaaagcaacacaacggagcacaatgggaccaacacaaccacagctccctccacctctcagagccctaagccgcttgtctccacagcgccccctcatgccctggaatctagcaccattaaacccacgacccctgcttccgagacagaaggatctggcgagaccacaccccctccgaatatcacccaggggcccagccctcccgaaacgacacctgagagacccgccaccacagccacctccaccccgagcacagacaacaccaattctaccacacacgttaccgataacaatcctacatccaccattagcacgtctccctccagctctccttccacacccagcacgccccagggaatccatcaccctgctcggaacctcctgtccgtgtctagcccgaagaccgccacaacccccacacctacgtcccccggcgagattagctctaaaacctccagcctgcactctgctatgagccgcacatccaccctctatacagccacccaagtgtctacggaaaatgcgaaccatagcgcccctagacagtccgagagctctgctcagcccaccacaacctccccgatgacaagccctgcccagtctatcctggtcatgtccgctgcccccaccgcgatccaaaatattcaccctagccccacgaaccggtccaagcgcaatcttgaaatggagatcattctgacactctctcagggcctgaaaaagtactatgggaagatccttaaactgctccatctgaccctggaggaagacacagagggactcctggaatggtgtaagagaaaccttggcagcaattgcgatgacgactttttccagaaacggattgaggaatttttcatgaccggggagggatactttaacgaggtgctgcagttcaagaccctctccacactgtctcctacggaacccagccacgcccgcccgcctaccgttgagccctttaaatcctatttcgctaagggctttcttagcatcgattctgggtacttctccgccaagtgttatcccagaagctctacatccggactgcaactcattaacgtgacccagcaccctgctcggatcgccgaaacaccgggccccaaaaccacgagcctgaagacaatcaattgcattaacctgcgcgcctctgtctttaaagagcatagagaaatcgagattaatgtgctcctgcctcagatcgctgttaaccttagcaattgtcacgtggtcattaactcccatgtgtgcgattacagcctggacaccgatggccccgtgcggctccctcacatctaccatgaggggaccttcatccccggaacatataagattgtcatcgacaaaaagaataaactgaacgatcgctgtacccttgttacaaattgcgtgattaagggcagagaagtgcggaaggggcaatctgtcctgcgccagtacaaaacggagatcaagattggaaaagcgtccaccggcagcagaaagctcctgtccgaggaacctggggacgattgtatctctcggacacagctgctcagaaccgaaacagccgagatccacgacgacaactatggaggccccggcgataaaattaccatctgcaatgggagcacgattgtggaccagcgcctgggatccgagcttggctgttacaccatcaaccgggttaagtcttttaagctgtgcgaaaatagcgctacagggaaaacctgcgagattgattccacaccggtgaagtgtagacaaggattctgcctcaaaatcacccaggaaggccgcgggcacgtcaagctgtctcggggcagcgaggtggtttccgacgcctgtgatagctcttgcgaggtgatgattcctaaaggaacaggcgacatcctggtcgattgttccgggggacagcagcatttccttaaggacaacctcatcgatctgggctgcccccacattcctctgctcgggaagatggccatctatatttgtagaatgagcaatcatccccgcaccacggtggcttttctgttctggttttctttcggatacgtcatcacatgcatcttttgtaaagcccttttctattccctgattatcattggcaccctcgggaagaaaatcaagcaataccgggaactgaaaccgcagacctgcacaatttgtgagaccgcgcctgtgaacgctatcgacgccgaaatgcacgatctgaactgcagctacaatatttgcccctattgtgcctctagacttacgtccgacggcctcgctcgccacgttcctcagtgccccaagcggaaggagaaagtggaagagacagagctgtacctgaacctcgaaagaatcccctggatcgtccgcaagctgcttcaggtgagcgagtccaccggagttgccctgaaacggagctcttggctcattgtgctgctggtccttctcacagtgagcctgtcccctgtgcaatctgctccggttggccatgggaagaccatcgaaacatatcagaccagagagggatttacgagcatttgtctgttcatgctcggctccatcctgtttcttgtctcttgcctggtgaaagggctcgtggacagcgtctccgattctttctttcccggactgagcgtgtgtaagacctgctccattggcagcatcaatgggttcgaaatcgagtctcacaaatgttactgctccctgttttgttgcccttattgtcggcattgcagcgccgaccgcgagattcaccagcttcatctctctatctgcaagaagagaaaaacaggctccaacgttatgctggcggtgtgtaagcggatgtgcttcagagccaccattgaagctagccgccgggccctgctcatcagatccattatcaatacaaccttcgtcatttgtatcctgacgcttacaatctgcgtggtttctaccagcgctgtggagatggaaaacctgccctccggaacatgggagcgcgaagaggatctcaccaatttttgtcaccaggagtgccaagtcaccgaaacagagtgtctgtgcccttacgaagccctggtgcttagaaaacccctgttcctcgacagcattgttaagggcatgaaaaacctgctcaattctacgtccctggagaccagcctttctatcgaggcgccttggggagccattaacgtgcagagcacatttaagccgaccgtctccacagctaatatcgccctgtcttggagctccgtggaacaccgggggaacaagattctcgtgaccggccgctctgagagcatcatgaaactggaagagagaacgggggtctcctgggatctgggagttgaagacgctagcgagtctaagctgctgacagtgtccatcatggatctcagccagatgtattcccccgtgttcgagtacctgtctggcgaccggcaagtcgaagagtggcctaaagccacctgtaccggggattgccccgaacgctgtggctgcacaagctctacctgcctccataaggagtggcctcactccagaaattggcggtgtaaccccacatggtgctggggagtgggcacggggtgtacctgctgtggagttgacgtgaaagatctgtttacagaccatatgttcgtcaagtggaaggtggaatacattaaaaccgaggccatcgtttgcgtggagcttacaagccaggaacgccagtgttccctgattgaggctggcaccagatttaatctcgggccggtcacgatcaccctgagcgaacctcggaacattcagcaaaagctgcctcccgagatcatcacacttcaccccaaagtggaagagggattctttgatctgatgcatgttcagaaggtgctctctgcgtccaccgtctgcaaactgcagagctgtacacacggcattcccggcgacctccaggtgtatcacatcgggaacctgcttaagggagaccgcgtgaatggccatctgattcacaagatcgagcctcatttcaacacctcttggatgtcctgggatgggtgcgacctggattactattgtaatatgggagactggccgagctgcacatacacgggcgtcacccaacacaaccacgccgcttttgttaatctcctgaacattgaaacagattataccaaaaccttccattttcactctaagagagtgacagcccatggggacacgccccagcttgatctgaaagcccggcctacctacggagctggcgagatcacagtgctcgtcgaagtggccgacatggagctgcacaccaagaaagttgagattagcggcctcaagttcgcgtccctggcttgcacagggtgttatgcctgctctagcggaatctcctgtaaagtgagaatccatgtcgatgaacccgacgagcttaccgtgcacgttaagagctccgatcctgacgtggtcgccgcttctacgagcctgatggcccgcaagctggagttcggcacagattccacctttaaagcgttctctgctatgcccaagaccagcctctgcttttacattgtggaacgggaatactgtaaatcctgctctgaggaggacacacagaagtgtgtcgacaccaaactggaacagccgcaaagcatccttattgagcacaaggggacaatcattggaaagcagaatgatacctgcacggccaaaacatcctgttggctggaaagcgtgaagtctttcttttatggcctcaaaaacatgctggggtccgttttcggaaactttttcatcggcatcctcctgtttcttgcccctttcgtgctgctggtcctctttttcatgttcggctggaagattctgttttgcttcaaatgttgcagacgcacccgggggcttctgaagtacagacatctcaaggacgatgaggaaacaggatatcgccggatcattgagagactgaataataaaaagggcaaaaaccgcctcctggacggggagcggcttgctgatagaaagatcgccgaactgtttagcaccaaaacgcacattggatga

SEQ ID NO: 13709 - RNA, 5052 nt, synthetic construct
  misc_feature 1..5052: note = derived and/or modified CDS sequence (opt5) from CCHFV(81-R-2014)__KR814865.1__GP
  source 1..5052: mol_type = other RNA
atgcacaccctgctcgtgtgcttcatcctgtaccttcagctgctcggccttgggggagcccatggccaaagcaacgctacagagcacaatgggacgaacaccacaaccgtcccctccacatctcagagccctaagccgcttgtttccaccacaccccctcatgccctggaatctagcaccattaaacccacgacccctacatccgagaccgaaggatctggcgagacagcgcccctccctaataccacgcaggggccgccccctcccgaaacaacccctgagagacccgctacaaccgtgaccagcacaccgtccacggacaacaccaatagcacaatccacgtgaccgataacaatcctacatctaccatttccacgagcccctcttccagcccttctacaccctccacaccccagggaatccatcaccctgcccggagcctgctgtccgtctctagcccgaagaccgccacaacccccacacctacgtcccccggcgagattaacagcgaaacctcttccctccacagcgctatgtctcgcacacctaccctgcatacagccacccaagtgagcacggagaatgctaaccactccgcccccagacagtctgaaagctccgcgcagccgaccacaaccagccttatgacatctcctgcccagtccatcctgctcatgagcgctgcccccaccgctatccaaaatacgcatccttctcccacaaaccggtccaaacgcaatctggagatggagattatccttaccctgagccagggcctcaagaaatattacgggaagattctgaagctgctccacctgacacttgaagaggacaccgaaggactgctcgagtggtgtaaaagaaacctgggctccaattgcgatgacgactttttccagaagcggatcggggaatttttcatgaccggagagggctattttaacgaggttcttcagttcaaaacactgtctacgctcagccctaccgaaccctcccacgcccgcctgccgacagtggagccttttaagtcttacttcgcgaaagggtttctgagcattgattccggatatttcagcgccaagtgttaccccagatcttccaccagcggcctccaactgatcaacgtcacacagcatcccgctcggattgccgaaacccctggcccgaagacgacatctcttaaaaccatcaattgcatcaacctgcgcgcttccgtgtttaaggagcacagagaaattgagatcaatgttctcctgccccagattgccgtgaaccttagcaattgtcatgtcgtgatcaactctcacgtgtgcgattatagcctggacaccgatgggcctgtccggctcccccatatttaccacgagggaacattcatccctggcacctacaaaatcgttattgacaagaaaaataagctgaacgatcgctgtacactggtgacgaattgcgtgatcaaagggagagaagtccggaagggacaatccgtgctccgccagtataagaccgagattaaaatcggcaaggccagcacagggtctagaaaactgctttccgaggaacccggagacgattgtattagccggacccagctgctcagaacagaaaccgctgagatccacgacgacaactacggcggccctggggataagatcacgatttgcaatggatccaccatcgttgaccagcgcctgggctctgagctggggtgttatacaattaaccgggtgaaatcctttaagctgtgcgaaaatagcgcgaccggaaagacatgcgagatcgattctacccccgtcaaatgtagacaaggcttctgcctcaagattacacaggaagggcgcggccatgtgaaactgagccggggatccgaggttgtgctggacgcctgtgattctagctgcgaggtcatgatcccgaagggcaccggggacattctcgtggattgttccggaggccagcagcacttcctgaaagacaaccttatcgatctggggtgccctcatatccccctcctgggaaagatggctatttacatctgtagaatgagcaatcaccctcgcacgacaatggcctttctgttctggttttctttcggctatgtcattacctgcatcttttgtaaggcccttttctactccctcattatcatcgggaccctgggcaaaaagattaaacaatatcgggaactgaagccccagacatgcaccatctgtgagacggctccggtgaacgccattgacgcggaaatgcacgatctcaactgcagctacaatatctgcccttactgtgcttctagactgacatccgacggacttgcccgccatgttccccagtgccctaaacggaaggagaaggtggaagagaccgagctgtatctcaacctggaacgcattccctggatcgtcagaaaactgcttcaggtgagcgagtctacaggcgttgccctcaagcggtccagctggctgatcgtgctgctcgtcctgcttaccgtgtccctgagccccgtgcaatctgctcctgttgggcacggaaaaacaattgaaacctaccagacgagagagggctttaccagcatctgtctcttcatgctggggtccattctgtttcttgtctcttgcctcgtgaagggactggtggacagcgtctccgattctttctttccgggcctgagcgtgtgtaaaacatgctccatcgggtctattaatggcttcgaaatcgagagccataagtgttattgctccctcttttgttgcccctactgtcggcactgcagcgccgaccgcgagatccatcagctgcacctttctatttgcaaaaagagaaagaccggatccaacgttatgctggctgtgtgtaaacggatgtgcttcagagccacaatcgaagcgagccgccgggccctcctgattagatctatcattaataccacgttcgtcatctgtattctgacacttaccatctgcgtggtttccacaagcgctgtggagatggaaaacctgcctgccggcacctgggagcgcgaagaggatctcaccaatttttgtcaccaggagtgccaagtcacagaaacggagtgtctgtgcccctatgaagctctcgtgctgagaaagcctcttttcctggactccatcgttaaagggatgaagaacctccttaattctaccagcctggagacatccctgagcattgaggccccctggggagcgatcaacgtgcagtctacctttaaacctacagtctccaccgccaatattgctctgagctggtctagcgtggaacatcggggcaacaagatcctcgtgacggggcgctccgagtctattatgaagctggaagagagaacaggagtcagctgggatctcggcgttgaagacgcctccgagtctaaactgcttaccgtgagcatcatggatctgtcccagatgtacagcccggtgttcgagtatctctctggggaccggcaagtcgaagagtggcccaaggctacctgtacaggcgattgccctgaacgctgtggatgcacctccagcacatgcctgcacaaagagtggccccattccagaaattggcggtgtaaccctacgtggtgctggggcgtggggaccggatgtacatgctgtggcgttgacgtgaaggatctgtttaccgaccacatgttcgtcaaatggaaggtggaatacatcaagacagaggccattgtttgcgtggagcttacctctcaggaacgccagtgtagcctgatcgaggccgggacgagatttaatctcggacccgtcaccattacactgtccgaaccgcggaacatccagcaaaaactccctcccgagattatcaccctgcatcccaaggtggaagagggcttctttgatcttatgcacgttcagaaagtgctgtctgctagcacagtctgcaagctgcagtcctgtacccacggcatccctggggacctccaggtgtaccatattggaaacctgcttaaaggcgaccgcatcaatgggcacctgattcataagatcgagccccacttcaacacaagctggatgtcttgggatggatgcgacctcgattattactgtaatatgggcgactggccttcctgcacgtataccggggtgacacaacacaaccatgcggcctttgtcaatctgctcaacattgaaaccgattacaccaagacattccactttcatagcaaaagagttacggctcacggagacaccccgcagctggatcttaaggcccggcccacatatggcgccggcgagatcaccgtgctggtggaagtcgctgacatggagctgcataccaaaaaggtggagatttctgggctcaaattcgcctccctggcgtgcaccggatgttacgcttgcagctctggcatcagctgtaaggttagaatccacgtggatgaacctgacgagcttacggtccacgtgaaatcctctgatcccgacgttgtggccgccagcacatccctgatggctcgcaagctcgagttcgggaccgatagcacctttaaggccttctccgcgatgcctaaaacatctctgtgcttttatattgtcgaacgggaatactgtaagagctgctccgaggaggacacccagaaatgtgtggacacaagactcgaacagccccaatctatcctgattgagcataagggaaccatcattggcaaacagaatgatacgtgcacagctaaggccagctgttggcttgaatccgtcaagtctttcttttacgggctgaaaaacatgctgggaagcgtgttcggcaactttttcatcggcatcctcctgtttcttgccccgttcgttctgctcgtgctgtttttcatgttcgggtggaagattctcttttgcttcaaatgttgccgccggaccagaggactgcttaagtatcgccacctgaaagacgatgaggaaacaggctaccggagaatcattgagcgcctgaataataagaaggggaaaaaccggctcctggacggagagagacttgctgatcggaagatcgccgaactgttttccaccaaaacgcatattggctga

SEQ ID NO: 13710 - RNA, 5052 nt, synthetic construct
  misc_feature 1..5052: note = derived and/or modified CDS sequence (opt5) from CCHFV(5180-R-2011)__KR814874.1__GP
  source 1..5052: mol_type = other RNA
atgcacaccctgctcgtgtgcttcatcctgtaccttcagctgctcggccttgggggagcccatagacaaagcaacgctacagagcacaatggcacgaacaccacaaccgccccctccacatctcagagccctaagccgcccgtctccaccgcgcctccctatgctcctgaatctagcacaattaaacccaccacgcctgcctccgagaccgaagggtctggagagacaaccccgccccctaatacaacccagggccccagccctcccgaagccacgccggagcggcctgctacaaccgccacatccacccccagcaccgacaacacaaattctacgacccatgctacagataacaatcctacctccacaatcagcacctctccctccagctctccctccacgcctagcacaccgcaggggattcaccatcccgcccgcaacctgctgtccgtttctagccctaagaccgcgaccacacccacccctacatcccccggagacatcagctctgagacgtccagcctccactctgccatgagcagaaccccgacactgcacaccgctacacaagcctccaccgaaaatgctaaccattctgcccctcggcagagcgagtccagcgcgcagcagacgaccacatctcccatgacctcccctgcccaacccattctggtgatgagcgctgcccctacagctatccagaatatccacccctctccgaccaaccgctccaaaagaaatctcgaaatggagattatcctgacgcttagccagggcctgaagaaatactatggcaagattctcaagctgcttcatctgacactcgaggaagataccgaggggctgctggaatggtgtaaacggaacctcggatccaattgcgacgatgactttttccagaagcgcatcgaggaatttttcatgacaggcgaggggtactttaacgaggtgctgcaattcaaaaccctttctaccctgagccctacagaaccctcccacgccagaccccctacggtcgagccgtttaagtcttatttcgccaaaggatttctcagcattgattccggctacttcagcgctaagtgttatccccggctgtctacctccgggcttcagctgatcaacgtgacacagcaccctgcgcgcattgccgaaacccccggacctaagacaaccagcctcaaaacgatcaattgcatcaacctgagagcttctgtttttaaggagcatcgggaaattgagatcaatgtgctgctcccccaaattgccgtcaacctgtccaattgtcacgtggttatcaacagccatgtgtgcgactactctcttgatacagacggccctgtccgcctgccccacatttaccatgagggcaccttcatcccggggacctataaaatcgtgattgataagaaaaataagctcaacgacagatgtacactggtgaccaattgcgtcatcaaaggacgggaaattcgcaagggccagagcgttcttagacagtacaagacagagatcaaaattgggaaggcctccacgggaagccggaaactgctctctgaagaacctggcgatgactgtatctccagaacccagctgctgcgcacagaaaccgctgagatccacgacgataactatgggggacccggcgacaagattacaatctgcaatggcagcaccattgtggatcaacggctcgggtccgagctgggatgttacacgatcaacagagtgaaatcttttaaactttgcgaaaatagcgccaccggcaagacatgcgagattgactccacccctgtcaaatgtcgccaggggttctgcctgaagatcacacaggaaggacggggccacgtgaaactctctagagggagcgaggttgtgctggatgcgtgtgacacctcctgcgaggtcatgattcccaagggcacaggagatatcctggtggactgttctggcgggcagcaacatttccttaaagataacctcatcgacctgggatgcccgcacattcctctgctcggcaagatggctatctatatttgtcgcatgagcaatcatccccggaccacgatggcctttctgttctggttttccttcgggtacgttatcacatgcattttctgtaaggcccttttctatagcctgatcatcattggaaccctcggcaaaaagatcaaacagtacagagaactgaagcctcagacctgcacaatttgtgagaccgctcccgtgaacgccatcgatgctgaaatgcacgacctgaactgctcttacaatatttgcccctattgtgcctcccgccttacgagcgacgggctcgcgcggcacgtccctcagtgcccgaaaagaaaggagaaggtggaagagacagagctgtacctgaacctcgaacgcatcccctggatcgtccggaaactgcttcaagtgtctgagtccaccggcgttgccctgaagagaagctcttggctcattgtgctgctggtccttctcacagtgtccctgagccctgttcagtccgctcccgtgggacatggcaaaaccatcgaaacatatcagacccgggaggggtttacgagcgtctgtctgttcatgctcggatctattctgtttcttgtgagctgcctggtgaagggcctcgttgattccgtctctgacagcttctttcctgggctgtccgtgtgtaaaacctgctctatcggaagcattaatggcttcgaaatcgagtcccacaagtgttactgctctctgttttgttgcccctattgtcgccattgcagcgccgatagagagatccaccagcttcatctctccatttgcaaaaagcggaagatggggagcaacgtgatgctggctgtctgtaaaagaatgtgcttccgcgccacaatcgaagcgtctcggagagccctgctcattcgctccatcattaataccacattcgtgatctgtattctgacccttacgatctgcgttgtgagcacatctgctgtcgagatggaaaacctgccttccggcacctgggagagagaagaggacctcacaaatttttgtcaccaagagtgccaggtgaccgaaaccgagtgtctgtgcccgtacgaagccctggttcttcggaagcccctgttcctcgatagcatcgtgaaaggaatgaagaacctgctcaattccacatctctggagacgagcctttccattgaggctccttggggcgccatcaacgtccagagcacctttaaacccacagtgtctaccgccaatattgctctgtcctggagctctgttgaacaccgcgggaacaagatcctcgtgacaggaagaagcgagtccattatgaagctggaggagcggaccggcgtctcttgggacctgggggtggaagatgcgagcgagtccaaacttctgacggtgtctatcatggacctcagccaaatgtattcccctgtcttcgagtacctgagcggagatcgccaggttgaagagtggcccaaggccacatgtaccggcgactgcccggaaagatgtgggtgcacctcttccacatgcctccataaagagtggcctcacagccggaattggcgctgtaaccccacctggtgctggggcgtgggaacaggctgtacgtgctgtggggtggatgtcaaggacctgtttaccgatcatatgttcgtgaaatggaaggttgaatacatcaagacagaggctattgtgtgcgtcgagcttacctcccaggaaagacagtgttctctgatcgaggccggaacacggtttaatctcggccccgtgaccattacgctgagcgaacctcgcaacatccaacagaaactgccccctgagattatcacccttcacccgaaggttgaagaggggttctttgacctgatgcatgtgcagaaagtcctctccgcctctacagtgtgcaagctgcagagctgtacccacggaatccccggcgacctccaagtttatcacattggcaacctgcttaaaggggatagagtgaatggacatctgatccacaagattgagcctcatttcaacacatcctggatgagctgggacggctgcgatctggactactattgtaatatgggggattggccctcttgcacctacacaggagtcacgcagcacaaccacgctgcctttgtgaatctcctgaacatcgaaaccgactatacaaagaccttccattttcactccaaacgggtgaccgcgcatggcgatacacctcagcttgacctgaaggctagacccacgtacggggccggagagattaccgtcctcgttgaagtggccgatatggagctgcacaccaaaaaggtggagatcagcggcctcaaattcgcttctctggcctgcacaggctgttatgcgtgctccagcgggatttcttgtaaggtccgcatccatgtggacgaaccggatgagcttacagttcacgtgaaaagcaatgaccctgatgtcgtggctgcctccacctctctgatggcccggaagctggaatttggaacggacagcacatttaaggctttctccgccatgcccaaaaccagcctctgcttttacatcgttgagagagaatactgtaagtcctgctctgaggaggacacccagaaatgtgtggatacaaagctggaacaacctcagagcattcttatcgagcacaaaggcaccattatcgggaagcagaacgacacatgcaccgctaaggcctcctgttggctggaatctgtcaagagcttcttttatggactcaagaatatgctgggctccgtgttcgggaactttttcattggaatcctcctgtttcttgcgcccttcgtcctgctggtgctctttttcatgttcggctggaaaatcctgttttgcttcaagtgttgccgccggacgagaggccttctgaaataccgcctcctgaaggatgacgaggaaacagggtatcggagaattatcgagcgcctcaataacaagaaaggaaagaatcggctgcttgatggcgagagactggccgaccggaaaattgctgaactgttttctaccaagacacatatcgggtga

SEQ ID NO: 13711 - RNA, 5052 nt, synthetic construct
  misc_feature 1..5052: note = derived and/or modified CDS sequence (opt5) from CCHFV(24-R-2012)__KR814856.1__GP
  source 1..5052: mol_type = other RNA
atgcacaccctgctcgtgtgcttcatcctgtaccttcagctgctcggcctgggaggagcccatagacaaagcaacgctacagagcacaatggcacgaacaccacaaccgccccctccacatctcagagccctaagccgcccgtctccaccgcgcctccccatgctcctgaatctagcacaattaaacccaccacgcctgcctccgagaccgaagggtctggagagacaaccccgccccctaatacaacccagggccccagccctcccgaagccacgccggagcggacagctaccacagccacctccacccctagcacagacaacaccaattctaccacacacgctaccgataacaatcccacatccaccatcagcacgtctccttccagctctccctccacacccagcacccctcaggggattcatcacccggcccgcaaccttctgtccgtttctagccccaagaccgcgacaacccctacacccacgtcccctggagacatcagctctgagacctccagcctccactctgccatgagcagaacacccaccctgcatacagctacccaagcctccacggaaaatgctaaccactctgccccgcggcagagcgagtccagcgcgcagcagaccacaacctctcctatgacatcccccgcccaacctattctggtgatgagcgctgcccccaccgctatccagaatatccatccttctcccacgaaccgctccaaaagaaatctcgaaatggagattatcctgacacttagccagggcctgaagaaatattacggcaagattctcaagctgcttcacctgaccctcgaggaagatacagaggggctgctggaatggtgtaaacggaacctcggatccaattgcgacgatgactttttccagaagcgcatcgaggaatttttcatgaccggcgaggggtattttaacgaggtgctgcaattcaaaaccctttctacactgagcccgacggaaccttcccacgccagacctcccaccgtcgagccctttaagtcttacttcgccaaaggatttctcagcattgattccggctatttcagcgctaagtgttacccgcggctgtctacatccgggcttcagctgatcaacgtgacccagcatcccgcgcgcattgccgaaacacctggacccaagaccacgagcctcaaaacaatcaattgcatcaacctgagagcttctgtttttaaggagcaccgggaaattgagatcaatgtgctgctccctcaaattgccgtcaacctgtccaattgtcatgtggttatcaacagccacgtgtgcgactattctcttgataccgacggccccgtccgcctgcctcatatttaccacgagggcaccttcatccccgggacatacaaaatcgtgattgataagaaaaataagctcaacgacagatgtaccctggtgacaaattgcgtcatcaaaggacgggaagttcgcaagggccagagcgtgcttagacagtataagacggagattaaaatcgggaaggcctccaccggaagccggaaactgctctctgaagaaccgggcgatgactgtatttccagaacacagctgctgcgcaccgaaacagctgagatccacgacgataactacgggggacctggcgacaagatcaccatttgcaatggcagcacgatcgtggatcaacggctcgggtccgagctgggatgttataccattaacagagtcaaatcttttaaactttgcgaaaatagcgccacaggcaagacctgcgagatcgactccacacccgtgaagtgtcgccaggggttctgcctgaagattacccaggaaggacggggccatgttaaactctctagagggagcgaggtggtcctggatgcgtgtgacacatcctgcgaggtgatgatccctaagggcaccggagatattctggttgactgttctggcgggcagcaacacttccttaaagataacctcatcgacctgggatgcccccatatcccgctgctcggcaagatggctatttacatctgtcgcatgagcaatcaccctcggacgacaatggcctttctgttctggttttccttcgggtatgtgattacctgcatcttttgtaaggcccttttctacagcctgattatcatcggaaccctcggcaaaaagattaaacagtatagagaactgaagccccagacatgcaccatctgtgagacggctcctgtcaacgccattgatgctgaaatgcacgacctgaactgctcttacaatatctgcccctactgtgcctcccgccttacaagcgacgggctcgcgcggcatgtgccccagtgccctaaaagaaaggagaaggtcgaagagaccgagctgtatctgaacctcgaacgcattccgtggatcgtgcggaaactgcttcaagtttctgagtccacaggcgtggccctgaagagaagctcttggctcatcgtcctgctggtgcttctcaccgtttccctgagccccgtgcagtccgctcctgtcggacacggcaaaacaattgaaacctaccagacgcgggaggggtttaccagcgtgtgtctgttcatgctcggatctatcctgtttcttgtgagctgcctggttaagggcctcgtcgattccgtgtctgacagcttctttcccgggctgtccgtgtgtaaaacatgctctattggaagcatcaatggcttcgaaattgagtcccataagtgttattgctctctgttttgttgcccttactgtcgccactgcagcgccgatagagagatccatcagcttcacctctccatctgcaaaaagcggaagatggggagcaacgtcatgctggctgtgtgtaaaagaatgtgcttccgcgccaccattgaagcgtctcggagagccctgctcatccgctccattatcaatacaaccttcgttatttgtatcctgacgcttacaatttgcgtggtcagcacctctgctgtggagatggaaaacctgccctccggcacatgggagagagaagaggacctcaccaatttttgtcaccaagagtgccaggttaccgaaacagagtgtctgtgcccttatgaagccctggtgcttcggaagccgctgttcctcgatagcatcgtcaaaggaatgaagaacctgctcaattccacgtctctggagaccagcctttccatcgaggctccctggggcgccattaacgtgcagagcacatttaaacctaccgtttctacagccaatatcgctctgtcctggagctctgtggaacatcgcgggaacaagattctcgtcaccggaagaagcgagtccatcatgaagctggaggagcggacgggcgtgtcttgggacctgggggtggaagatgcgagcgagtccaaacttctgacagtctctattatggacctcagccaaatgtactcccccgttttcgagtatctgagcggagatcgccaggtggaagagtggcctaaggccacctgtaccggcgactgccccgaaagatgtgggtgcacatcttccacgtgcctccacaaagagtggccgcatagccggaattggcgctgtaaccctacatggtgctggggcgtgggaacgggctgtacctgctgtggggtcgatgtgaaggacctgtttacagatcacatgttcgttaaatggaaggtggaatacatcaagaccgaggctatcgtctgcgtggagcttacatcccaggaaagacagtgttctctgattgaggccggaacccggtttaatctcggccccgttacgatcaccctgagcgaaccccgcaacattcaacagaaactgcctcccgagatcattacacttcatcctaaggtggaagaggggttctttgacctgatgcacgtccagaaagtgctctccgcctctaccgtttgcaagctgcagagctgtacacacggaatcccgggcgacctccaagtgtaccatatcggcaacctgcttaaaggggatagagtcaatggacacctgattcataagatcgagccccacttcaacacctcctggatgagctgggacggctgcgatctggactattactgtaatatgggggattggccttcttgcacatatacgggagtgacccagcacaaccatgctgcctttgtgaatctcctgaacattgaaacagactacaccaagaccttccactttcattccaaacgggtcacagcgcacggcgatacgccccagcttgacctgaaggctagacctacctatggggccggagagatcacagttctcgtggaagtggccgatatggagctgcataccaaaaaggtcgagattagcggcctcaaattcgcttctctggcctgcacaggctgttacgcgtgctccagcgggatctcttgtaaggtgcgcattcacgttgacgaacccgatgagcttaccgtgcacgtcaaaagcaatgacccggatgtggttgctgcctccacgtctctgatggcccggaagctggagttcggaacagacagcacctttaaggctttctccgccatgcctaaaaccagcctctgcttttatatcgtggaaagagaatactgtaagtcctgctctgaggaggacacacagaaatgtgtcgataccaagctggaacaaccccagagcatccttattgagcataaaggcacaatcattgggaagcagaacgatacctgcacggctaaggcctcctgttggctggaatctgtgaaatccttcttttacggactcaagaatatgctgggcagcgtcttcgggaactttttcatcgggattctcctgtttcttgcgcctttcgtgctgctggttctctttttcatgttcggctggaaaatcctgttttgcttcaagtgttgccgccggacaagaggccttctgaaatatcgcctcctgaaggacgacgaggaaaccgggtaccggagaatcattgagcgcctcaataacaagaaaggaaagaatcggctgcttgatggcgagagactggccgaccggaaaatcgctgaactgttttctacaaagacccacattgggtga

SEQ ID NO: 13712 - RNA, 5052 nt, synthetic construct
  misc_feature 1..5052: note = derived and/or modified CDS sequence (opt5) from CCHFV(46-ST-2012)__KR814860.1__GP
  source 1..5052: mol_type = other RNA
atgcacaccctgctcgtgtgcttcatcctgtaccttcagctgctcggccttgggggagcccatggccaaagcaacgctacagagcacaatgggacgaacaccacaaccgtcccctccacatctcagagccctaagccgcttgtttccaccacaccccctcatgccctggaatctagcaccattaaacccacgacccctacatccgagaccgaaggatctggcgagacagcgcccctccctaataccacgcaggggccgccccctcccgaaacaacccctgagagacccgctacaaccgtgaccagcacaccgtccacggacaacaccagctctacaatccacgtgaccgataataaccctacatccaccattagcacgtctccctccagctctccttccacacccagcacaccccagggaatccatcaccctgcccggtccctgctgtctgtcagctccccgaagaccgccacaacccccacacctacgagccccggcgagattaattctgaaacctccagcctccactctgctatgagccgcacacctaccctgcatacagccacccaagtgtccacggagaacgctaatcactctgcccccagacagagcgaatccagcgcgcagccgaccacaacctctcttatgacatcccctgcccagagcatcctgctcatgtctgctgcccccaccgctatccaaaacattcatccttcccccacgaatcggagcaaacgcaacctggagatggagatcattcttacactgtcccagggcctcaagaaatattacgggaagatcctgaagctgctccacctgacccttgaagaggacacagaaggactgctcgagtggtgtaaaagaaatctgggctctaactgcgatgacgactttttccagaagcggattgaagagtttttcatgaccggggagggatattttaatgaagttcttcagttcaaaaccctgagcacactctcccctacggagccctctcacgcccgcctgccgaccgtggaaccttttaagagctacttcgcgaaaggctttctgtccgtcgatagcgggtatttctctgccaagtgttaccccagatccagcacatctggactccaactgatcaacgtgacccagcatcccgctcggattgccgagacacctggcccgaagaccacgtcccttaaaacaatcaactgcatcaatctgcgcgctagcgtttttaaggaacacagagagattgagatcaacgtgctcctgccccagattgccgtcaatctttctaactgtcatgtggtgatcaatagccacgtctgcgattattccctggacaccgatggccctgttcggctcccccatatttaccacgaagggaccttcatccctggaacatacaaaatcgtgattgacaagaaaaacaagctgaatgatcgctgtaccctggtgacaaactgcgtcatcaaaggcagagaggtgcggaaggggcaaagcgttctccgccagtataagacggaaattaaaatcggaaaggcctctaccggctccagaaaactgcttagcgaggaacccggggacgattgtatttcccggacacagctgctcagaaccgagacagctgagatccacgacgacaattacggaggccctggcgataagatcaccatttgcaacgggtctacgatcgtggaccagcgcctgggaagcgaactgggctgttataccattaatcgggtcaaatcctttaagctgtgcgagaactctgcgacagggaagacctgcgaaatcgatagcacacccgtgaaatgtagacaaggattctgcctcaagattacccaggagggccgcgggcatgttaaactgtcccggggctctgaggtggtcctggacgcctgtgatagctcctgcgaagtgatgatcccgaagggaacaggcgacattctcgtcgattgtagcgggggacagcagcacttcctgaaagacaatcttatcgatctgggctgccctcatatccccctcctggggaagatggctatttacatctgtagaatgtctaaccaccctcgcaccacgatggcctttctgttctggttttccttcggatatgtgattacatgcatcttttgtaaggcccttttctacagcctcattatcatcggcaccctggggaaaaagattaaacaatatcgggagctgaagccccagacctgcacaatctgtgaaaccgctccggttaatgccattgacgcggagatgcacgatctcaactgctcttacaacatctgcccttactgtgcttccagactgacgagcgacggccttgcccgccatgtgccccagtgccctaaacggaaggaaaaggtcgaggagacagaactgtatctcaatctggagcgcattccctggatcgtgagaaaactgcttcaggtttctgaatccaccggagtggccctcaagcggagctcctggctgatcgtcctgctcgtgctgcttacagtgagcctgtctcccgttcaaagcgctcctgtcggccacgggaaaaccattgagacataccagaccagagaaggatttacgtccatctgtctcttcatgctgggctctattctgtttcttgtgagctgcctcgtgaaggggctggtcgactccgtgtctgatagcttctttccgggactgtccgtttgtaaaacctgctctatcggcagcattaacgggttcgagatcgagtcccataagtgttattgcagcctcttttgttgcccctactgtcggcactgctctgccgaccgcgaaatccatcagctgcacctttccatttgcaaaaagagaaagacaggcagcaatgtgatgctggctgtctgtaaacggatgtgcttcagagccaccatcgaggcgtctcgccgggccctcctgattagatccatcattaacgctacattcgtgatctgtattctgacccttacgatctgcgttgtgagcacatccgccgtcgaaatggagtctctgcctgctggaacctgggaacgcgaggaggatctcacaaatttttgtcaccaggaatgccaagtgaccgagaccgaatgtctgtgcccctatgaggccctcgttctgagaaagcctcttttcctggacagcatcgtgaaaggcatgaagaacctccttaattccacaagcctggagacgtctctgtccattgaagcgccctggggagccatcaacgtccagagcacctttaaacctacagtgtctaccgctaatattgccctgagctggtcctctgtggagcatcgggggaacaagatcctcgtcacaggccgcagcgaatccattatgaagctggaggaaagaaccggggtttcttgggatctcggagtggaggacgctagcgagtccaaactgcttacggtgagcatcatggatctgtctcagatgtactccccggtcttcgaatatctcagcggcgaccggcaagtggaggaatggcccaaggccacatgtaccggggattgccctgagcgctgtggctgcacctcctctacatgcctgcacaaagaatggccccatagcagaaattggcggtgtaaccctacctggtgctggggagttggcacagggtgtacgtgctgtggagtggacgtcaaggatctgtttaccgaccacatgttcgtgaaatggaaggttgagtacatcaagacagaggccattgtgtgcgtcgaacttacctcccaggagcgccagtgttctctgatcgaagctggcacaagatttaatctcgggcccgtgaccattacgctgagcgagccgcggaacatccagcaaaaactccctcccgaaattatcaccctgcatcccaaggttgaggagggattctttgatcttatgcacgtgcagaaagtcctgtccgcgagcacagtgtgcaagctgcagtcttgtacccacggcatccctggcgacctccaggtgtaccatattgggaatctgcttaaaggagaccgcatcaacggccacctgattcataagatcgaaccccacttcaacacatcctggatgagctgggatgggtgcgacctcgattattactgtaatatgggagactggccttcttgcacctatacaggcgtcacgcaacacaaccatgccgcttttgttaatctgctcaacattgagaccgattacacaaagaccttccactttcattccaaaagagtgaccgcccacggggacacaccgcagctggatcttaaggcccggcccacgtatggagctggcgaaatcaccgtgctggtcgaggtggccgacatggagctgcataccaaaaaggttgaaattagcggcctcaaattcgcgtctctggcttgcaccgggtgttacgcctgcagctccggaatctcttgtaaggtgagaatccacgtcgatgagcctgacgaacttacagtgcacgttaaaagctccgatcccgacgtggtcgccgctagcacctccctgatggcccgcaagctcgagttcggcacggattctacatttaaggcgttcagcgctatgcctaaaacctccctgtgcttttatattgtggaacgggagtactgtaagtcttgcagcgaggaagacacccagaaatgtgtcgacacaagactcgagcagccccaatccatcctgattgaacataaggggaccatcattggaaaacagaatgatacatgcaccgccaaggcctcttgttggcttgagagcgtgaagtccttcttttacggcctgaaaaacatgctggggagcgttttcggaaactttttcatcggcatcctcctgtttcttgctccgttcgtgctgctcgtcctgtttttcatgttcggctggaagattctcttttgcttcaaatgttgccgccggacgagagggctgcttaagtatcgccacctgaaagacgatgaagagacaggataccggagaatcattgagcgcctgaataataagaagggcaaaaaccggctcctggacggggaaagacttgccgatcggaagatcgctgagctgttttctaccaaaacacatattggatga

SEQ ID NO: 13713 - RNA, 5052 nt, synthetic construct
  misc_feature 1..5052: note = derived and/or modified CDS sequence (opt5) from CCHFV(ROS/HUVLV-100)__DQ206448.1__GP
  source 1..5052: mol_type = other RNA
atgcacaccctgctcgtgtgcttcatcctgtaccttcagctgctcggccttgggggagcccatagacaaagcaacgctacagagcacaatggcacgaacaccacaaccgccccctccacatctcagagccctaagccgcttgtctccaccgcgccccctcatgctctggaatctagcacaattaaacccaccacgcctgtttccgagaccgaagggtctggagagacaacgccccctccgaatacaacccagggccccagccctcccgaagccacgcctgagcggcccacaaccacagccacctccaccccgagcacagacaacaccaattctaccacacacgtgaccgataacaatcctacatccaccatcagcacgtctccctccagctctccttccacacccagcacaccccaggggattcatcaccctgctcgcaacctcctgtccgtgtctagcccgaagaccgccaccacccccacacctacgtcccccggagagatcagctctgaaacctccagcctgcactctgctatgagcagaacatccaccctctatacagccacccaagtctctacggagaatgcgaaccatagcgcccctcggcagtccgaaagctctgctcagcagaccacaacctcccccatgacaagcccggcccaatctattctggtgatgtccgctgcccctaccgcgatccagaatatccaccccagccctacgaaccgctccaaaagaaatcttgagatggagattatcctgacactctctcagggcctgaagaaatactatggcaagattcttaagctgctccatctgaccctggaagaggacacagaagggctcctggagtggtgtaaacggaaccttggaagcaattgcgatgacgactttttccagaagcgcatcgaagagtttttcatgaccggcgaggggtactttaacgaagttctgcaattcaaaaccctctccacactgtctcccacggagcctagccacgccagacccccgaccgtggaaccttttaagtcctatttcgctaaaggatttcttagcattgattctggctacttctccgccaagtgttatccccggctgagcacatctgggctccagctgatcaacgtcacccagcaccccgctcgcattgccgagacacctggaccgaagaccacgtccctgaaaacaatcaattgcatcaacctcagagccagcgtgtttaaggaacatcgggagattgagatcaatgttctgcttccccaaattgctgtgaacctgtctaattgtcacgtcgtgatcaacagccatgtgtgcgattactccctcgacaccgatggccctgtccgcctgccccacatttaccatgaaggcaccttcatccctgggacatataaaatcgttattgacaagaaaaataaacttaacgatagatgtaccctggtgacaaattgcgtgatcaagggacgggaggtccgcaagggccagagcgtgctcagacagtacaagacggaaattaaaatcgggaaggcgtctaccggatcccggaaactgctgagcgaggaacccggcgacgattgtatttccagaacacagctcctgcgcaccgagacagccgagatccacgacgacaactatgggggacctggcgataagatcaccatttgcaatggctctacgatcgttgaccaacggcttgggagcgaactgggatgttacaccattaacagagtgaaatcctttaagctctgcgaaaattctgctacaggcaagacctgcgagatcgatagcacacccgtcaaatgtcgccaggggttctgcctgaagattacccaggagggacggggccacgtgaaactgtccagagggtctgaggttgtgcttgacgcctgtgatagctcctgcgaagtcatgatcccgaagggcacaggagacattctcgtggattgtagcggcgggcagcaacatttcctgaaagacaacctgatcgatctcggatgccctcacatccccctgcttggcaagatggccatttatatctgtcgcatgtctaatcatcctcggaccacgatggcttttctgttctggttttccttcgggtacgtcattacatgcatcttttgtaaggccctcttctatagcctgattatcatcggaaccctgggcaaaaagattaaacagtacagagagcttaagccccagacctgcacaatctgtgaaaccgcgccggtgaacgctattgacgccgagatgcacgatctcaactgctcttacaatatctgcccttattgtgcctcccgcctgacgagcgacgggctggctcggcacgttccccagtgccctaaaagaaaggaaaaggtggaggagacagaactctacctgaaccttgagcgcattccctggatcgtccggaaactgctccaagtgtctgaatccaccggcgttgccctgaagagaagctcctggctgatcgtgcttctcgtcctgctgacagtgagcctctctcccgtgcagagcgctcctgttggacatggcaaaaccattgagacatatcagacccgggaagggtttacgtccatctgtctgttcatgcttggatctattctgtttctcgtcagctgcctggtgaagggcctggtggactccgtctctgatagcttctttccggggctttccgtgtgtaaaacctgctctatcggaagcattaatggcttcgagatcgagtcccacaagtgttactgcagcctcttttgttgcccctattgtcgccattgctctgccgacagagaaatccaccagctgcatctgtccatttgcaaaaagcggaagacagggagcaacgttatgctcgcggtgtgtaaaagaatgtgcttccgcgccaccatcgaggcttctcggagagccctgcttattcgctccatcattaatacaaccttcgtcatctgtattctgacgctcacaatctgcgtggttagcacctccgctgtggaaatggagaacctgccttctggcacatgggaaagagaggaggatctgaccaatttttgtcaccaagaatgccaggtcaccgagacagaatgtctttgcccctacgaggccctggtgctccggaagcctctgttcctcgacagcatcgttaaaggaatgaagaacctgcttaattccacgagcctggagacctctctctccattgaagcgccctggggcgccatcaacgtgcagagcacatttaaacctaccgtctctacagctaatattgccctgagctggtcctctgtggagcaccgcgggaacaagatcctggtgaccggaagaagcgaatccattatgaaacttgaggaacggacgggcgtctcttgggatctgggggttgaggacgctagcgagtccaagctcctgacagtgagcatcatggatctctctcaaatgtattccccggtgttcgaatacctgagcggagaccgccaggtcgaggaatggcccaaggccacctgtaccggcgattgccctgagagatgtgggtgcacatcctctacctgccttcataaagaatggccccacagccggaattggcgctgtaaccctacatggtgctggggcgtgggaacgggctgtacctgctgtggggttgacgtgaaggatctgtttacagaccatatgttcgtcaaatggaaggtggagtacatcaagaccgaggccattgtttgcgtggaactcacatcccaggagagacagtgttctctgatcgaagctggaacccggtttaatctgggccccgtcacgattacccttagcgagccgcgcaacatccaacagaaactgcctcccgaaattatcacactccaccccaaggtggaggaggggttctttgatctgatgcatgttcagaaagtgctctccgcgagcaccgtctgcaagctgcagtcttgtacacacggaatccctggcgaccttcaagtgtatcacattggcaacctgctgaaaggggacagagtgaatggacatctcatccacaagattgaaccccatttcaacacctcctggatgagctgggatggctgcgacctggattactattgtaatatgggggactggccttcttgcacatacacgggagtcacccagcacaaccacgccgcttttgttaatcttctgaacatcgagacagattataccaagaccttccattttcactccaaacgggtgacagcccatggcgacacgccgcagctcgatctgaaggccagacccacctacggggctggagaaattacagtgctcgtcgaggtggccgacatggagctgcacaccaaaaaggttgaaatcagcggccttaaattcgcgtctctggcttgcacaggctgttatgcctgcagctccgggatttcttgtaaggtgcgcatccatgtcgatgagcctgacgaactgaccgtgcacgttaaaagctccgatcccgacgtggtcgccgctagcacgtccctcatggcccggaagctggagttcggaacagattctacctttaaggcgttcagcgctatgcctaaaacctccctttgcttttacatcgtggaaagagagtactgtaagtcttgcagcgaggaagacacacagaaatgtgtcgacaccaagctggagcaaccccagtccattctcatcgaacacaaaggcacaattatcgggaagcagaatgatacctgcacggccaaggcctcttgttggctggagagcgtgaaatccttcttttatggactcaagaacatgctgggcagcgttttcgggaactttttcattggaatccttctgtttctggctccgttcgtgctcctggtcctgtttttcatgttcggctggaaaatcctgttttgcttcaagtgttgccgccggacaagaggcctcctgaaataccgcctcctgaaggacgatgaagagaccgggtatcggagaattatcgagcgccttaataataagaaaggaaagaaccggctgctggacggcgaaagactcgccgatcggaaaattgctgagctgttttctacaaagacccatatcgggtga

SEQ ID NO: 13714 - RNA, 5052 nt, synthetic construct
  misc_feature 1..5052: note = derived and/or modified CDS sequence (opt5) from CCHFV(Saf)__KX013487.1__GP
  source 1..5052: mol_type = other RNA
atgcacaccctgctcgtgtgcttcatcctgtaccttcagctgctcggccttgggggagcccatggccaaagcaacgctacagagcacaatgggacgaacaccacaaccgccccctccacatctcagagccctaagccgcttgtctccaccgcgccccctcatgctctggaatctagcacaattaaacccaccacgcctgcctccgagaccgaaggatctggcgagacaacgccccctccgaatacaacccaggggcccagccctcccgaaacgacacctgagagacccgccaccacagctacctccaccccgagcacagacaacaccaattctaccacacacgttaccgataacaatcctacatccaccatcagcacgtctccctccagctctccttccacacccagcacaccccaggggattcatcaccctgcccggaacctcctgtccgtgtctagcccgaagaccgctaccacccccacacctacgtcccccggcgagatcagctctgaaacctccagcctgcactctgccatgagccgcacatccaccctctatacagcgacccaagtgtctacggagaatgccaaccatagcgctcctagacagtccgaaagctctgcccagcccaccacaacctccccgatgacaagccctgctcagtctattctggtcatgtccgccgcgcccaccgccatccaaaatatccaccctagccccacgaaccggtccaaacgcaatcttgagatggagattatcctgacactctctcagggcctgaagaaatactatgggaagattcttaagctgctccatctgaccctggaagaggacacagaaggactcctggagtggtgtaaaagaaaccttggcagcaattgcgatgacgactttttccagaagcggatcgaagagtttttcatgaccggggagggatactttaacgaagtgctgcagttcaaaaccctctccacactgtctcctacggagcccagccacgctcgcccgcctaccgttgaaccctttaagtcctatttcgccaaaggctttcttagcattgattctgggtacttctccgctaagtgttatcccagaagctctacatccggactgcaactcatcaacgtgacccagcaccctgcccggattgccgagacaccgggccccaagaccacgagcctgaaaacaatcaattgcatcaacctgcgcgcttctgtctttaaggaacatagagagattgagatcaatgtgctcctgcctcagattgcggttaaccttagcaattgtcacgtggtcatcaactcccatgtgtgcgattacagcctggacaccgatggccccgtgcggctccctcacattcatcacgaagggaccttcatccccggaacatacaaaatcgtcattgacaaggagaataaactgaacgatcgctgtacccttgttacaaattgcgtgatcaagggcagagaagtgcggaaagggcaatctgtcctgcgccagtataagacggagattaagatcggaaaagcctccaccggcagcagaaagctcctgtccgaggaacctggggacgattgtatttctcggacacagctgctcagaaccgagacagctgaaatccacgacgacaactacggaggccccggcgataaaatcaccatttgcaatgggagcacgatcgtggaccagcgcctgggatccgagcttggctgttataccattaaccgggttaagtcttttaaactgtgcgaaaatagcgccacagggaagacctgcgagatcgattccacaccggtgaagtgtagacaaggattctgcctcaaaattacccaggagggccgcgggcatgtcaagctgtctcggggcagcgaagtggttctggacgcctgtgattccagctgcgaggtgatgatccctaaaggaacaggcgacattcttgtcgattgttctgggggacagcagcactacctcaaggacaacctgatcgatctgggctgcccccatatccctctcctggggaaaatggctatttatatctgtagaatgtccaatcacccccgcaccacgatggccttcctgttttggttcagctttggatacgtgattacatgcatcttctgtaaggcgctgttttattctctcattatcatcggcaccctggggaagaaaattaagcaataccgggaactgaaaccgcagacctgcacaatctgtgagaccgctcctgtcaacgccattgacgccgaaatgcacgatcttaactgctcctacaatatctgcccctattgtgctagcagactcacgtctgacggcctggcccgccatgtgcctcagtgccccaagcggaaagagaaggttgaggaaacagagctgtacctcaacctggaacgcattccctggatcgtgagaaaacttctgcaggtctccgagagcaccggagtggctctcaagcggtccagctggctgatcgttctgcttgtgctcctgacagtctctctgagccctgtgcaatccgccccggtgggccacgggaagaccattgaaacatatcagaccagagagggattcacgtctatctgtctctttatgctgggcagcattcttttcctggtttcctgcctcgtcaaagggctggtggactctgtgagcgattcctttttccccggactgtctgtctgtaagacctgcagcatcggctccattaatgggtttgagatcgaaagccataaatgttactgctctcttttctgttgcccttattgtcggcactgctccgcggaccgcgagatccatcagctccacctgagcatttgcaagaaaagaaagacaggctctaacgtgatgctggccgtttgtaagcggatgtgctttagagctaccatcgaagcctcccgccgggctctcctgattagaagcatcattaatacaaccttcgtgatctgtattcttacgctgacaatctgcgtcgtgtccacctctgccgttgagatggaaaacctccccagcggaacatgggagcgcgaggaagatctgaccaatttctgtcaccaggagtgccaagtgaccgaaacagagtgtctgtgcccttacgaggcgcttgtcctgagaaaacccctcttttccgacagcatcgtgaagggcatgaaaaacctgctcaattctacgtccctggaaaccagcctttctattgaggccccttggggagctatcaacgttcagagcacattcaagccgaccgtgtccacagccaatattgctctgtcttggagctccgtcgaacatcggggaaacaaaatcctcgtgaccggccgctctgagagcattatgaagctggaagagagaacgggggtgtcctgggatctgggagtcgaggacgccagcgaatctaaacttctgacagtttccatcatggatctcagccagatgtattcccccgtgtttgagtacctgtctggcgaccggcaagtggaagagtggcctaaggccacctgtaccggggattgccccgaacgctgtggctgcacaagctctacctgcctccacaaggagtggcctcattctagaaattggcggtgtaaccccacatggtgctggggagtcggcacggggtgtacctgctgtggagtggacgttaaagatctgttcacagaccacatgtttgtgaagtggaaagtcgagtacatcaagaccgaagctattgtgtgcgttgagcttacaagccaggaacgccagtgttccctgatcgaggcgggcaccagattcaatctcgggccggtgacgattaccctgagcgaacctcggaacatccagcaaaagctgcctcccgagattatcacacttcatcccaaagtcgaggaaggatttttcgatctgatgcacgtgcagaaggttctctctgcctccaccgtgtgcaaactgcagagctgtacacacggcatccccggcgacctccaggtctatcatattgggaacctgcttaagggagaccgcgtgaatggccacctgatccataaaattgagcctcactttaacacctcttggatgtcctgggatgggtgcgacctggattactattgtaatatgggagactggccgagctgcacatacacgggcgtgacccaacacaaccatgctgccttcgtcaatctcctgaacatcgaaacagattatatgaagacctttcacttccattctaagagagttaccgcccacggggacacaccccagcttgatctgaaagctcggcctacgtacggagccggcgagattaccgtgctcgtggaggtcgcggacatggaactgcatacaaagaaagtggagatcagcggcctcaagtttgtttccctggcttgcaccgggtgttatgcctgctctagcggaatttcctgtaaagtgagaatccacgtcgatgaacccgacgagcttacagtgcacgttaagagctccgatcctgacgtggtcgccgcttctaccagcctgatggcccgcaaactggagttcggcacggattccacattcaaggcgttttctgctatgcccaagaccagcctctgcttctacatcgtggaacgggagtactgtaaatcctgctctgaagaggacacccagaagtgtgtcgacacaaaactggaacagccgcaaagcattcttatcgagcataaggggaccattatcggaaaacagaatgatacatgcaccgccaaggcctcctgttggctggaaagcgtgaagtcctttttctatggcctcaaaaacatgctggggtccgtttttggaaatttctttattggcatcctcctgttccttgctccttttgtgctgctggtcctcttctttatgttcggctggaagatcctgttctgctttaaatgttgcagacgcacgcgggggcttctgaagtacagacacctcaaagacgatgaggagacaggatatcgccggattatcgaaagactgaacaataagaagggcaaaaaccgcctcctggacggggagcggcttgccgatagaaagattgctgaactgttcagcaccaaaacacatatcggatga

SEQ ID NO: 13715 - RNA, 5052 nt, synthetic construct
  misc_feature 1..5052: note = derived and/or modified CDS sequence (opt5) from CCHFV(52-R-2014)__KR814862.1__GP
  source 1..5052: mol_type = other RNA
atgcacaccctgctcgtgtgcttcatcctgtaccttcagctgctcggcctgggaggagcccatagacaaagcaacgctacagagcacaatggcacgaacaccacaaccgccccctccacatctcagagccctaagccgcccgtctccaccgcgcctccccatgctcctgaatctagcacaattaaacccaccacgcctgcctccgagaccgaagggtctggagagacaaccccgccccctaatacaacccagggccccagccctcccgaagccacgccggagcggcctgctacaaccgccacatccacccccagcaccgacaacacaaattctacgacccacgctacagataacaatcctacctccacaatcagcacctctccctccagctctccctccacgcctagcacaccgcaggggattcatcaccccgcccgcaaccttctgtccgtttctagccctaagaccgcgaccacacccacccctacatcccccggagacatcagctctgagacgtccagcctccactctgccatgagcagaaccccgacactgcataccgctacacaagcctccaccgaaaatgctaaccactctgcccctcggcagagcgagtccagcgcgcagcagacgaccacatctcccatgacctcccctgcccaacccattctggtgatgagcgctgcccctacagctatccagaatatccatccctctccgaccaaccgctccaaaagaaatctcgaaatggagattatcctgacgcttagccagggcctgaagaaatattacggcaagattctcaagctgcttcacctgacactcgaggaagataccgaggggctgctggaatggtgtaaacggaacctcggatccaattgcgacgatgactttttccagaagcgcatcgaggaatttttcatgacaggcgaggggtattttaacgaggtgctgcaattcaaaaccctttctaccctgagccctacagaaccctcccacgccagaccccctacggtcgagccgtttaagtcttacttcgccaaaggatttctcagcattgattccggctatttcagcgctaagtgttacccccggctgtctacctccgggcttcagctgatcaacgtgacacagcatcctgcgcgcattgccgaaacccccggacctaagacaaccagcctcaaaacgatcaattgcatcaacctgagagcttctgtttttaaggagcaccgggaaattgagatcaatgtgctgctcccccaaattgccgtcaacctgtccaattgtcatgtggttatcaacagccacgtgtgcgactattctcttgatacagacggccctgtccgcctgccccatatttaccacgagggcaccttcatcccggggacctacaaaatcgtgattgataagaaaaataagctcaacgacagatgtacactggtgaccaattgcgtcatcaaaggacgggaagttcgcaagggccagagcgtgcttagacagtataagacagagattaaaatcgggaaggcctccacgggaagccggaaactgctctctgaagaacctggcgatgactgtatttccagaacccagctgctgcgcacagaaaccgctgagatccacgacgataactacgggggacccggcgacaagatcacaatttgcaatggcagcaccatcgtggatcaacggctcgggtccgagctgggatgttatacgattaacagagtcaaatcttttaaactttgcgaaaatagcgccaccggcaagacatgcgagatcgactccacccctgtgaaatgtcgccaggggttctgcctgaagattacacaggaaggacggggccatgttaaactctctagagggagcgaggtggtcctggatgcgtgtgacacctcctgcgaggtgatgatccccaagggcacaggagatattctggttgactgttctggcgggcagcaacacttccttaaagataacctcatcgacctgggatgcccgcatgtgcctctgctcggcaagatggctatctacatttgtcgcatgagcaatcacccccggaccacgatggcctttctgttctggttttccttcgggtatgtcatcacatgcatcttttgtaaggcccttttctacagcctgattattatcggaaccctcggcaaaaagatcaaacagtatagagaactgaagcctcagacctgcacaatttgtgagaccgctcccgtgaacgccatcgatgctgaaatgcacgacctgaactgctcttacaatatttgcccctactgtgcctcccgccttacgagcgacgggctcgcgcggcatgtccctcagtgcccgaaaagaaaggagaaggtggaagagacagagctgtatctgaacctcgaacgcatcccctggattgttcggaaactgcttcaagtgtctgagtccaccggcgtcgccctgaagagaagctcttggctcatcgtgctgctggttcttctcacagtgtccctgagccctgtccagtccgctcccgtgggacacggcaaaaccatcgaaacataccagacccgggaggggtttacgagcgtgtgtctgttcatgctcggatctattctgtttcttgttagctgcctggtcaagggcctcgtggattccgtgtctgacagcttctttcctgggctgtccgtctgtaaaacctgctctatcggaagcattaatggcttcgaaatcgagtcccataagtgttattgctctctgttttgttgcccctactgtcgccactgcagcgccgatagagagattcatcagcttcacctctccatctgcaaaaagcggaagatggggagcaacgtgatgctggctgtttgtaaaagaatgtgcttccgcgccacaatcgaagcgtctcggagagccctgctcattcgctccatcattaataccacattcgtgatctgtattctgacccttacgatctgcgtcgtgagcacatctgctgttgagatggaaaacctgccttccggcacctgggagagagaagaggacctcacaaatttttgtcaccaagagtgccaggtgaccgaaaccgagtgtctgtgcccgtatgaagccctggtccttcggaagcccctgttcctcgatagcattgtgaaaggaatgaagaacctgctcaattccacatctctggagacgagcctttccatcgaggctccttggggcgccatcaacgttcagagcacctttaaacccacagtgtctaccgccaatattgctctgtcctggagctctgtcgaacatcgcgggaacaagatcctcgtgacaggaagaagcgagtccattatgaagctggaggagcggaccggcgtgtcttgggacctgggggtcgatgacgcgagcgaatccaaacttctgacggtttctatcatggatctcagccaaatgtactcccctgtgttcgagtatctgagcggagaccgccaggtggaggaatggcccaaggccacatgtaccggcgattgcccggagagatgtgggtgcacctcttccacatgcctccacaaagaatggcctcatagccggaattggcgctgtaaccccacctggtgctggggcgtcggaacaggctgtacgtgctgtggggtggacgttaaggatctgtttaccgaccacatgttcgtgaaatggaaggtcgagtacattaagacagaagctatcgtgtgcgttgagcttacctcccaggagagacagtgttctctgatcgaagccggaacacggtttaatctcggccccgtgaccattacgctgagcgagcctcgcaacatccaacagaaactgccccctgaaattatcacccttcatccgaaggtcgaggaagggttctttgacctgatgcacgtgcagaaagttctctccgcctctacagtgtgcaagctgcagagctgtacccacgggattcccggcgatctccaagtctaccatatcggcaacctgcttaaaggggacagagtgaatggacacctgatccataagattgagcctcacttcaacacatcctggatgagctgggatggctgcgacctggattattactgtaatatgggggactggccctcttgcacctatacaggagtgacgcagcacaaccatgctgcctttgtcaatctcctgaacatcgagaccgattacacaaagaccttccactttcattccaaacgggttaccgcgcacggcgacacacctcagcttgatctgaaggctagacccacgtatggggccggagaaattaccgtgctcgtggaggtcgccgacatggaactgcatacaaagaaggtggagatcagcggcctcaaattcgcttctctggcctgcaccggctgttacgcgtgctccagcgggatttcttgtaaggttcgcatccacgtggatgagccggacgaacttacagtccacgtgaaaagcaatgatcctgacgttgtggctgcctccacctctctgatggcccggaagctggagttcggaacggacagcacatttaaggctttctccgccatgcccaaaaccagcctctgcttttatattgtcgaaagagagtactgtaagtcctgctctgaagaggatacccagaaatgtgtggacacaaagctggagcaacctcagagcatccttatcgaacataaaggcaccattatcgggaagcagaacgatacatgcaccgctaaggccggatgttggctggagtccgtcaaatctttcttttacggcctcaagaatatgctggggagcgtgttcggaaactttttcattggcatcctcctgtttcttgcgcccttcgttctgctggtgctctttttcatgttcggctggaaaattctgttttgcttcaagtgttgccgccggacgagagggcttctgaaatatcgcctcctgaaggacgatgaagagacaggataccggagaatcatcgaacgcctcaataacaagaaaggcaagaatcggctgcttgacggggagagactggccgatcggaaaattgctgagctgttttccaccaagacacacatcggatga

SEQ ID NO: 13716 - RNA, 5052 nt, synthetic construct
  misc_feature 1..5052: note = derived and/or modified CDS sequence (opt5) from CCHFV(Turkey-Kelkit06)__GQ337054.1__GP
  source 1..5052: mol_type = other RNA
atgcacacacccctggtgtgcttcatcctctacctgcagcttctgtgtctcggcggggcccatggacaactgaacgctaccgagcacaatggcacgaacaataccacagcccctggggcgagccagtccccgaagccccctatgtctaccacaccccctcatgctcccgaaagctccaccattaaacctacaaccccgatctctgaggccgaaggaagcggcgagacgacctctccccctaacacaacccaggggctttctagccccgaaacaacctccgagagacctgccacgacaagcatttctacctccagcacagactctaccaatcccaccacacagatgacggataacaccccgacacctaccgtctccacaagcccctcttccagcccttccaccccctctacgccccaaggaatccaccatcctgctcggagcctgctctccgttagctctccgaagacagtgaccacccccacacctacctcccccggcgagatgagctctgaaacaagctcccagcactctgccatgagccgcattcctacgccccacaccgctacaagagtgtccaccgagatcacaaatcatcggaccccgcgccagagcgaatcttccgcccagcaaacgacccctagccccatgacatctcctgcgcagtccatcctgctgatgagcgccgctcccaccgccgtccaggacattcacccttcccccacaaacagatctaaacggaatctcgagaccgagatcattctgacgcttagccagggcctgaagaaatattacgggaagatcctcaagctgcttcatctgacactcgaacaagataccgagggactgctggaatggtgcaaaggcaacctcgggtccaattgtgacgatgactttttccagaagcgcattgaggaatttttcatgacaggagagtgctattttaacgaggtgctgcagttcaaaaccctttctaccctgagcccgacagaaccttcccacgctagactccccacggccgagccctttaagagctacttcgcgaaaggctttctgtctatcgattccgggtatttcagcgccaagtgttaccctcggtcttccgctagcggacttcaactgattaatgttacccagcacccggcccgcatcgctgaaacacccggccctaagaccacatctctcaaaaccatcaactgcattaatctgagagccagcgtgtttaaggagcatcgggaagtcgagatcaacgtgctgctcccccagattgccgttaacctgtccaattgtcacgtggtcatcaacagccatgtgtgcgactattctcttgatacggacggccctgtgcgcctgcccagaatttaccacgaggggacattcatccctggaacctacaaaatcgtcattgataagaaaaataagctcaacgaccggtgtaccctggttacaaattgcgtgatcaaaggccgcgaagtgagaaaggggcagtccgtccttcggcaatataagaccgagattaaaatcggaaaggctagcacaggctttagaaaactgctctccgaggaacccggggatgactgtatttctcgcacgcagctgctgcggaccgaaacagcggagatccatgacgataactacggaggcccgggcgacaagatcaccatttgcaatgggagcacaatcgtggatcagagactcggatccgagctgggctgctataccattaaccgcgttaaatctttcaagctgtgtaagaatagcgccacggggaaaacctgcgaagtggactccacacctgtcaagtgtcggcagggattctgcctgaaaatcacccaagagggcagagggcacgtgaagctctctcgcggcagcgaagttgtgctggatgcttgtgactccagctgcgaggtcatgattcccaaaggaacaggcgatatcctggtggactgttctgggggacagcagcactttcttaaggataacctcattgacctgggctgccctcatatccccctgctcgggcggatggccatctacatttgtagaatgtccaatcacccgcgcaccacaatggccttcctgttttggttcagctttggatatgtcattacctgcatcttctgtaaggctctgttttactctctgatcattatcggcacgctcgggaaaaagatcaaacagtatcgggagctgaagcctcaaacatgcaccatttgcgaaaccgcccccgtgaacgcgatcgatgctgagatgcatgacctgaattgttcctacaacatttgcccttactgtgccagcagacttacatctgacggcctcgcccgccacgttacccagtgccccaaacggaaggaaaaggtggaggaaacggagctgtatctgaatctcgagagaatcccctggattgtccggaaactgcttcaggtgtccgaaagcacaggagttgctctgaagcgctccagctggctcatcgtgctgctggtccttctcaccgtgtctctgagccctgtgcagtccgccccggttggccacgggaaaacaatcgagatttaccaaaccagagaaggattcgcttctatctgtctgtttatgctcggcagcattctgttcatcgtctcctgccttgtgaaggggctggtggattctgtcagcgagtcctttttccccggactctctgtgtgtaaaacatgcagcattggctccgttaacgggtttgaaatcgagagccataagtgttattgctctctgttctgttgcccttactgccggcactgttccgccgacagagagatccatcagctgcaccttagcatttgcaaaaagcgcaagaccggctctaacgtgatgctcgcggtctgtaaacggatgtgcttcagagccacgatcgaggcttcccgcagagccctgctgattcggagcatcattaataccacatttgtgatctgtattctcaccctgacaatctgcgttgtgtccacctctgctgtcgaaatggaaaaccttcccgccggaacgtgggagcgcgaagaggatctgacaaatttctgtcatcaggagtgccaagtgaccgaaacagagtgtctctgcccttatgaagcgctggttctgagaaagcccctttttctggacagcatcgtgaaaggcatgaagaacctccttaattccaccagcctcgagacctctctgtccattgaggccccttggggagctatcaacgtccagagcacattcaaaccgacggtgtctaccgccaatattgctcttagctggtcctctgtggtccaccgggggaacaagatcctggttacaggccgcagcgaatccattatgaagctcgaggaaagaaccggggtgtcttgggatctgggagtggaggacgccagcgaatccaaactgcttacagtcagcatcatggatctgtctcagatgtactcccccgtgtttgagtatctcagcggcgaccggcaggttgaggaatggcctaaggccacctgtacgggggattgccccgagcgctgcggctgtacatcctctacctgcctgcacaaagaatggagccattccagaaattggcggtgtaaccctacctggtgctggggagtgggcacagggtgtacctgctgtggagtcgacgtgaaggatctcttcacagaccacatgtttgttaaatggaaggtggagtacatcaagacggaagctattgtctgcgtggcgctgacctctcaagagcgccagtgtagccttatcgaggccggcacaagattcaatctggggcccgttaccattacactctccgaaccgcggaacatccagcagaaactgcctcccgagattatcaccctgcatcccaagatcgaagagggatttttcgatcttatgcacgtgcaaaaagtcctgagcgcttctacggtgtgcaagctccagtcctgtacccatggcattcctggcgaccttcaggtgtaccacatcgggaatctcctgaaaggagacagagtcaacggccaccttattcataagatcgaaagccactttaatacatcttggatgtcctgggatgggtgcgacctggattattactgcaacatgggagactggcccagctgtacctatacaggcgttacccagcataaccacgccgccttcgtgaatctgctcaacattgagacagattacacgaagacctttcacttccattctaaacgcgtgacagctcacggggacacccctcaactggatcttaaggcccggccgacctatggagcgggcggcatcacagtcctggtggaggttgctgacatggaactccatacgaaaaaggtggagattagcgggctgaaattcgcctccctcgcctgcaccggatgttacgcttgctctagcggcatctcctgtaaggtcagaatccacgtggatgaacccgacgagctgacagttcatgtgaaaagctccgatcctgacgtcgtggccgcgtctaccagccttatggctcgcaagctggagtttgggacagattccaccttcaaggccttttctgccatgcccaaaacgagcctgtgcttctatattgtcgaacgggagtactgtaagtcctgctctgaagacgacacacagaaatgtgtggataccagactcgagcagcctcaaagcatcctgattgaacacaagggaaccatcattggcaaacagaatgacacatgcaccgctaaggcctcctgttggcttgagagcgttaagtcctttttctacgggctgaaaaacatgctcggatccgtgtttggcaatctgttcatcggcatcctcctgtttcttgctcccttcgtcctgctggtgctctttttcatgttcgggtggaagattctgttttgcttcaaatgctgtcgccggacaagaggactttttaagtatcgccacctgaaagatgacgaggaaaccggctaccggagaatcattgagcggctcaacagcaagaaggggaaaaatcgcctgctcgatggagacagactggccgatcggaagatcgcggaacttttctctacgaaaacacatattggctga

SEQ ID NO: 13717 - RNA, 5052 nt, synthetic construct
  misc_feature 1..5052: note = derived and/or modified CDS sequence (opt5) from CCHFV(V42/81)__GU477490.1__GP
  source 1..5052: mol_type = other RNA
atgcacaccctgctcgtgtgcttcatcctgtaccttcagctgctcggccttgggggagcccatgtccaacccaacgctacagagcacaatagaacgaacaccacaaccgcccctggcacaagccattcccttaagccgctggtttctaccacaccccctcaggcgcccgaaagctccaccattaaacctacgacccccacatctgagaccgaagggagcggagaggctacacctctctccaataccatccaggccccgtctagccccgaaacgacatccgagcggcctgccaccgctgtgattagcacatctggcaccgactccaccaacagcacaacgcagaccacagataataaccccaccacaaccgtggggacgtctccttccagctctccctccacaccgagcacccctcaaggaatccaccatcacgcccgctccctgctgtctgtcaccagccccgagacagtgaccacacctaagcccacgtcccccagagaaatgagctctgagacctccaatcagcacagcgctatgtctcggacacctacccatcacacagttacccaggtgagcacggaaaacacctcccattctacaccgcgccagcccgagagctccgcccaacctaccagcagctcccccatgacaagccctgcgcagtctaccctcctgatgtccgccgctcccacggccgtccagagcattcacccgtcccctacaaatagatctaaacggaaccttgagaccgaaatcatcctgacactcagccagggcctgaagaaatattacggcaagattcttaagctgctccacctgaccctggaggaagacaccgaggggctcctggaatggtgtaaacgcaatcttggatccaactgcgatgacgactttttccaaaagagaatcgaggagtttttcatgacaggcgaagggtattttaatgaggtgctgcagttcaaaacgccctctaccgttagccctacagaaccctcccatgctcggctccctaccgccgagccctttaagagctacttcgcgaaaggatttctgtctattgactccggctatttcagcgccaagtgttactctcgctccagcacatctgggcttcagctgatcaacgtgacccaacacccggctagaattgccgaaacgcctggacccaagacaaccagcctcaaaaccatcaattgcattaacctgcgggcttccgtctttaaggagaaccgcgagatcgaaatcagcgtgctgctcccccagattgccgtgaatctgtctaactgtcatgtcgttatcaattcccacgtgtgcgattatagccttgacacagatggccctgtgagactgccgcggattaaccatgagggcaccttcatccccgggacatacaaaattgtcatcgacaagaaaaataagctcaacgatcgctgtacgctggtgaccaattgcgttatcaaaggaagagaagtgcggaagggccagtccgtccttagacagtacaagacagagattaaaatcgggaaggcctctaccggaagccgcaaactgctctccaaggaacctggcgacgattgtatttctcggacacaactgatgagaaccgagacggctgagatccacgacgacaactatgggggacccggcgataaaattaccatctgcaatggcagcacaatcgtggaccagcgcctggggtccgaactcggatgttacaccattaaccgggttaagtcttttaagctgtgcgagaatagcgcgacaggcaaagcctgcgaagtggattccacccctgtcaagtgtagacaggggttctgccttaaaatcacacaggagggacgcggccacgtgaagctgagccgggggtctgaggtcgtgctcgacgcttgtgattccagctgcgaagttatgattcccaaaggcaccggagacatcctggtggattgttctggcgggcaacagcatttcctgaaggacaaccttattgatctcgagtgccctcacatccccctgctgggaaagctcgccatttatatctgtagaatgtccaatcatccgcgcacgacaatggcctttctgttctggtttggcttcgggtacgtcattacctgcatcctttgtaaagctctgttttatagcctcatcattatcggaaccctgggcaagaaaattaagcagtaccgggaactgaaacctcagacatgcaccatctgtgagacggcccccgtgaacgcgatcgacgctgaaatgcacgatcttaattgctcttataacatttgcccttactgtgcctccagactcacaagcgacgggctggcccgccacgttacccaatgccccaagcggaaggagaaagtggaggaaacagagctgtacctcaacctggaaagaatcccgtggattgtccggaagctgctccaggtgtccgagagcaccggcgtggttctgaaacgctctagctggctgatcgtcctgcttgtgctcctgacagtgtccctgtctcctgtccagagcgctcccgtgggacatggcaagaccattgaaacgtatcagaccagagaggggttcacatccatctgtctctttatgctgggatctatccttttcattgttagctgcatcgtgaaaggcctggtcgactccgtgtctgatagctttttccctgggctctccgtttgtaagacctgcagcatttcttccatcaatggatttgagattgaaagccacaaatgttactgctctctgttctgttgcccctattgtcggcattgctccgccgacagagagatccaccaactgcatcttagcatctgccgcaagcggagaacaggctccaacgtgatgctcgctgtctgtaagcgcatgtgctttagagccaccattgaagtgtctcggcgcgcgctgctgatcagaagcattatcaatacgacattcgttatttgtatcctcaccctgacaatttgcgtggtctccaccagcgccgtggagatggaaaaccttcccgctgggacctgggagcgggaggaagatctgacaaatttctgtcaccaggagtgccaggtgacggaaaccgagtgtctctgcccttacgaggccctggtcctgcgcaaaccgctttttctggactctatcgttaagggcaaaaagaacctcctgaatagcacaagcctcgaaacctctctgagcatcgaggctccctggggagccattaacatccaatccacattcaaacctaccgtgtctgcggccaatattgctcttagctggtcctctgtggaacacagaggcaacaagatcctggtcagcgggcggtccgagagcattatgaagctcgaggaacgcacgggagtgtcttggaatctgggcgttgaggatgcctccgaaagcaaactgcttacagtgtccatcatggacctgtctcagatgtatagccccgtctttgagtacctctccggggatagacaggtggaagagtggcctaaggctacctgtaccggagactgccccgaacggtgtggctgcacatcttctacctgcctgcataaagagtggcctcactcccgcaactggagatgtaatccgacatggtgctggggcgttgggacgggatgtacctgctgtggcgtggatgtcaaggacctcttcatcgatcatatgtttgtgaaatggaaggttgagtatattaagacagaagccatcgtgtgcgtcgagctgaccagccaggaacggcaatgttctcttattgaggccgggacaagattcaacctgggacccgtgaccatcacgctctccgaacctcgcaatattcagcagaaactgccccctgagatcatcaccctgcaccccaagattgaggaaggctttttcgaccttatgcatgtgcagaaagtcctgagcgcttctacagtttgcaagctccaatcctgtacccacgggatcccgggagatctccaggtgtaccacattggcaacctgctgaaaggcgaccgggtgaacgggcatcttatccacaagattgagcctcattttaatacaagctggatgtcttgggacggatgcgatctggactactattgtaacatgggcgattggcccagctgcacctacacaggggtcacgcagcacaatcacgcggccttcgtgaacctgctcaatatcgaaaccgactatacaaagacctttcatttccactccaaaagagttaccgctcatggagagacaccccagctggatcttaaggcccgccctgcctacggcgctggggagattacggtgctggtcgaagtggccgacatggagctccacaccaaaaaggttgaaatctctggactgaaatttgcgagcctcgcttgcacaggctgttatgcctgctccagcggcatctcctgtaaggtgcggattcatgtcgatgagcccgacgaactgaccgtgcacgtcaaatctaacgatcctgacgtggttgccgctagcacatcccttatggccagaaagctggagtctgggaccgatagcacgttcaaggcgttctccgctatgccgaaaacatctctgtgcttttacatcgtggagcgcgaatattgtaagagctgctccgaggacgatacccaaaaatgtgtcgaaaccaagctcgagcagccccagagcattctgatcgaacacaaaggaacaattatcggcaagcaaaatgatacctgcacagccaaggcctcttgttggcttgagtccgtgaaatccttcttttacgggctgaagaacatgctcggatctgttttcggcaatttctttatcgggattctgctctttctggctcctttcgtgcttctggtcctgtttttcatgtttggatggaaaatcctcttctgcttcaagtgttgccggagaacccgcggcctgtttaaataccggcatcttaaggaggacgaagagacgggctatagacggattatcgaacgcctgaactccaagaaagggaagaatagactcctggatggagagcggctcgccgaccgcaaaattgctgaactgttcagcacaaagacccacatcggctga

SEQ ID NO: 13718 - RNA, 5052 nt, synthetic construct
  misc_feature 1..5052: note = derived and/or modified CDS sequence (opt5) from CCHFV(75-R-2012)__KR814863.1__GP
  source 1..5052: mol_type = other RNA
atgcacaccctgctcgtgtgcttcatcctgtaccttcagctgctcggccttgggggagcccatagacaaagcaacgctacaggccacaatgggacgaacaccacaaccgccccctccacatctcagagccctaagccgcttgtctccaccgcgccccctcatgctctggagtctagcattatcaaacacacaacccccgtttccgaaacggagggatctggcgaaaccacacctccccctaataccacacaggggccgagccccctcgagaccacgcctgaacggcccgccacaaccgccacatccacccctagcaccgacaacacaaattctacgacccatgtgacagataacaatcccacctccacaattagcacctctccgtccagctctccttccacgcccagcacacctcagggaatccaccaccccgctcgcaacctgctgtccgtgtctagcctcaagaccgccaccacacccacccctacatccccgggcgagattagctctgagacgtccagcctgcattctgctatgagcagaacctccacactttataccgccacacaagtctctaccgaaaatgcgaaccacagcgctccccggcagtccgagagctctgctcagcagacgaccacatcccctatgaccagccccgcccaatctatcctggtgatgtccgctgcccctacagcgatccagaatacccatcccagcccgacgaaccgctccaaaagaaatctcgaaatggagattatcctgacactttctcagggcctgaagaaatactatgggaagattctcaagctgctgcacctcaccctggaggaagacacagagggacttctggaatggtgtaaacggaacctcggcagcaattgcgatgacgatttcttccagaagcgcatcgaggaatttttcatgaccggggagggatactttaacgaggttctgcaattcaaaaccctttccacacagtctcctacggaacccagccacgccagacctcccaccgtggagccttttaagtcctatttcgctaaaggctttctgagcattgactctgggtacttctccgccaagtgttatccccggctcagcacatctggactgcagctgatcaacgtcacccaacatccggctcgcattgccgaaacacctggccccaagaccacgtccctcaaaacaatcaattgcatcaacctgagagccagcgtgtttaaggagcaccgggaaattgagatcaatgttcttctgccccagattgctgtgaacctctctaattgtcatgtcgtgatcaacagccacgtgtgcgattactccctggacaccgatggccctgtccgccttccgcatatttaccacgaggggaccttcatccccggaacatataaaatcgttattgacaagaaaaataagctgaacgatagatgtaccctcgtgacaaattgcgtgatcaaaggccgggaagtccgcaaggggcagagcgtgctgagacagtacaagacggagattaaaatcggaaaggcgtctaccggctcccggaaactgctcagcgaggaacctggggacgattgtatttccagaacacaactgcttcgcaccgaaacagccgagatccacgacgacaactatggaggccccggcgataagatcaccatttgcaatgggtctacgatcgttgaccagcggctgggaagcgagctcggctgttacaccattaacagagtgaaatcctttaagctgtgcgaaaattctgctacagggaagacctgcgagatcgatagcgcccctgtcaaatgtcgccagggattctgcctgaagattacacaggaaggccgggggcatgtgaaactttccagaggctctgaggttgtgctcgacgcctgtgatagctcctgcgaggtcatgatccccaagggaaccggcgacattctggtggattgtagcgggggacaacagcacttcctgaaagacaacctcatcgatctgggctgccctcatatcccccttctggggaagatggctatttatatctgtcgcatgtctaatcacccgcggacaaccatggcctttctcttctggttttccttcggatacgtcattacgtgcatcttttgtaaggcgctgttctatagcctgattatcatcggcacacttgggaaaaagattaaacagtacagagaactcaagcctcagacctgcaccatctgtgagacagctcccgtgaacgccattgacgccgaaatgcacgatctgaactgctcttacaatatctgcccttattgtgcttcccgcctgaccagcgacggcctcgcccggcatgttccccaatgcccgaaaagaaaggagaaggtggaagagacggagctgtaccttaacctggaacgcattccttggatcgtccggaaactccttcaggtgtctgagtccacaggagttgctctgaagagaagctcctggctgatcgtgctcctggtcctgctcaccgtgagcctgtctcccgtgcagagcgcccctgttggccacgggaaaacaattgaaacctatcagacacgggagggatttacctccatctgtcttttcatgctgggctctattctctttctggtcagctgcctggtgaaggggcttgtcaattccgtgtctgacagcttctttcccggactctccgtgtgtaaaacgtgctctatcggcagcattaacgggttcgaaatcgagtcccataagtgttactgcagcctgttttgttgcccctattgtcgccactgctctgcggatagagagatccatcaactgcacctctccatttgcaaaaagcggaagaccggcagcaatgttatgctggccgtgtgtaaaagaatgtgcttccgcgctacaatcgaagcctctcggagagcccttctgattcgctccatcattaacaccacattcgtcatctgtattctcaccctgacgatctgcgtggttagcacatccgccgtggagatggaaaatctgccttctggaacctgggagagagaagaggaccttacaaacttttgtcaccaggagtgccaggtcaccgaaaccgagtgtctgtgcccgtacgaagcgctcgtgctgcggaagcccctcttcctggatagcatcgttaaaggcatgaagaatcttctgaactccacaagcctcgagacgtctctgtccattgaggccccttggggagctatcaatgtgcaaagcacctttaaacccacagtctctaccgccaacattgctctgagctggtcctctgtggaacatcgcgggaataagatccttgtgacaggcagaagcgagtccattatgaagctggaggaacggaccggggtctcttgggacctcggagttgaagatgccagcgagtccaaactgctcacggtgagcatcatggacctgtctcagatgtattcccctgtgttcgagtaccttagcggcgatcgccaggtcgaagagtggcccaaggccacatgtaccggggactgccctgaaagatgtggctgcacctcctctacatgcctgcacaaagagtggccgcatagccggaactggcgctgtaatcccacctggtgctggggagtgggcacagggtgtacgtgctgtggagttgatgtgaaggacctctttaccgatcacatgttcgtcaaatggaaggtggaatacatcaagacagaggctattgtttgcgtggagctgacctcccaggaaagacaatgttctctgatcgaggcgggcacacggtttaaccttgggcctgtcaccattacgctgagcgaaccccgcaacatccagcagaaactccctcccgagattatcaccctgcatccgaaggtggaagagggattctttgacctcatgcacgttcagaaagtgctgtccgccagcacagtctgcaagctgcaatcttgtacccacggcatccctggcgatctccaggtgtatcatattgggaatctgctgaaaggagacagagtgaacggccacctgatccataagattgagccccacttcaatacatcctggatgagctgggacgggtgcgatcttgactactattgtaacatgggagattggccctcttgcacctacacaggcgtcacgcagcacaatcatgctgcctttgttaacctgctcaatatcgaaaccgactatacaaagaccttccactttcattccaaacgggtgaccgcccacggggatacacctcagctggacctcaaggctagacccacgtacggagccggcgagattaccgtgctggtcgaagtggcggatatggagcttcatacaaagaaggttgagatcagcggcctgaaattcgcttctctggcctgcaccgggtgttatgcctgcagctccggaatttcttgtaaggtgcgcatccacgtcgacgaacctgatgagctcacagtgcacgttaaaagctccgacccggatgtggtcgctgccagcacctccctgatggcgcggaaacttgaatttggcacggactctacatttaaggctttcagcgccatgcccaaaacctccctgtgcttttacatcgtggagagagaatactgtaagtcttgcagcgaggaggatacccaaaaatgtgtcgacacaaagctcgaacagcctcagtccattctgatcgagcataaagggaccattatcggaaagcaaaacgacacatgcaccgccaaggcttcttgttggctcgaaagcgtgaaatccttcctgtatggccttaagaatatgctggggagcgtttttggaaacttctttattggcatcctcctgttcctggccccctttgtgcttctggtcctcttctttatgttcggctggaaaatcctgttctgctttaagtgttgccgccggacgagagggctcctgaaataccgccttctgaaggatgacgaggaaacaggatatcggagaattatcgagcgcctgaataacaagaaaggcaagaatcggctcctggatggggagagacttgctgaccggaaaattgccgaactgttctctaccaagacacacatcggatga

SEQ ID NO: 13719 - RNA, 5052 nt, synthetic construct
  misc_feature 1..5052: note = derived and/or modified CDS sequence (opt5) from CCHFV(VLG/TI29414)__AY179961.1__GP
  source 1..5052: mol_type = other RNA
atgcacaccctgctcgtgtgcttcatcctgtaccttcagctgctcggccttgggggagcccatattcaaagcaacgctacagagcacaatggcacgaacaccacaaccgccccctccacatctcagagccctaagccgcttgtctccaccgcgccccctcatgctctggaatctagcacaatcaaacccaccacgcctgtttccgagaccgaagggtctggaggcacaacaccccctccgaatacaacccaggggcccagccctcccgaggccacgcctgaaagacccgccacaaccgctacatccaccccgagcaccgacaacacaaattctacgacccacgtgacagataacaatcctacctccacaattagcacctctccctccagctctccttccacgcccagcacaccccagggaatccatcaccctgcccggaacctcctgtccgtgtctagcccgaagaccgctaccacacccacccctacatcccccggcgacattagctctgagacgtccagcctgcactctgccatgagccgcacctccacactctataccgcgacacaagtctctaccgagaatgccaaccatagcgctcctagacagtccgaaagctctgcccagcagacgaccacatcccccatgaccagcccggctcaacctatcctggtgatgtctgccgcgcccacagccatccagaatattcacccttcccccaccaaccggagcaaacgcaatcttgagatggaaatcattctgacgctctcccagggcctgaagaaatactatgggaagatccttaagctgctccatctgacactggaggaggataccgaaggactcctggagtggtgtaaaagatctcttggcagcaactgcgacgatgactttttccagaagcggattgaagagtttttcatgacaggggaaggatactttaatgaggttctgcaattcaaaaccctctccaccctgtctcctacagagcccagccacgctcgcccgcctacggtggaaccctttaagtcctatttcgccaaaggctttcttagcatcgattctgggtacttctccgctaagtgttatcccagactgagcacctctggactccagctgattaacgtcacacagcaccctgcccggatcgccgagaccccgggccccaagacaacctccctgaaaacgatcaactgcattaatctccgcgctagcgtgtttaaggaacatagagagatcgaaattaacgttctgcttcctcaaatcgcggtgaatctgtctaactgtcacgtcgtgattaatagccatgtgtgcgactactccctcgatacagacggccccgtccggctgcctcacatctaccatgaggggaccttcatccccggaacctataaaattgttatcgataagaaaaacaaacttaatgaccgctgtacactggtgaccaactgcgtgattaagggcagagaggtccggaaggggcagagcgtgctccgccagtacaagacagaaatcaaaattggaaaggcctctacgggctccagaaaactgctgagcgaggaacctggggatgactgtatctcccggacccagctcctgagagctgagcccgccgaaatccacgacgataattatggaggcccgggcgacaagattacaatctgcaacgggtctaccattgttgatcaacgccttggaagcgagctgggctgttacacaatcaatcgggtgaaatcctttaagctctgcgagaactctgccaccgggaagacgtgcgaaattgacagcacccctgtcaaatgtagacagggattctgcctgaagatcacacaggagggccgcgggcacgtgaaactgtcccggggctctgaagttgtgcttgatgcttgtgacagctcctgcgaggtcatgattcccaagggaaccggcgatatcctcgtggactgtagcgggggacagcaacatttcctgaaagataatctgatcgacctcggctgccctcacattcccctgcttgggaagatggccatctatatttgtagaatgtctaaccatccgcgcacaaccatggcgtttctgttctggttttccttcggatacgtcatcacatgcatcttttgtaaggctctcttctatagcctgattatcattggcaccctggggaaaaagatcaaacagtaccgggagcttaagcctcagacgtgcacaatttgtgaaaccgcccccgtgaatgccatcgatgctgagatgcacgacctcaactgctcttacaacatttgcccttattgtgcctccagactgaccagcgacggcctggctcgccacgttccccagtgccccaaacggaaggaaaaggtggaggaaacagagctctacctgaatcttgagagaatcccttggaacgtccgcaaactgctccaagtgtctgaatccaccggagttgccctgaagcggagctcctggctgatcgtgcttctcgtcctgctgacggtgagcctctctccggtgcagagcgcgcccgttggccatgggaaaacaattgagacctatcagacaagagaaggatttacctccatctgtctgttcatgcttggctctattctgtttctcgtcagctgcctggtgaaggggctggtggattccgtctctgacagcttctttcctggactttccgtgtgtaaaacatgctctatcggcagcattaatgggttcgagatcgaatcccacaagtgttactgcagcctcttttgttgcccctattgtcggcattgctctgccgatcgcgagatccaccagctgcatctgtccatttgcaaaaagagaaagatgggcagcaacgttatgctcgctgtgtgtaaacggatgtgcttcagagccaccatcgaggcttctcgccgggccctgcttattagatccatcattaatacgaccttcgtcatctgtattctgacactcaccatctgcgtggttagcacatccgcggtggaaatggagaacctgccttctggaacctgggaacgcgaggaagacctgacgaatttttgtcaccaagagtgccaggtcacagagaccgaatgtctttgcccctacgaggccctggtgctcagaaagcctctgttcctcgatagcatcgttaaaggcatgaagaacctgcttaattccacaaacctggaaaccagcctctctattgaggctccgtggggagccatcaatgtgcagtccacctttaaacccacagtcagcacggctaacattgccctgtcttggagctccgtggagcaccgggggaataagatcctggtgaccggccgctctgaaagcattatgaaacttgaggaaagaacaggggtctcctgggacctgggagttgaggatgcctctgaaagcaagctcctgaccgtgtccatcatggacctcagccaaatgtattctcctgtgttcgagtacctgtccggcgatcggcaggtcgaggaatggcccaaggctacatgtaccggggactgccctgagcgctgtggctgcacgagctccacatgccttcataaagaatggccccactctagaaactggcggtgtaatccgacctggtgctgggaggtgggaaccggctgtacatgctgtgggtggaacgttaaggatctgtttaccgaccatatgttcgtgaaatggaaggtcgaatacatcaagacagaggcgattgtgtgcgttgagctcacgagccaggaacgccagtgttccctgatcgaggccggaaccagatttaacctgggccctgtgacaattaccctttctgaaccccggaatatccaacagaaactgccccctgagattatcacactccaccccaaggtcgaagaggggttctttgatctgatgcatgtgcagaaagttctcagcgcttccaccgtgtgcaagctgcagagctgtacgcacggaatccctggcgaccttcaagtctatcacattggcaacctgctgaaaggggaccgcgtgaatggacatctcatccacaagattgagccgcatttcaacacctcttggatgtcctgggatggctgcgacctggattactattgtaatatgggggactggcccagctgcacatacaccggaatgacacagcacaaccacgccgcctttgtgaatcttctgaacatcgaaaccgattatacaaagacgttccattttcactctaaaagagtcaccgctcatggcgacacacctcagctcgatctgaaggcccggcccacctacggggcgggagagattaccgttctcgtggaagtggctgacatggagctgcacaccaaaaaggtcgagatctccggccttaaattcgccagcctggcctgcacgggctgttatgcttgctctagcgggatttcctgtaaggtgagaatccatgttgatgaacctgacgagctgaccgtgcacgtcaaatctaatgatcccgacgtgatcgccgcgagcacatccctcatggctcgcaagctggagttcggaaccgatagcacatttaaggccttctccgccatgccgaaaacctctctttgcttttacattgctgaacgggaatactgtaagagctgctccgaggaggacacgcagaaatgtgttgacacaaagctggaacaacctcagtctatcctcattgagcacaaaggcaccatcattgggaagcagaacgatacctgcacagccaaggctagctgttggctggaatccgtgaaatctttcttttatggactcaagaatatgctgggcagcgtcttcgggaactttttcatcggaatccttctgtttctggcccccttcgtgctcctggtcctgtttttcatgttcggctggaaaattctgttttgcttcaagtgttgcagacgcacccggggcctcctgaaatacagactcctgaaggacgatgaggaaacagggtatcgccggatcattgagagacttaataacaagaaaggaaagaatcgcctgctggacggcgagcggctcgcggatagaaaaatcgccgaactgttttccaccaagacgcatattgggtga

SEQ ID NO: 13720 - RNA, 5055 nt, synthetic construct
  misc_feature 1..5055: note = derived and/or modified CDS sequence (opt5) from CCHFV__KJ648916.1__GP
  source 1..5055: mol_type = other RNA
atgcacatcagcctgatgtacgccattctctgcctgcagctttgtggcctgggggagacccatggatcccacaacgaaacaagacataataagacggacaccatgacaacccccggcgataacccttctagcgagccgcccgtgtccacagctctctctatcaccctggaccctagcacagtcacccccacgacccctgcctccgggcttgaaggatctggcgaggtttatacatctccccctattaccacagggtccctgccgctcagcgaaaccacgcccgagctgcctgtgacaaccggaacagataccctgtctgcgggcgacgtggatccctccacccagacagctggcgggacgagcgcccctaccgtccggacatctctccccaattccccgagcaccccttctacaccccaggacacccaccatcctgtgcgcaacctgctttccgttacgagccccggacccgatgagacatccaccccttctggcaccgggaaagaaagctccgccacaagctctccgcaccccgtgtccaatagacctcccacccctcccgctacagcccagggaccgacggagaacgacagccacaatgctaccgaacatcctgagtctctgacacagagcgccacccccggcctcatgacatcccctacccaaatcgtccacccccagtctgcgacgcctattaccgtgcaggatacacatcccagcccgaccaacgcctccaaggctaatctgaaaatggagatcatccttacactgagccaggggctcaagaaatactatggaaagattctgcggctgctccaactgacccttgaagaggacacggaaggcctgctcgagtggtgcaagcgcaacctgggccttgattgtgacgatacattctttcagaaaagaatcgaagagttctttattaccggggagggacacttcaatgaagttctgcagtttcggacacctggcaccctctctaccacagagtccacgcccgccgggctgcccaccgctgaacctttcaagagctactttgccaaaggattcctgtctatcgactccggctattacagcgcgaagtgctattccgggacatctaacagcggactccagctgattaatatcacccgccactccacaagaattgtggacaccccgggccccaaaatcacgaaccttaagacaatcaattgtattaacctgaaggcctctatctttaaagagcatcgggaagtcgagattaacgtgctcctgcctcaagtggctgtcaatcttagcaactgccacgttgtgatcaagtcccatgtgtgtgattacagcctggacattgatggcgccgtccgcctcccccacatctaccatgagggggtgttcatccctggaacctataaaattgttatcgacaagaaaaataagctgaacgatagatgcaccctgtttacagactgtgtgattaaaggccgggaagtccgcaaggggcagtctgtgctcagacagtacaagaccgagatccggattggaaaggcttccacaggcagccgcagactgctttctgaggaaccctccgatgactgcatcagccggacgcaactgctcagaaccgaaacagccgagatccacggggataattatggcggacctggcgacaaaattaccatctgtaacgggtctacaattgttgatcagcgcctgggaagcgagctgggctgctacaccatcaatcgggtgagatccttcaaactttgcgaaaacagcgccacggggaagaattgtgagattgactctgtccccgtgaaatgccgccagggatattgtctccggatcacccaggaaggcagagggcacgtcaagctgtcccgcggcagcgaggtggttctggacgcttgcgatacatcctgtgagattatgatcccgaagggaaccggcgacatcctcgtggattgctctgggggacaacagcattttctgaaagacaaccttattgatctgggctgtcctaagatccccctcctggggaaaatggcgatttacatctgccggatgagcaatcaccctaagacaaccatggccttcctgttctggttttccttcggatatgtcattacatgtatcctttgcaaagctatcttttacctcctgattatcgtgggcaccctggggaagagactcaagcagtaccgcgaactgaaaccccagacgtgtacaatttgcgagaccaccccggttaacgccatcgacgccgaaatgcatgatcttaattgctcttataacatttgtccttactgcgctagccggctgacatccgacggcctcgccagacacgtgatccaatgtcccaagcgcaaagagaaggtcgaagagaccgagctgtatctgaatcttgaacggatcccttgggtggtgagaaaactcctgcaggtttctgagagcacgggagtcgcgctgaagcggtccagctggctcattgtgctgcttgtgctgttcacagtctctctctcccccgtgcagagcgctcccatcggccaggggaagaccattgaagcctaccgcgccagagagggatatacatctatctgcctgtttgttctgggctccattcttttcatcgtgagctgtctcatgaaagggctggtcgattctgtgggaaactcctttttccctggcctgagcatctgcaagacctgttccattagctctatcaacgggtttgaaattgagagccacaaatgctactgttccctcttctgctgtccgtattgccggcattgctctacagacaaggagatccacaaactgcatcttagcatttgtaagaaaagaaagaagggctccaatgttatgctggctgtgtgcaaactcatgtgttttcgcgccaccatggaagtctctaaccgggctctgttcatcagaagcattatcaatacgacctttgtgctgtgcatccttattctggccgtttgtgtggtctccacatctgcggtggagatggaaaacctccccgccggaacctgggagcgcgaagaggatctgacaaatttctgccaccaagagtgtcaggtgaccgaaacggagtgcctctgtccttacgaagctctggtccttagaaagcccctgttcctcgacagcacagccaaaggcatgaagaacctgcttaattccaccagcctggagacatctctgtccatcgaggctccttggggagccattaacgttcagagcacctacaaacccaccgtgtctacagcgaatatcgccctctcctggagctccgtggaacatcgggggaacaagattctggtctctggccgcagcgagtccatcatgaagctcgaagagagaacggggatcagctgggatctgggagtggaagacgcttctgagtccaaacttctgaccgttagcgtgatggacctctctcagatgtatagccctgtctttgagtacctgtccggcgatcggcaagtgggcgaatggccgaaggccacatgcaccggggactgtcccgagcgctgcggatgcacatctagcacctgtctgcacaaagaatggcctcactccagaaattggcggtgcaaccccacgtggtgttggggcgttgggacaggatgcacctgttgcggccttgatgtgaaggacctgttcaccgattatatgtttgtcaaatggaaggtggagtacattaagacagaagctatcgtttgtgtggagctcacctctcaggagcgccagtgcagcctgattgaagccgggacaagattcaatctcggacctgtcacgatcaccctgtccgagccccggaacattcaacagaaacttccgcctgaaatcatcacactgcatccccgcattgaggaaggctttttcgacctgatgcacgtgcagaaggtgctcagcgcctctaccgtctgtaaactgcagtcctgcacacatggcgttcccggggatcttcaagtgtatcacatcggaaatctgctcaagggcgacaaagtgaacgggcatctgattcacaagatcgagcctcactttaacaccagctggatgtcctgggatggatgtgacctcgattactattgcaatatgggcgactggccctcttgcacgtacaccggggtcacacagcataaccacgctagcttcgtgaatctgcttaacattgagaccgattacacaaagaattttcatttccactccaaaagagttaccgcgcacggagacacacctcagctggacctgaaggcccggccgacgtatggcgctggcgaaatcaccgtgctcgtcgaggtggccgatatggaactgcataccaaaaagattgagatctctgggcttaaatttgccagcctggcttgtacaggatgctacgcctgttccagcggcatctcttgcaaggttcgcattcacgtggacgagcccgatgaactcaccgtccatgtgaaatccgacgatcctgacgtcgtggcggcttctagctccctgatggccagaaagctcgagttcgggacagatagcacgtttaaggccttctctgctatgcccaaaaccagcctgtgtttctatatcgttgaacgggagcactgcaagtcctgttctgaagaggacaccaaaaagtgcgtgaacacaaaacttgagcagcctcaaagcattctgatcgaacataagggaacaattatcggcaagcaaaattccacctgtacggccaaagcgagctgctggctggagtccgtcaagagctttttctacgggctcaaaaacatgctgagcggaatctttggcaatgtgttcatgggcatttttcttttcctggctccctttatcctcctgattctcttctttatgttcgggtggagaatcctgttttgtttcaagtgctgccgccggacaagaggacttttcaaatatcgccacctgaaggatgacgaagagaccggctaccggagaattatcgaaaagctgaacaataaaaaggggaaaaacaagctcctggatggagagcgccttgccgaccggagaatcgccgagctgttttccaccaaaacacacattggctga

SEQ ID NO: 13721 - RNA, 3495 nt, synthetic construct
  misc_feature 1..3495: note = derived and/or modified CDS sequence (opt5) from CCHVF(CCHVF 10200)__U39455.2__Gn-NSm-Gc
  source 1..3495: mol_type = other RNA
agcgaggaaccctccgacgattgcgtgtctagaacccagctgctccggacagagacggccgaaatccacggcgacaactacgggggacctggcgataagattaccatctgtaatgggagcacaattgtcgaccaacgcctgggatccgagcttggctgctataccatcaacagagttcggtctttcaaactgtgtgaaaatagcgctacagggaagaactgcgagattgattccgtgccggtgaaatgtcgccagggatactgcctcagaatcacccaggagggccggggccatgtcaagctgtctcgcgggagcgaagtggttcttgacgcctgtgatacatcctgcgagatcatgattcccaaaggaaccggcgacatcctggtggattgtagcgggggacagcaacactttctcaaggacaatctgattgatctgggctgccctaagatccccctcctggggaaaatggcgatttatatctgtagaatgtctaaccatcctaagacgaccatggctttcctgttttggttctcctttggatacgtcattacatgcatcctgtgcaaagccatcttctatctcctgattatcgtgggcacccttggccggcgcctgaagcagtacagagaactcaaaccccagacatgtaccatttgcgagacgacacctgttaatgccatcgacgctgagatgcacgatctgaactgtagctataatatttgcccgtactgtgcctctcggctgacctccgacgggctcgctcgccatgtgatccagtgccccaagagaaaggaaaaagtcgaggaaacagagctgtaccttaacctggaacggatcccttgggtggtgcgcaagctcctgcaagtcagcgagtctaccggagttgcccttaaaagatccagctggctgattgtgctcctggtgctgtttaccgtctccctctctcccgtgcagagcgcgcctatcggccaggggaagacaattgaggcctatcgggctagagaaggatacacgtccatctgtctgttcgttcttggcagcattctgtttatcgtgtcttgcctcatgaaagggctggtcgactccgtgggaaatagcttctttcccggcctttctatctgtaagacctgcagcatttcctctatcaacggcttcgagattgaaagccacaaatgttattgctccctgttttgctgtccgtactgccgccactgtagcacagataaggagatccataagctccacctgtctatttgcaaaaagcggaaaaccgggtccaatgttatgctggccgtgtgtaagctcatgtgcttcagagctacaatggaagtcagcaaccgcgccctgttcatccggtctattatcaataccacgtttgtgctttgtatcctgattctcgcggtctgcgtggtttccacaagcgccgtggagatggagaacctgcctgctggaacctgggaaagagaggaagacctgaccaacttctgtcatcaggagtgccaagtcacagaaaccgagtgtctttgcccctatgaggccctcgtgctgcgcaaacctctgtttctcgattccacagctaagggcatgaagaatctgcttaactctacgagcctggaaacctccctctctatcgaggccccctggggagccattaatgttcagagcacatacaaacccaccgtgtccacagctaacatcgcgctgagctggtcttccgtcgaacaccgggggaataagattctggtgagcggcagatctgagtccatcatgaaacttgaggaacgcaccgggatcagctgggacctcggcgtggaggatgcctctgaaagcaagctgctgacggtttccgtcatggacctcagccagatgtattctcctgtgttcgagtacctgtccggagatcggcaagtggaagagtggccgaaagctacctgcacaggcgactgtcccgagagatgcgggtgtaccagctccacatgccttcacaaggaatggcctcattctcgcaactggcggtgtaatcccacctggtgctggggagtcggcacggggtgtacatgctgtggactggatgtgaaggacctctttaccgattacatgttcgttaaatggaaggtggagtatattaaaacagaagccatcgtctgcgtggagctgaccagccaggaaagacagtgttccctgattgaggccggcacccggtttaaccttgggcctgttacaatcacgctctctgagccccgcaatattcagcaaaagctgccgcctgaaatcatcaccctgcaccccagaattgaggaaggcttctttgacctcatgcatgtgcagaaagtcctgagcgcttccacagtgtgcaaacttcagtcttgcacccacggagttcctggcgaccttcaggtgtaccatatcgggaacctcctgaagggagataaagtcaatggccacctgattcacaagatcgagccccatttcaacacaagctggatgtcctgggacgggtgtgatcttgactattactgcaatatgggagattggcctagctgtacctatacgggcgtgacacaacacaaccatgcctcttttgtgaatctcctgaacattgaaaccgactacaccaaaaacttccactttcactccaagcgggtcacagcgcatggggatacaccccagctggacctcaaagctagaccgacctatggcgccggagagatcacggttctggtggaggtggccgatatggaacttcacaccaagaaaatcgagattagcggcctgaagttcgcttctctcgcctgcacagggtgttacgcttgctccagctctatctcctgtaaggtccgcattcatgtggacgaacctgatgagctgaccgttcacgtgaaaagcgacgatcccgacgtcgtggccgcgtccagctctctgatggcccggaaacttgagttcggaacagacagcacctttaaggctttctccgccatgcccaagacgtctctgtgcttttacatcgttgaaagagagcattgtaaaagctgctccgaagaggataccaagaagtgtgtgaatacaaaactcgaacagcctcagtctattctgatcgagcacaagggcaccattatcgggaaacaaaacagcacatgcaccgctaaggcctcctgctggctcgagtctgtcaagagcttcttttatggactgaagaatatgctttccggcatcttcgggaacgtgtttatgggcattttcctgtttctcgcgccgttcatcctgctgattctgtttttcatgtttggatggcgcatccttttctgtttcaagtgctgtagacggacacgcggcctctttaaatacagacacctgaaggacgatgaagagaccgggtatcggcgcattatcgaaaaactcaataacaagaaaggaaagaataagctgcttgacggcgagagactggccgatgggcggatcgctgaactcttcagcacgaaaacacatattgga

SEQ ID NO: 13722 - RNA, 3495 nt, synthetic construct
  misc_feature 1..3495: note = derived and/or modified CDS sequence (opt5) from CCHVF(CCHVF IbAr10200)__AF467768.2__Gn-NSm-Gc
  source 1..3495: mol_type = other RNA
agcgaggaaccctccgacgattgcatctctagaacccagctgctccggacagagacggccgaaattcacggcgacaactacgggggacctggcgataagatcaccatttgtaatgggagcacaatcgtggaccaacgcctgggatccgagcttggctgctataccattaacagagtccggtctttcaaactgtgtgaaaatagcgctacagggaagaactgcgagatcgattccgttccggtgaaatgtcgccagggatactgcctcagaatcacccaggagggccggggccatgtgaagctgtctcgcgggagcgaagtcgtgcttgacgcctgtgatacatcctgcgagattatgatccccaaaggaaccggcgacattctggttgattgtagcgggggacagcaacactttctcaaggacaatctgatcgatctgggctgccctaagattcccctcctggggaaaatggcgatctatatttgtagaatgtctaaccatcctaagacgaccatggctttcctcttttggttctcctttggatacgtgatcacatgcatcctgtgcaaagccattttctatctcctgatcattgtcggcacccttggcaagcggctgaaacagtaccgcgaactcaagccccagacatgtaccatctgcgagacgacacctgtgaatgccattgacgctgagatgcacgatctgaactgtagctataatatctgcccgtactgtgcctctagactgacctccgacgggctcgctcggcatgttatccagtgccccaagcgcaaagaaaaggtggaggaaacagagctgtaccttaacctggaacggattccttgggtcgtgagaaaactcctgcaagtgagcgagtctaccggagtcgcccttaagcgctccagctggctgatcgttctcctggtgctgtttaccgtgtccctctctcccgtccagagcgcgcctattggccaggggaaaacaatcgaggcctatagagctcgggaaggatacacgtccatttgtctgttcgtgcttggcagcatcctgtttatcgtttcttgcctcatgaaggggctggtggactccgtcggaaatagcttctttcccggcctttctatttgtaaaacctgcagcatctcctctattaacggcttcgagatcgaaagccacaagtgttattgctccctgttttgctgtccgtactgcagacactgtagcacagataaggagattcataaactccacctgtctatctgcaagaaacgcaagaaagggtccaatgtgatgctggccgtttgtaagctcatgtgcttccgggctaccatggaagtgagcaacagagccctgttcattcgctctatcatcaatacaacctttgtcctttgtattctgatcctcgcggtgtgcgtcgtgtccacgagcgccgttgagatggagaacctgcctgctggaacatgggaacgggaggaagacctgaccaacttctgtcatcaggagtgccaagtgaccgaaacagagtgtctttgcccctatgaggccctcgtcctgagaaagcctctgtttctcgattccaccgctaaaggcatgaagaatctgcttaactctacaagcctggaaacgtccctctctattgaggccccctggggagccatcaatgtgcagagcacctacaaacccacagtttccaccgctaacattgcgctgagctggtcttccgtggaacaccgcgggaataagatcctggtcagcggccggtctgagtccatcatgaaacttgaggaaagaacagggattagctgggacctcggcgtggaggatgcctctgaaagcaagctgctgaccgtgtccgttatggacctcagccagatgtattctcctgtcttcgagtacctgtccggagatcgccaagtgggcgaatggccgaaggctacgtgcaccggggactgtcccgagcggtgcggatgtacaagctctacctgccttcacaaagagtggcctcattccagaaactggcgctgtaatcccacatggtgctggggcgtggggaccggatgtacgtgctgtggcctggatgtcaaggacctctttacagattacatgttcgtgaaatggaaggttgaatatatcaaaaccgaggccattgtgtgcgtcgaactgacaagccaggagcggcagtgttccctgatcgaagccgggaccagatttaaccttggccctgtgaccattacactctctgagccccggaatatccagcaaaagctgccgcctgagatcattacgctgcacccccgcatcgaagagggattctttgacctcatgcatgttcagaaggtgctgagcgcttccaccgtctgcaaacttcagtcttgcacacacggcgtgcctggggacctgcaggtttaccatattggaaacctcctgaagggcgataaagtgaatgggcacctgatccacaagattgaaccccatttcaacaccagctggatgtcctgggacggatgtgatcttgactattactgcaatatgggcgattggcctagctgtacatataccggggtcacgcaacacaaccatgcctcttttgtgaatctcctgaacatcgagacagactacaccaaaaacttccactttcactccaagagagtgaccgcgcatggcgatacaccccagctggacctcaaagctcggccgacctatggagccggcgaaatcacagtcctggttgaggtggccgatatggagcttcacacgaagaagattgaaatcagcgggctgaaattcgcttctctcgcctgcaccggatgttacgcttgctccagcggcatttcttgtaaggtgagaatccatgtcgacgagcctgatgaactgacagtgcacgttaaatccgacgatcccgacgtggtcgccgcgagctccagcctgatggcccgcaaacttgagttcgggaccgactctacatttaaggctttcagcgccatgcccaagacctccctgtgcttttacattgtggagcgggaacattgtaagtcttgcagcgaggaagatacgaaaaagtgtgttaataccaaactcgagcagcctcagtccatcctgattgaacacaagggaacaatcatcggcaaacaaaactctacctgcacagctaaggccagctgctggctcgagtccgtgaagtctttcttttatgggctgaaaaatatgcttagcggcattttcggaaacgtctttatgggcatcttcctgtttctcgcgccgttcattctgctgatcctgtttttcatgtttgggtggcgcattcttttctgtttcaagtgctgtagaagaacccggggactctttaaataccgccacctgaaggacgatgaggaaacaggctatagacggatcatcgagaaactcaataacaagaaggggaaaaataagctgcttgacggagaacgcctggccgatagacggattgctgagcttttctccaccaaaacgcatatcggc

SEQ ID NO: 13723 - RNA, 3495 nt, synthetic construct
  misc_feature 1..3495: note = derived and/or modified CDS sequence (opt5) from CCHVF(CCHVF Turkey-Kelkit06)__GQ337054.1__Gn-NSm-Gc
  source 1..3495: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtaaaaattctgctacagggaagacctgcgaagttgacagcacaccggtgaaatgtcggcagggattttgcctcaagatcacccaggagggccgcggccatgtgaagctgtccagagggtctgaggtcgtgcttgatgcctgtgacagctcctgcgaagttatgatccccaaaggaacgggcgatattctggtggactgtagcgggggacagcaacacttcctcaaggataacctgatcgacctgggctgccctcatattcccctcctggggcggatggcgatctacatttgtcgcatgtctaatcaccctagaaccacaatggcttttcttttctggttttccttcggatatgtcattacctgcatcttttgcaaagccctgttctacagcctcatcatcattggcacactgggcaagaaaatcaagcagtatcgggagcttaagccccagacctgtacgatttgcgaaacagcccctgtgaacgctatcgatgccgagatgcatgacctgaattgttcttacaacatttgcccgtattgtgcttcccgcctcaccagcgacgggctggccagacacgttacacagtgccccaaacggaaggagaaagtggaagagaccgaactgtacctcaatctggagcgcatcccttggatcgtcagaaaacttctgcaagtgtctgaatccaccggagtggcgctcaaacggagctcctggctgattgtccttctggttctcctgacagtgtctctgagccccgtgcagtccgcccctgtcggccacgggaagacgatcgagatttaccagacccgcgagggatttgctagcatctgtctcttcatgctgggctctattctttttatcgtgtcctgcctggttaaagggctcgtggatagcgtctctgagagcttctttcccggactgtccgtgtgtaagacatgctctatcggcagcgttaacggcttcgaaattgaatcccataagtgttattgcagccttttctgctgtccgtactgcagacactgttctgccgaccgggagatccatcagctgcacctctccatttgcaaaaagagaaaaaccgggagcaatgtgatgctggctgtctgtaagcgcatgtgctttcgggccacaatcgaagcgtctagacgcgccctgctcattcggtccatcattaacaccacgttcgtgatctgtatcctgacacttaccatttgcgtcgtgagcacctccgctgttgagatggagaatctgcctgccggaacatgggaaagagaggaagatctcaccaacttttgtcaccaagagtgccaggtgacagaaacggagtgtctgtgcccctatgaggctctggtccttcgcaaacctctcttcctggactctatcgtgaagggcatgaagaatctgctcaacagcacctccctggaaacatctcttagcattgaggccccctggggagccatcaacgttcagtccacctttaaacccacagtgagcaccgctaatattgcgctgtcttggtccagcgtcgtgcatcggggaaacaagatcctcgtgacgggcagatctgaatccatcatgaaactggaggagcgcaccggggttagctgggatctgggcgtcgaagacgcctctgagagcaaacttctcacagtgtccattatggatctgagccaaatgtactctcctgtgttcgaatatctgtccggagaccggcaggtcgaggaatggccgaaggctacctgcacaggcgattgtcccgagagatgcgggtgtaccagctccacgtgcctccacaaggagtggtctcatagccgcaattggcggtgtaaccctacatggtgctggggagtgggcaccgggtgtacatgctgtggagttgacgtgaaggatctgtttaccgaccacatgttcgtcaaatggaaggtggaatacatcaaaaccgaggccattgtttgcgtggcccttacatcccaggaaagacagtgttctctgatcgaggctggcacgcggtttaatctcgggcccgtcaccattacactgagcgaacctcgcaacatccaacagaagctgcccccggagatcattacccttcatcctaaaatcgaggaaggcttctttgacctcatgcacgtgcagaaggttctgtccgcctctacagtgtgcaagctgcagagctgcacccacgggattcccggcgatctccaagtctatcatatcgggaatctgcttaaaggagacagagtgaacggccacctgattcataagatcgagtcccacttcaatacgagctggatgtcttgggatgggtgtgacctcgattactactgcaacatgggagactggccttcctgtacatataccggcgtgacccagcacaatcatgcggcttttgtcaacctgctgaatatcgaaacagattacaccaaaacattccacttccatagcaagcgggttacggcccacggggacacaccccagcttgatctcaaagccagacctacctatggcgctggaggcattaccgtgctggtggaggtcgccgacatggaactgcatacaaagaaagtggagatctctgggctcaagtttgcttccctggcctgcaccggatgttacgcgtgcagctctggcatttcctgtaaggttcgcatccacgtggatgagcccgacgaacttacggtccacgtgaaaagctccgatccggacgttgtggccgctagcacctctctgatggcccggaagctcgagttcgggacagacagcacctttaaggctttctccgccatgcctaagacatctctgtgcttttatattgtcgaaagagagtactgtaaaagctgctccgaggatgacacccagaagtgtgtggatacacgcctggaacaaccccagtctatccttattgagcataagggaaccatcatcggcaaacagaacgacacgtgcacagcgaaggccagctgctggctggaatccgttaaatctttcttttatgggctcaagaatatgctgggcagcgtgttcggaaacctctttattggcatcctgcttttcctggctccctttgtcctcctggtgctgttctttatgttcgggtggaaaattcttttctgttttaagtgctgtagacggacccgcggactgttcaagtacagacacctcaaagatgacgaggaaaccggctaccggcgcatcattgagagactgaactccaagaaagggaagaatcggctcctggatggagaccgccttgccgatagaaaaatcgctgagctgtttagcacaaagacccatatcggc

SEQ ID NO: 13724 - RNA, 3498 nt, synthetic construct
  misc_feature 1..3498: note = derived and/or modified CDS sequence (opt5) from CCHVF(CCHVF SR3)__AJ538199.1__Gn-NSm-Gc
  source 1..3498: mol_type = other RNA
agcgaggaatccggcgacgattgcatctctagaacccagctgctccggacagagacggccgaagtgcacggggacaactacggaggccccggggataagattaccatctgtaatggaagcacagtcgttgaccaacgcctgggctccgagcttgggtgctataccattaacagagtgcggtctttcaaactgtgtgaaaatagcgctacaggaaagtcctgcgagatcgattctattcctgtgaaatgtaagcagggctactgcctcaaaatcacccaggagggccgcgggcatgtcaagctgagcagaggatccgaagtggttcttgacgtgtgtgatagctcttgcgaggtcatgatcccgaagggcacaggggacattctggtggattgttccggaggccagcaacactttctcaaagacaacctggttgatctggggtgccccaagatccctctcctgggaaaaatggccatttatatctgtcggatgagcaatcatcccaagaccacgatggcgttcctgttttggttctcttttggctacgtgattacctgcatcctgtgcaaagctattttctttctcctgatcatcttcggcacacttgggaagcgctttaagcagtatagagaactgaaacctcagacctgtacaatttgcgagaccacgcccgtcaacgccatcgacgccgagatgcacgatctcaattgttcctacaacatttgcccttattgtgctagccggctgacatctgacggactggcccgccatgtgacccagtgcccgagacggaaggaaaaagtggaggaaacagagctctacctgaatcttgaacgcatcccctgggtcgttagaaagctgctccaagtgtccgagagcaccggcaccgtgctgaaacggtcctcttggcttattgtcctgctcgtgctgttcacagttagcctgtcccctgtgcagagcgctcccatcgggcacggaaagacgatcgagacctaccgcgtcagagaagagtatacatctatttgtctctttgtgctgggctccatccttttcattgttagctttctgatgaaagggctcgtggacggagtcggcaacatcttcttccctggcctgtctgtgtgcaagacctgtagcattgggtccatcaatggatttgaaatcgagtctcacaagtgctactgtagccttttctgctgcccctattgtcggcattgctccgccgatggcgaaattcaccagctgcatctcagcatctgtaaaaagagaaaaacagggtctaacgtcatgctggcggtgtgcaagcgcatgtgttttcgggccaccatggaggtttccaataaagctctgttcattagaagcatcattaacacgacatttgtgatgtgcatcctcaagggagagttcgccgctgtcaagtctattcacccgatcgaaatggagtccctgcctgccggcacctgggaacgcgaggaagaccttaccaatttttgtcaccaggagtgccaagtgacagagaccgaatgtctgtgcccctacgaggcgctcgttctgcggagacctctgttccttgatagcatcgtgaaagggatgaagaacctcctgaactccacatctctggaaacgagcctctccattgaggccccctggggcgctatcaatgtccagtctacctataaacccacagtgagcaccgccaacattgctctgtcctggagctctgtggagcatcgcggaaataaggttcttgtctccggccggagcgaatctatcatgaaactggaggaaagaacagggatttcctgggacctcggagtggaggatgccagcgaatctaagctgctgaccgtgagcgtcatggacctttcccagatgtacagccctgtgtttgagtatctctctggcgatcgccaagttgaggaatggccgaaggccacgtgtaccggggactgccccgagcggtgcggatgtacatcctctacctgcctgcacaaagaatggcctcattccagaaactggcgctgtaatcccacatggtgctggggcgtggggaccggctgtacgtgctgtggactggatgtcaaggacctcttcacagattacatgtttgtgaaatggaaggttgagtacatcaaaaccgaagctatcgtgtgcgtcgagctgacatctcaggagcggcagtgtagccttattgaagcgggcaccagattcaacctggggtccgtgaccatcacactctctgagcctcggaatattcagcaaaagctgcccccggaaatcattacgctgcaccctaagatcgaggaaggatttttcgaccttatgcatgttcagaaagtgctcagcgcctccaccgtctgcaagctgcagtcttgtacacacggcgtgcccggggaccttcaggtgtatcacatcggaaacctcctgaaaggcgatcgcgtcaatgggcatcttattcacaagatcgagcaacatttcaacaccagctggatgtcctgggacggctgcgatctggactactattgcaatatgggagattggcctagctgtacatacaccggcgttacgcagcacaaccacgcttcttttgtgaatctcctgaacattgagacagactataccaaaaccttccattttcactccaagagagtgacagcccatggggatacaccccagctggaccttaaagcccggcctacctacggagctggcgaaatcacggtcctcgtggaggttgccgatatggaactgcacaccaagaagattgagatcagcgggctgaaattcgcgggactcacatgcaccggctgttatgcttgcagctccgggatcagctgtaaggtgcgcattcatgtcgacgagcccgatgaactgacagtgcacgttaaatctgacgatccggacgtggtcgccgcctccagctcccttatggctagaaagctggagtttggcaccgacagcacgttcaaagccttttctgctatgcctaagaccagcctctgcttctacatcgtggaacgggagtactgtaagtcctgcaataaagaagatacacagaagtgtgttaacaccaaactggagcaaccccagtctattctgatcgagcacaagggaacaattatcggcaaacagaacaatacctgcacagccaaggcgagctgttggcttgaatccgtgaagtctttcttttatgggctgaaaaacatgctcggaggcatttttgggaatgtcttcatcggaatctttaccttcctgacgcccttcattctcctgatcctgtttttcatgtttggctggcgcattcttttctgctttaagtgctgtagaagaacacggggcctcttcaaataccgccatctgaaggacgatgaggaaaccgggtatagaaaaatcattgagcggctgaacaataagaagggcaaaaaccgccttctggacggagaaagactcgccgatcggaagatcgctgagctgtttagcaccaaaacacacatcggg

SEQ ID NO: 13725 - RNA, 3498 nt, synthetic construct
  misc_feature 1..3498: note = derived and/or modified CDS sequence (opt5) from CCHVF(CCHVF UCCR4413)__KY484038.1__Gn-NSm-Gc
  source 1..3498: mol_type = other RNA
agcgagtcctctgccagcggctgcatctccagaacccagatgattaagtctgaaacagctgagatccacgacgatatttacgggggacccggcgaaaaactgacgatctgtaacgggaccacagtggtcgaccaacggctcggaagcgagctgggctgctataccattaatcgcatcaagacatacaaactttgtgaaaactccgttaaggagaaaacctgcgagatcgattctgtgcctgtgaagtgtagacaggggctgtgcctcaagattacacaggaaggacggggccatgtcaaactgagccgcggctccgagatcgtgcttgacatttgtgatagctcttgcgaactgatgatcccgaaggggaccggagacattctcgttgattgttccggcgggcagcaacacttcctgcaggacaatctggtggatctcggatgccccaacatccctctgcttggcaaagtcgccatttatatctgtagaatgagcaatcatcccaagacgaccatggcgtttctgttctggttttctttcgggtacgtgatcacatgcattctctgcaaaatcctgttttatcttctgattatcaccggaacactcggcaagaagctgaaacagtaccgggagctgaagcctcagacctgtacgatttgcgagtccacacccgttaacgctatcgacgccgaaatgcacgatctcaattgtagctataacatctgcccttactgtgcctctcgcctgacctccgacggccttattagacatgtgaatctgtgcccgaaacggaaggagaaagtcgaagagacagaactctacctgaaccttgagcgcatcccctggttcgtgagaaagctgctccaagtgagcgagtccaccggggtcgctctgaaacggtctagctggctgctcattctggttatccttctgaccgtgtccatgagccctgtgcagtctgcccccattaatcagcagcgcgctgtcgaagcctatcaagcgagagagggatacacaggcatctgtctctttatcctggggtccgtgcttttcatgacgagctggctgaccaagggactcattgattctatcggcgacagctttttccctgggctgtttgtttgcaagacatgttccattggatctatcaacggcttcgaaattgagagccaccggtgctattgttccctgctctgctgcccctactgtagaacctgcagcgccgacaaagattctcaccagctgcatctttccatctgtaagaaaaagaaagctggcagcaatgtgatgctggccgtctgcaagcgcatgtgttttaaggctacaattgaagcctctaaccgggtgctcctgatcagatccatcattaataccacgttcatcatttgcatgctgatccttgttgtgtgtgtcattagcacatccgcggtggagatggaggacctcccggccgggacctgggaacgcgaggaagatctgaccaacttctgccaccaggagtgtcaagtcacagaaaccgagtgcctgtgtccttatgaggcttttgtgctccggaaacccctgttcctttctagcatcgttaaggggaaaaagaacctgctcaattccgcctctctggaaacaagcctgtccatcgaggctccttggggcgccattaacgcccagagcacgtttaaacccaccatctctacagctaatattgcgctttcctggagctctgtggaacatagagggaacaaggtcctcgtgtccggacgcagcgagtctatcatgaagctggaggaacggaccggcattagctggaatctgggggttgaggacgcctccgaaagcagaatgctcacagtgtctgtcatggatctgtcccagatgtaccttcccgtgttcgagtatctgagcggcgaccgccaggtggaagagtggcctaaagctacctgcacgggagattgcccggagcggtgtggctgcacctcctctacatgtctccacaaggaatggccccacagcagaaactggcgctgcaatcctacctggtgttggggagttggaacaggctgcacctgttgcgggctggacgtcaaagatctgtttacggactacatgttcgtgaagtggaaagtggagtacatcaagacagaagccatcgtctgtgtggagcttacctcccaagaacggcagtgctctctcattgaggccggaacaagatttaacctgggccccgttaccatcaccctgagcgagcctcgcaatattcagcagaagctcccctccgaaatcgtgacactgcatccgaaaattgaggaagggttctttgatcttatgcacgtccaaaaggtgctgtctgctagcacggtttgtaaactccagtcctgcacccatggcgtggccggagacctgcaggtctatcacgtgggcaacctgcttaagggggacaaaatcaatggacatagcatccacaagattgagcctcacctcaacacatcttggatgtcctgggatggctgcgacctggattactattgtaatatgggggactggcccagctgcacctacacaggagttacccagcataaccacgcggctttcgtgaatctgctcaacatcgaaacggattatacaaaatcttttcatttccactccaagcgggtcaccgcccacggcgacacccctcaactggatcttaaggccagacccatgtacggggctggcgagattacagtgctggtggaggtcgccgacatggaactccatagcaaaaacatcgagatttctggactgaagtttgcttccctgacctgtagcggctgctatgcctgttccagcgggatctcttgcaaagttcggattcacgtggatgaacctgacgagcttgcggtgcatgtcaagagcgatgacctggatgtggttgccgcttcctctagcctcatggcccgcaaaatcgagttcggaacagactccacgttcaaggctttttctagcatgcccaaggaatccctgtgtttctacatcgtggagagagacttttgcaaatcttgtgccgcggaagatacccagaagtgcgtcaaagccaagctcgagcagccgcagagcattctgatcgaacacaaaggcacaattatcgggaagcaaaatgacacctgttccacaaagaccagctgctggcttgagtctttcaaatcctttttctacggactgaagaacatgctcagcggcgtgtttgggtctgctattatgggcatcctgctgttccttgccccttttatcctgctcattctgttctttttctttggatggcggatcctcttctgcctgagatgttgccgccggacgagaggccttttcaaatataagcatattaaagatgacgaggaagctgggtacaagaagatcattgagaaactgaataacaagaaaggaggcacctccaagctcctggatggggaacgcctggccgacagaaaaatcgccgagctttttagcacaaaggctcacatcgga

SEQ ID NO: 13726 - RNA, 3495 nt, synthetic construct
  misc_feature 1..3495: note = derived and/or modified CDS sequence (opt5) from CCHVF(CCHVF 66019)__AB069669.1__Gn-NSm-Gc
  source 1..3495: mol_type = other RNA
agcgaggaatccggcgacgattgcatctctagaacccagctgctccggacagagacggccgaagtgcacggggacaactacggaggccccggggataagattaccatctgtaatggaagcacaattgtcgaccaacgcctgggctccgagcttgggtgctataccatcaacagagttaaatctttcaagctgtgtgaaaatagcggaacaggcaaatcctgcaagattgataacacccctgtgaaatgtcggcagggcttttgcctcaagatcacacaggaggggcgcggacatgtgaagctgtctagaggcagcgaggtcgtgcttgacgcttgtgattccagctgcgaaatcatgattccgaaagggaccggagacatcctggttgattgttctggcgggcagcaacacttcctcaaggacaatctggtggatctgggatgccccaacattcctctcctgggcaaaatggccatctacatttgtcggatgtccaatcatcccaagacgaccatggcgtttcttttctggtttagcttcggctatgtcatcacatgcatcttttgcaaaattatcttctacctgctcattgtggttgggaccctgggaaagaagtttaaacagtatcgcgagcttaagcctcagacatgtaccatctgcgaaacgacacccaccaacgctattgacgccgagatgcacgatctgaaatgttcttacaatatctgcccttattgtgcctccagactcacaagcgacggcctggctcggcatgtgacccagtgcccgaagcgcaaagagaaggtcgaagagaccgaactgtacctcaacctggagcggattccctggatcgtgagaaaacttctgcaagtgtctgaatccacaggggtcgccctcaagcgcagctcctggctgatcgttcttctggtgctcctgacggtgtctctgagccctgtccagtccgctcccattggacacggcaagaccatcgaggcctaccagacaagagaggggtataccagcgtgtgtctcttcatgctgggaggcattctttttgttgtgtcttgcctgatgaaaggcctcgtcgactccgtgagcaattctttctttcctgggctgagcatctgtaagacatgctccattggatctgttaacggcttcgaaatcgagagccacaaatgttactgctcccttctgtgctgtctctattgccggcattgtagcgcggatcgcgaaatccaccagctgcatctgtctatttgcaagaaaagacgggccgggggaaatgtgatgctcgctgtctgtaagagaatgtgcctgcgcgccaccatggaggtgtccaacaaggtccttttcatccggagcattatcaatacgacatttgtgatttgtatcctggttctcgctgtgtgcattgtctctacctccgccgtggaaatggagagcctgcccgcgggcacctgggagagagaagaggacctgacaaacttctgtcaccaagaatgccaggttaccgagacagaatgtctttgcccgtacgaggccctcgtgctgcgcaaacctctgttttccgattctatcgtcaaggggatgaaaaacctcctgaatagcacgtcccttgagacctctctgagcatcgaagctccctggggcgccattaacgtgcagtccacattcaagcctaccgtgagcacagctaatatcgccctctcttggtccagcgttgagcaccggggaaacaaaattctggtctctggcagatccgaaagcatcatgaagctggaggagcgcaccgggatttcttgggaccttggagtggaagatgccagcgagtccaagctcctgacggtgagcgtcatggacctgtctcaaatgtattcccccgtgtttgaatacctcagcggcgatcggcaggttgaggaatggcccaaagctacctgcacagggaattgtcctgacagatgcggatgtacctcctctacatgcctgcataaggagtggccgcacagccgcaactggcggtgtaatcccacctggtgctggggcgtggggacgggctgtacatgctgtggacttgatgtcaaagacctgttcaccgattatatgtttgtgaagtggaaagttgagtacatcaagacagaagcgatcgtgtgcgtcgagctcaactcccaggaaagacagtgttctctgattgaggccggcacccgcttcaatctggggcctgtgaccatcacacttagcgaaccccggaacattcaacagaagctcccttccgagatcattacgctgcatcccagaatcgaggaaggatttttcgacctgatgcacgttcagaaagtgctctctgctagcaccgtctgcaagctgcagtcctgcacacatggcgtgccgggggaccttcaaatctaccacattggaaatctgctcaaaggcgatcgggtgaacgggcacctgatccataagattgagcctcactttaataccagctggatgtcttgggacggctgtgatctggactattactgcaacatgggagattggccctcctgtacatataccggcgtcacgcagcataatcacgccgccttcgttaaccttctcaacatcgaaacagactacaccaaaaattttcacttccatagcaagcgcgtgaccgctcacggggatacacctcagctggacctgaaagccagacccacctatggagcgggcgagattacagtgctcgtcgaagtggctgatatggagctgcatacgaagaagatcgccatctctgggcttaaattcgcctccctgacctgcacaggatgttacgcttgcagctctggcatttcctgtaaggttcggatccacgtggacgagcctgatgaactcaccgtccatgtgaaaagcgaggaccccgatattgttgccgcttccagctctctgatggccagaaagctggaatttgggacagacagcaccttcaaagcgttttccgccatgccgaagacgtctctttgcttctatatcgtggagcgcgagtactgtgaaagctgctccaaggaggacacccagaaatgtgtcaacacaaagctggaacaacctcagtctattctcatcgagcacaaaggcaccattatcggaaagcagaatgatacatgcaccgctaaagccagctgctggctggaatccgtgaagtctttcttttacggcctcaagaacatgctgagcgggatctttggaaatgttttcattggcatctttcttttcctggctccctttattctcctgatcctgttctttatgttcgggtggcggattcttttctgttttaaatgctgtagacgcacaagaggactgttcaagtatcggtacctcaaagacgatgaggagtccggctatcgcagaatcatcgaacggctgaacaataagaaaggcaagaacaagctcctggacggggagcgccttgccgatagacggattgcggaactgtttagcaccaaaacgcacatcgga

SEQ ID NO: 13727 - RNA, 3495 nt, synthetic construct
  misc_feature 1..3495: note = derived and/or modified CDS sequence (opt5) from CCHVF(CCHVF 7001)__AB069670.1__Gn-NSm-Gc
  source 1..3495: mol_type = other RNA
gccgagggcgggagctccgactgcatctctagaacccagctggtgaagacagaagtcgctgagattcacgaagatagctacggaggccccggggagaaaatcacgatttgtaacggatccaccatcgttgaccaacggctcggctctgaactggggtgctatacaattaatcgcgtgagaagctacaaactttgtgagaactccgcctctggaaaaagctgcgagatcgattccatccctgtgaagtgtaaacagggcttctgcctgaagattacccaggaaggccgggggcatgtcaagctcagccgcggaacagagatcgtgctggacgtttgtgattcttcctgcgaacttatgattccgaaaggcaccggggacatcctggtggattgtagcggaggccagcaacactttctccagaataacctgattgacctggggtgccccaatgtccctctcctgggaaagatggcgatctatgtgtgtagaatgtctaaccatcccaaaacaaccatggctttcctgttttggttctcctttggctacgttattacgtgcatcgcctgccgggtgcttttctatctcctgatcgccattggcaccgtcgggaagaaacttaagcagtaccgcgagctgaagcctcagacatgtatcgtgtgcgagagcgtgcccgtcaatgctattgatgccgaaatgcacgagctcaactgttcttataatatctgcccttactgtgcttccagactgagcaccgacggactgattcggcatgttacacaatgcccgaaacgcagagaaaaggtggaggaaaccgagctctttctgaaccttgagcggatcccctggctggtgcgcaaactcctgcaggtctccgaatctacgggcatggcccttaagagaagctgttggatgatcacactgctcattctgctgctcgtgtccatcagccctgttcagtctgcgcccgtggggaaagagcgggccattgaaacctaccaggctcgcgagacatataccggaatctgcctgttcgtccttggctccgtgctgtttgccgttagctggctcaccaaggctctgattgatgggatcggaaattctttctttcctggccttagcgtgtgtaaaacatgctccatcggctctattaacgggttcgaaatcgagagccacaagtgttactgctccctgttttgctgtccctattgcagagcctgtagctctgacaagaatacgcaccggatgcatctcaacgtctgcaaaaagagaaaaatgggatccaatgtgatgctggcggtctgtaagcgcatgtgcttccgggccaccattgaggctagcaacaaagccctgctcatcagatctattatcaactccacattcgtgatttgtatcctgatccttaccatttgcgttgtgagcacatccgctgtcgatatggaaaatctgccggccggcatctgggagaaggaagaggacctcaccaacttttgtcaccaagaatgccaggtgacggagacagagtgtctgtgcccttacgaagccatggttctgcgcaagccccttttcctcgacaatattgctaaagggatgaagtctctgctgaacagcacctccctcgagacctctctgagcatcgaagcgccttggggagccattaatgtgcagtccacatttaaacccaccgtcagcgctgccaacatcgccctttcttggtccagcgtggagcatcggggcaataagatcctggtgtctgggagatccgagagcattatgaaactcgaggaacgcacaggcgtttcttggaacctgggagtcgaagatgctagcgagtccaagacgctgaccgtgagcgtgatggacctttctcaaatgtattcccccgtcttcgaatacctcagcggcgatagacaggtggaggagtggcctaaggccacatgcaccggggactgtccggaaagatgcggatgtacatcctctacctgcctgcacaaagagtggccccacagccgcaattggcggtgtaaccctacgtggtgctggggcgttgggaccggatgtacatgctgtggcctggatgtgaaggactttttcaccgattatatgctcgtcaaatggaaggtggaatacatcaaaacagaggcgattgtttgcgtggaactgacctcccaggagagacagtgttctcttatcgaggctgggacgcgctttaatctgggccccgtcacaattaccctcagcgaacctcggaacgtgcaacagagactgcccccggagatcgttacactgcatcctaagatcgaagagggattctttgaccttatgcacgtgcagaagattctctccgcctctaccgtctgcaaactgcagagctgcacccatggcgtgcccggggatttccaagtgtaccacgtcggaaatctgctccggggcgacaaggttaacgggcattccatccacaaaattgaacctcactttaatacaagctggatgtcttgggatggatgtgacctggactatttctgcaacatgggcgattggccctcctgtacgtacaccggggtgacacagcataaccgcgccgcttttatcaatatgcttaacattgagaccgactatacaaagaccttccacttccatagcaaaagagtgacggcccacggcgatacacctcagctggacctcaaggctcggcccgcctacggagcgggcgaggtcaccgtgctggttgaagtggccgatctggagcttcacaccaaaaagctcgaagtctctgggctgaagatcgcttccctgacatgcagcggatgttatgcctgttcttccggcatcagctgcaaagtgcggattcatgttaatgagccggacgagtttaccgtgcacgtccgctccagcgatcctgacgtggttgctgccgggtctagcctcatggcgcggaagatcgagttcggagccgattccacatttaaggctttctctagcatgcccaaggactccctgtgcttttacattgtggaaaaagattattgttctagctgcacggacgatgacacccagaagtgtgtcaacacaaaacttgaccatccccaatccatcctgattgaacacaagggcaccatcattgggaagcagaatgatacatgctctaccaaaacgagctgctggctcgagtccgtgaagggcttcttttacggactgaaaaacatgctgagcggcatcttcgggaatgtgtttcttggaatcttcctgtttctcgcccctttcgtcctgctcatctttttcttctttttcggctggagactgctgttttgtcttaagtgctgtcgcagaacccgggggctcctgaagtacaaacatctgaaggacgaagaggaggctggatataaaaagattattgaacgccttaacggcaaaaagggcaagtctcagctgttcgatggggagagactcgccgaccggaaaatcgccgaactgttttccacaaagattcacatcgga

SEQ ID NO: 13728 - RNA, 3495 nt, synthetic construct
  misc_feature 1..3495: note = derived and/or modified CDS sequence (opt5) from CCHVF(CCHVF 75024)__AB069671.1__Gn-NSm-Gc
  source 1..3495: mol_type = other RNA
agcgaggaatccggcgacgattgcatctctagaacccagctgctccggacagagacggccgaaattcacggggacaactacggaggccccggggataagatcaccatttgtaatggaagcacaatcgtggaccaacgcctgggctccgagatggggtgctataccattaacagagtcaaatctttcaaactttgtgaaaatagcgctacaggaaagtcctgcgagatcgattctatccctgttaagtgtcggcagggctactgcctgaaaattacccaggagggccgcgggcatgtgaagctcagcagaggatccgaagtggtcctggacgcctgtgatagctcttgcgaggtgatgatcccgaagggcacaggggacattcttgttgattgttccggaggccagcaacactttctgaaagacaacctcatcgatctggggtgccccagcattcctctgctcggaaagatggcgatctatatttgtcggatgtctaatcatcccaaaaccacgatggctttcctgttttggttctcctttggctacgtgattacctgcatcctttgcaaggccattttctatctgctcatcattgtcggcacactggggaaacgctttaagcagtacagagaacttaagcctcagacctgtacaatctgcgagaccacgcccgccaacgctattgacgccgagatgcacgatctgaattgtagctataacatctgcccttactgtgcttctcggctcacatccgacggactggcccgccatgtgacccagtgcccgaaaagaaaggaaaaagttgaggaaacagagctgtacctcaatctggaacggatcccctgggtggtccgcaaacttctgcaagtgagcgagtccaccggcgtggcgctcaagagatctagctggctgattgtccttctggttctcttcgccatctccctgagccctgtgcagtctgctcccattgggcacggaaagaccatcgagacatatcaggcccgggaagagtacacgtccatttgtctgtttgtgctcggcagcatcctgttcatcgtctcttgccttatgaaagggctggtggacagcattggaaacatctttttccctggcctctccatttgtaagacctgctctatcggcagcattaatgggtttgaaatcgagtcccacaagtgttattgcagcctgctttgctgtccctactgccgccattgttctgctgatagagaaattcaccagctgcatctctccatctgcaaaaagcggaaaacaggaagcaacgttatgctggccgtgtgtaagagaatgtgcttccgcgcgaccatggaggtctctaataaagccctgctcatccggtccattatcaacacaaccttcgtggtttgtattctgatccttgctgtgtgcgtcgtgagcacgtccgccgtcgagatggaatctctgccggctggcacatgggagagagaagaggacctcaccaatttttgtcaccaagaatgccaggtgaccgagacagagtgtctgtgcccttatgaagccctggttcttcgccggcccctcttcctggatagcattgtgagagggatgaagaaccagctgaactccacctctctcgagacaagcctgtccatcgaagccccttggggagctatcaatgtccaaagcacgtacaagcccaccgtgtctacagcgaacattgccctttcctggagctctgttgagcaccgcggcaataaaatcctggtgtccgggcggagcgagtctattatgaagctcgaagagagaaccggcatcagctgggacctgggagtcgaagatgcttccgagagcaaactgcttacagtgtctgtgatggacctctcccagatgtatagccccgtttttgaatacctgtccggcgatcgccaggtcgaggagtggcctaaggctacctgcacgggggactgtccggaacggtgcggatgtaccacatctacctgcctgcataaagagtggccccacagcagaaactggcgctgtaatcctacatggtgctggggcgtggggaccggatgtacgtgctgtggcctcgatgtgaaggacctgttcacagattacatgattgtcaagtggaaagtggaatatatcaagaccgaggccatcgtttgcgtggaacttacatcccaggagcggcaatgttctctgattgaggccgggaccagatttaacctcggcagcgtcaccatcacactgtccgaaccccggaatattcagcagaaactgcctcccgagatcattacgcttcatccgcgcatcgaagagggattctttgacctcatgcacgtgcagaaggttctgtctgccagcaccgtgtgcaaactgcaatcctgcacacatggcgtccctggggacctccaggtgtaccacgttggaaacctgcttaagggcgataaggtgaatgggcacctgatccataaaattgaaccccacctcaacaccagctggatgtcttgggacggatgtgatctggactattactgcaatatgggcgattggccttcctgtacatataccggggtcacgcagcataaccacgcgagcttcgtgaatctgcttaacatcgagacagactacaccaagtcttttcacttccattccaaaagagtgaccgctcacggcgatacaccccagctcgacctgaaggcccggcctacctatggagccggcgagattacagtcctggttgaagtggctgatatggagtttacgcccaaaaagatcgaaattagcgggctcaaattcgcctctctgacctgcacaggatgttacgcttgctccagcggcatctcctgtaaggtgagaatccatgtcgacgagccggatgagcttaccgtgcacgttaagagcgacgatcctgacgtggtcgccgcgtctagctccctgatggcccgcaaactcgaatttgggacagactctaccttcaaggctttcagcgccatgcccaaaacgtccctgtgcttttacatcgtggagcgggaatattgtaagtcttgcagcaaagaggatacccaaaagtgtgttaatacaaagctggaacagccccagtccatccttattgagcataaaggaaccatcattggcaagcagaacaacacatgcaccgctaaagcctcttgctggctggagagcgtgaagtccttcttttacgggctcaaaaatatgctgagcggcatcttcggaaacctctttatgggcattttcctgtttcttgcgcctttcatcctgctcatcctgtttttcatgtttgggtggcgcattctgttctgttttaagtgctgtagaagaacacggggacttttcaagtatcgccacctgaaagacgatgaagagaccggctacagacggatcattgaacgcctcaataacaagaaagggaagaataaactgctcgacggagagagactggccgatcggcgcatcgctgaacttttctctacgaagacacacattggc

SEQ ID NO: 13729 - RNA, 3495 nt, synthetic construct
  misc_feature 1..3495: note = derived and/or modified CDS sequence (opt5) from CCHVF(CCHVF 7803)__AB069672.1__Gn-NSm-Gc
  source 1..3495: mol_type = other RNA
agcgaggaatccggcgacgattgcatctctagaacccagctgctccggacagagacggccgaaattcacggggacaactacggaggccccggggataagatcaccatttgtaatggaagcacaatcgtggaccaacgcctgggctccgagatggggtgctataccattaacagagtgaaatctttcaaactttgtgaaaatagcgctacaggaaagtcctgcgagatcgattctatccctgttaagtgtcggcagggctactgcctgaaaattacccaggagggccgcgggcatgtgaagctcagcagaggatccgaagtgatcctggacgcctgtgatagctcttgcgaggtcatgattccgaagggcacaggggacatccttgtggattgttccggaggccagcaacactttctgaaagacaacctcattgatctggggtgccccagcatccctctgctcggaaagatggcgatttatatctgtcggatgtctaatcatcccaaaaccacgatggctttcctgttttggttctcctttggctacgttattacctgcattctttgcaaggccatcttctatctgctcattatcgtgggcacactggggaaacgctttaagcagtacagagaacttaagcctcagacctgtacaatttgcgagaccacgcccgccaacgctatcgacgccgagatgcacgatctgaattgtagctataacatctgcccttactgtgcttctcggctcacatccgacggactggcccgccatgtcacccagtgcccgaaaagaaaggaaaaagtggaggaaacagagctgtacctcaatctggaacggattccctgggttgtgcgcaaacttctgcaagtcagcgagtccaccggcgtggcgctcaagagatctagctggctgatcgtgcttctggtcctcttcgccatttccctgagccctgttcagtctgctcccatctcccacgggaagaccattgagacatatcaggcccgggaagagtacacgagcatctgtctgtttgtgctcggatctatcctgttcattgtgagctgccttatgaaaggcctggtcgactccatcgggaacatctttttccctggactctctatctgtaagacctgcagcattggctccatcaatggctttgaaattgagagccacaagtgttattgctctctgctttgctgtccctactgccgccattgttccgctgatagagaaatccaccagctgcatctcagcatctgcaaaaagcggaaaacagggtctaacgtgatgctggccgcgtgtaagagaatgtgcttccgcgccaccatggaggtttccaataaagctctgctcattcggagcatcattaacacaaccttcgtggtctatatcctgattcttgccgtgtgtgttgtgtccacgtctgctgtcgagatggaaagcctgccggccggaacatgggagagagaagaggacctcaccaatttttgccaccaagaatgtcaggtgaccgagacagagtgcctgtgtccttacgaagccctggtccttcgccggcccctcttcctggattccatcgtgagaggcatgaagaaccctctgaactctaccagcctcgagacatccctgagcatcgaagctccctggggagcgattaatgttcagtctacgtataagcccaccgtgtccacagccaacatcgctcttagctggtcttccgtcgagcaccgcgggaataaaattctggtgagcggccggtctgagagcatcatgaagctcgaagagagaaccgggatttcctgggacctgggcgttgaagatgccagcgagtctaaactgcttacagtgtccgtcatggacctcagccaaatgtactcccctgtgtttgaatacctgtctggagatcgccaggtggaggagtggccgaaggctacctgcacgggcgactgccccgaacggtgtgggtgcaccacaagcacctgtctgcataaagagtggcctcactccagaaactggcgctgcaatcccacatggtgttggggagttggcaccgggtgcacgtgttgcggactcgatgtcaaggacctgttcacagattatatgatcgtgaagtggaaagtggaatacatcaagacccggggcattgtctgtgtggagcttacatctcaggaaagacagtgcagcctgatcgaggccgggacccggtttaacctcggctccgttaccattacactgtctgagcctcgcaatatccaacagaaactgcccccggaaattatcacgcttcatcctagaatcgaggaaggattctttgacctcatgcacgtgcagaaggtcctgagcgcctccaccgtgtgtaaactgcagagctgcacacatggcgttcccggggacctccaagtgtatcacgtcggaaacctgcttaagggcgataaggtgaatgggcacctgattcataaaatcgagcctcacctcaacacctcttggatgtcctgggacggatgcgatctggactactattgtaatatgggcgattggcccagctgcacatacaccggggttacgcagcataaccacgcgtctttcgtgaatctgcttaacattgaaacagactataccaagtcctttcacttccatagcaaacgggtcaccgctcacggcgatacacctcagctcgacctgaaggccagacccacctacggagccggcgagatcacagtgctggtggaggtcgctgatatggaatttacgccgaaaaagattgagatctctgggctcaaattcgcctccctgacctgtacaggatgctacgcttgtagctccggcattagctgcaaggttcgcatccatgtggacgaacctgatgagcttaccgtgcacgtcaagtctgacgatcccgacgtggttgccgcgagctcctctctgatggcccggaaactcgagtttgggacagacagcaccttcaaggctttctccgccatgcccaaaacgtctctgtgtttttatatcgtggaaagagagtactgcaagagctgttccaaagaagatacccagaagtgcgtcaatacaaagctggagcaacctcagtctattcttatcgaacataaaggaaccattatcggcaagcagaacaacacatgtaccgctaaagccagctgctggctggagtccgtcaagagcttcttttatgggctcaaaaatatgctgtctggcattttcggaaactttttcatgggcatctttctcttcctggcgccgtttatccttctgattctcttctttatgttcgggtggcgcatcctgttttgcttcaagtgttgcagacggacacgcggactgttcaagtacagacaccttaaagacgatgaggaaaccggctatcggcgcattatcgagagactgaataacaagaaagggaagaataaactcctggacggagaacggctcgccgatcgcagaattgctgagctgttttccacgaagacacacatcggc

SEQ ID NO: 13730 - RNA, 3495 nt, synthetic construct
  misc_feature 1..3495: note = derived and/or modified CDS sequence (opt5) from CCHVF(CCHVF 79121)__AB069673.1__Gn-NSm-Gc
  source 1..3495: mol_type = other RNA
gccgagggcgggagctccgactgcatctctagaacccagctggtgaagacagaagtcgctgagattcacgaagatagctacggaggccccggggagaaaatcacgatttgtaacggatccaccatcgttgaccaaggcctcgggtctgaactgggatgctatacaattaatcgggtgcgcagctacaaactttgtgagaactccgcctctggcaaaagctgcgagatcgattccatccctgtgaagtgtaaacagggcttctgcctgaagattacccaggaagggagaggacatgtcaagctcagccggggcacagagatcgtgctggacgtttgtgattcttcctgcgaacttatgattccgaaagggaccggagacatcctggtggattgtagcggcgggcagcaacactttctccagaataacctgattgacctgggatgccccaatgtccctctcctgggcaagatggcgatctatgtgtgtcgcatgtctaaccatcccaaaacaaccatggctttcctgttttggttctcctttggctacgttattacgtgcatcgcctgcagagtgctgttctatctcctgatcgccattgggaccgtcggaaagaaacttaagcagtaccgggagctgaagcctcagacatgtatcgtgtgcgagagcgtgcccgtcaatgctattgatgccgaaatgcacgagctcaactgttcttataatatctgcccttactgtgcttcccgcctgagcaccgacggcctgattagacatgttacacaatgcccgaaacggcgcgaaaaggtggaggaaaccgagctctttctgaaccttgagagaatcccctggctggtgcggaaactcctgcaggtctccgaatctacggggatggcccttaagcgcagctgttggatgatcacactgctcattctgctgctcgtgtccatcagccctgttcagtctgcgcccgtgggaaaagagagagccattgaaacctaccaggctcgggagacatataccggcatctgcctgttcgtccttgggtccgtgctgtttgccgttagctggctcaccaaggctctgattgatggaatcggcaattctttcagccctggcctttccgtgtgtaaaacatgctctatcgggagcattaacggatttgaaatcgagtcccacaagtgttactgcagcctgttctgctgtccctattgccgcgcctgttcttccgacaagaatacgcacagaatgcatctcaacgtctgcaaaaagcggaaaatgggcagcaatgtgatgctggcggtctgtaagagaatgtgctttcgcgccaccattgaggcttctaacaaagccctgctcatccggtccattatcaacagcacattcgtgatttgtatcctgatccttaccatttgcgttgtgtccacatctgctgtcgatatggaaaatctgccggccgggatctgggagaaggaagaggacctcaccaacttctgtcaccaagaatgccaggtgacggagacagagtgtctgtgcccttacgaagccatggttctgagaaagcccctttttctcgacagcaccgctaaaggaatgaagtccctgcttaattctaccagcctcgagacatccctgagcattgaagcgccttggggcgccatcaacgtgcagtctaccttcaaacccacagtctccgctgccaatattgcccttagctggtcttccgtggagcatcgcgggaacaagatcctggtgagcggccggtctgagagcatcatgaaactcgaagagagaacgggagtttcctggaatctgggcgtcgaagatgctagcgagtctaagaccctgacagtgtccgtgatggaccttagccaaatgtattcccccgtctttgaatacctctctggggatcgccaggtggaggagtggcctaaggcgacctgcacaggagactgtccggaacggtgcggctgtaccagctccacgtgcctgcacaaagagtggccccactctagaaactggcgctgtaatcctacctggtgctggggagttgggacaggctgtacctgctgtgggctggatgtgaaggacttctttacagattatatgctcgtcaaatggaaggtggaatacattaaaaccgaggccatcgtttgcgtggaactgacgagccaggagcggcagtgttcccttattgaggctggcacaagattcaacctgggacccgtcaccatcacactctctgaacctcgcaatgtgcaacagcggctgcccccggagattgttaccctgcatcctaagatcgaagagggctttttcgaccttatgcacgtgcagaagatcctcagcgcctccaccgtctgcaaactgcagagctgcacacatggggtgcccggagattttcaaatttaccacgtgggcaacctgctcagaggggacaaggtcaatggacattctatccacaaaattgaacctcacttcaacacgtcctggatgagctgggatggctgtgacctggactatttttgcaatatgggggattggccctcttgtacctacacaggcgttacccagcataaccgggccgctttcatcaacatgcttaatattgagacagactataccaagacgtttcacttccattccaaacgcgtgacagcccacggagatacccctcagctggacctcaaggctagacccgcctacggcgcgggggaggtgaccgtcctggtggaagttgccgatctggagcttcacacaaagaacctcgaagtgagcggactgaagatcgcttctctgacctgctccggctgttatgcctgcagctccgggatcagctgtaaggtccggattcatgtgaatgagccggacgagttcacagttcacgtgagatctagcgatcctgacgtcgtggctgccggatcctctctcatggcgcgcaaaatcgaatttggcgccgatagcacgttcaaggctttttcctctatgcccaaagacagcctgtgcttctacattgttgagaaggattattgttcctcttgcaccgacgatgacacacagaaatgtgtgaacaccaaacttgaccatccccaaagcatcctgattgaacacaaggggacaatcattggcaagcagaatgatacctgctccacgaagaccagctgctggctcgagtctgtcaaaggatttttctacggcctgaagaacatgctgtccgggatctttggaaatgtgttccttggcatctttctgttcctcgccccttttgtgctgctcattttctttttcttctttgggtggcggctgcttttctgtctgaaatgctgtagacgcacaagaggactcctgaagtacaagcatctgaaagacgaagaggaggctggctataagaaaatcattgaacggcttaacggcaagaaaggaaagagccagctgtttgatggggagcgcctcgccgacagaaagatcgccgaactgttctctaccaaaattcacatcggc

SEQ ID NO: 13731 - RNA, 3495 nt, synthetic construct
  misc_feature 1..3495: note = derived and/or modified CDS sequence (opt5) from CCHVF(CCHVF 8402)__AB069674.1__Gn-NSm-Gc
  source 1..3495: mol_type = other RNA
agcgaggaatccggcgacgattgcatctctagaacccagctgctccggacagagacggccgaaattcacaacgacaattacgggggacccggcgataagatcaccatttgtaacgggagcacagtggtcgaccaacgcctgggatccgagcttggctgctataccatcaatagagttaaatctttcaagctgtgtgaaaacagcgctacagggaaatcctgcgagattgattctacccctgtgaagtgtcggcagggattttgcctcaaaatcacacaggagggccgcggccatgtgaagctgagcagagggtccgaagtcgtgcttgacgcctgtgatagctcttgcgagatcatgattccgaagggaaccggcgacatcctggttgattgttccgggggacagcaacacttcctcaaagacaatctgattgatctgggctgccccaacatccctctcctggggaagatggcgatttacatctgtcggatgagcaatcatcccaaaacgaccatggcttttcttttctggttttctttcggatatgtggtcacatgcattctgtgcaaggtgatcttttacctcctgatcgttgtgggcacccttggcaaaaagttcaagcagtatcgcgaactgaaacctcagacatgtaccatttgcgagacgacacccgtcaacgccatcgacgccgagatgcacgatctcaattgttcctacaacatttgcccttattgtgctagcagactgacctctgacgggctggcccggcatgtgatgcagtgcccgaagcgcaaagaaaagatcgaggaaacagagctctacctgaatcttgaacggattccctgggtggtcagaaaactgctccaagtttccgagagcaccggagtggctctgaagcgctcctcttggcttgtggtcctgctcgtgctgctgaccgttagcctctcccctgtgcagagcgcccccatcggccacgggaaaacagtcgagacgtaccagaccagagaaggatatacatctatctgtctgtttgtgcttggctccattctgttcatcgttagctgcctcatgaaggggctggtggactctgtcggaaacagctttttccctggcctttccatttgtaagacctgctctatcggcagcgtgaatgggtttgagattgaatcccacaaatgttactgcagcctgttctgctgtccctattgccggcattgttctgcggatcgcgagatccacagactccatctgtccatctgcaagaaacggaagacaggaagcaacgtcatgctggccgtgtgtaaaagaatgtgcttccgcgctaccgttgaagtgtctaataaggccctcctgattcggaacatcattaacacgacatttgtcctttgtatcctgattctcgctgtgtgcgttgtgtccaccagcgccgtcgagatggagtccctgccggcgggcacctgggaaagagaggaagacctgacaaatttctgtcaccaggagtgccaagtgaccgaaacagagtgtctttgcccttacgaggccctcgtgctgcgcaagcccctgttttctgatagcatcgttaaagggatgaagaacctcctcaattccacgtctcttgaaaccagcctgtccattgaggctccttggggagccatcaacgtccagagcacattcaaacccaccgtgtctgctgccaatatcgccctctcctggagctctgtggaacaccggggcaacaagattctggtctccgggagaagcgagtctatcatgaaactggaggaacgcacaggcattagctgggaccttggagtggaggatgcttccgaaagcaagctcctgaccgtttctgtgatggacctgtcccagatgtatagccccgtctttgagtacctctccggcgatcggcaagtggaagagtggcctaaggcgacgtgcaccggggactgtccggagagatgcggatgtacatctagcacatgcctgcataaagaatggccccactcccgcaattggcggtgtaaccctacctggtgctggggcgttgggaccggatgtacgtgctgtggccttgatgtgaaggacctgttcacagattatatgtttatcaaatggaaggtcgagtacattaaaaccgaagccatcgtgtgcgttgagctcacatctcaggaaagacagtgtaccctgatcgaggctgggacccgcttcaatctgggccccgtgacaattacgcttagcgagcctcggaacatccagcaaaagctgcccccggaaattgtcaccctgcatcctagaatcgaggaaggatttttcgacctgatgcacgtgcagaaggtgctctccgcctctacagtctgcaaactgcagagctgcacccatggcgttcccggggaccttcaggtgtaccacattggaaatctgctcaagggcgataaagtgaacgggcacctgatccataagatcgagcctcactttaatacatcctggatgagctgggacggatgtgatctggactattactgcaacatgggcgattggccctcttgtacctatacgggggtcacacaacataatcacgccgctttcgtgaacatgcttaacattgaaaccgactacaccaaaaattttcacttccattccaagcgggttacagcccacggcgatacccctcagctcgacctgaaagcgcgccccacatatggagctggcgagatcacggtgctggtcgaggtggccgatatggaactccataccaagaagattgagatcagcgggctgaaattcgcctctcttacatgcaccggatgttacgcttgctccagcggcatttcttgtaaggttagaatccacgtggacgaaccggatgagctgacagtccatgtgaaatccgaggaccctgatatcgttgccgctagctccagcctcatggcccggaagctggaatttgggaccgactctacgttcaaagcgtttagcgccatgcccaagacctccctgtgcttctatattgtggagagagaatactgtaagtcttgcagcaaagaggacacacagaagtgtgtcaacaccaaacttgaacagccccaatccatcctgattgagcacaagggaacaatcattggcaaacagtctaatacctgcacagctaaggccagctgctggctcgagtccgtgaagtctttcttttacgggctgaaaaacatgctcagcggcatctttggaaatgtgttcattggcgtctttctgttctttgctcctttcatccttctgatcctctttttcatgttcgggtggcgcattctgttttgtttcaagtgctgtcggagaacccgcggactgtttaaatatagacaccttaaggatgacgaagagacgggctaccggaaaatcattgaacgcctgaacaataagaaggggaaaaacaagctcctggatggagagagactcgccgaccggaaaatcgcggaactgttctccacaaagacccatattggc

SEQ ID NO: 13732 - RNA, 3495 nt, synthetic construct
  misc_feature 1..3495: note = derived and/or modified CDS sequence (opt5) from CCHVF(CCHVF 88166)__AB069675.1__Gn-NSm-Gc
  source 1..3495: mol_type = other RNA
agcgaggaatccggcgacgattgcatctctagaacccagctgctccggacagagacggccgaaattcacagcgacaactacgggggacccggcgataagatcaccatttgtaatgggtccacagtggtcgaccaacgcctgggatctgagcttggctgctataccatcaacagagttaagagcttcaaactgtgtgaaaattccgctacagggaaatcttgcgagattgatagcacccctgtgaagtgtcggcagggattttgcctcaaaatcacacaggagggccgcggccatgtgaagctgtccagagggagcgaagtcgtgcttgacgcctgtgattcttcctgcgagatcatgattccgaagggaaccggcgacatcctggttgattgtagcgggggacagcaacacttcctcaaagacaacctgattgatctgggctgccccaatatccctctcctggggaagatggcgatttacatctgtcggatgtctaaccatcccaaaacgaccatgggatttcttttctggttttccttcggctatgtggtcacatgcattctgtgcaaggtgatcttttacctcctgatcgttgtgggcacccttgggaaaaagttcaagcagtatcgcgaactgaaacctcagacatgtaccatttgcgagacgacacccgtcaatgctatcgacgccgagatgcacgatctcaactgtagctacaatatttgcccttattgtgcctctagactgacctccgacggactggctcggcatgtgatgcagtgcccgaagcgcaaagaaaagatcgaggaaacagagctctacctgaaccttgaacggattccctgggtggtcagaaaactgctccaagttagcgagtccaccggcgtggccctgaagcgctctagctggcttgtggtcctgctcgtgctgctgaccgtttccctcagccctgtgcagtctgctcccatcgggcacggaaaaacagtcgagacgtaccagaccagagaaggctatacatccatctgtctgtttgtgcttgggagcattctgttcatcgtttcttgcctcatgaagggactggtggacagcgtcggcaattcctttttccctggcctttctatttgtaagacctgcagcatcgggtccgtgaacggatttgagattgaaagccacaaatgttactgctctctgttctgctgtccctattgccggcattgttccgccgatcgcgagatccacagactccatctgagcatctgcaagaaacggaagacatggtctaatgtcatgctggcggtgtgtaaaagaatgtgcttccgcgccaccgttgaagtgtccaacaaggctctcctgattcggaatatcattaacacgacatttgtcctttgtatcctgattctcgccgtgtgcgttgtgagcacctccgctgtcgagatggagtctctgccggccggcacctgggaaagagaggaagacctgacaaacttctgtcaccaggagtgccaagtgaccgaaacagagtgtctttgcccttacgaggcgctcgtgctgcgcaagcccctgtttagcgattccatcgttaaagggatgaagaatctcctgaactctacgagccttgaaacctccctgagcattgaggccccttggggagctatcaatgtccagtctacattcaaacccaccatgtccgccgctaacatcgccctcagctggtcttccgtggaacaccggggcaataagattctggtgagcgggagatctgagagcatcatgaaactggaggaacgcacaggcatttcctggaaccttggagtcgaggacgccagcgaatctaagctcctgaccgtgtccgttatggatctgagccagatgtattcccccgtgtttgagtacctctctggcgaccggcaagtcgaagagtggcctaaggctacgtgcaccggggattgtccggagagatgcggatgtacaagctctacctgcctgcataaagaatggccccactctcgcaattggcggtgtaaccctacatggtgctggggcgtggggaccggatgtacgtgctgtggccttgacgttaaggatctgttcacagactatatgtttatcaaatggaaggtggagtacattaaaaccgaagcgatcgtctgcgtggagctcacaagccaggaaagacagtgtaccctgatcgaggccgggacccgcttcaatctgggccccgttacaattacgctttccgagcctcggaacatccagcaaaagctgcccccggaaattgtgaccctccatcctagaatcgaggaaggatttttcgatctgatgcacgtccagaaggtgctctctgctagcacagtgtgcaaactgcagtcctgcacccatggcgtccccggggaccttcaggtttaccacattggaaatctgctcaagggcgacaaagtgaacgggcacctgatccataagatcgagcctcactttaatacaagctggatgtcttgggatggatgtgacctggattattactgcaacatgggcgactggccctcctgtacctatacgggggtgacacaacataatcacgccgccttcgtcaacatgcttaacattgaaaccgattacaccaaaaattttcacttccatagcaagcgggtgacagctcacggcgacacccctcagctcgatctgaaagcccgccccacatatggagcgggcgagatcacggttctggtggaggtcgctgacatggaactccataccaagaagattgagatctctgggctgaaattcgcctcccttacatgcaccggatgttacgcctgcagctctggcatttcctgtaaggtgagaatccacgttgatgaaccggacgagctgacagtgcatgtcaaaagcgaggatcctgacctcgtggctgcctccagctctctgatggctcggaagctggaatttgggaccgatagcacgttcaaagccttttccgcgatgcccaagacctctctttgcttctatatcgttgagagagaatactgtaagagctgctccaaagaggacacacagaagtgtgtgaacaccaaactggaacagccccaatctattctcatcgagcacaagggaacaattatcggcaaacagaataatacctgcacagccaaggctagctgctggctggagtccgtcaagtcctttttctacgggctcaaaaacatgctgagcggcatttttggaaacgtgttcatcggcgtgtttcttttctttgcccctttcattctgctcatcctgtttttcatgttcgggtggcgcatcctgttttgtttcaagtgctgtcggagaacccgcggactttttaaatatagacacctgaaggacgatgaagagacgggctaccggaaaattatcgaacgcctcaataacaagaaggggaaaaataagctgctcgacggagagagactggctgatcggaaaattgccgaacttttctccacaaagacccatatcggc

SEQ ID NO: 13733 - RNA, 3495 nt, synthetic construct
  misc_feature 1..3495: note = derived and/or modified CDS sequence (opt5) from CCHVF(CCHVF BA88166)__AF338470.1__Gn-NSm-Gc
  source 1..3495: mol_type = other RNA
agcgaggaatccggcgacgattgcatctctagaacccagctgctccggacagagacggccgaaattcacagcgacaactacgggggacccggcgataagatcaccatttgtaatgggtccacagtggtcgaccaacgcctgggatctgagcttggctgctataccatcaacagagttaagagcttcaaactgtgtgaaaattccgctacagggaaatcttgcgagattgatagcacccctgtgaagtgtcggcagggattttgcctcaaaatcacacaggagggccgcggccatgtgaagctgtccagagggagcgaagtcgtgcttgacgcctgtgattcttcctgcgagatcatgattccgaagggaaccggcgacatcctggttgattgtagcgggggacagcaacacttcctcaaagacaacctgattgatctgggctgccccaatatccctctcctggggaagatggcgatttacatctgtcggatgtctaaccatcccaaaacgaccatgggatttcttttctggttttccttcggctatgtggtcacatgcattctgtgcaagggcatcttttacctcctgatcgtggttgggacccttgggaaaaagttcaagcagtatcgcgaactgaaacctcagacatgtaccatttgcgagacgacacccgtgaatgctatcgacgccgagatgcacgatctcaactgtagctacaatatttgcccttattgtgcctctagactgacctccgacggcctggctcggcatgtcatgcagtgcccgaagcgcaaagaaaagatcgaggaaacagagctctacctgaaccttgaacggattccctgggtggtgagaaaactgctccaagtcagcgagtccaccggggttgccctgaagcgctctagctggcttgtggtgctgctcgtcctgctgaccgtgtccctcagccctgttcagtctgctcccatcggacacggcaaaacagtggagacgtaccagaccagagaagggtatacatccatctgtctgtttgtccttggaagcattctgttcatcgtgtcttgcctcatgaagggcctggttgacagcgtgggcaattcctttttccctgggctttctatttgtaagacctgcagcatcggatccgtcaacggctttgagattgaaagccacaaatgttactgctctctgttctgctgtccctattgccggcattgttccgccgatcgcgagatccacagactccatctgagcatctgcaagaaacggaagacatggtctaatgtgatgctggcggtctgtaaaagaatgtgcttccgcgccaccgtggaagtttccaacaaggctctcctgattcggaatatcattaacacgacatttgtgctttgtatcctgattctcgccgtctgcgtggttagcacctccgctgtggagatggagtctctgccggccgggacctgggaaagagaggaagacctgacaaacttctgtcaccaggagtgccaagtcaccgaaacagagtgtctttgcccttacgaggcgctcgtgctgcgcaagcccctgtatctcgatagcatcgtgaaaggaatgaagaatctgcttaactccacgtctctggaaaccagcctctccattgaggccccttggggcgctatcaatgttcagagcacatttaaacccaccatgtctgccgctaacatcgccctgtcctggagctctgtcgaacaccgggggaataagattctggtgtccggcagaagcgagtctatcatgaaacttgaggaacgcacaggaattagctggaacctcggcgtggaggacgcctccgaaagcaagctgctgaccgtctctgtgatggatctctcccagatgtacagccccgttttcgagtatctgtccggggaccggcaagtggaagagtggcctaaggctacgtgcaccggagattgtccggagagatgcggctgtacatctagcacatgccttcataaagaatggccccactcccgcaattggcggtgtaaccctacctggtgctggggagtcggaaccggctgtacgtgctgtgggctggacgtgaaggatctctttacagactacatgttcatcaaatggaaggttgagtacattaaaaccgaagcgatcgtgtgcgtcgagctgacatctcaggaaagacagtgtaccctgatcgaggccggcacccgctttaatcttggacccgtgattatcacactcagcgagcctcggaacattcagcaaaagctgcccccggaaatcgttacgctgcatcctagaattgaggaaggcttctttgatctcatgcacgtgcagaaggtcctgtccgcttctaccgtgtgcaaacttcagagctgcacacatggggtgcccggagacctgcaggtctatcacatcggcaatctcctgaagggggacaaagttaacggacacctgatccataagattgagcctcacttcaatacctcctggatgagctgggatggctgtgaccttgattactattgcaacatgggggactggccctcttgtacatacaccggcgtgacgcaacataatcacgccgcctttgtgaacatgctcaacatcgaaacagattataccaaaaatttccactttcattccaagcgggtcaccgctcacggagacacacctcagctggatctgaaagcccgccccacctacggcgcgggggagattacagtgctcgttgaggtggctgacatggaactgcatacgaagaagatcgagattagcggacttaaattcgcctctctgacctgcacaggctgttatgcctgctccagcgggatctcttgtaaggtcagaatccacgtggatgaaccggacgagctcaccgttcatgtgaaatccgaggatcctgacattgtcgctgccagctccagcctgatggctcggaagctggaatttggaacagattctacctttaaagccttcagcgcgatgcccaagacgtccctttgcttttacatcgtggagagagaatactgtaagtcttgcagcaaagaggacacccagaagtgtgttaacacaaaactggaacagccccaatccattctcatcgagcacaagggcaccattatcgggaaacagaataacacatgcaccgccaaggcttcttgctggctggagagcgtgaagtccttcttttatggcctcaaaaatatgctgtctggaattttcggcaacgtctttatcggggtgttccttttcttcgccccttttatcctgctcattctgttctttatgttcggatggcgcatcctgttctgttttaagtgctgtcggagaacacgcggccttttcaaatacagacacctgaaggacgatgaagagaccgggtatcggaaaattatcgaacgcctcaataacaagaagggcaaaaataagctgctcgacggagagagactggctgatcggaaaattgccgaactttttagcacgaagacacatatcggc

SEQ ID NO: 13734 - RNA, 3495 nt, synthetic construct
  misc_feature 1..3495: note = derived and/or modified CDS sequence (opt5) from CCHVF(CCHVF BA66019)__AF350448.1__Gn-NSm-Gc
  source 1..3495: mol_type = other RNA
agcgaggaatccggcgacgattgcatctctagaacccagctgctccggacagagacggccgaagtgcacggggacaactacggaggccccggggataagattaccatctgtaatggaagcacaattgtcgaccaacgcctgggctccgagcttgggtgctataccatcaacagagttaaatctttcaagctgtgtgaaaatagcggaacaggcaaatcctgcaagattgataaacatcctgtgaagtgtcggcagggcttttgcctcaagatcacccaggaggggcgcggacacgtgaaactgtctagaggcagcgaggtcgtgcttgacgcttgtgattccagctgcgaaatcatgattccgaaggggacaggagacatcctggttgattgttctggcgggcagcaacatttcctcaaagacaacctggtggatctgggatgccccaatattcctctcctgggcaagatggccatctacatttgtcggatgtccaaccaccccaaaaccacgatggcgtttcttttctggtttagcttcggctatgtcattacctgcatcttttgcaagatcatcttctacctgctcattgtggttgggacactgggaaagaaatttaagcagtatcgcgagcttaaacctcagacctgtacaatctgcgaaaccacgcccacaaatgctattgacgccgagatgcatgatctgaagtgttcttacaacatctgcccttattgtgcctccagactcaccagcgacggcctggctcggcacgtgacacagtgcccgaaacgcaaggagaaagtcgaagagaccgaactgtacctcaatctggagcggattccctggatcgtgagaaaacttctgcaagtgtctgaatccaccggggtcgccctcaagcgcagctcctggctgatcgttcttctggtgctcctgacagtgtctctgagccctgtccagtccgctcccattggacacggcaagacgatcgaggcctaccagaccagagaggggtatacaagcgtgtgtctcttcatgctgggaggcattctttttgttgtgtcttgcctgatgaagggcctcgtcgactccgtgagcaactctttctttcctgggctgagcatctgtaaaacctgctccattggatctgttaatggcttcgaaatcgagagccataagtgttactgctcccttctgtgctgtctctattgccggcactgtagcgcggatcgcgaaatccatcagctgcacctgtctatttgcaaaaagagacgggccgggggaaacgtgatgctcgctgtctgtaagagaatgtgcctgcgcgccacaatggaggtgtccaataaagtccttttcatccggagcattatcaacaccacgtttgtgatttgtatcctggttctcgctgtgtgcattgtctctacatccgccgtggaaatggagagcctgcccgcgggcacctgggagagagaagaggacctgaccaatttctgtcaccaagaatgccaggttacagagaccgaatgtctttgcccgtacgaggccctcgtgctgcgcaagcctctgttttccgattctatcgtcaaagggatgaagaacctcctgaacagcacatcccttgagacgtctctgagcatcgaagctccctggggcgccattaatgtgcagtccaccttcaaacctacagtgagcaccgctaacatcgccctctcttggtccagcgttgagcatcggggaaataagattctggtctctggcagatccgaaagcatcatgaagctggaggagcgcacagggatttcttgggaccttggagtggaagatgccagcgagtccaaactcctgaccgtgagcgtcatggacctgtctcaaatgtattcccccgtgtttgaatacctcagcggcgatcggcaggttgaggaatggcccaaggctacgtgcaccggggactgtcctgatagatgcggatgtacatcctctacctgcctgcacaaagagtggccgcatagccgcaactggcggtgtaatcccacatggtgctggggcgtggggaccggctgtacgtgctgtggacttgacgtcaaggatctgttcacagactatatgtttgtgaaatggaaggttgagtacatcaagaccgaagcgatcgtgtgcgtcgagctcaactcccaggaaagacagtgttctctgattgaggccggcacacgcttcaatctggggcctgtgaccatcacccttagcgaaccccggaacattcaacagaaactccctcccgagatcattacactgcacccgagaatcgaggaaggatttttcgacctgatgcatgttcagaaggtgctctccgcttctacggtctgcaaactgcagagctgcacccacggcgtgcctggggatcttcaaatctaccacattggaaatctgctcaagggcgaccgggtgaacgggcatctgatccacaaaattgagccccattttaatacatcctggatgagctgggatggctgtgacctggattattactgcaacatgggagactggccttcttgtacctatacaggcgtcacccagcacaatcacgccgccttcgttaaccttctcaatatcgaaacggattacacaaagaactttcatttccactccaaacgcgtgaccgctcatggggacacaccccagctggatctgaaggccagacctacctatggagcgggcgagattaccgtgctcgtcgaagtggctgacatggagctgcacacaaagaaaatcgccatcagcgggcttaagttcgcctctctgacgtgcaccggatgttacgcttgctccagcggcatttcttgtaaagttcggatccatgtggatgagcccgacgaactcacagtccacgtgaagtccgaggatccggacattgttgccgctagctccagcctgatggccagaaaactggaatttgggaccgactctacattcaaggcgtttagcgccatgcctaagacctccctttgcttctatatcgtggagcgcgagtactgtgaatcttgcagcaaagaggatacgcagaagtgtgtcaacaccaaactggaacaaccccagtccattctcatcgagcacaagggcacaattatcggaaaacagaatgatacctgcacagctaaggcctcttgctggctggaaagcgtgaagtcctttttctacggcctcaaaaacatgctgtctgggatctttggaaatgttttcattggcatctttcttttcctggctccctttattctcctgatcctgttctttatgttcgggtggcggattcttttctgttttaagtgctgtagacgcaccagaggactgttcaaatatcggtacctcaaggacgacgaggagagcggctatcgcagaatcatcgaacggctgaacaataaaaagggcaagaacaaactcctggatggggagcgccttgccgacagacggattgcggaactgttttccacaaagacccatatcgga

SEQ ID NO: 13735 - RNA, 3495 nt, synthetic construct
  misc_feature 1..3495: note = derived and/or modified CDS sequence (opt5) from CCHVF(CCHVF BA8402)__AF350449.1__Gn-NSm-Gc
  source 1..3495: mol_type = other RNA
agcgaggagtccggcgacgattgcatctctagaacccagctgctccggacagagacggccgaaattcacaacgacaattacgggggacccggcgataagatcaccatttgtaacgggagcacagtggtcgaccaacgcctgggatccgagcttggctgctataccatcaatagagttaactctttcaatctgtgtgaaaacacagctaccgggaaaagctgcgagattgattccacacctgtgaagtgtcggcagggattttgcctcaaaatcacccaggagggccgcggccatgtgaagctgtctagagggagcgaagtcgtgcttgacgcctgtgagtccagctgcgaaatcatgattccgaaaggaacgggcgatatcctggttgactgttctgggggacagcaacacttcctcaaggataatctgattgacctgggctgccccaacatccctctcctggggaagatggcgatttacatctgtcggatgtccaatcatcccaaaaccacaatggcttttcttttctggtttagcttcggatatgtggtgacctgcattctgtgcaaggtcatcttttacctcctgatcgttgtgggcacacttggcaaaaagttcaaacagtatcgcgagctgaagcctcagacctgtacgatttgcgagacaacccccgtcaacgccatcgatgccgaaatgcacgacctcaattgttcttacaacatttgcccttattgtgcttccagaccgacaagcgatgggctggcccggcatgtgatgcagtgccccaagcgcaaagagaagatcgaagagaccgctctgtacctcaatctggaacggattccttgggtggtcagaaaacttctgcaagtttctgagtccaccggagtggccctcaagcgcagctcctggctggtggtccttctggtgctcctgacagtttctctgagccccgtgcagtccgcgcctatcggccacgggaaaacggtcgagacctaccagacaagagaaggatataccagcatctgtctctttgtgctgggctctattcttttcatcgtttcctgcctgatgaaggggctcgtggacagcgtcggaaacagctttttccccggcctgtctatttgtaaaacatgctccatcggctctgtgaatgggtttgagattgaaagccacaagtgttactgctcccttttctgctgtccgtattgccggcattgtagcgccgaccgcgagatccacagactgcatctctctatctgcaagaaacggaagaccggatccaacgtcatgctggctgtgtgtaaaagaatgtgcttccgcgccacggttgaagtgagcaacaaggctctgctcattcggaatatcattaacacaacctttgtcctgtgtatccttattctggccgtgtgcgttgtgtctacctccgcggtcgagatggagagcctccctgccggcacatgggaaagagaggaagatctgaccaatttctgtcaccaggagtgccaagtgacagaaacggagtgtctgtgcccctacgaggctcttgtgctccgcaaacctctgttttccgactctatcgttaaggggatgaagaacctgctcaatagcacctccctggaaacatctcttagcattgaggccccctggggagctatcaacgtccagtccaccttcaaacccacagtgagcgccgccaatatcgctctgtcttggtccagcgtggaacaccggggcaacaagattctcgtctctgggagatccgagagcatcatgaaactggaggaacgcaccggcatttcttgggatctgggagtggaggacgcgagcgaatccaagctgctcacggttagcgtgatggatctgtctcagatgtattcccctgtctttgagtacctgagcggcgaccggcaagtggaagagtggccgaaagctacctgcacaggggattgtcccgagagatgcggatgtacctcctctacatgcctccataaggaatggcctcacagccgcaattggcggtgtaaccccacctggtgctggggcgttgggacgggatgtacatgctgtggcctggacgtgaaggatcttttcaccgactatatgtttatcaaatggaaggtcgagtacattaaaacagaagctatcgtgtgcgttgagctgacctcccaggaaagacagtgtaccctcatcgaggccgggacacgcttcaatctgggccctgtgacgattaccctgtctgagccccggaacatccagcaaaaacttccgcctgaaattgtcacactccatcccagaatcgaggaaggatttttcgatctgatgcacgtgcagaaagtgctgagcgcctccaccgtctgcaagctccagtcttgcacacatggcgttcctggggaccttcaggtgtaccacattggaaatcttctgaagggcgacaaagtgaacgggcacctcatccataagatcgagccccactttaataccagctggatgtcctgggatggatgtgacctgcattattactgcaacatgggcgattggcctagctgtacgtatacaggggtcacccaacacaaccacgctgccttcgtgaatatgctgaacattgaaaccgactacacaaagaattttcatttccactctaagcgggttaccgcgcatggcgatacaccccagcttgacctcaaagctcgcccgacgtatggagccggcgagatcaccgtgctggtcgaggtggccgatatggaactgcacacaaagaaaattgagatctccgggctcaagttcgctagcctgacctgcacaggatgttacgcctgttcttccggcattagctgcaaggttagaatccatgtggacgaacctgatgagcttaccgtccacgtgaaatctgaggaccccgatatcgttgctgcctccagctccctgatggcgcggaagctcgaatttgggacggacagcaccttcaaagccttttctgctatgcccaagacaagcctgtgcttctatattgtggagagagaatactgtgagtcctgctctaaagaagatacccagaagtgtgtcaacacaaagctggagcagcctcaaagcatccttattgagcacaaaggaaccatcattggcaagcagtccaatacatgcaccgccaaagcctcttgctggctggaaagcgtgaagtcctttttctacgggctcaaaaacatgctgtctggcatctttggaaatgtgttcattggcgtctttctcttctttgccccgttcatcctgcttatcctgtttttcatgttcgggtggcgcattctcttttgtttcaagtgctgtcggagaacgcgcggactgtttaagtatagacatctgaaagacgacgaggaaacaggctaccggaagatcattgagcgccttaacaataaaaaggggaaaaacaagctgctcgatggagaaagactggcggaccggaagatcgccgaactcttcagcaccaaaacccacattggc

SEQ ID NO: 13736 - RNA, 3495 nt, synthetic construct
  misc_feature 1..3495: note = derived and/or modified CDS sequence (opt5) from CCHVF(CCHVF Matin)__AF467769.2__Gn-NSm-Gc
  source 1..3495: mol_type = other RNA
agcgaggaatccggcgacgattgcatctctagaacccagctgctccggacagagacggccgaaattcacagcgactcctacgggggacccggcgataagatcaccatttgtaacgggtctacagtggtcgaccaacgcctgggaagcgagcttggctgctataccatcaatagagttaaatccttcaagctgtgtgaaaactctgctacagggaaaagctgcgagattgattccacccctgtgaagtgtcggcagggattttgcctcaaaatcacacaggagggccgcggccatgtgaagctgagcagagggtctgaagtcgtgcttgacgcctgtgattccagctgcgagatcatgattccgaagggaaccggcgacatcctggttgattgttctgggggacagcaacacttcctcaaagacaatctgattgatctgggctgccccaacatccctctcctggggaagatggcgatttacatctgtcggatgtccaatcatcccaaaacgaccatggtgtttcttttctggtttagcttcggatatgtcattacatgcatcctgtgcaaggtgatcttttacctcctgattgttgtgggcacccttggcaaaaagttcaagcagtatcgcgaactgaaacctcagacatgtaccatctgcgagacgacacccgtcaacgctattgacgccgagatgcacgatctcaattgttcttacaacatctgcccttattgtgcctccagactgaccagcgacgggctggctcggcatgtgatgcagtgcccgaagcgcaaagaaaagattgaggaaacagagctctacctgaatcttgaaagaatcccctgggtggtccggaaactgctccaagtttccgagtctaccggagtggccctgaagcgcagctcctggcttgtggtcctgctcgtgctgctgaccgttagcctctctcctgtgcagtccgctcccatcggccacgggaaaacagtcgagacgtaccagattagagaaggatataccagcgtgtgtctgtttgttcttggctctatcctgttcattgtgagctgcctcatgaaggggctggtcgactccgatggaaacagctttttccctggccttagcatctgtaagacatgctccattggcagcatcaatgggtttgagatcgaatctcacaaatgttactgctccctgttctgctgtccctattgccggcattgtagcaccgaccgcgagattcacaagctccatctgtctatctgcaaaaagagaaaaacaggatccaacgtgatgctggccgtctgtaagcggatgtgcttcagagcgaccgtggaagttagcaataaggccctcctgattcgctccatcattaacacgacatttgtggtctgtatccttattctggctgtgtgcgttgtgtctaccagcgccgtcgagatggagtccctcccggctggcacctgggaacgggaggaagatctgatcaatttctgtcaccaggagtgccaagtgacagaaaccgagtgtctgtgcccttacgaggcccttgtgctcagaaaacccctgtttctggactctatcattaaggggatgaaaaacctcctgaacagcacatcccttgaaacgagcctgtctatcgaggcgccttggggagccattaatgttcagtccaccttcaagcccacaatgagcgctgccaacatcgctctctcttggtccagcgtcgaacaccgcggcaataaaattctggtgtctgggcggagcgagtccatcatgaagctggaggaaagaaccggcatcagctgggatcttggagtggaggacgcctctgaatccaagctcctgacagtcagcgtgatggatctgtcccagatgtattctcccgtttttgagtacctcagcggcgaccgccaagtggaagagtggcctaaagctacctgcacgggggattgtccggagcggtgcggatgtacctcctctacatgcctgcataaggaatggccccacagcagaaactggcgctgtaatcctacctggtgctggggcgtcgggacaggatgtacctgctgtggccttgacgtgaaagatctgttcacggactatatgtttgttaagtggaaagtggagtacattaagacagaagtcatcgtgtgcgttgagctcacctcccaggaacggcagtgttctctgattgaggccgggacaagattcaacctgggccccgtgaccatcacccttagcgagcctcgcaatattcagcaaaagctgcccccggaaatcgtcacactccatcctcggatcgaggaaggatttttcgacctgatgcacgtgcagaaagtgctctccgcgagcacggtctgcaagctgcagtcttgcacccatggcgttcccggggatcttcaggtgtaccacattggaaacctgctcaaaggcgacaaggtgaatgggcacctgatccataaaattgagcctcactttaacacatcctggatgagctgggatggatgtgacctggattattactgcaatatgggcgactggccctcttgttcctataccggggtcacacaacataaccacgccgctttcgtgaatatgcttagcatcgaaaccgattacacgaagaactttcacttccattctaaaagagttacagcccacggcgacacccctcagctcgatctgaaggcccggcccacctatggagctggcgagattacagtgctggtcgaggtggccgacatggaactccataccaagaaaatcgagatctccgggctgaagttcgcgagccttacatgcacgggatgttacgcttgctccagcggcatttcttgtaaagttcgcatccacgtggatgaaccggacgagctgaccgtccatgtgaagtctgaggatcctgacattgttgccgcctcctctagcctcatggctagaaaactggaatttgggacagactccaccttcaaggccttttctgctatgcccaagacaagcctgtgcttctatatcgtggagcgggaatactgtaaatcctgctctaaggaggatacccagaaatgtgtcaatacgaaacttgaacagccccaaagcattctgatcgagcacaagggaaccattatcggcaagcagaacgacacatgcaccgccaaggcgtcctgctggctcgagagcgtgaaatcctttttctacgggctgaagaacatgctctctggcatctttggaaatgtgttcattggcatctttctgttccttgccccttttgctctgctcattctgttctttatgttcgggtggagaatcctgttctgttttaaatgctgtcgccggacaagaggacttttcaagtatcgccacctgaaagatgacgaagagaccggctacagaaagattatcgaacggctcaacaataagaaagggaagaacaaactgctcgatggagagcgcctggccgacagaaagatcgctgaactttttagcacaaaaacccatgtcggc

SEQ ID NO: 13737 - RNA, 3495 nt, synthetic construct
  misc_feature 1..3495: note = derived and/or modified CDS sequence (opt5) from CCHVF(CCHVF Baghdad 12)__AJ538197.2__Gn-NSm-Gc
  source 1..3495: mol_type = other RNA
agcgaggaatccggcgacgattgcatctctagaacccggctgctccgcacagagacggccgaaattcacggggacagctacggaggccccggggataagatcaccatttgtaacggatccacaatcgtggaccagagactgggctctgagatggggtgctataccattaatcgggtcaagagcttcaagctgtgtgaaaactccgctacaggaaaatcttgcaagatcgatagcatccctgttaaatgtcgccaaggctactgcctgaagattacccaggagggcagagggcatgtgaagctctcccggggaagcgaggtggtcctggacgcctgtgattcttcctgcgaagtgatgatcccgaaaggcacaggggacattcttgttgattgtagcggaggccagcagcactttctgaaggacaatctcatcgatctggggtgccccaacattcctctgctcggaaaaatggcgatctatatttgtcgcatgtctaatcatcccaagaccacgatggctttcctgttttggttctcctttggctacgtgattacctgcatcctttgcaaagccatcttctatctgctcatcattgtcggcacactggggaagagatttaagcaataccgggagcttaaacctcagacctgtacaatctgcgaaaccacgcccgtgaacgccattgacgctgagatgcacgatctgaattgtagctataacatctgcccttactgtgcctctcgcctcacatccgacggactggctagacatgttacccagtgcccgaagcggaaagagaaggtggaagagacagaactgtacctcaatctggagcgcatcccctgggtcgtgagaaaacttcttcaggtgagcgaatccaccggcgtcgccctcaagcggtctagctggctgattgttcttctggtgctcctggcggtgtccagctctcctgtccaatccgcccccatcgggtatggaaaaaccattgagacataccaggctcgcgagggctatacgagcatctgtctgttcgtgctcgggtctattctgtttatcgttagctgccttaccaagggactggtggactccatcggcaacattttctttcctggcctctctatctgtaagacatgcagcattgggtccatcaatggattcgaagtcgagagccacaaatgttactgctctctgctttgctgtccctattgcagacactgttccgccgatcgggaaattcatcagctgcacctcagcatctgcaagaaaagaaagaccgggtcttccgtgatgctggctgtttgtaaacgcatgtgctttcgggccacaatggaggtgagcaacaaggcgctgctcattagatccatcatcaataccacgttcgtcgtgtgtattctgacacttgccgtctgcgtggtttctaccagcgctgtggaaatggagtccctgccggccgggacctgggagcgcgaagaggacctcacaaacttctgtcatcaggaatgccaagtcaccgagacagaatgtctgtgcccttacgaggctctggtgcttcggaagcccctctttctggattctatcgttaaaggaacgaagaatctgctcaacagcacctccctggagacaagcctttctattgaagccccttggggcgccatcaacgtgcagtccacctataaacccacagtcagcaccgctaatattgcgctgtcttggtccagcgtggagcacagagggaacaagatcctcgtgtctggccgcagcgaatccatcatgaaactggaggagcggacgggaattagctgggacctgggcgttgaagatgcctctgagtccaaacttctcaccgtcagcgtgatggacctgtcccagatgtactctcccgtgttcgaatacctgagcggggatagacaagtcgaggaatggcctaaggctacatgcaccggagactgtccggagcgctgcggctgtacaacctccacgtgcctccacaaagagtggccccattctcggaattggagatgtaaccctacatggtgctggggcgtgggaaccggctgtacatgctgtgggctggatgttaaggacctttttaccgattatatgttcgtgaaatggaaggtcgaatacatcaaaaccgacgccattgtgtgcgttgagctgacaagccaggaacgccagtgttccctcatcgaggccggcacgcggtttaatctgggatctgtgaccattacactgagcgaacccagaaacatccagcaaaaacttcctcccgagatcattaccctccacccgcggatcgaggaaggcttctttgacctgatgcatgtccagaaggtgctgtccgctagcacagtttgcaaactccagtcttgcacccacggggtgcctggagatctgcaggtctatcatattggcaatcttctgaagggggacaaagtgaacggacacctcatccacaagattgagccccatttcaatacgtcctggatgagctgggatggctgtgacctggattactattgcaacatgggggactggccttcttgtacatacaccggcgtgacccaacacaatcatgcctcctttgtcaacctgcttaatatcgaaacagattataccaagagcttccactttcactctaagcgcgttacagcgcatggagacacgccccagctcgatctgaaagtgagacctacctacggcgctggggagatcacagtgctggtcgaagtggccgacatggagctccacaccaagaagattgagatctccggactgaaattcgccagccttacatgcaccggctgttacgcttgctccagcgggatttcttgtaaggttcggatccatgtggatgaacccgacgagctgacggtccacgtgaaaagcgatgacccggacgttgtggccgcttcctctagcctcatggccagaaagctggaatttggaaccgattccacattcaaagcgttctctgccatgcctaagaccagcctgtgcttttatattgtcgagcgcgagtactgtaagtcctgctctaaagaagacacacagaagtgtgtgaacaccaaacttgagcagccccaaagcatcctgattgaacataagggcacaatcatcgggaaacagaataatacctgcacggctaagacatcctgctggctcgagagcgttaagtctttcttttatggcctgaaaaacatgctctccggaattttcggcaactttttcatggggatctttctgttccttgccccctttattctgctcatcctgttctttatgttcggatggcggattctgttttgtttcaagtgctgtagacgcaccagaggccttttcaaataccggcacctgaaggatgacgaagagaccgggtatcgcagaatcatcgagcggctcaacaataaaaagggaaagaacaaactgctcgatggcgaacgcctggctgacagacggattgccgagctttttagcacaaagacccacatcggc

SEQ ID NO: 13738 - RNA, 3495 nt, synthetic construct
  misc_feature 1..3495: note = derived and/or modified CDS sequence (opt5) from CCHVF(CCHVF VLG/TI29414)__AY179961.1__Gn-NSm-Gc
  source 1..3495: mol_type = other RNA
agcgaggaacccggcgacgattgcatctccagaacccagctgctccgggccgagcctgctgaaattcacgacgataactacgggggaccgggcgacaagatcacaatttgtaatgggtctacgatcgtggatcaacgcctgggaagcgagcttggctgctataccattaacagagtcaaatccttcaagctgtgtgaaaattctgccacagggaaaacctgcgagatcgacagcacacccgttaagtgtcggcagggattttgcctcaaaatcacccaggagggccgcggccatgtgaagctgtccagagggtctgaagtggtccttgatgcgtgtgacagctcctgcgaggtgatgattcctaagggaacaggcgatatcctggttgactgtagcgggggacagcaacacttcctcaaagataacctgattgacctgggctgcccccatatccctctcctggggaagatggctatttacatctgtcggatgtctaatcacccccgcaccacgatggcctttcttttctggttttccttcggatatgtgattacctgcatcttttgcaaagccctgttctacagcctcatcattatcggcacactgggcaagaaaattaagcagtatagagaacttaagcctcagacctgtacaatctgcgagaccgctccggtcaacgccattgatgctgagatgcatgacctgaattgttcttacaacatctgcccctattgtgcctcccggctcacgagcgacgggctggcgcgccacgtgcctcagtgccccaaaagaaaggaaaaagttgaggaaacagagctgtacctcaatctggaacggatcccttggaacgtgcgcaaacttctgcaagtctctgagtccaccggagtggccctcaaaagaagctcctggctgattgtgcttctggtcctcctgacagtttctctgagccccgtgcagtccgctccggtgggccacgggaagaccatcgagacctaccagacacgggaaggatttacgagcatttgtctcttcatgctgggctctatcctttttctggtctcctgcctcgtgaaagggctggttgatagcgtgtctgacagcttctttcctggactttccgtctgtaagacctgctctattggcagcatcaatggcttcgagatcgaatcccataagtgttattgcagcctgttctgctgtccctactgccgccactgttctgccgatagagagattcatcagctccacctgtccatctgcaaaaagcggaaaatggggagcaacgtgatgctggctgtttgtaagagaatgtgctttcgcgccacaattgaagcgtctcggagagccctcctgatccgctccattatcaataccacattcgtgatttgtatccttaccctgacgatctgcgtcgtgagcacatccgctgtcgagatggagaacctcccttctggaacctgggaacgggaggaagacctgaccaatttttgtcaccaagagtgccaggtgacagaaaccgagtgtctgtgcccctatgaggcccttgttctcagaaaacccctgttcctggatagcattgtgaagggcatgaagaacctcctgaactccacaaatcttgaaacgtctctgagcatcgaggctccttggggagccattaacgtccagtccacctttaaaccgacagtgagcaccgccaatatcgctctctcttggtccagcgttgaacatcgcggaaacaagattctggtgacaggccggtctgagtccatcatgaaactggaggaaagaaccggggtcagctgggaccttggcgtggaggatgcgtctgaaagcaagctcctgacggtgtccatcatggacctgagccaaatgtactctcccgttttcgagtatctctccggagatcgccaggtcgaagagtggcctaaagctacctgcacaggcgactgtcccgagcggtgcgggtgtaccagctccacatgcctgcacaaggaatggcctcattctagaaattggcgctgtaaccccacctggtgctgggaggtgggaacgggctgtacatgctgtgggtggaatgtgaaggatctttttaccgaccacatgttcgtcaaatggaaggtggaatacattaaaacagaggccatcgtttgcgtggaactgaccagccaggagcggcagtgttccctcattgaggccggaaccagatttaacctgggcccggtcacaatcacgctgtctgaacctcggaatattcaacagaaacttccccctgagatcatcaccctccatcccaaggtggaagaggggttctttgacctgatgcacgttcagaaggtgctgagcgcctccacagtctgcaagctccagtcttgcacccacggcattcctggagatctgcaagtgtatcatatcggcaaccttctgaaaggggaccgcgttaatggacacctcattcataagatcgaaccccacttcaacacaagctggatgtcctgggatggctgtgacctggattactactgcaatatgggggactggccgagctgtacctatacgggaatgacacagcacaaccatgctgcctttgtgaatctgcttaacattgagaccgattacaccaaaacattccacttccattctaagagagtcaccgcgcacggcgacacacctcagctcgatctgaaagctcggcccacgtatggggccggcgagatcaccgtgctggtggaagtcgccgacatggagctccatacaaagaaagttgaaatctccggactgaagtttgctagccttgcctgcaccggctgttacgcttgttcttccgggattagctgcaaggtgagaatccacgtggatgagcccgacgagctgacagtccacgtgaaatctaacgatcctgacgttattgccgcgtccaccagcctcatggcccgcaagctggaatttggaacggactccacctttaaggctttcagcgccatgccgaagacatctctgtgcttttatatcgctgagcgggaatactgtaaaagctgctccgaggaagatacccagaagtgtgtggacacaaaacttgagcaaccccagtctattctgatcgagcataagggcaccattatcgggaagcagaatgatacatgcaccgccaaagcgagctgctggctcgaatccgtcaagtctttcttttatggactgaaaaacatgctcggcagcgtgttcgggaatttcttcatcggcattctgctttttctggcccctttcgttctcctggtgctgtttttcatgttcggatggaagatcctgttttgtttcaagtgctgtagacgcacgagaggccttctcaaataccggctgctcaaggacgatgaggaaacagggtaccgcagaattatcgagcggctgaacaataaaaaggggaaaaaccgccttctggacggcgaaagactcgctgatcggaagattgccgagctgttttccaccaagacccacatcggg

SEQ ID NO: 13739 - RNA, 3495 nt, synthetic construct
  misc_feature 1..3495: note = derived and/or modified CDS sequence (opt5) from CCHVF(CCHVF TADJ/HU8966)__AY179962.1__Gn-NSm-Gc
  source 1..3495: mol_type = other RNA
agcgaggaatccggcgacgattgcatctctagaacccagctgctccggacagagacggccgaaattcacggggacgattacggaggccccggggacaagatcaccatttgtaacggaagcacaatcgtggatcaacgcctgggctccgagcttgggtgctataccattaatagagtcaaatctttcaagctgtgtgaaaacagcgctacaggaaagaattgcgagatcgactccgttcctgtgaagtgtcggcagggctactgcctcaaaatcacccaggagggccgcgggcatgtgaagctgtctagaggaagcgaagtcgtgcttgatgcctgtgactccagctgcgaggttatgattccgaagggcacaggggatatctctgtggactgttccggaggccagcaacactttctgaaagataacctcattgacctggggtgccccaagatccctctgctcggaaaaatggcgatttatatctgtcggatgagcaatcatcccaagaccacgatggctttcctgttttggttctcttttggctacgtcattacccgcatcctttgcaaagccatcttctatctgctcattatcgtgggcacactggggaagagatttaagcagtaccgggaacttaaacctcagacctgcacaatttgtgagaccacgcccgccaacgctatcgatgccgagatgcacgacctgaattgctcctataacatttgtccttactgcgctagccgcctcacatctgacggactggccagacatgttacccagtgtccgaagcggaaagaacgcgtggaggaaacagagctgtacctcaatctggaaagaatcccctggatcgtccggaaacttctgcaagtgtccgagagcaccggcgtggcgctcaaacgctcctcttggctgattgtccttctggttctcttcaccgtgagcctgtcccctgtgcagagcgcccccatcgggtatggaaacacaattgagacgtaccaggctagagaagagtatacctctatctgcctgtttgtcctcggctccattctgttcatcgtgagctgtcttatgaaggggctggttgattctatcggaaatattttcttccctggcctcacaatctgcaaaacctgtagcattggctccatcaacgggtttgaaattgagtctcacaagtgctactgtagcctgctttgctgcccctattgtcggcactgctccgccgacagagaaatccatcagctgcacctcagcatttgtaagaaacgcaagacaggatctaatgtgatgctggctgtctgcaaacggatgtgtttcagagccaccatggaggtgtccaacaaggcgctgctcatccgcagcatcattaatacgacattcgttgtgtgcatcctgattcttgccgtctgtatcgtgtctacctccgctgtcgagatggaaagcctgccggccggcacctgggagcgggaagaggatctcacaaacttttgccatcaagaatgtcaggtgaccgagacagagtgcctgtgtccttacgaagctctggttcttagacgccccctcttcctggactccattgtgaaagggatgaagaaccctctgaactctacgagcctcgagacctccctgtctatcgaagccccctggggagccatcaacgtccagagcacatataagcccaccgtgtccacagctaatattgcgcttagctggtcttccatcgagcaccggggcaacaatattctggttagcgggagatctgagtccatcatgaaactcgaggaacgcaccggcattagcggagatctgggcgtggaagacgcctctgagagcaagctgcttacggtctccgtgatggatctcagccaaatgtactctcctgtgtttgaatacctgtccggggaccggcaggttgaggagtggccgaaagctacctgcacaggagattgccccgaaagatgtggctgcaccagctccacatgtctgcacaaggagtggcctcattctcgcaactggcggtgcaatcccacctggtgttggggagtcggaacgggctgcacatgttgcgggctcgacgtgaaagatctgttcatcgactatatgtttgtgaagtggaaggtcgactacatcaaaaccgaagccattgtgtgtgttgagcttacaagccaggaaagacagtgctccctggtggaggccggcacccggttcaacctcggacctgtcaccatcacactgtctgagccccgcaatattcaacagaagctgccgcctgaaatcattacgcttcaccccagaatcgaggaaggctttttcgatctcatgcatgtgcagaaagttctgagcgcttccaccgtgtgtaagctgcagtcttgcacacacggggtccctggagacctccaagtgtatcatatcggcaacctgcttaaaggggataaggagaatggacacctgattcacaagatcgaaccccattttaacaccagctggatgtcctgggacggctgcgatctcgactactattgtaatatgggggattggcctagctgcacatacaccggcgttacgcagcacaaccatgcctctttcgtgaatctgctgaacattgagacagactataccaaatcctttcacttccacagcaagcgggtcaccgcgcatggagatacaccccagcttgacctcaaagctagaccgacctacggcgccggggagatcacagtgctggtggaagtcgccgatatggagctgcacacgaagaaaattgaaatcaccggactcaagtttgcttctctgacatgtaccggctgctacgcctgttccagcgggatttcttgcaaagttcgcatccatgtggacgagcctgatgagcttacagtgcacgtcaagtccgacgaccccgatgtggttgctgccagctccagcctgatggcgcggaagctcgaatttggaaccgactctacgttcaaagcctttagcgctatgcccaagacctccctgtgtttctatatcgtggagagagaataccgcaaatcttgcagcaaggaggatacacagaaatgtgtcaacaccaagctggaacaacctcagtccattcttatcgagcataagggcacaattatcgggaaacagaataatacctgcacagccaaggcttcttgttggctggagagcgtgaaatcctttttctatggcctcaagaatatgctgtctggaatttttggcaacgttttcgtggggatctttctcttcctggccccgtttatccttctgattctcttctttatgttcggatggagaatcctgagctgctttaaatgctgtcggcgcaccagaggcctgcttaagcaccggcacctgaaggacgatgaagagacggggtaccgcagaattatcgaacggctcaataacaaaaaggggaaaaataagctgctcgacggcgagcgcctggcggatagacggattgccgaacttttctccacaaaaacccatatcggc

SEQ ID NO: 13740 - RNA, 3495 nt, synthetic construct
  misc_feature 1..3495: note = derived and/or modified CDS sequence (opt5) from CCHVF(CCHVF Hodzha)__AY223476.1__Gn-NSm-Gc
  source 1..3495: mol_type = other RNA
agcgaggaatccggcgacgattgcatctctagaacccagctgctccggacagagacggccgaaattcacggggacgattacggaggccccggggacaagatcaccatttgtaacggaagcacaatcgtggatcaacgcctgggctccgagcttgggtgctataccattaatagagtcaaatctttcaagctgtgtaaaaacagcgctacaggaaagtcctgcgaaatcgactctacccctgttaaatgtcggcagggctactgcctcaagatcacacaggagggccgcgggcatgtgaagctgagcagaggatccgaggtggtccttgatgcctgtgacagctcttgcgaagtgatgattccgaaaggcaccggggatatcctggttgactgttccggaggccagcaacactttctcaaggataatctgattgacctggggtgcccccggatccctctcctgggaaaaatggcgatttatatctgtcgcatgagcaaccatcccaagacgaccatggctttccttttctggttctcttttggctacgtgattacatgcatcctgtgcaaagccatcttctatctcctgattatcgtcggcacccttgggaagagatttaagcagtaccgggagctgaaacctcagacatgtaccatttgcgaaacgacacccgccaatgctatcgatgccgagatgcacgacctcaactgttcctataatatttgcccttactgtgctagccgcctgacctctgacggactggccagacatgtgacacagtgcccgaagcggaaagagaaggttgaagagaccgaactctacctgaaccttgagcgcatcccctggatcgtgagaaaactgctccaagtctccgaaagcaccggcgtggcgctgaagcggtcctcttggcttattgtgctgctcgtcctgttcgccgttagcctgtcccctgtgcagagcgctcccatcgggcacggaaaaacaattgagacgtatcaggcccgcgaggattacacctctatctgtctctttgtgctgggctccattcttttcatcgtcagctgcctgatgaaggggctcgtggactctatcggaaatatctttttccctggcctgacaatttgtaagacctgcagcattggctccatcaacgggtttgaaattgagtctcacaaatgttattgcagccttctgtgctgtccctactgcagacattgttccgctgatcgggaaatccaccagctccatctgagcatttgcaagaaaagaaagacaggatctaatgttatgctggccgtgtgtaaacgcatgtgcttccgggcgaccatggaggtctccaacaaggccctcctgatcagaagcatcattaatacgacattcgtggtttgtatccttattctggctgtgtgcgtcgtgtctacctccgccgtcgaaatggagagcctcccggctggcacctgggagcgcgaagaggacctgacaaacttttgtcaccaagaatgccaggtgaccgagacagaatgtctgtgcccttatgaggcccttgttctccggagacccctgttcctggattccatcgtgaaggggacgaaaaatctcctgaactctaccagccttgagacatccctgtctattgaagccccttggggagctatcaacgtccagagcacctacaagcccacagtgtccaccgcgaatatcgccctcagctggtcttccgttgagcaccgcggcaacaaaattctggtgagcgggcggtctgaatccatcatgaagctggaggagagaacgggcattagctgggaccttggagtcgaagatgcttctgagagcaaactcctgaccgtgtccgtgatggacctgagccaaatgtattctcccgtttttgaatacctctccggcgatcgccaggtcgaggaatggcctaaggccacatgcaccggggactgtccggagcggtgcggatgtacaagctctacctgcctgcataaggagtggccccactccagaaattggcgctgtaaccctacgtggtgctggggcgtggggacaggatgtacctgctgtggccttgatgtgaaagacctgttcacagactacatgtttgtcaagtggaaagtggattatatcaagaccgaagccattgtttgcgtggagctcaccagccaggaacggcagtgttccctggtcgaggctgggacaagattcaatctgggccccgtgacgatcaccctttctgaacctcggaacatccaacagaaacttcccccggagattatcacactgcatcctcgcattgaggaaggatttttcgacctgatgcacgttcagaaggtgctcagcgcctccaccgtctgcaagctgcagtcttgcacacatggcgtgcccggggatcttcaagtttaccacatcggaaatctgctcaaaggcgacaaggtgaacgggcacctgattcataaaatcgagcctcactttaataccagctggatgtcctgggatggatgtgacctggattattactgcaacatgggcgactggcccagctgtacgtatacaggggtcacccagcataatcacgcgtctttcgtgaaccttctcaatatcgaaaccgattacacaaagtcctttcacttccatagcaaaagagtgaccgctcacggcgacacacctcagctggatctgaaggcccggcccacgtatggagccggcgagattaccgtcctcgttgaagtggctgacatggagctgcataccaaaaagatcgagattacagggcttaagtttgcctctctgacatgcaccggatgttacgcttgctccagcggcatctcttgtaaagtgcgcattcacgtcgatgaaccggacgagctcacggtgcatgttaagtccgacgatcctgacgtggtcgccgcgagctccagcctgatggccagaaaactggaatttgggaccgattctacattcaaggcttttagcgccatgcccaaaacctccctttgcttctacatcgtggagcgggagtattgtaagtcttgcagcaaggaagacacacagaaatgtgttaacaccaagctggagcaaccccagtccattctcatcgaaagaaaaggaacaatcattggcaagcagaataatacctgcacggctaaagcctcttgctggctggagagcgtgaagtcctttttctacgggctcaagaacatgctgtctggcatctttggaaacgtcttcgtgggcatttttcttttcctggcgccttttatcctcctgattctgttctttatgttcgggtggcgcatcctcttttgtttcaaatgctgtagacggacacgcggactgttcaagtataaacacctcaaggatgacgaagagaccggctacagacggatcattgagcgcctgaacaataaaaaggggaagaacaaactcctggatggagaaagacttgccgaccggcgcatcgctgagctgtttagcaccaagacacacattggc

SEQ ID NO: 13741 - RNA, 3495 nt, synthetic construct
  misc_feature 1..3495: note = derived and/or modified CDS sequence (opt5) from CCHVF(CCHVF Kosovo/9553/2001)__AY675511.1__Gn-NSm-Gc
  source 1..3495: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacagctcctgcgaggtgatgattcccaagggaacgggcgatatcctggttgactgtagcgggggacagcaacacttcctcaaagataacctgattgacctgggctgccctcatatccccctcctggggaagatggcgatttacatcgctcggatgtctaatcaccctaaaaccacaatggcctttcttttctggttttccctgggatatgtgattacctgtatcctctgcaaggccctgttctacagccttatcattatcggcacactgggcaaaaagattaagcagtatcgcgaactcaaaccccagacctgcacgatctgtgagacagctcctgtcaacgccattgatgctgagatgcatgacctgaattgctcttacaacatctgtccgtattgcgcctccagactgaccagcgacgggctcgcgcggcacgtgaagcagtgtcccaaacgcaaggaaaaagttgaggaaacagagctgtaccttaatctggaaagaatcccttgggtggtccggaagctcctgcaagtgtctgagtccaccggagtggcccttaaacgcagctcctggctgattgtcctcctggttctgctcaccgtgtctctgagccccgtgcagtccgctcctgtcggccacgggaagacaatcgagacgtaccagaccagagaaggatttacaagcatttgccttttcatgctgggctctatcctctttattgtgtcctgtctggttaaggggcttgtggatagcgtctctgacagcttctttcccggactgtccgtgtgcaaaacctgttctatcggcagcatcaacggcttcgagattgaatcccataagtgctattgtagcctcttttgctgcccgtactgtcggcactgctctgccgatcgcgagatccatcagctgcacctgtccatttgtaaaaagagaaaaacagggagcaatgttatgctcgctgtgtgcaagcggatgtgtttcagagccaccatcgaagcgtctcgccgggccctgcttattagatccatcattaacacgacattcgtcatctgcatcctgaccctcaccatttgtgtggctagcacatccgccgtcgagatggagaccctgcctgctgccacatgggaacgcgaggaagacctgacgaatttttgccaccaagagtgtcaggtgcccgaaaccgagtgcctttgtccttatgaggccctcgttctgcggaagcccctgttcctcgattctatcgtgaaaggaatgaagaacctgcttaatagcacatccctggaaacctctctcagcattgaggctccctggggcgcgatcaacgtccagtccacatttaaacctaccgtgagcacggccaacattgctctgtcttggtccagcgttgaacatagagggaataagatcctggtgaccggacgctctgagtccatcatgaaacttgaggaacggacaggcgtcagctgggacctcggggtggaggatgcctctgaaagcaagctgctgaccgtgtccattatggacctcagccaaatgtactctccggttttcgagtatctgtccggcgatagacaggtcgaagagtggcccaaggccacatgcaccggagactgccctgagcgctgtggctgcacgagctccacatgtcttcacaaagaatggccccattctcggaactggagatgcaatcctacctggtgttggggagtgggaacaggctgcacctgttgcggggtggatgtcaaggacctgtttaccgaccacatgttcgtgaaatggaaggttgagtacatcaaaacagaagctattgtgtgtgtcgagctcacgagccaggaacgccagtgctccctgatcgaggccggaacccggtttaacctgggccccgtgacaattaccctttctgagccgagaaatatccaacagaagctccctcccgaaatcattacactgcatcctaagatcgaggaagggttctttgatctgatgcacgttcagaaagtgctcagcgcgtccaccgtctgtaagctgcagtcttgcacgcacggcattcccggagaccttcaagtgtatcatatcggcaacctgctcaaaggggatcgggttaatggacacctgattcataagatcgagcctcacttcaacacaagctggatgtcctgggacggctgcgatctggactactactgtaatatgggggattggcccagctgcacctataccggagtgacacagcacaaccatgctgcctttgtcaatcttctcaacatcgaaaccgactacacaaaaacgttccactttcattctaagcgcgtgaccgcccacggcgatacaccgcagctggacctgaaagctagacctacctatggggccggcgagattacagtgctcgtcgaggttgctgatatggaactgcataccaagaaggtggagatctccggacttaaattcgccagcctggcgtgtacgggctgctacgcctgttcttccgggattagctgcaaggtgcggatccacgtcgacgaacccgatgagctcaccgtgcacgttaaatcttccgaccccgacgtggtcgctgccagcacatccctgatggctagaaagctggagttcggaaccgatagcacatttaaagccttctctgcgatgcctaagaccagcctttgtttttatattgtggaaaaggagtactgcaaatcctgttctgaagacgatacaaagaaatgcgttgacaccaagctggagcagccgcaaagcatcctcattgaacatcgcggcacgatcatcgggaaacccaatgatacatgtcctgccaagacctcctgctggctggagtctgtcaagagcttcttttatggactcaaaaacatgctgggctccgtgttcgggaactttttcattggcatccttctgtttctcgctcccttctttctgtggatgctgtctttcatgtttggatggaagattcttttctgcttcaaatgttgccggagaacccgcggcctgtttaagtacagacacctcaaagacgatgaggaaacagggtaccggcgcatcattgagagactgaataacaagaaggggaaaaatcggctcctggacggcgaacgccttgccgatagaaagatcgctgagctgttcagcaccaaaacgcatatcggg

SEQ ID NO: 13742 - RNA, 3495 nt, synthetic construct
  misc_feature 1..3495: note = derived and/or modified CDS sequence (opt5) from CCHVF(CCHVF SPU41/84)__AY900142.1__Gn-NSm-Gc
  source 1..3495: mol_type = other RNA
agcgaggaatcctctgacgattgcatcagcagaacccagctgctccggacagagacggccgaaattcacggcgacaactacgggggacccggcgataagatcaccatttgtaatgggtccacagtggtcgaccaacgcctgggatctgagcttggctgctataccatcaacagagttaaaacattcaagctgtgtgaaaatagcgctaccgggaaatcctgcgagattgattctgtgcctgtgaagtgtcggcagggatactgcctcaaaatcacacaggagggccgcggccatgtcaagctgagcagagggtccgaagtggttcttgacgcctgtgataccagctgcgaggtgatgatcccgaagggaacgggcgacattctggtcgattgttctgggggacagcaacactttctcaaagacaacctgatcgatctgggctgccccaagattcctctcctggggaaaatggcgatctatatttgtcggatgtccaatcatcccaagaccacaatggctttcctcttttggttcagctttggatacgtgattacctgcatcatctgcaaagttatcttctatctgctcattatcgtgggcacactgggcaagcgctttaagcagtacagagaacttaaacctcagacctgtacgatttgcgagacaacccccgtcaacgccatcgacgccgagatgcacgatctgaattgttcttataacatttgcccttactgtgcttcccggctcacaagcgacgggctggcccgccatgtgacccagtgcccgaagagaaaagaaaaggtggaggaaaccgagctgtacctcaatctggaacggatcccctgggtcgttcgcaaacttctgcaagtgtctgagtccacaggagtggctctcaagagaagctcctggctggtcgtgcttctggttctcctgacggtgtctctgagccctgtccagtccgcccccatcagccacggcaaaaccgtggaggcgtatcgggcccgcgaagggtacacatctatgtgtctcttcgttctgggatccgtgctttttctggtcagctgcctcatgaagggcctggtggactctgtcgggaacaccttctttcctggacttagcatttgtaagacatgctccatctctagcattaatggcttcgagatcgaatcccacagatgttattgcagcctgttttgctgtccctactgccggcattgttctgctaacaaagagattcaccagctccatctgtccatctgcaagaaaagaaaggccggcagcaatgtgatgctggctgtttgtaaacgcatgtgcttccgggccaccatggaagtgtctaacagagcgcttttcatccgctccattatcaatacgacatttgtcctgtgtattcttatcctggccgcttgcgtggttagcacctccgccgtggagatggagtctctcccggctgggacctgggaacgggaggaagatctgacaaacttctgtcaccaggagtgccaagtcgccgacaccgaatgtctgtgcccttatgaggcccttgtgctcagacgccccctgtttctggatagcattgtgaagggaatgaagaacctcctcaattccacatctcttgagacgagcctgtccatcgaagctccttggggcgcgattaacgttcagagcacctacaaacccacagtctctaccgccaatatcgctctctcctggagctctgtggagcaccgggggaacaagatcctggtgtccggaagaagcgaatctattatgaaactggaggagcgcacaggcatcagctgggaccttggggtcgaagatgcctccgagagcaagctcctgaccgtgtctgttatggacctgtcccagatgtatagccccgtgttcgaatacctctccggcgatcggcaagtcgaggaatggcctaaagccacgtgcaccggagactgtccggagagatgcggctgtacatcttctacctgcctgcataaggagtggccccactcccgcaattggcggtgtaaccctacatggtgctggggagtggggaccggctgtacgtgctgtgggcttgatgttaaggacctgtttacagattacatgttcgtgaaatggaaggtcgaatatattaaaaccgaggctatcgtgtgcgttgaactcacatctcaggagagacagtgtagcctgattgaagccggaacccggtttaatctgggccccgtgaccatcacactttccgagcctcgcaacatccagcaaaagctgcccccggagattatcacgctgcatcctagaattgaagaggggttctttgacctgatgcacgtccagaaagtgctctctgcgagcaccgtgtgcaagctgcagtcctgcacacatggcgtccccggagaccttcaggtttaccacatcggcaatctgctcaagggggataaagtgaacggacacctggtgcataagattgaacctcacttcaataccagctggatgtcttgggacggctgtgatctggactattactgcaacatgggggattggccctcctgtacatataccggagtcacgcaacataatcacgctagctttgtgaacatgcttaatatcgagacagactacaccaaaaacttccactttcattctaagcgggttaccgcccacggcgatacacctcagctcgacctgaaagccagacccacctatggggctggcgaaatcacagtgctggtcgaggtggccgatatggagctccatacgaagaaaattgaaatctccggactgaagttcaccagccttacatgcaccggctgttacgcttgcagctccgggattagctgtaaggttcgcatccacgtggacgagccggatgaactgacagtccatgtgaaatccgaggaccctgatgttgtggccgcgagctctagcctcatggcccggaagctggagttcggaaccgactccacgtttaaggctttctctgccatgcccaagaccagcctgtgcttttacattgtcgaaagagagtattgtaaatcctgctctgaagaggacacacagaagtgtgtgaacaccaaacttgaacagccccaaagcatcctgatcgagcgcaaaggcacaattatcgggaagcagaataatacctgcaaagctaaggccggatgctggctcgagtccgtgaaatctttcttttacggcctgaagaacatgctcagcgggattttcggcaacgtctttatcggaattttcctgtttcttgcgcctttcatcctgctcattctgtttttcatgtttggctggagaatcctgttctgtttcaagtgctgtcggcgcacaagagggctttttaaatatcggcacctgaaggatgacgaagagaccggataccgcaaaatcattgaaagactcaataacaagaaaggcaagaataagctgctcgatggggagcggctggccgaccgcagaatcgctgaacttttctccacgaaaacacacattgga

SEQ ID NO: 13743 - RNA, 3495 nt, synthetic construct
  misc_feature 1..3495: note = derived and/or modified CDS sequence (opt5) from CCHVF(CCHVF UG3010)__AY900143.1__Gn-NSm-Gc
  source 1..3495: mol_type = other RNA
gccgagggcgtgagcaacgactgcgtctccagaacccagctgatcaagacagaagttgctgagattcacgaagattcttacgggggacccggcgagaaaatcacgatttgtaatgggagcaccatcgtggaccaacggctcggatccgaactgggctgctatacaattaaccgcgtgaagacctacaaactttgtgaaaattctgccacagagaaggggtgcgaaatcgatagcgtccctgtgaaatgtaagcagggattctgcctgaaggttacccaggagggcagaggccatgtgaaactctcccgggggacagaaatcgtcctggacgtgtgtgatacctcttgcgagcttatgattccgaagggaacgggcgacatcctggttgattgtagcgggggacagcaacactttctccaggacaacctgattgatctgggctgccccaatgtgcctctcctggggaaaatggcgatctatatttgtcgcatgtccaaccatcccaagaccacaatggctttcctgttttggttcagctttggatacgtcattacctgcatcgtgtgcaaagtgctgttctatctcctgatcgtcatcggcacactttctaagaagctgaaacagtacagagagctcaagcctcagacctgtattgtttgcgaatccacgcccgtgaatgccatcgacgccgagatgcacgaactgaactgtaattataacatttgcccttactgtgctagccggctgacatctgatggcctcgtgcgccatgtcaatcaatgcccgaaaagaaaggagaaagtggaagagaccgagctgtaccttaacctggaacggatcccctggctcgttcgcagactgcttcaggtgtccgagagcacagggatggccctgaagcggtcttgttggatgaccaccctcctgattctgctcgtcgtgtccctgagccctgttcagtccgctcccgtgggacagggcaaagccgtcgaagtgtatcgcgtcagagagtcttacacaagcatctgcctttttgtgctggggtccgttctcttcgcggtgagctggctgatcaagggacttattgacggcatcggaaattctttcttccctgggctgtccgtctgtaagacgtgcagcattggctctatcaacggctttgaaattgagagccacaaatgttattgctccctcttctgctgtccctactgccgggcctgttctagcgataagatcacccaccgcatgcatctgaatgtgtgcaaaaagagaaaagctgggtccaacgttatgctggccgtgtgtaagcggatgtgctttaaggctacagtcgaggccagcaacaccgcgctcctgatcagaggaattatcaattctacattcgtgatttgtgtgcttatcctggttatttgcgtcgtgtccaccagcgccgtggacatggaaaacctcccggctggcatctgggagcgcgaagaggacctgacgaatttctgtcaccaagaatgccaggtcacagagaccgagtgtctgtgcccttatgaagcccttattctccggaaacccctgtacctggattctatcgctaaggggatgaaatccctcctgaacagcaccaatcttgagacatccctgtctatcgaagccccttggggagccattaacgtgcagagcacctttaagcccacagtttccgctgcgaatatcgccctctcttggagctccgtggagcatagaggcaacaaaattctggtcagcgggcgctctgagtccatcatgaagctggaggagcggacgggcattagctggtctcttggagtggaagacgcttccgagagcaagaccctcacagtttctgtgatggatctgagccaaatgtattcccccgtcttcgaatacctgagcggcgacagacaggtggaggagtggcctaaagctacctgcacaggggattgtcaggaacgctgcggatgtacctcttccacgtgcctccacaaggagtggccgcacagccggaattggagatgtaaccccacctggtgctggggcgttgggacaggatgtacctgctgtggcctggacgtgcgcgatctttttacagactacatgatggtcaaatggaaggtggaatatgtgaaaaccgaggccatcatgtgcgtcgaactgacgtcccaggagcggcaatgttctctcatcgaggctgggacaagattcaatctgggccctgttaccattacactgagcgaaccccgcaacatccagcagcggcttccttccgagattgtgaccctccatcccaagatcgaagagggatttttcgatctgatgcacgtgcagaaggtcctgtctgccagcaccgtgtgcaaactccaatcctgcacacatggcgttccgggggaccttcaggtgtaccacgtcggaaatcttctgaagggcgataaagtgaacgggcattctattcacaagatcgaaagccactttaatacgtcctggatgagctgggacggatgtgacctcgattatttctgcaacatgggcgactggccttcttgtacctacacaggggttacccagcataacagagcggcttttatcaatatgctgaacattgagacagattataccaaaacgttccactttcattccaagcgggtgacagcccacggcgacacaccccagctggatcttaaagcccgccctacctacggagctggcgaggtcaccgtgctcgttgaagtggccgacctggagctgcacaccaagaagatcgaagtcagcgggctcaaattcgcttctctgacatgctccggatgttatgcctgcagctctggcatttcctgtaaggtgagaatccatgtgaatgagcccgatgagtttacggtccacgttaaaagctccgaccctgatgtggtggcggccgggagctctcttatggctcggaagattgaatttggagccgacagcaccttcaaagccttttcctctatgcccaagaacagcctgtgcttctacatcgtcgagagagattactgttcctcttgcacaaatgacgatacccaaaagtgtgtggacacaaaactcgaacatccgcagagcatcctgattgagcacaagggcaccatcattgggaaacagaacgacacgtgctccaccaagacatcttgctggctggaaagcgttaaatcctttttctatggccttaagaatatgctgggaggcatctttgggaacgtgttcctcggaatttttctgttcctcgccccttttgcgctgcttatcttctttttctttttcggctggcgcctcctgttctgtctgaagtgctgtcggagaacccgcgggctgcttaaatacaagcagctgaaagatgaggaggaagccggatataagaaaattatcgagagactcaatgacaagaagggcaaaagccggctgtttgatggcgaacgcctcgctgacagaaagatcgccgagctgttctctacaaaaacccatattggg

SEQ ID NO: 13744 - RNA, 3495 nt, synthetic construct
  misc_feature 1..3495: note = derived and/or modified CDS sequence (opt5) from CCHVF(CCHVF Hy13)__AY900145.1__Gn-NSm-Gc
  source 1..3495: mol_type = other RNA
agcgaggaatccggcgacgattgcatctctagaacccagctgagccggacagagacggccgaaattcactccgacaactacgggggacccggcgataagatcaccatttgtaatgggtctacaatcgtggaccaacgcctcggaagcgagctgggctgctataccattaacagagtcaaatccttcaaactttgtgaaaattctgctacagggaaaagctgcgagatcgattccacccctatcaagtgtcggcagggattttgcctgaaaattacacaggagggccgcggccatgttaagctcagcagagggtctgaagtggtgctggacgcctgtgattccagctgcgagatcatgattccgaagggaaccggcgacatccttgtcgattgttctgggggacagcaacacttcctgaaagacaacctcattgatctgggctgccccaatatccctctgctcgggaagatggcgatttacatctgtcggatgtccaaccatcccaaaacgaccatggcttttctgttctggtttagcttcggatatgtgatcacatgcattctttgcaaggttatcttttacctgctcattgtggtcggcaccctgggcaaaaagttcaagcagtatcgcgaacttaaacctcagacatgtaccatctgcgagacgacacccgtgaatgccattgacgccgagatgcacgatctgaactgttcttacaatatctgcccttattgtgcttccagactcaccagcgacgggctggcccggcatgttatgcagtgcccgaagcgcaaagaaaaggtggaggaaacagagctgtacctcaacctggaaagaatcccctgggtcgtgcggaaacttctgcaagtgtccgagtctaccggagtcgctctcaagcgcagctcctggctggttgtgcttctggtgctcctgaccgtcagcctgtctcctgtgcagtccgcccccattggccacgggaaaacagttgagacgtaccagaccagagaaggatatacaagcatctgtctctttgtgctgggctctattcttttcatcgtcagctgcctgatgaaggggctcgtggactccgttggaaatagctttttccctggcagctccatttgtaagacctgcagcatcggctctatcaacgggtttgagattgaatcccacaaatgttactgcagcctgttctgctgtccctattgccggcattgttctgcggatcgcgagatccacaaacttcatctgtccatttgcaaaaagagaaaaacaggaagcaatgtgatgctcgccgtctgtaagcggatgtgcttcagagctaccgtggaagtctccaacaaggccctgctgatccgcaatattatcaacacgacatttgtggtttgtattctcatcctggctgtgtgcgtcgtgtctaccagcgccgttgagatggagtcccttccggcgggcacctgggaacgggaggaagacctgacaaacttctgtcaccaggagtgccaagccaccgaaacagagtgtctctgcccttacgaggctctggtgctgagaaaacccctgttttctgatagcatcgtcaaggggatgaaaaatctcctgaactccacgagcctggaaacctctctctccattgaggccccttggggagctatcaatgtgcagagcacattcaagcccaccgtgtctgccgccaacattgctctgtcctggagctctgttgaacaccgcggcaataaaatccttgtcagcgggcggtccgagagcattatgaagctggaggaaagaacaggcatctcttgggacctcggagtggaggatgcgtccgaaagcaagctgctgaccgtgtccatcatggacctttctcagatgtatagccccgtctttgagtacctctccggcgatcgccaagtggaagagtggcctaaagccacgtgcaccggggactgtccggagcggtgcggatgtacatcttctacctgcctgcataaggaatggccccactccagaaactggcgctgtaatcctacatggtgctggggcgttgggaccggatgtacgtgctgtggcctggatgtgaaagacctcttcacagatcatatgtttgtcaagtggaaagtggagtatattaagaccgaagctatcgtttgcgtggagctgacatctcaggaacggcagtgtagccttattgaggccgggaccagattcaacctgggccccgtcaccatcacactctccgagcctcgcaatattcagcaaaagctgcccccggaaatcgtgacgctgcaccctcggatcgaggaaggatttttcgaccttatgcatgttaaaaaggtgctcagcgcctctaccgtctgcaaactgcagtcctgcacacacggcgtgcccggggaccttcaggtgtaccacattggaaacctcctgaagggcgataaagtcaatgggcatcttatccacaagattgagcctcattttaacaccagctggatgtcttgggacggatgtgatctggactactattgcaatatgggcgattggccctcctgtagctacacaggggttacccagcacaaccacgctgccttcgtgaatatgctcaacatcgaaacggactatacaaaaatttttcatttccactctaagagagtgaccgcgcatggcgatacccctcaactggacctgaaggctcggcccacatacggagccggcgagatcaccgtccttgtggaggttgccgatatggaactccacacaaagaagatcgagatttccgggctgaaattcgctagcctgacgtgcaccggatgttatgcctgctccagcggcatctcttgtaaggtgcgcattcatgtcgacgaaccggatgagctcacagtgcacgttaaaagcgaggaccctgatatcgtggctgcctcctctagcctgatggcgagaaaacttgaatttgggaccgactccacattcaaggccttttctgctatgcccaagaccagcctgtgcttctacattgtcgagcgggaatattgtaagtcctgctctaaagaggacacgcagaagtgtgtgaacaccaaactcgaacagccccagagcatcctgattgagcacaagggaacaatcatcggcaagcaaaatgatacctgcacatccaaagccgggtgctggctggagagcgttaagtcctttttctacggccttaaaaacatgctgtctggaatttttggcaatgtgttcatcgggatttttctcttcctggctccttttatcctcctgattcttttctttatgttcggatggagaatcctgttctgttttaagtgctgtcgccggaccagaggcctcttcaaataccgccatctgaaggacgatgaagagacagggtatagaaagatcattgaacggctgaacaataaaaagggaaagaacaaacttctggacggcgagcgcctcgccgatagaaagatcgcggaactgtttagcaccaagacgcacattggc

SEQ ID NO: 13745 - RNA, 3495 nt, synthetic construct
  misc_feature 1..3495: note = derived and/or modified CDS sequence (opt5) from CCHVF(CCHVF Semunya)__DQ094832.1__Gn-NSm-Gc
  source 1..3495: mol_type = other RNA
gccgagggcgtgagcaacgactgcgtctccagaacccagcttatcaagacagaagttgctgagattcacgaagattcttacgggggacccggcgagaaaatcacgatttgtaatgggagcaccatcgtggaccaacggctcggatccgaactgggctgctatacaattaaccgcgtgaagacctacaaactttgtgagaatagcgccacagagaaggggtgcgaaatcgatagcgtccctgtgaaatgtaagcagggattctgcctgaaggttacccaggagggcagaggccatgtgaaactctcccgggggacagaaatcgtcctggacgtgtgtgatacctcttgcgagcttatgattccgaagggaacgggcgacatcctggttgattgtagcgggggacagcaacactttctccaggacaacctgattgatctgggctgccccaatgtgcctctcctggggaaaatggcgatctatatttgtcgcatgtccaaccatcccaagaccacaatggctttcctgttttggttcagctttggatacgtcattacctgcgtggtgtgcaaagtcctgttctatctcctgatcgttatcggcacacttggcaagaagctgaaacagtacagagagctcaagcctcagacctgtatcgtgtgcgaatctattcccgtgaatgccatcgacgccgagatgcacgaactgaactgtaattataacatttgcccttactgtgcttcccggctgacgagcgatgggctcgtccgccatgtgacacaatgcccgaaaagaaaggagaaagttgaagagaccgagctgtaccttaatctggaacggatcccctggctcgtgcgcagactgcttcaggtctctgagtccacaggaatggccctgaagcggagctgttggatgaccaccctcctgattctgctcgtggtttctctgtcccctgtgcagagcgctcccgtcggccaggaaaaagccatcgaggtgtatcaagtccgcgaatcctacacatctatctgcctttttgtgctggggagcgttctcttcgcggtgtcctggctggtcaagggacttattgacggcatcgggaacagctttttccctggactgtctgtgtgtaagacgtgctccattggcagcatcaatggctttgagattgagtctcacaaatgttattgcagcctcttctgctgtccctactgcagagcctgttcctctgataagatcacccaccggatgcatctgaacatctgcaaacgcagaaaggttgggagcaatgtgatgctggctgtctgtaaacggatgtgctttaaggccacagtggaggcttccaacagcgccctcctgattagatctatcattaactccaccttcgtgatctgtgttcttattctggtcatctgcgtggtgagcacatctgcggtcgacatggaaaatctcccggccggaatttgggaacgcgaggaagacctgaccaacttctgtcaccaggagtgccaggtgacggagacagaatgtctgtgcccttatgaggctcttatcctccggaagcccctgtttctggattccatcgccaaaggcaagaaaagcctccttaattccaccaaccttgaaacctctctgagcattgaggctccttggggagccatcaatgttcaatccacattcaagcccaccgtgtctgccgctaacattgcgctcagctggtccagcgtcgagcatagagggaataaaatcctggtgtctggccgctccgaaagcattatgaagctggaggaacggacagggatctcttggtcccttggcgttgaggacgccagcgaatctaagacgctcaccgtgagcgtcatggatctgtcccagatgtacagccccgtgtttgagtatctgtctggagacagacaggttgaggaatggcctaaagctacatgcaccggcgattgtccggagcgctgcgggtgtacatcctctacctgcctccacaaggaatggccccactcccggaactggagatgtaatcctacgtggtgctggggagtgggcaccgggtgtacatgctgtggactggacgtccgcgatcttttcaccgactacatgatggtgaaatggaaggtggagtacgtcaaaacagaagccatcatgtgcgttgagctgacctctcaggagcggcaatgtagcctcattgaagccggcacgagatttaacctggggcccgtgacaatcaccctgtccgagcctcgcaatgtgcagcagcggcttccctctgaaattgtcacactccatccgaagatcgaggaaggcttctttgatctgatgcacgtgcagaaggttctgttctgcaaatatagcctccaagctacctcctgcacccatggagtgcctggcgacctgcaggtctaccacgtggggaaccttctgaagggagataaagttaatggccattctattcacaagatcgagagccactttaacacatcctggatgagctgggacgggtgtgacctcgattatttctgcaatatgggagactggccctcttgtacgtacaccggcgtgacacagcataacagagccgcgtttgtcaacatgctgaatatcgagaccgattatacaaaaaccttccactttcattccaagcgggtgacggctcacggggacacacctcagctggatcttaaagcccgccccacctacggcgccggagaagttaccgtgctcgtcgaggtggctgacctggaactgcacacaaagaagattgaggtgagcggcctcaaattcgcctctctgacctgctccgggtgttatgcttgcagctctggaatctcctgtaaggtccggattcatgttaacgagcctgatgaatttacagtgcacgtgaaaagcaatgaccccgatgtcgtggccgcgggctccagccttatggcccggaagatcgagtttggggctgactctacgttcaaagcctttagctccatgccgaagaactctctgtgcttctacattgttgaaagagattactgtagctcctgcaccgacgatgacacacaaaagtgtgtgaatatcaaactcgagcatcctcagtctatcctgattgaacacaagggaaccatcattggcaaacagaacgacacatgccccaccaagacgagctgctggctggagtccgtcaaatctttcttctatgggcttaagaatatgctgggcggaatctttggcaacgtgttcctcgggatttttctgttcctcgctccctttgccctgcttatcctgttctttttcttcggatggcgcctcctgttttgtctgaagtgctgtcggagaacccgcggccttctgaaatacaagcagctcaaagatgaggaagaggcggggtataagaaaattatcgaaagactgaatgacaagaagggaaaaagcagactcttcgatggcgagcgcctggccgacagaaagatcgctaaactgttttccacaaagacccatattggc

SEQ ID NO: 13746 - RNA, 3495 nt, synthetic construct
  misc_feature 1..3495: note = derived and/or modified CDS sequence (opt5) from CCHVF(CCHVF SPU128/81/7)__DQ157174.1__Gn-NSm-Gc
  source 1..3495: mol_type = other RNA
agcgaggaaccctccgacgattgcatctctagaacccagctgctccggacagagacggccgaaattcacggcgacaactacgggggacctggcgataagatcaccatttgtaatgggagcacaatcgtggaccaacgcctgggatccgagcttggctgctataccattaacagagtcaaatctttcaagctgtgtgaaaatagcgctacagggaaatcctgcgagatcgagtctgttccggtgaagtgtcggcagggatactgcctccgcatcacccaggaaggcagaggccatgtgaaactgagccgggggtccgaggtcgtgcttgatgcctgtgacacaagctgcgaaattatgatccccaagggaaccggcgatattctggttgactgttctgggggacagcaacactttctcaaggataacctgatcgacctgggctgccctaaaattcccctcctggggaagatggcgatctatatttgtcgcatgtccaatcatcctaaaacgaccatggctttcctgttttggttcagctttggatacgtgatcacatgcatcctttgcaaggccattttctatctcctgatcattatcggcacccttggcaaaagatttaagcagtaccgggagctgaagccccagacatgtaccatttgcgagacgacacctgtcaacgccatcgatgctgaaatgcacgacctcaattgttcttataacatctgcccgtactgtgcctcccgcctgaccagcgatgggctggctagacatgtgacacagtgccccaaacggaaggagaaagttgaagagaccgaactctacctgaatcttgagcgcattccttgggtggtcagaaagctgctccaagtgtctgagtccaccggagtggccctgaaacggagctcctggcttatcgtcctgctcgttctgttcacagtgtctctgagccccgtgcagtccgcgcctattggccacgggaagacgatcgaagcctatcgcgctagagagggatacaccagcatttgtctctttgtcctgggctctatccttttcatcgtgtcctgcctgatgaaagggctcgttgacagcgtgggaaacagctttttccccggcctgtctatttgtaagacatgctccatctctagcattaatggctttgaaatcgagtcccacaagtgttattgcagccttttctgctgtccgtactgccggcattgttctgccgacaaagaaattcacaagctgcatctctccatctgcaaaaagagaaaaaccgggagcaacgtcatgctggctgtgtgtaagcgcatgtgcttccgggccacaatggaggtttctaatagagcgctgtttattcgctccatcatcaacaccacgttcgtgctctgtattctgatccttgccgtctgcgtggtcagcacatccgctgtggagatggaaaatctgcctgccggaacctgggagcgggaagaggatctcaccaacttttgtcaccaggaatgccaggttacagagaccgagtgtctgtgcccctatgaagctctggtgcttagaaagcctctcttcctggactctattgtcaaaggcatgaagaacctgctcaatagcacatccctggagacgtctcttagcatcgaagccccctggggagccattaacgtgcaatccacctacaaacccacagttagcaccgctaatatcgcgctgtcttggtccagcgtggagcaccgcgggaacaagatcctcgtctctggccggtccgagagcattatgaaactggaagagagaacagggatctcttgggatctgggcgtggaagacgccagcgagtccaaacttctcaccgtgagcgttatggatctgtctcagatgtattcccctgtctttgaatacctgagcggagaccgccaggtggaggagtggccgaaggctacgtgcaccggcgattgtcccgaacggtgcgggtgtacatcctctacctgcctccataaggagtggcctcacagcagaaattggcgctgtaaccccacatggtgctggggagtgggcaccgggtgtacgtgctgtggactggacgtcaaggatcttttcacagactacatgtttgtgaaatggaaggttgaatatattaaaaccgaggccatcgtgtgcgtcgaactgacatcccaagagcggcagtgttctctcattgaggccggcaccagattcaatctggggcctgtgaccatcacactgagcgaaccccggaacatccagcagaaacttccgcctgagattatcacgctccatccccgcattgaagagggctttttcgatctgatgcacgttcaaaaggtgctgtccgcttctaccgtctgcaagctccagagctgcacacatggagtgcctggcgacctgcaggtttaccacatcgggaatcttctgaagggagacaaagtgaacggccacctcattcataagatcgaaccccactttaatacctcctggatgagctgggatgggtgtgacctggattattactgcaacatgggagactggccttcttgtacatataccggcgtcacgcagcataatcacgcctccttcgtgaacctgcttaatatcgagacagattacaccaaaaactttcacttccatagcaagagagtgaccgcgcacggggacacaccccaactcgatctgaaagctcggccgacctatggcgccggagagattacagtcctggttgaagtggccgacatggagctccatacgaagaagatcgaaatttctggcctgaaattcgcttcccttacctgcacagggtgttacgcctgcagctctggaatctcctgtaaggtgcgcattcacgtcgatgagcctgacgagctgaccgtgcatgttaaaagcgatgaccccgatgtggtcgctgcctccagctctctcatggcgagaaagctggaatttggcacagacagcaccttcaaagccttttccgctatgcccaagacgtctctgtgcttctacatcgtggagcgggaacactgtaagagctgctccgaggaagacaccaaaaagtgtgttaacacaaaacttgagcagcctcagtctattctgatcgagcacaaggggaccatcattggaaaacagaatagcacatgcaccgccaaggcttcctgctggctcgaatctgtcaagagctttttctatggcctgaaaaacatgctctccgggatctttggcaatgtgttcattggaatctttctgttccttggcccgtttattctgctcatcctgttctttatgttcgggtggagaatcctgttctgttttaagtgctgtcgcagaacacggggacttctgaaataccgccatctcaaggaggatgaagagaccggctatagacggattatcgaacgcctgaacaataaaaaggggaagaacaaactcctggacggagagagacttgccgatcggcgcattgcggagctgttcagcacgaagacacacatcggc

SEQ ID NO: 13747 - RNA, 3495 nt, synthetic construct
  misc_feature 1..3495: note = derived and/or modified CDS sequence (opt5) from CCHVF(CCHVF ROS/HUVLV-100)__DQ206448.1__Gn-NSm-Gc
  source 1..3495: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacagctcctgcgaggtgatgattcccaagggaacgggcgatatcctggttgactgtagcgggggacagcaacacttcctcaaagataacctgattgacctgggctgccctcatatccccctcctggggaagatggcgatttacatctgtcggatgtctaatcaccctcgcaccacaatggcttttcttttctggttttccttcggatatgtgattacctgcatcttttgcaaagccctgttctacagcctcatcattatcggcacactgggcaagaaaattaagcagtatagagaacttaagccccagacctgtacgatctgcgagacagcccctgtcaacgctattgatgccgagatgcatgacctgaattgttcttacaacatctgcccgtattgtgcttcccggctcaccagcgacgggctggcccgccacgtgccccagtgccctaaaagaaaggaaaaagttgaggaaacagagctgtacctcaatctggaacggatcccctggattgtgcgcaaacttctgcaagtctctgagtccaccggagtggcgctcaaaagaagctcctggctgatcgtgcttctggtcctcctgaccgtttctctgagccctgtgcagtccgcccccgtgggccacgggaagacaattgagacgtaccagacccgggaaggatttacaagcatctgtctcttcatgctgggctctattctttttctggtctcctgcctcgtgaaagggctggttgatagcgtgtctgacagcttctttccgggactttccgtctgtaagacctgctctatcggcagcatcaacggcttcgagattgaatcccataagtgttattgcagcctgttctgctgtccttactgccgccactgttctgctgatagagagatccatcagctccacctgtccatttgcaaaaagcggaaaacagggagcaatgtgatgctggccgtttgtaagagaatgtgctttcgcgctaccatcgaagcctctcggagagcgctcctgattcgctccatcattaacacgacattcgtgatctgtatccttaccctgaccatttgcgtcgtgagcacatccgccgtcgagatggagaatctcccctctggaacctgggaacgggaggaagacctgacaaacttttgtcaccaagagtgccaggtgacggaaaccgagtgtctgtgcccttatgaggctcttgttctcagaaaacccctgttcctggatagcatcgtgaagggcatgaagaatctcctgaactccacatctcttgaaaccagcctgtccattgaggccccctggggagctatcaacgtccagagcacatttaaacctaccgtgtctacggccaatattgccctctcctggagctctgttgaacatcgcggaaacaagatcctggtgaccggccggtccgagagcatcatgaaactggaggaaagaacaggggtctcttgggaccttggcgtggaggatgctagcgaatccaagctcctgaccgtgagcattatggacctgtctcaaatgtactccccggttttcgagtatctcagcggagatcgccaggtcgaagagtggcccaaagcgacatgcaccggcgactgtcctgagcggtgcgggtgtacgtcctctacatgcctgcacaaggaatggccccatagcagaaattggcgctgtaaccctacctggtgctggggagtgggcacagggtgtacctgctgtggagtggatgtcaaggacctttttaccgaccacatgttcgtgaaatggaaggttgagtacatcaaaacagaagccattgtgtgcgtcgagctgacgtcccaggaacggcagtgttctctcatcgaggctggcaccagatttaatctggggcccgtgacaattaccctgagcgagccgcggaacatccaacagaaacttcctcccgaaatcattacactccatcctaaggttgaggaaggcttctttgatctgatgcacgtgcagaaggtcctgtccgcctctaccgtgtgcaagctccagagctgcacgcacggaatccccggcgacctgcaagtttatcatattgggaatcttctgaaaggagatcgcgtgaacggccacctcatccataagattgagcctcacttcaatacatcctggatgagctgggacgggtgtgatctggactactactgcaacatgggagattggccctcttgtacctataccggcgtcacacagcacaatcatgccgcttttgtgaacctgcttaatatcgaaaccgactacacaaaaacgttccacttccattccaagagagtgaccgcccacggggatacaccgcagctcgacctgaaagcgcggcctacctatggcgctggagagatcacagtcctggttgaggtggccgatatggaactccataccaagaaagtggagattagcggcctgaagtttgcctctcttgcttgcacggggtgttacgcctgctccagcggaatctcttgtaaggtccgcattcacgtggacgaacccgatgagctgaccgttcacgtgaaatccagcgaccccgacgtcgtggctgcctccacaagcctcatggcgagaaagctggagttcggcaccgattctacatttaaagccttcagcgctatgcctaagacctccctgtgcttttatatcgttgaacgggagtactgtaaatcttgcagcgaagaggacacacagaagtgtgtggataccaaacttgaacaaccgcagtccattctgatcgagcataaggggacgattatcggaaagcagaacgacacatgcaccgccaaggcttcttgctggctcgagagcgtcaagtccttcttttatggcctgaaaaatatgctcgggtctgtgttcggcaactttttcatcgggattctgctttttctggcccccttcgttctcctggtgctgtttttcatgttcggctggaagatcctgttttgtttcaagtgctgtagacgcaccagagggcttctcaaataccggctgctcaaggatgacgaagagacaggataccgcagaattatcgaacggctgaacaataaaaagggcaaaaaccgccttctggatggggagagactcgcggaccggaagattgccgaactgtttagcaccaagacgcacatcgga

SEQ ID NO: 13748 - RNA, 3495 nt, synthetic construct
  misc_feature 1..3495: note = derived and/or modified CDS sequence (opt5) from CCHVF(CCHVF AP92)__DQ211625.1__Gn-NSm-Gc
  source 1..3495: mol_type = other RNA
agcgagggcggggacggaggctgcatctccagaacccagctgattaagacagaaacggccgaggtgcacggggatgactacggaggccccggggagaaaatcaccatttgtaacggatctacaatcgtcgatcaacggctcggcagcgagctgggctgctataccattaatcgcatcaagtccttcaaactttgtgaaaactctgctcaggggaagaattgcgagatcgacagcgcccctgttcagtgtagacagggatactgcctgaaaatttcccaagagggccgggggcatgtgaagctctctcgcggaagcgaaatcgtgctggatgtctgtgacacatcctgcgagattatgatcccgaagggcaccggggatattcttgtggactgtagcggaggccagcagcactttctgcagtctaacctcgttgatctgggctgccccaatatccctctgctcgggaaaatggcgatttatatctgtagaatgtccaaccatcccaagacaaccatggctttcctgttttggttcagctttggatacgtgatcacgtgcattctttgcaaaaccctgttctatatcctcattatcattggcacactggggaagaaacttaagcaataccgggaactgaagcctcagacctgtacaatctgcgagtctgtccccgtgaatgccatcgacgccgagatgcacgatctcaactgttcctataatatttgcccttactgtgctagccgcctgacctctgaaggactgacgagacatgttaaccagtgcccgaaacggaaggagaaagtggaagagacagaactctacctgaatcttgagcgcatcccctggattgtcagaaagctgctccaggtgtccgagagcaccggcgtggccctgaaacggtcctcttggatgatcgtccttctgattctcctgatcgttagcatgtcccctgtgcaaagcgctcccatctctcaggaacgcacagtggccctgtatcagtccagagaggactacatggggatttgtctcgtcatcatgggaagcgtgctgcttgcggtttctctgctcgtgcggggcctgattgatagcatctcctctacctttttccctggccttagcgtctgccgcacctgtcacattgggtccatcaacggatttgaaattgagagccacaagtgctattgtggcctgctctgctgcccctactgtagagcctgctctacagaccaagacgctcatcagttccacctgtccgtgtgtaaaaagcggaaggccgggagcaatgttatgctggctgtgtgcaaaagaatgtgttttaaggccatcatcgaagcgtctaacaaagtcctcttcattcgcaatgtgatcaacacgacctttgtcgtgtgcattctggttatggtggcctgtatcgcttccagcgccgctgtcgagatggagaaccttccggccggaacatgggaacgggaggaagaactgaccaatttctgccatcaggaatgtcaggtgacagagaccgagtgcctctgtccttatgaatccttcattctgagaaagcccctgtttcttgattctatcgccaaaggcgttaagaacctcctgaatagcacgtccctggagacatctctcagcatcgaagctccttggggcgcgattaacgcccaatccacctacaagcccaccgctagctctgccaatatcgccctgacatggtccagcgtggagcaccgcgggaacaaaattcttgtctctggacggtccgagagcatcatgaagctggaagagagaaccggcatttcttggaatctcggggtggaagacgctagcgagtcccgcacactgacgatcagcgtgatggatctgtctcagatgtattcccccgttttcgaataccttagcggagaccggcaggtcgaggagtggcctaaagctacctgcacaggcaactgcccggaaagatgtgggtgcacctcctctacatgtctctacaaggagtggccccacagccgcaattggcggtgcaaccctacctggtgttggggagtgggcacggggtgcacctgttgcggcctggatgtgaaagaactgtttacagaccatatgctcgtcaagtggaaggtggagtatatcaaaaccgaagcgattgtttgtgtggagctgacatcccaggagagacaatgctctcttatcgaagctggaacccgcttcagcctgggccccgtcacgattacactctccgagcctcggaatatccagcagaagctgcccccggaactgattacccttcaccctaaaatcgaggatgggtactttgacctcatgcatgtgcagaaggttatgtctgccagcacagtgtgtaaactgcaatcctgcacccacggagtccccggcgatctgcagatctatcatgtggggaacctcctgaagggagacagagttaatggccaccttattcacaaggtggaacctcatctgaacaccagctggatgtcttgggatgggtgcgacctcgactacttctgtaatatgggcgattggccctcctgcacatatacgggagtcacccagcacaaccatgccgcttttgccaacctgctgaatatcgagacagactacaccaaaacattccactttcacagcaagcgggtgaccgctcatggcgatacgcctcagcttgacctcaaagcccgccccagatatggggcgggagagattacagtgctggtcgaagttgccgatatggagctgcacaccaagaaagtggaagtgaccggcctcaagttcgcttctctgacatgttccgggtgctacgcctgtagctctggaatctcctgcaaagtccggattcatgtggacgagccggatgagcttaccgttcacgtcaagagctccgaccctgatatcgtggctgccagctctagcctgatggcgagaaagattgaatttggcgtggactccacattcaaagccttttctagcatgcccaaggattccctctgtttctacatcgttgagcgcgactattgcaactcttgtaaaaatgaagagacgcaacggtgcgtgaacgctaagctggaacagccccagagcatcctgattgagcataccgggacaatcattggcaaacaaaatgatacctgtggatccagaacatcttgctggcttgacagcttcaagtcctttttctacggcctcaagagcatgctctctgggatctttggaaacgtcttcctgggcatttttctcttcctggccccttttgcccttctgctgttctttttctttttcgggtggcgcatcctgttttgcttcaaatgttgcagacggacccgcggactgttcaagtatagacacatcaaagacgatgaggaagtgggctacaagaaaattatcgagcggcttaataacaagaagggcaaacaccgcctgctcgacggggaaagactggccgatcggaagattgccgagctcttttccacgaaaacccatatcgga

SEQ ID NO: 13749 - RNA, 3495 nt, synthetic construct
  misc_feature 1..3495: note = derived and/or modified CDS sequence (opt5) from CCHVF(CCHVF ArD8194)__DQ211626.1__Gn-NSm-Gc
  source 1..3495: mol_type = other RNA
gccgagggcgggagcaacgactgcgtgtccagaacccagctggtcaagacagaagttgctgagatccacgaagattcttacggaggccccggggagaaaattacgatctgtaatggaagcaccattgtggaccaacggctcggctccgaactggggtgctatacaatcaaccgcgtgagaacctacaagctgtgtgaaaattctgccacagagaaaagctgcgagattgattccgtccctgtgaagtgtaaacagggattctgccttaagatcacccaggagggccggggccatgttaagctctctcgcgggacagaaatcgtgctggacgtctgtgataccagctgcgagcttatgattccgaaaggaacgggcgacatcctggtggattgttccgggggacagcaacactttctccaggacaacctgattgatctgggctgccccaatatccctctcctggggagaaccgcgatttatgtttgtcggatgagcaaccatcccaagacaaccatggctttcctgttttggttctcttttggatacgtgatcacatgcgtcgtgtgcaaagtgcttttctatctcctgattgtcatcggcacccttggcaagcgcctgaaacagtacagagagctcaagcctcagacgtgtatcgtttgcgaatccattcccgtgaatgccatcgacgccgagatgcacgatctgaactgtaattataacatttgcccttactgtgctagccggctgacatctgacgggctcgtgcgccatgtcacccaatgcccgaagagaaaagaaaaggtggaggaaacagagctgtaccttaatctggagcggatcccctggctcgttcgcaaactgcttcaggtgtccgaaagcaccggagtcgccctgaagagatcttgttggatgattaccctcctgatcctgctcacagtgtccatgagccctgttcagtccgctcccgtgggccacaaacgggccgtcgaggtgtatcagatgcgcgaatcttacacggggatctgcctgtttgtccttggaagcgtgctgttcgcggtttcctggctcgtgaaggccctgattgatagcatcggcaactcctttttccctgggctttctatttgtaaaacctgcagcatcggatctattaatggctttgagatcgaaagccacaagtgttattgctccctgttctgctgtccctactgcagagcttgttctagcgacaagatcacacatcggatgcacctcaacgtctgcaaaaagagaaaagtgggctccaatgttatgctggccgtgtgtaagcgcatgtgctttaaagctaccattgaggccagcaaccgggcgacattcatcagaaacattatcaattctaccttcgtcatttgtatcctgattctcgtgatctgcgtggtttccacgagcgccgtcgacatggagaacctgccggctgggatctgggaaaaggaggaagatcttacaaatttttgtcatcaagagtgccaggtgaccgaaaccgagtgtctgtgcccttatgaggccctcatgctgcgcaagcccctgttccttgaccggattgctaaaggaatgaagtctctcctgaactccacaagcctggaaacctccctctctatcgaggccccttggggcgccattaatgtgcagagcacatttaaacccacggtctccgctgcgaacatcgccctgtcttggagctccgtggaacacaaggggaataaaattcttgttagcggaagatctgagtccatcatgaagctggaggaacgcaccggcatcagctggtgcctcggggtggaggatgcttctgaatccaagacactgaccgtcagcgtgatggacctgtctcaaatgtacagccccgttttcgagtatctttccggcgatagacaggtggaagagtggcctaaagccacatgtaccggagactgcccggagcggtgtggctgcacgagctctacctgtctccacaaggaatggccccattcccgcaactggcggtgcaatcctacatggtgttggggagtcgggaccggctgcacatgttgcgggctggatgtgaaagacctgtttaccgattacatgctcgttaagtggaaagtggagtacattaagacggaagccatcatttgtgtcgagctgacaagccaggaaagacagtgctcccttatcgaggctggaacccgcttcaacctgggccccgtgacaattaccctctctgagcctcggaatgtgcaacagagactgcccccggaaatcatcaccctgcaccctaagattgaggaagggtttttcgaccttatgcatgtccagaaagttatgagcgcctccacagtgtgcaagctccagtcttgtacgcacggcgtgcccggagatctgcaagtctatcatgtgggcaacctgctcaaaggggacaaggttaatggacacagcatccacaaaattgagtcccatctgaacacctcttggatgagctgggacggctgcgatcttgactacttttgtaatatgggggattggccttcctgcacatataccggagtgacacagcacaaccatgcggctttcatcaacatgctgaatattgaaaccgactacacgaagacatttcacttccacagcaaacgggtcaccgcccatggcgatacaccccagctcgacctgaaggcccgccctgcttatggggccggcgagatcaccgtgctggttgaggtggctgatcttgaactccacaccaagaaaatcgaggtctctggactgaagtttgcctccctgagctgttctggctgctacgcgtgttccagcgggatttcttgcaaagtgagaatccatgttaacgaacccgacgagttcacagtgcacgtcaagtccaatgatccggacgtggtggccgctggaagctccctcatggcccggaaaattgagagcggcgctgattctacgttcaaggcctttagctccatgcctaagaactctctgtgtttctatatcgtcgaaagagactactgcagctcctgtaccgatgacgacacacagaaatgcgttgatattaaacttgagcatccccaatctatcctgattgaacacaaggggaccatcatcggaaagcagaatgacacatgccccaccaaaacgagctgttggctcgagtccattaagagctttttctacggcctgaagaacatgctgtctgggatctttggcaatgtgttccttggaatgctgctctttctggcgcctttcattctcctgatcctgtttttctttttcggctggcgccttctcttttgcctgaaatgttgccggagaacccgcaagctgcttaaatataagcacctgagagatgaagaggagtccgggtacaaaaagattatcgaacggctcaacgacaagaaaggaaagagccgcctgttcgatggcgagagactcgccgaccggaaaatcgctgaactgttctctacaaagacccatattggg

SEQ ID NO: 13750 - RNA, 3495 nt, synthetic construct
  misc_feature 1..3495: note = derived and/or modified CDS sequence (opt5) from CCHVF(CCHVF ArD15786)__DQ211627.1__Gn-NSm-Gc
  source 1..3495: mol_type = other RNA
gccgagggcgggagcaacgactgcgtgtccagaacccagctggtcaagacagaagttacggagatccacgaagattcttacggaggccccggggagaaaattaccatctgtaatggaagcacaattgtggaccaacggctcggctccgaactggggtgctataccatcaaccgcgtgagaacatacaagctctgtgaaaattctgctaccgagaaaagctgcgagattgattccgtccctgtgaagtgtaaacagggattctgcctgaagatcacacaggagggccggggccatgttaagctctctcgcgggaccgaaatcgtgctggacgtctgtgatacgagctgcgagcttatgattccgaaaggaaccggcgacatcctggtggattgttccgggggacagcaacactttctccaggacaacctgattgatctgggctgccccaatatccctctcctggggcagacagccatttatgtttgtagaatgagcaaccatcccaagaccacaatggcgttcctgttttggttctcttttggatacgtgattacctgcgtcgtgtgcaaagtgctgttctatctcctgatcgtcatcggcacgcttggcaagcggctgaaacagtaccgcgagctcaagcctcaaacatgtatcgtttgcgaatccattcccgtgaatgctatcgacgccgagatgcacgatctgaactgtaattataacatttgcccttactgtgccagcagactgacctctgacgggctcgtgcggcatgtcacacagtgcccgaagcgcaaagaaaaggtggaggaaaccgagctgtaccttaatctggagagaatcccctggctcgttcggaaactgcttcaggtgtccgaaagcaccggagtcgctctgaagcgctcttgttggattatcacactcctgatcctgctcacggtgtccatgagccctgttcagtccgcccccgtgggccacaaaagagctgtcgaggtgtatcaaattcgggaatcttacaccgggatctgcctgtttgtccttggaggcgtgctgttcgccgttagctggctcgtgaaggcgctgattgattccatcgggaacagctttttccctggactttctatttgtaaaacatgctccatcggcagcatcaatggctttgagattgaatctcacaagtgttattgcagcctgctctgctgtccctactgccgcgcctgttcctctgacaagatcacccatagaatgcacctgaacgtctgcaaaaagcggaaagtggggagcaatgttatgctggctgtgtgtaagagaatgtgcttcaaagccacaattgaggctaacaaccgcgccacctttatccggaatattatcaactccacgttcgtcatttgtatcctcatcctggtgatttgcgtggttagcacatctgcggtcgacatggagaatcttccggccggaatctgggaaaaggaggaagatctgaccaacttctgtcatcaggagtgccaggtgaccgaaacagagtgtctctgcccttatgaggctctgatgctgagaaagcccctttccctcgacagcattgccaaaggcatgaagtctctgcttaattccaccagcctcgaaacatccctgtctatcgaggctccttggggagccattaacgtgcaaagcacgtttaaacccaccatctccgccgctaatatcgcgctttcttggagctccgtcgaacacaaggggaacaaaattctggtgagcggccgctctgagtccatcatgaagctcgaggaacggacagggattagctggtgcctgggcgttgaggatgcctctgaatccaagaccctgacagtgagcgtcatggacctttctcagatgtacagccccgtgttcgagtatctctccggagatagacaggttgaagagtggcctaaagctacctgtacgggcgactgcccggagcgctgtgggtgcaccagctctacatgtctgcacaaggaatggccccattcccggaattggagatgcaaccctacctggtgttggggagtgggcacagggtgcacctgttgcggactggatgtcaaagacctctttacggattacatgctggtgaagtggaaagttgagtacatcaagacagaagccattatctgtgtggagcttaccagccaggaacgccaatgctccctgatcgaggccggcacacggttcaatctcgggcccgtcaccattaccctgtctgagcctagaaacgtgcagcagcgcctgcccccggaaatcattacacttcaccctaagatcgaggaaggctttttcgacctcatgcatgtgcagaaagtcatgagcgcttccacggtttgcaagctgcaatcttgtacccacggagtgcccggcgatcttcaggtgtatcatgtcgggaatctcctgaaaggagacaaggtgaacggccacagcattcacaaaatcgagtcccatcttaatacatcttggatgagctgggacgggtgcgatctggactacttttgtaacatgggagattggccttcctgcacctatacaggcgttacccagcacaaccgggccgcgttcatcaatatgctcaacattgaaacggactacacaaagacctttcatttccacagcaaaagagtgaccgctcacggggatacaccccagctggacctgaaggcccggcctacctatggcgccggagagatcacagtccttgtggaggttgctgatctcgaactgcatacgaagaaaattgaggtgtctggcctgaagtttgcctccctcacctgtagcgggtgctacgcttgttcttccggaatcagctgcaaagtccgcattcacgtgaatgaacccgacgagttcacagttcatgtgaagtctaacgatccggacgtcgtggccgcgggctccagcctgatggccagaaaaatcgagtccggggctgatagcacctttaaggccttctctagcatgcctaaaaattccctttgtttctatattgtggaacgggactactgctctagctgtacagatgacgacacccaaaagtgcgtcgatatcaagctggagcacccccagtccatcctcattgaacataaaggaacgatcattggcaagcagaacgatacctgccccacaaaaacctcttgttggctggagagcatcaagtcctttttctacgggctgaagaatatgctttctggcatttttggaaacatcttcctgggcatgctcctgtttctcgctcctttcgttctgcttatcctgtttttctttttcgggtggagactcctgttttgcctgaaatgttgccgccggacaagaaagctgctgaaatataagcacctccgcgacgaagaggagagcggatacaaaaagattatcgaaagactgaatgacaagaaaggcaagtcccggcttttcgatggggagcgcctggccgacagaaaaattgcggaactttttagcaccaagacacacgtggga

SEQ ID NO: 13751 - RNA, 3495 nt, synthetic construct
  misc_feature 1..3495: note = derived and/or modified CDS sequence (opt5) from CCHVF(CCHVF ArD39554)__DQ211628.1__Gn-NSm-Gc
  source 1..3495: mol_type = other RNA
agcgagtccaacaataacgactgcgtgtctagaacccagctgatcaagacagaaaatgccgagattcacggcgatgactacgggggacccggcgagaaaatcacgatttgtaacgggagcaccatcgtcgagcaacggctcggatccgaactgggctgctatacaattaatcgcatcaagtctttcaaactttgtgagaacagcgcttccgggaagggatgcgagatcgattctacccctgttaaatgtaagcagggcttttgcctgaagattacacaggaaggcagagggcatgtgaaactcagccggggatccgagatcattctggacgtgtgtgatagctcttgcgaaatgatgatcccgaagggctccggggacattcttgtcgattgtagcggaggccagcaacacttcctgcaggacaatctcgtggatctggggtgccccaacgttcctctgctcggaaaaatggccatctacatttgtcgcatgtctaatcatcccaagaccacaatggcgtttctgttctggttttccttcggctatgtgattacctgcatcttttgcaaagtcatcttctacgtgcttatcattatcggcacgctggggaagagaattaagcagtatcgggagctcaaacctcagacctgtacaatctgcgaggctacccccgttaacgccatcgacgccgaaatgcacgatctgaattgtagctacaacatttgcccttattgtgcttctcgccttacatccgagggactggtgagacatgtcacccaatgcccgaagcggaaagaaaagatcgaggaaacggagctctacctgaatctggagcgcattccctggtttgtgagaaaactccttcaggtgagcgaatccacaggcgtcgccctgaagcggtctagctggctggttaccctcctggtgcttctgacagtgtccctcagccctgtccagtctgctcccatcgggcaggagcgcaccgtggttacctaccaagtgagagaatcctatacaggaatgtgtctgttcattctgggcagcgtcctctttgccatctcttggctgacgaaagggcttgtggacagcgttggaaacatcttctttcctggcctgtccgtgtgcaagacctgttctattggcagcatcaatgggttcgagattgaatcccacaagtgctactgtagcctcttctgctgcccctattgtcggtactgctctgcggatcgcggagcccaccagtcccatctgagcgtctgtaaaaagagaaaaacaggctctaacgtgatgcttgctgtctgcaagcggatgtgttttagagccaccctgaaagtgtccagcgaggctctcatcattcgctccatcattaacacaaccttcgttgtgtgcatcctgatcctggtcgtgtgtgttgtgtctacgagcgccgtcgagatggaaaatctcccggcggggacatgggagaaggaagaggacctgaccaacttttgccaccaggaatgtcaagtgaccgagacagagtgcctttgtccttatgaagccttcgtgctgcggaagcccctctttctggactccaccgctaaatctatgaagtccctgcttaattccacaagcctcgagacgtctctgtccattgaagccccttggggagctatcaacgttcagagcaccttcaaacccacagcctctaccgccaatattgctctgtcctggagctctgtcgagcatagaggcaacaagatcctcgtgacagggcgcagcgagtccattatgaaactggaagaacggaccggcatcagctggaatcttggagtggaagatgcgtctgagtccaagacgctgaccgtcagcgtgatggacctctcccagatgtactctacagtttttgaatatctgagcggcgatagacaggtggaggagtggcccaaggctacctgcacaggggactgccctgaacgctgtggatgcacctcctctacgtgtctgcacaaagcctggccgcacagccggaactggagatgcaatcccacatggtgttggggcgtcgggaccggatgcacatgttgcggccttgatgtgaagaacctcttcaccgactacatgctgatcaaatggaaggttgagtttattaaaaccgaagccatcgtgtgtgtcgagctgacatcccaagaacgccagtgctctctcattgaggccgggacgcggttcaatctgggccctgtgaccatcacacttagcgagcccagaaacattcagcagaagctgcctcccgaactcgttaccctgcatccgcgcgtggaggaaggatttttcgatctgatgcacgtccaaaaggtgctttccgctagcacagtgtgtaaactccagtcttgcacccatggcgtccctggggacctgcaggtttaccacgtgggaaatctgctcaagggcgataaaatcaacgggaatagctttcataagatcgagcccaacctgaacacgagctggatgtcttgggacggatgcgatcttgactattactgtaatatgggcgactggccttcctgcacatataccggggtgacccagcacaaccacgccgcgttcgtcaatctgctcaacattgaaacagattacaccaaaaatttccattttcacagcaagcgggtgacagctcatggcgagacgccccaactggacctgaaagccagacctaagtatggagccggcgaggttaccgtgcttgtcgaagtggctgatatggagctccacacaaagaaaatcgaaatttctgggctgaagttcgcctccctgacctgtacaggatgctacgcttgtagctccggcatcagctgcaaagttcggctccacgtggacgagcccgatgagctgaccgtccatgtgaagtctgacgatccggacgttgtggccgcgagctcctctcttatggcccgcaaaattgaatttgggacggatagcaccttcaaggctttttcctctatgcctaaggacaaactgtgtttctatatcgtcgagagagattactgcagctcctgttctaaggaagacacacagaaatgcgtgaacgccaagctcgagcagccccagagcatcctgattgaacacaaaggaaccatcattggcaagcaaaatgatacatgtaccgtgaaggcttcctgctggctggagagcgtcaaatcctttttctacgggcttaagaacatgctgggcggaatctttggcaatgttattctcgggatcattatgttcctggccccctttgcgctcctgcttctgttctttctcttcggatggcggatcctgttctgcctgagatgttgccgccggacaagaggcctttttaaatataagcatatcaaagacgacgaggaatctgggtacaagcgcattatcgagagactgaacaataagaaaggaaagaacaaactcttcgatggcgaacggctggccgacaagaaaattgctgagctctttagcaccaagacgcacatcggc

SEQ ID NO: 13752 - RNA, 3495 nt, synthetic construct
  misc_feature 1..3495: note = derived and/or modified CDS sequence (opt5) from CCHVF(CCHVF C-68031)__DQ211629.1__Gn-NSm-Gc
  source 1..3495: mol_type = other RNA
agcgaggaatccggcgacgattgcatctctagaacccagctgagccggacagagacggccgaaattcactccgacaactacgggggacccggcgataagatcaccatttgtaatgggtctacaatcgtggaccaacgcctcggaagcgagctgggctgctataccattaacagagtcaaatccttcaaactttgtgaaaattctgctacagggaaaagctgcgagatcgattccacccctatcaagtgtcggcagggattttgcctgaaaattacacaggagggccgcggccatgttaagctcagcagagggtctgaagtggtgctggacgcctgtgattccagctgcgagatcatgattccgaagggaaccggcgacatccttgtcgattgttctgggggacagcaacacttcctgaaagacaacctcattgatctgggctgccccaatatccctctgctcgggaagatggcgatttacatctgtcggatgtccaaccatcccaaaacgaccatggcttttctgttctggtttagcttcggatatgtgatcacatgcattctttgcaaggttatcttttacctgctcattgtggtcggcaccctgggcaaaaagttcaagcagtatcgcgaacttaaacctcagacatgtaccatctgcgagacgacacccgtgaatgccattgacgccgagatgcacgatctgaactgttcttacaatatctgcccttattgtgcttccagactcaccagcgacgggctggcccggcatgttatgcagtgcccgaagcgcaaagaaaaggtggaggaaacagagctgtacctcaacctggaaagaatcccctgggtcgtgcggaaacttctgcaagtgtccgagtctaccggagtcgctctcaagcgcagctcctggctggttgtgcttctggtgctcctgaccgtcagcctgtctcctgtgcagtccgcccccattggccacgggaaaacagttgagacgtaccagaccagagaaggatatacaagcatctgtctctttgtgctgggctctattcttttcatcgtcagctgcctgatgaaggggctcgtggactccgttggaaatagctttttccctggcctgtctatttgtaagacctgctccatcggcagcatcaacgggtttgagacagaatctcacaaatgttactgctcccttttctgctgtccctattgccggcattgtagcgcggatcgcgagattcacaagctgcatctctctatctgcaaaaagagaaaaaccggatccaatgtgatgctggccgtctgtaagcggatgtgcttcagagctacggtggaagtcagcaacaaggccctgctcattcgcaatatcattaacacaacctttgtggtttgtatcctgattcttgctgtgtgcgtcgtgtccacctctgccgttgagatggagagcctgccggcgggcacatgggaacgggaggaagacctcaccaacttctgtcaccaggagtgccaagtgacagaaacggagtgtctgtgcccttacgaggccctggtccttagaaaacccctcttttccgattctatcgtgaaggggatgaaaaatctgctgaacagcacctccctcgaaacaagcctgtctatcgaggctccttggggagccattaatgtgcagtccaccttcaagcccacagttagcgctgccaacatcgccctttcttggtccagcgtcgaacaccgcggcaataaaattctggtgtctgggcggagcgagtccatcatgaagctcgaggaaagaaccggcattagctgggacctgggagtggaggatgcttctgaatccaagctgcttacggtcagcatcatggacctctcccagatgtattctcccgtgtttgagtacctgagcggcgatcgccaagttgaagagtggcctaaagcgacctgcacaggggactgtccggagcggtgcggatgtacctcctctacatgcctgcataaggaatggccccacagcagaaactggcgctgtaatcctacctggtgctggggcgtggggacgggatgtacatgctgtggcctcgatgtcaaagacctgttcaccgattatatgtttgtgaagtggaaagttgagtacatcaagacagaagccattgtgtgcgtcgagcttacctcccaggaacggcagtgttctctgatcgaggctgggaccagattcaacctcggccccgtgacaattacgctgagcgagcctcgcaatatccagcaaaagctgcccccggaaattgttacccttcatcctcggatcgaggaaggatttttcgacctcatgcacgtgaaaaaggtcctgtccgccagcacagtgtgcaaactgcagtcttgcacccatggcgtgcccggggacctccaggtctaccacatcggaaacctgcttaagggcgataaagttaatgggcacctgattcataagatcgagcctcactttaacacatcctggatgagctgggacggatgtgatctcgactattactgcaatatgggcgattggccctcttgttcctataccggggtgacgcagcataaccacgccgctttcgtgaatatgctgaacattgaaacagactacaccaaaatctttcacttccatagcaagagagtcaccgcccacggcgatacacctcaactggaccttaaggcgcggcccacctatggagctggcgagattacagtgctcgttgaggtggccgatatggaactgcatacgaaaaagatcgagatctctgggctgaaattcgcctccctgacctgcacaggatgttacgcttgcagctccggcattagctgtaaggtccgcatccacgtggacgaaccggatgagctcaccgttcatgtgaaatctgaggaccctgatattgtcgccgctagctcctctcttatggccagaaagctggaatttgggacagacagcaccttcaaggcgttttccgccatgcccaaaacgtctctctgcttctatatcgtggagcgggaatactgtaagagctgctccaaagaggacacccagaagtgtgttaacacaaaactggaacagccccagtctattctgatcgagcacaagggaaccattatcggcaagcaaaatgatacatgcaccagcaaagctgggtgctggcttgagtccgtcaagagctttttctacggcctgaaaaacatgctctctggaatctttggcaatgtgttcattgggatctttctgttcctcgccccttttattctgcttatcctgttctttatgttcggatggcgcattctcttctgttttaagtgctgtagacggacaagaggcctgttcaaatatcgccacctgaaggacgatgaagagaccgggtacagaaagatcatcgaacggcttaacaataaaaagggaaagaacaagctgctcgacggcgagcgcctggctgatagaaaaattgccgaactcttttccacgaagacacatatcggc

SEQ ID NO: 13753 - RNA, 3495 nt, synthetic construct
  misc_feature 1..3495: note = derived and/or modified CDS sequence (opt5) from CCHVF(CCHVF Drosdov)__DQ211630.1__Gn-NSm-Gc
  source 1..3495: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgcctgtgacagctcctgcgaggtgatgattcccaaaggaacgggcgatatcctggttgactgtagcgggggacagcaacacttcctcaaggataacctgattgacctgggctgccctcatatccccctcctggggaaaatggcgatttacatctgtagaatgtctaatcaccctcggaccacaatggcttttcttttctggttttccttcggatatgtgattacctgcatcttttgcaaggccctgttctacagcctcatcattatcggcacactgggcaaaaagattaagcagtatcgcgaacttaaaccccagacctgtacgatctgcgagacagcccctgtcaacgctattgatgccgagatgcatgacctgaagtgttcttacaatatctgcccgtattgtgcttccagactcaccagcgacgggctggcccggcacgtgacacagtgccccaaacgcaaggaaaaagttgaggaaaccgagctgtacctcaacctggaaagaatcccttggattgtgcggaaacttctgcaagtctctgagtccaccggagtggcgctcaagcgcagctcctggctgatcgtgcttctggtcctcctgacagtttctctgagccccgtgcagtccgcccctgtgggccacgggaagacgattgagacctaccagacaagagaaggatttaccagcatctgtctcttcatgctgggctctattctttttatcgtctcctgcctggtgaaggggctcgttgatagcgtgtctgacagcttctttcccggactgtccgtctgtaaaacatgctctatcggcagcattaatggcttcgagatcgaatcccataagtgttattgcagccttttctgctgtccgtactgccggcactattctgctgatcgcgagattcatcagctgcacctctccatctgtaaaaagagaaaaaccgggagcaacgtgatgctggccgtttgcaagcggatgtgttttaaggctacgattgaagcctctagacgcgcgctgctcatccggtccattatcaatacaaccttcgtgatctgcattctgatccttgccatttgtgtcgtgagcacctccgctgtcgagatggagaacctgcctgccggaacatgggaaagagaggaagacctcaccaatttttgccaccaagagtgtcaggtgacagaaacggagtgcctgtgtccctacgaggctctggttcttcgcaaacctctcttcctggattctaccgtgaagggcatgaaaaacctgctcaatagcacatccctggaaacctctcttagcatcgaggccccctggggagccattaacgtccagtccacatttaagcccaccgtgagcacggctaacatcgcgctgtcttggtccagcgttgaacatcggggaaataaaatcctcgtgaccggcagatctgagtccattatgaagctggaggaacgcacaggggtcagctgggacctgggcgtggaggatgcctctgaaagcaaacttctcaccgtgtccatcatggacctgagccaaatgtattctcctgttttcgagtacctgtccggagatcggcaggtcgaagagtggccgaaggctacatgcaccggcgactgccccgagagatgtgggtgcacgagctccacatgtctccacaaggaatggcctcattctcgcaactggcggtgcaatcccacctggtgttggggagtgggcacagggtgcacctgttgcggagtggatgtcaaagacctgtttaccgaccacatgttcgtgaagtggaaagttgagtatatgaagacagaagccattgtgtgtgtcgagcttacgagccaggaaagacagtgctccctgatcgaggccggcacccgctttaacctcgggcctgtgacaattaccctgtctgagccccggaatatccaacagaagctgccgcctgaaatcattacacttcatcccaaaatcgaggaaggcttctttgatctcatgcacgttcagaaggtgctgagcgcttccaccgtctgtaaactgcagtcttgcacgcacgggattcctggcgacctccaaatctaccatattgggaacctgcttaagggagatagagtgaatggccacctgatccataaaatcgagccccacttcaacacaagctggatgtcctgggacgggtgcgatctcgactactattgtaatatgggaaactggcctagctgcacctacaccggcgttacacagcacaatcatgccgcgtttgtgaacctgctgaatattgaaaccgattatacaaagacgttccacttccattctaaacgggtcaccgctcacggggacacaccccagcttgatctcaaggcccgcccgacctacggcgccggagagatcacagtgctggtggaggtcgctgacatggaactgcataccaagaaagttgagatttccggcctcaagtttgccagcctggtgtgtacggggtgctatgcttgttcttccggaatcagctgcaaagtgcggattcacgtcgatgaacctgacgagcttaccgtgcacgttaagtcttccgatcccgacgtggtcgccgcgagcacatccctgatggccagaaaactcgagttcggcaccgacagcatctttaaggctttctctgccatgcccaagacaagcctgtgtttttacattgtggaaagagagtattgcaaatcctgttctgaagatgacaccaagaaatgcgttgatacaaagctggagcagcctcaaagcatccttatcgaacataaagggaccattatcggaaagcagaacgacacgtgtacagctaaggcctcctgctggctggagtctgtgaaatccttcttttacggcctcaagaatatgctggggagcgtcttcggcaactttttcgtgggcattctcctgtttcttgcgccgttcgttctgctcgtgctgtttttcatgttcggatggaaaatcctgttttgcttcaagtgttgccgccggaccagagggctttttaaataccgccacctgaaggatgacgaggaaaccggatatagacggattatcgagcgcctcaactctaagaaaggcaagaatagactgctcgatggggaacggctggccgaccgcaaaatcgctgagcttttcagcacaaagacccatattgga

SEQ ID NO: 13754 - RNA, 3495 nt, synthetic construct
  misc_feature 1..3495: note = derived and/or modified CDS sequence (opt5) from CCHVF(CCHVF Kashmanov)__DQ211631.1__Gn-NSm-Gc
  source 1..3495: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacagctcctgcgaggtgatgattcccaagggaacgggcgatatcctggttgactgtagcgggggacagcaacacttcctcaaagataacctgattgacctgggctgccctcatatccccctcctggggaagatggcgatttacatctgtcggatgtctaatcaccctcgcaccacaatggcttttcttttctggttttccttcggatatgtgattacctgcatcttttgcaaagccctgttctacagcctcatcattatcggcacactgggcaagaaaattaagcagtatagagaacttaagccccagacctgtacgatctgcgagacagcccctgtcaacgctattgatgccgagatgcatgacctgaattgttcttacaacatctgcccgtattgtgcttcccggctcaccagcgacgggctggcccgccacgtgccccagtgccctaaaagaaaggaaaaagttgaggaaacagagctgtacctcaatctggaacggatcccctggattgtgcgcaaacttctgcaagtctctgagtccaccggagtggcgctcaaaagaagctcctggctgatcgtgcttctggtcctcctgaccgtttctctgagccctgtgcagtccgcccccgtgggccacgggaagacaattgagacgtaccagacccgggaaggatttacaagcatctgtctcttcatgctgggctctattctttttctggtctcctgcctcgtgaaagggctggttgatagcgtgtctgacagcttctttccgggactttccgtctgtaagacctgcacaatcggctctatcaacggcttcgagattgaaagccataagtgttattgctccctgttctgctgtccttactgccgccactgtagcgctgatagagagatccatcagctccacctgtctatttgcaaaaagcggaaaaccgggtccaatgtgatgctggccgtttgtaagagaatgtgctttcgcgctacgatcgaagccagccggagagcgctcctgattcgctctatcattaacacaaccttcgtgatctgtatccttaccctgacaatttgcgtcgtgtccaccagcgccgtcgagatggagaatctcccctccggaacatgggaacgggaggaagacctgacgaacttttgtcaccaagagtgccaggtgaccgaaacagagtgtctgtgcccttatgaggctcttgttctcagaaaacccctgttcctggattctatcgtgaagggcatgaagaatagcctcaactccacctctctggaaacaagcctttccattgaggccccctggggagctatcaacgtccagagcacctttaaacctacggtgtctaccgccaatattgccctgtcctggagctctgttgaacatcgcgggaacaagatcctcgtgacaggccggtccgagagcatcatgaaactggaggaaagaaccggggtctcttgggacctgggcgtggaggatgctagcgaatccaaacttctcacagtgagcattatggacctgtctcaaatgtactccccggttttcgagtatctgagcggagatcgccaggtcgaagagtggcccaaggcgacctgcacgggcgactgtcctgagcggtgcgggtgtacatcctctacctgcctccacaaggaatggccccatagcagaaattggcgctgtaaccctacatggtgctggggagtgggcaccgggtgtacctgctgtggagtggatgtcaaggacctgtttacagaccacatgttcgtgaaatggaaggttgagtacatcaaaacggaagccattgtgtgcgtcgagcttacctcccaggaacggcagtgttctctgatcgaggctggcacaagatttaatctcgggcccgtgaccattacactgagcgagccgcggaacatccaacagaagctgcctcccgaaatcattacccttcatcctaaagttgaggaaggcttctttgatctcatgcacgtgcagaaggtcctgtccgcctctacggtgtgcaagctgcagagctgcacacacggaatccccggcgacctccaagtttatcatattgggaatctgcttaaaggagatcgcatcaacggccacctgattcataagatcgagcctcacttcaatacctcctggatgagctgggacgggtgtgatctcgactactactgcaacatgggagattggccctcttgtacctatacaggcgtgacccagcacaatcatgccgcttttgtcaacctgctgaatatcgaaacagactacacgaaaaccttccacttccattccaagagagtgacagcccacggggataccccgcagcttgacctcaaagcgcggcctacatatggcgctggagagattaccgtgctggtcgaggttgccgatatggaactgcatacgaagaaagtggagatcagcggcctcaagtttgcctctctggcttgcaccgggtgttacgcctgctccagcggaatttcttgtaaggtgagaatccacgtcgacgaacccgatgagcttacagtgcacgttaaatccagcgaccccgacgtggtcgctgcctccaccagcctgatggcgcgcaagctcgagttcggcacagattctacctttaaagccttcagcgctatgcctaagacatccctgtgcttttatattgtggaacgggagtactgtaaatcttgcagcgaagaggacacccagaagtgtgttgatacgaagctggaacaaccgcagtccatccttattgagcataaagggacaatcatcggaaagcagaacgatacctgcaccgccaaggcttcttgctggctggagagcgtgaagtccttcttttatggcctcaaaaatatgctggggtctgtcttcggcaactttttcattggaatcctcctgtttcttgcccccttcgtgctgctcgttctgtttttcatgttcggctggaagattctgttttgtttcaagtgctgtagacgcacaagagggcttctgaaataccggcacctcaaggacgacgaagagaccggataccgcagaatcattgaacggctgaacaataaaaagggcaaaaaccgcctcctggatggggagagacttgcggaccggaagatcgccgaactgtttagcacgaagacacatatcgga

SEQ ID NO: 13755 - RNA, 3495 nt, synthetic construct
  misc_feature 1..3495: note = derived and/or modified CDS sequence (opt5) from CCHVF(CCHVF Oman)__DQ211632.1__Gn-NSm-Gc
  source 1..3495: mol_type = other RNA
agcgaggaatccggcgaggactgcatctctagaacccagctgctccggacagaaacggccgagattcacggggataactacggaggccccggggacaagatcaccatttgtaatggaagcacaatcgtggatcaacgcctgggctccgaacttgggtgctataccattaacagagtcaaatctttcaagctgtgtgagaatagcgctacaggaaaatcctgcgagatcgacaacacccctgttaagtgtaaacagggcttttgcctcaagatcacacaggaaggccgggggcatgtgaagctgtctcgcgatagcgaggtggtccttgacgcctgtgattccagctgcgaaattatgatcccgaaaggaaccggcgacattctggtggattgttctgggggacagcaacacttcctcaaggacaatctgatcgatctgggctgccccaacattcctctcctggggaaaatggcgatctacatttgtagaatgtccaatcatcccaagacgaccatggcttttcttttctggtttagcttcggatatgttatcacatgcatcctgtgcaaagtgatcttttacctcctgattgtcgtgggcacccttggcaagaagttcaaacagtatcgggagctgaagcctcagacatgtaccatttgcgagacgacacccgttaacgccatcgacgccgaaatgcacgatctcaattgttcttacaacatttgcccttattgtgcttcccgcctgaccagcgacgggctggccagacatgtgatgcagtgcccgaaacggaaggagaaaatcgaagagacagaactctacctgaatcttgagcgcatcccctgggtcgtgagaaagctgctccaagtgtctgagtccaccggagtcgctctgaaacggagctcctggcttattgttctgctcgtgctgctgaccgtgtctctcagccctgtccagtccgcccccatcggccacgggaagacaattgaaacgtaccagacccgcgagggatatacaagcatctgtctgtttgtgcttggctctattctgttcatcgtttcccacctcatgaaggggctggtggacagcgtcggaaacagctttttccctggcctttctatctgcaaaacctgttccattggctctatcaatgggtttgaaattgagagccataagtgcttctgttccctgttctgctgcccctactgtagacactgcagcgcggataaagaaatccataagctccacctgtctatttgtaaaaagcggaaggccggatccaacgtgatgctggctgtttgcaaacgcatgtgttttagagccacaatggaggtgagcaataaggctctcctgatccggtctgtcattaacaccacgttcgtggtctgcatccttatcctggccgtgtgtgttgtgtccacaagcgcggtcgagatggaatccctcccggccggcacctgggagagagaagaggacctgaccaacttttgccaccaggaatgtcaagtgacagagaccgagtgcctgtgtccttatgaagctcttgttctccgcaaacccctgttcctggattctattgccaaggggatgaaaaatctcctgaacagcacatcccttgagacgtctctgagcatcgaagctccttggggagccattaatgtgcagtccacctttaagcccacagtcagcaccgccaacatcgctctctcttggtccagcgtggagcatcggggcaataagattctggtgtctgggagatccgagagcatcatgaaactggaggaacgcacaggcatctcttgggaccttggagttgaagatgcgagcgagtccaagctcctgaccgtcagcgtgatggacctgtctcagatgtactcccccgtgttcgaatatctcagcggcgatcggcaagtcgaggagtggcctaaagccacgtgcaccggggactgcccggaaagatgtggatgcacatcctctacctgtctgcacaaggagtggccccatagccgcaactggcggtgcaatcctacatggtgttggggcgtggggaccggatgcacgtgttgcggccttgatgttaaagacctgtttacagattacatgttcgtgaagtggaaggtcgaatatattaaaaccgaggctatcgtgtgtgttgaactcacatcccaggagagacagtgctctctgattgaggccgggacccgctttaacctgggccccgtgaccatcacacttagcgaacctcggaatattcagcaaaagctcccgcccgagatcgtcacgctgcaccctagaatcgaagagggattctttgacctgatgcatgtgcagaaagttctctccgcctctaccgtgtgtaagctgcagagctgcacacacggcgtccccggggaccttcaggtgtaccacattggaaacctgctcaaaggcgataaggtgaatgggcatctgatccacaaagtcgaacctcatttcaacacctcctggatgagctgggacggatgcgatctggactactattgtaatatgggcgattggccctcttgcacatacaccggggttacgcaacacaaccacgctgcctttgtgaatcttctcaacattgagacagactataccaagaacttccatttccactccaagcgcgtgaccgcgcatggcgatacacctcagctggacctgaaagctcggcccaattacggagccggcgaggtcaccgtgctcgttgaagtggccgatatggagctgcacacaaagaaaatcgaaattagcgggcttaagtttgcttctctgacgtgtaccggatgctatgcctgttccagcggcatctcttgcaaagtcagaatccatgtggacgagccggatgagctcacagttcacgtgaagtccgaagaccctgatattgtcgctgccagctccagcctgatggcgcggaagctggagttcgggaccgactctacatttaaagccttcagcgctatgcccaagacctccctttgtttttacatcgtggaacgcgagtattgcaaatcttgtagcaaggaagacacgcagaaatgcgttaacgccaagctggagagaccccagtccattctcatcgagcacaagggaaccattatcggcaaacaaaatgatacatgtaccgctaaggcctcttgctggctggaaagcgtgaaatccttcttttacgggctcaagaacatgctgtctggcattttcggaaatgtctttatcggcatcttcctttttctggcgcctttcattctcctgatcctgtttttcatgttcgggtggcggattctgttttgcttcaaatgttgcagacgcacacggggactttttaagtacagacatctcaaggacgatgaggaaaccggctatcgcaaaatcattgagagactgaacaataagaaagggaagaacaaactcctggacggagaacggcttgccgatcgcaagatcgctgagctgttcagcacaaaaacccacatcggc

SEQ ID NO: 13756 - RNA, 3495 nt, synthetic construct
  misc_feature 1..3495: note = derived and/or modified CDS sequence (opt5) from CCHVF(CCHVF SPU97/85)__DQ211633.1__Gn-NSm-Gc
  source 1..3495: mol_type = other RNA
agcgaggaatccgacggcgattgcatctctagaacccagctgctccggacagagacggccgaaattcacagcgacaactacgggggacccggcgataagatcaccatttgtaatgggtccacaatcgtggaccaacgcctgggatctgagcttggctgctataccattaacagagtcaagagcttcaaactgtgtgaaaattccgctacagggaaatcttgcgagatcgatagcacccctgttaagtgtcggcagggattttgcctcaaaatcacacaggagggccgcggccatgtgaagctgtccagagggagcgaaattgtgcttgacgcctgtgattcttcctgcgagatcatgattccgaagggaaccggcgacatcctggtcgattgtagcgggggacagcaacacttcctcaaagacaacctgattgatctgggctgccccaatatccctctcctggggcggatggcgatttacatctgtcgcatgtctaaccatcccaagacgaccatggcttttcttttctggttttccttcggatatgtgatcacatgcattctgtgcaaagttatcttttacctcctgattgtggccggcaccgtcggcaagaaattcaagcagtatagagaacttcggcctcagacatgtaccatctgcgagacgacacccgtgaatgccattgacgctgagatgcacgatctgaactgtagctacaatatctgcccttattgtgcctctcgcctcacctccgacgggctggctagacatgttatgcagtgcccgaagcggaaagaaaagatcgaggaaacagagctgtacctcaacctggaacgcattccctgggtggtcagaaaacttctgcaagtgagcgagtccaccggagtggccctcaagcggtctagctggctgaccgtccttctggttctcctgatcgtgtccctgagccctgtgcagtctgcgcccattggccacgggaaaacaatcgagacgtaccaggcccgcgaaggatatacctccttttgtctcttcattctgggcagcatcctttttatcgtctcttgcctggtgaaggggctcattgacagcgttggaaattccttctttcctggcctgtctatctgtaaaacatgcagcattggctccgtgaacgggttcgagatcgaaagccacaagtgttactgctctcttttctgctgtccctattgcagacattgttccgctgatcgggagattcacaagctgcatctcagcatctgcaaaaagagaaaaaccggatctaatgtcatgctggccgtgtgtaagcgcatgtgctttcgggctacaattgaagtttccaacagagccctgctcatccgcagcatcattaataccacgttcgcggtgtgtatcctgacacttgccgtctgcgtggtctccacctctgctgtggagatggagagcctgccggccggcacctgggaacgggaggaagacctcacaaacttttgtcaccaggagtgccaagttaccgaaacagagtgtctgtgcccttacgaggctctggtgcttagaaaacccctcttcctggattccattgtcaaggggaagaaaaacctgctcaattctacgagcctggaaacctcccttagcatcgaggccccttggggagccattaacgtgcagtctacatttaagcccaccgtttccgctgcgaatatcgccctgagctggtcttccgtggaacaccgcggcaacaaaatcctcgtcagcgggcggtctgagagcattatgaagctggaggaaagaacaggcatctcctgggacctgggagtggaggatgctagcgaatctaaacttctcaccgtgtccgttatggacctgagccagatgtattcccccgtcttcgagtacctgtctggcgatcgccaagtggaagagtggcctaaggccacgtgcaccggggactgtccggagcggtgcggatgtacaagctctacctgcctccataaggaatggccccactccagaaattggcgctgtaaccctacatggtgctggggcgtggggaccggatgtacgtgctgtggcctggatgtcaaagacctttttacagattatatgttcgtgaagtggaaagttgagtacattaagaccgaagccatcgtgtgcgtcgagctgacaagccaggaacggcagtgttccctcattgaggctgggaccagatttaatctgggccccgtgaccatcacactgtctgagcctcggaacatccagcaaaaacttcccccggaaattatcacgctccatcctcgcattgaggaaggattctttgacctgatgcacgttcagaaggtgctgagcgcctccaccgtctgcaagctccagagctgcacacatggcgtgcccggggacctgcaggtttaccacatcggaaatcttctgaaaggcgataaggtgaacgggcacctcattcataaaatcgagcctcacttcaatacctcttggatgtcctgggacggatgtgatctggactattactgcaacatgggcgattggcccagctgtacatataccggggtcacgcaacataatcacgcggcttttgtgaacctgcttaatatcgaaacagactacaccaagaacttccacttccattctaaaagagtgaccgcccacggcgatacacctcagctcgacctgaaggcccggcccacctatggagctggcgaggtcacagttctggtggaggtggccgatatggaactccatacgaaaaagattgagatctccgggctgaagtttgctagcctttcttgcaccggatgttacgcctgctccagcggcatttcctgtaaagtcagaatccacgtggacgaaccggatgagctgacagttcatgtcaagagcgaggaccctgatattgtggcggccgggtctagcctcatggctcgcaaactggagttcggagccgactccacctttaaggctttctctgccatgcccaaaacaagcctgtgcttttatatcgtggaacgggaatactgtaagtcctgctctagagaggacacccagaagtgtgttaacacgaaacttgaacgcccccagagcattctgatcgagcacaagggcaccatcattgggaaacaaaatgatacatgcaccgcgaaggcctcctgctggctcgagtctgtcaagagcttcttttacggcctgaaatccatgctcagcggaatcttcggcaacgtgtttattgggatcttcctgtttattgctcctttcgtgcttctgatcctctttttcatgttcggatggagaatcctgttttgtttcaagtgctgtcggcgcacaagaggcctgtttaaatatcggcaccttaaggacgatgaagagaccgggtaccgcaaaattatcgaaagactgaataacaagaaaggaaagaataagctcctggacggcgagcggctcgccgatcgcaaaattgctgaactgttctctacaaagtcccatatcggc

SEQ ID NO: 13757 - RNA, 3495 nt, synthetic construct
  misc_feature 1..3495: note = derived and/or modified CDS sequence (opt5) from CCHVF(CCHVF SPU103/87)__DQ211634.1__Gn-NSm-Gc
  source 1..3495: mol_type = other RNA
agcgaggaatcctctgacgattgcatcagcagaacccagctgctccggacagagacggccgaaattcacggcgacaactacgggggacccggcgataagatcaccatttgtaatgggtccacaatcgtggaccaacgcctgggatctgagcttggctgctataccattaacagagtcaaaacattcaagctgtgtgaaaatagcgctaccgggaaatcctgcgagatcgattctgttcctgtgaagtgtcggcagggatactgcctcaaaatcacacaggagggccgcggccatgtgaagctgagcagagggtccgaagtcgtgcttgacgcctgtgataccagctgcgaggttatgattccgaagggaacgggcgacatcctggtggattgttctgggggacagcaacactttctcaaagacaacctgattgatctgggctgccccaagatccctctcctggggaaaatggcgatttatatctgtcggatgtccaatcatcccaagaccacaatggctttcctcttttggttcagctttggatacgtcattacctgcgtgctgtgcaaagccatcttctatctcctgatcattgttggcacacttggcaagcgcctgaagcagtacagagaactcaaacctcagacctgtacgatctgcgagacaacccccgtgaacgccattgacgctgagatgcacgatctgaattgttcttataacatctgcccttactgtgcctcccggctgacaagcgacgggctcgctcgccatgtcacccagtgcccgaagagaaaagaaaaggtggaggaaaccgagctgtaccttaatctggaacggattccctgggtggtccgcagactcctgcaagtttctgagtccacaggagtggcccttaaacggagctcctggctgatcgtgctcctggtcctgtttacggtgtctctcagccctgttcagtccgcgcccatcagccacggcaagaccgtggaggcctatcaggctcgcgaagggtacacaggaatgtgtctgttcgtccttggctctattctgtttctcgtgtcctgcctgatgaaagggcttgttgacagcgtgggaaacaccttctttcctggcctgtctatctgtaagacatgcagcatttcctctatcaatggcttcgagattgaaagccacagatgttattgctccctcttttgctgtccctactgccggcattgtagcgccaacaaggagatccaccagctgcatctgtctatctgcaaaaagagaaaaaccgggtccaatgtcatgctcgctgtgtgtaagcgcatgtgcttccgggccacgatggaagtcagcaacagagcgctgttcattcgctctatcattaatacaacctttgtgctttgtatcctgattctcgccgtttgcgtggtctccaccagcgctgtggagatggagtccctgccggccggaacatgggaacgggaggaagatctgaccaacttctgtcaccaagagtgccaggttacagacacggaatgtctttgcccttatgaggctctcgtgctgagacgccccctgtttctcgataacatcgtcaaaggcatgaagaatctgcttaactctaccagcctggagacatccctctctattgaagccccttggggagccatcaatgtgcagagcacctacaagcccacagtgtccaccgctaacatcgcgctgagctggtcttccgttgagcaccgggggaataaaattctggtcagcggcagatctgaatccatcatgaaacttgaggagcgcacggggattagctgggacctcggcgtggaagatgcctctgagagcaaactgctgaccgtgtccgtcatggacctcagccaaatgtattctcccgtgttcgaatacctgtccggagatcggcaggttgaggaatggcctaaggctacatgcaccggcgactgtccggagagatgcgggtgtacaagctctacctgccttcataaagagtggccccactcccgcaactggcggtgtaatcctacgtggtgctggggagtgggcacagggtgtacctgctgtggactggatgtcaaggacctctttacagattacatgttcgtgaagtggaaaatcgaatatattaagaccgaggccatcgtttgcgtggaactgaccagccaggagagacagtgttccctgatcgaagccggcacacggtttaaccttgggcccgtcacgattaccctctctgagcctcgcaatatccaacagaaactgcccagcgagattatcacactgcatccgagaattgaagagggcttctttgacctcatgcacgtgcagaaggttctgtccgcttctaccgtgtgcaaacttcagagctgcacacatggagtccctggcgacctgcaagtgtaccacatcgggaacctcctgaagggagataaggtgaatggccacctggtccataaaatcgaaccccacttcaacacctcctggatgagctgggacgggtgtgatcttgactattactgcaatatgggagattggccttcttgtacgtatacaggcgttacccagcataaccacgcctcctttgtgaatctcctgaacattgagaccgactacacaaagaacttccactttcatagcaaacgggtgaccgcgcacggggatacaccccagctggacctcaaggctagacctacgtatggcgccggagaaatcaccgtcctggtggaggttgccgatatggagcttcatacaaagaagattgaaatctctggcctgaaattcacctccctcacatgcaccgggtgttacgcttgcagctctggaatttcctgtaaggtgcgcatccacgtcgacgagcccgatgaactgacggtgcatgttaagagcgacgatccggacgtggtcgccgcttccagctctctgatggcccggaaacttgagttcggcaccgacagcacatttaaggcgttctccgccatgcctaaaacctctctgtgcttttacatcgtggagagagaatattgtaagagctgctccgaggaagatacacagaaatgtgttaataccaagctcgagcaaccccagtctattctgatcgaacacaaggggacaattatcggaaaacagaacaatacctgcaaggctcgcgccggctgctggctcgagagcgtgaaatccttcttttacgggctgaagaacatgctttctggcattttcggaaatgtctttatcggcattttcctgtttctcgctcccttcatcctgctgatcctgtttttcatgtttgggtggcggattcttttctgtttcaaatgctgtagacgcacgagaggactctttaagtatcggcacctgaaggacgatgaggaaacaggctaccgcaaaatcattgagagactcaacaataagaaagggaagaacaaactgcttgacggagaacggctggccgatcgcagaatcgcggagcttttcagcaccaagacccatattggc

SEQ ID NO: 13758 - RNA, 3495 nt, synthetic construct
  misc_feature 1..3495: note = derived and/or modified CDS sequence (opt5) from CCHVF(CCHVF SPU415/85)__DQ211635.1__Gn-NSm-Gc
  source 1..3495: mol_type = other RNA
agcgaggaatccgacggcgattgcatctctagaacccagctgctccggacagagacgaccgaaattcacagcgacaactacgggggacccggcgataagatcacaatttgtaatgggtccaccatcgtggaccaacgcctgggatctgagcttggctgctatacaattaacagagtcaagagcttcaagctgtgtgaaaattccgccaccgggaaatcttgcgagatcgatagcacacctgttaagtgtcggcagggattttgcctcaaaatcacccaggagggccgcggccatgtgaagctgtccagagggagcgaaattgtgcttgacgcttgtgattctaactgcgagatcatgattccgaagggaacgggcgacatcctggtcgattgttccgggggacagcaacacttcctcaaagacaatctgattgatctgggctgccccaacatccctctcctggggaagatggccatttacatctgtcggatgagcaatcatcccaaaaccacaatggcgtttcttttctggttttctttcggatatgtgattacctgcatcctgtgcaaggttatcttttacctcctgattgtggctggcacagtcggcaaaaagttcaagcagtatcgcgaacttagacctcagacctgtacgatctgcgagacaattcccgtgaacgccatcgacgccgagatgcacgatctgaattgttcctacaacatctgcccttattgtgctagccggctcacctctgacgggctggcccgccatgttatgcagtgcccgaaaagaaaggaaaaagtggaggaaacagagctgtacctcaatctggaacggattccctgggtcgtgcgcaaacttctgcaagtgtccgagagcaccggagtcgctctcaaaagatcctcttggctgaccgttcttctggtgctcctgatcgtgagcctgtcccctgtccagagcgcccccattggccacgggaagacaatcgagacgtaccaggcgcgggaaggatatacctctttttgtctcttcattctgggctccatcctttttgtggttagctgcctggtgaaagggctcatcgactctgtcggaaacagcttctttcctggcctgtccatttgtaagacatgctctatcggcagcattaatgggttcgagatcgaatcccacaagtgttactgcagccttttctgctgtccctattgccgccattgttctgccgatagagagattcacaaactgcatctctccatctgcaagaaacggaagaccggaagcaacgtgatgctggctgtttgtaaaagaatgtgctttcgcgccacaattgaagtgtctaatcgggctctgctcatcagaaacatcattaacaccacgttcgtcgtgtgtatcctgacacttgccgtctgcgtggtttccaccagcgcggtggagatggagtccctgccggccggcacctgggaaaaggaggaagacctcacaaatttttgtcaccaggagtgccaagtcaccgaaacagagtgtctgtgcccttacgaggctctggtgcttcgcaagcccctcttcctggattctattgttaaagggatgaagaacctgctcaatagcacgtccctggaaacctctcttagcatcgaggccccttggggagctattaacgtgcagtccacatttaaacccaccgtcagcgccgccaatatcgctctgtcttggtccagcgtggaacaccggggcaacaagatcctcgtgtctgggagatccgagagcattatgaaactggaggaacgcacaggcatctcttgggacctgggagttgaggatgcgagcgaatccaaacttctcaccgtcagcgtgatggacctgtctcagatgtattcccccgtgttcgagtacctgagcggcgatcggcaagtcgaagagtggcctaaggccacgtgcaccggggactgtccggagagatgcggatgtacatcctctacctgcctccataaagaatggccccacagccgcaattggcggtgtaaccctacatggtgctggggcgtggggaccggatgtacgtgctgtggcctggatgttaaggacctttttacagattatatgttcgtgaaatggaaggtcgagtacattaaaaccgaagctatcgtgtgcgttgagctgacatcccaggaaagacagtgttctctcattgaggccgggacccgctttaatctgggccccgtgaccatcacactgagcgagcctcggaacatccagcaaaaacttcccccggaaattatcacgctccatcctagaattgaggaaggattctttgacctgatgcacgtccagcgggtgctgtccgcctctaccgtttgcaagctccagagctgcacacatggcgtgcccggggacctgcaggtctaccacatcggaaatcttctgaagggcgataaggtgaacgggcacctcattcataaaatcgagcctcacttcaatacctcctggatgagctgggacggatgtgatctggactattactgcaacatgggcgattggccctcttgtacatataccggggtgacgcaacataatcacgctgcctttgtcaacctgcttaacatcgaaacagactacaccaagaatttccacttccattccaaacgcgttaccgcgcacggcgatacacctcagctcgacctgaaggctagacccacctatggagccggcgaggtgacagtgctggtcgaggtggccgatatggaactccatacgaaaaagattgagatcagcgggctgaagtttgcttctcttacctgcacaggatgttacgcctgctccagcggcatttcttgtaaagttaagatccacgtggacgaaccggatgagctgaccgtccatgtgaaatccgaggaccctgatattgttgctgccgggagctccctcatggcgcggaagctggagttcggagccgacagcacatttaaggctttctctgccatgcccaagaccagcctgtgcttttatatcgtggaaagagaatactgtaagtcctgctctcgcgaggacacgcggaaatgtgtcaacaccaaacttgatagaccccagagcattctgatcgaacacaagggcacaatcattgggaagcagaataatacctgcacagctaaagcctcctgctggctcgagtctgttaagagcttcttttacggcctgaagaacatgctctccggaatcttcggcaacgtgtttattgggatcttcctgtttattgcgcctttcgtgcttctgatcctctttttcatgttcggatggcgcatcctgttttgtttcaaatgctgtagacggacccgcggcctgtttaagtatagacaccttaaagacgatgaggaaacagggtaccggaagattatcgagcgcctgaataacaaaaagggaaagaataaactcctggacggcgaaagactcgccgatcggaagattgctgagctgttctctaccaaaagccatatcggc

SEQ ID NO: 13759 - RNA, 3495 nt, synthetic construct
  misc_feature 1..3495: note = derived and/or modified CDS sequence (opt5) from CCHVF(CCHVF Turkey200310849)__DQ211636.1__Gn-NSm-Gc
  source 1..3495: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgaggttgacagcacaccggtgaagtgtcggcagggattttgcctcaaaatcacccaggagggccgcggccatgtgaagctgtccagagggtctgaagtcgtgcttgatgcctgtgacagctcctgcgaggttatgatccccaagggaacgggcgatattctggtggactgtagcgggggacagcaacacttcctcaaagataacctgatcgacctgggctgccctcatattcccctcctggggaagatggcgatctacatttgtcggatgtctaatcaccctcgcaccacaatggcttttcttttctggttttccttcggatatgtcattacctgcatcagctgcaaagccctgttttactctctcatcatcattggcacactgggcaagaaaatcaagcagtatagagaacttaagccccagacctgtacgatttgcgagacagcccctgtgaacgctatcgatgccgagatgcatgacctgaattgttcctacaacatttgcccgtattgtgctagccggctcacctctgacgggctggcccgccacgttacacagtgccccaaaagaaaggaaaaagtggaggaaaccgagctgtacctcaatctggaacggatcccttggatcgtccgcaaacttctgcaagtgtccgagagcaccggagtggcgctcaaaagatcctcttggctgattgtccttctggttctcctgacagtgagcctgtcccccgtgcagagcgcccctgtcggccacgggaagacgatcgagatttaccagacccgggaaggattcgcttctatctgtctctttatgctgggctccattcttttcatcgtgagctgcctggttaaagggctcgtggattctgtcagcgactcctttttccccggactgtctgtgtgtaagacatgcagcatcggctccgttaacggctttgagattgaaagccataagtgttattgctctcttttctgctgtccgtactgccgccactgttccgccgatagagagatccatcagctgcacctcagcatttgcaaaaagcggaaaaccgggtctaatgtgatgctggctgtctgtaagagaatgtgcttccgcgccacaatcgaagcgtcccggagagccctgctcattcgcagcatcattaacaccacgtttgtgatctgtatcctgacacttaccatttgcgtcgtgtccacctctgctgttgagatggagaatctgcctgccggaacatgggaacgggaggaagacctcaccaacttctgtcaccaagagtgccaggtgacagaaacggagtgtctgtgcccctatgaggctctggtccttagaaaacctctctttctggatagcatcgtgaagggcatgaagaatctgctcaactccacctctctggaaacaagcctttccattgaggccccctggggagccatcaacgttcagagcaccttcaaacccgctgtgtctacagcgaatattgccctgtcctggagctctgtcgaacatcgcggaaacaagatcctcgtgaccggccggtccgagagcatcatgaaactggaggaaagaacgggggtgtcttgggacctgggcgttgaggatgctagcgaatccaaacttctcaccgtcagcattatggacctgtctcaaatgtactcccctgtgtttgagtatctgagcggagatcgccaggtggaagagtggccgaaggccacatgcaccggcgactgtcccgagcggtgcgggtgtacatcctctacctgcctccacaaggaatggcctcatagcagaaattggcgctgtaaccccacgtggtgctggggagtcggcacagggtgtacctgctgtggagtggatgttaaggacctgttcacagaccacatgtttgtgaaatggaaggtcgagtacatcaaaaccgaagccattgtgtgcgttgagcttacctcccaggaacggcagtgttctctgatcgaggctggcacaagattcaatctcgggcctgtgacgattaccctgagcgagccccggaacatccaacagaagctgccgcctgaaatcattacacttcatcccaaaatcgaggaaggctttttcgatctcatgcacgtccagaaggtgctgtccgcctctaccgtttgcaagctgcagagctgcacacacgggattcctggcgacctccaagtgtatcatatcgggaatctgcttaaaggagatcgcgtcaacggccacctgattcataagatcgagtcccactttaataccagctggatgtcttgggacgggtgtgatctcgactactactgcaacatgggagattggccctcctgtacgtatacaggcgtgacccagcacaatcatgcggctttcgtgaacctgctgaatatcgaaaccgactacacaaaaacctttcacttccatagcaagagagtcacagcccacggggatacgcctcagcttgacctcaaagcccggcccacctatggcgctggagagattacagttctggtggaggtggccgatatggaactgcataccaagaaagtcgagatctctggcctcaagttcgcttccctggcctgcacagggtgttacgcgtgcagctctggaatttcctgtaaggtgagaatccacgttgacgaaccggatgagcttaccgtgcacgtcaaaagctccgaccctgacgtggttgccgctagcacgtctctgatggcccgcaagctcgagtttggcaccgatagcacattcaaggctttttccgccatgcccaagacctctctgtgcttctatattgtggaacgggagtactgtaaaagctgctccgaagacgatacacagaagtgtgtcgacaccagactggagcaaccccagtctatccttattgaacataaggggacaatcatcggaaaacagaacgatacctgcacggcgaaggccagctgctggctggagtccgtgaaatctttcttttatggcctcaagaatatgctggggagcgtttttggcaacctcttcattggaatcctgctttttctggctcctttcgtgctcctggtcctgtttttcatgtttggctggaaaattcttttctgtttcaagtgctgtcgcagaacacgggggctgtttaagtaccgccacctcaaagacgatgaggaaaccggatacagacggatcattgagcgcctgaactccaagaaaggcaagaatagactcctggacggggatcggcttgccgaccgcaaaatcgctgaactgttcagcaccaagacacatatcgga

SEQ ID NO: 13760 - RNA, 3495 nt, synthetic construct
  misc_feature 1..3495: note = derived and/or modified CDS sequence (opt5) from CCHVF(CCHVF Iran-52)__DQ446215.1__Gn-NSm-Gc
  source 1..3495: mol_type = other RNA
agcgaggagtccggcgacgattgcatctctagaacccagctgctccggacagagacggccgaagtgcacggggacaactacggaggccccggggataagattaccatctgtaatggaagcacagtcgttgaccaacgcctgggctccgagcttgggtgctataccattaacagagtgcggtctttcaaactgtgtgaaaatagcgctacaggaaagtcctgcgagatcgattctattcctgtgaaatgtaagcagggctactgcctcaaaatcacccaggagggccgcgggcatgtcaagctgagcagaggatccgaagtggttcttgacgtgtgtgatagctcttgcgaggtcatgatcccgaagggcacaggggacattctggtggattgttccggaggccagcaacactttctcaaagacaacctggttgatctggggtgccccaagatccctctcctgggaaaaatggccatttatatctgtcggatgagcaatcatcccaagaccacgatggcgttcctgttttggttctcttttggctacgtgattacctgcatcctgtgcaaagctattttctttctcctgatcatcttcggcacacttgggaagcgctttaagcagtatagagaactgaaacctcagacctgtacaatttgcgagaccacgcccgtcaacgccatcgacgccgagatgcacgatctcaattgttcctacaacatttgcccttattgtgctagccggctgacatctgacggactggcccgccatgtgacccagtgcccgagacggaaggaaaaagtggaggaaacagagctctacctgaatcttgaacgcatcccctgggtcgttagaaagctgctccaagtgtccgagagcaccggcaccgtgctgaaacggtcctcttggcttattgtcctgctcgtgctgttcacagttagcctgtcccctgtgcagagcgctcccatcgggcacggaaagacgatcgagacctaccgcgtcagagaagagtatacatctatttgtctctttgtgctgggctccatccttttcattgttagctttctgatgaaagggctcgtggacggagtcggcaacatcttcttccctggcctgtctgtgtgcaagacctgtagcattgggtccatcaatggatttgaaatcgagtctcacaagtgctactgtagccttttctgctgcccctattgtcggcattgctccgccgatggcgaaattcaccagctgcatctcagcatctgtaaaaagagaaaaacagggtctaacgtcatgctggcggtgtgcaagcgcatgtgttttcgggccaccatggaggtttccaataaagctctgttcattagaagcatcattaacacgacatttgtggtctgcatcctcattctggccgtgtgtgttgtgtctacctccgctgtcgagatggaaagccttccggccggaacctgggagcgcgaagaggacctgacaaatttctgccaccaggaatgtcaagtgaccgagacagagtgcctctgtccttacgaagcgctggtgctgcggagacccctttttctcgattccatcgttaagggcatgaagaacctgctgaactctacgagcctcgagacctccctgtctatcgaagccccttggggcgctattaatgtccagagcacatataaacccaccgtgtccacagccaacatcgctcttagctggtcttccgtggagcaccgcgggaataaggtcctggtgagcggacggtctgagtccattatgaaactcgaagagagaaccggcatcagctgggacctgggggttgaagatgcctctgagagcaagctgcttacggtgtccgtcatggacctcagccagatgtactctcccgtgttcgaatatctgtccggagatcgccaagttgaggagtggcctaaagctacctgcacaggcgactgcccggaacggtgtgggtgcaccagctccacatgtctgcataaggagtggccccactctagaaactggcgctgcaatcctacctggtgttggggagtgggcacggggtgcacatgttgcggcctcgatgtcaaggacctgtttaccgattacatgttcgtgaaatggaaggttgaatacattaaaacagaggccatcgtgtgtgtcgaacttaccagccaggagcggcagtgctccctgatcgaggcgggaaccagatttaacctcggctctgtgacaattacgctgagcgaaccccggaatatccagcaaaagctgcctcccgagattatcacccttcatccgaaaattgaagaggggttctttgacctcatgcacgtgcagaaggtcctgtccgcctctacagtttgtaagctgcagagctgcacccatggagtgcctggcgacctccaggtgtatcacatcgggaacctgcttaaaggagatcgcgtcaatggccacctgatccataagattgaacaacacttcaacacatcctggatgagctgggacgggtgcgatctcgactactattgtaatatgggcgattggccctcttgcacctacacgggagtgacacagcataaccacgcttccttcgttaatctgctgaacatcgagaccgactataccaaaacatttcacttccatagcaagagagtgaccgcccacggcgatacacctcagcttgacctcaaagcccggcccacgtacggggctggagagattaccgtcctggtggaagttgccgatatggagctgcatacaaagaaaatcgaaatttctggcctcaagtttgcggggctgacctgtacaggatgctatgcttgttccagcggcatctcttgcaaggtgagaatccacgtcgaggagcctgacgaacttaccgtgcatgttaaatccgatgaccccgatgtggtcgccgccagctccagcctgatggctcgcaagctcgagttcgggacggactctacctttaaagccttcagcgctatgccgaagacatccctgtgtttttacattgtggaacgggagtactgcaaatcttgtagcaaggaagacacccagaagtgcgtgaatacaaaactggagcaacctcagtccatccttattgagcacaagggcaccatcattggaaaacagaacaacacatgtaccgccaaggcgtcttgctggctggaaagcgtcaaatccttcttttatggcctcaagaatatgcttgggggaatcttcggcaacgtttttattgggatcttcacgtttctcacacccttcatcctgcttattctgttctttatgttcggatggagaatcctcttttgcttcaagtgttgccgcagaacccggggcctgtttaaataccgccacctgaaggatgacgaggaaaccggctatagaaaaattatcgagcggcttaataacaagaaagggaagaatcgcctgctcgatggagaaagactggccgaccggaagattgctgaactcttctctacaaaaacccatatcggc

SEQ ID NO: 13761 - RNA, 3495 nt, synthetic construct
  misc_feature 1..3495: note = derived and/or modified CDS sequence (opt5) from CCHVF(CCHVF Iran-53)__DQ446216.1__Gn-NSm-Gc
  source 1..3495: mol_type = other RNA
agcgaggaatccggcgacgattgcatctctagaacccagctgctccggacagagacggccgaagtgcacggggacaactacggaggccccggggataagattaccatctgtaatggaagcacagtcgttgaccaacgcctgggctccgagcttgggtgctataccattaacagagtgcggtctttcaaactgtgtgaaaatagcgctacaggaaagtcctgcgagatcgattctattcctgtgaaatgtaagcagggctactgcctcaaaatcacccaggagggccgcgggcatgtcaagctgagcagaggatccgaagtggttcttgacgtgtgtgatagctcttgcgaggtcatgatcccgaagggcacaggggacattctggtggattgttccggaggccagcaacactttctcaaagacaacctggttgatctggggtgccccaagatccctctcctgggaaaaatggccatttatatctgtcggatgagcaatcatcccaagaccacgatggcgttcctgttttggttctcttttggctacgtgattacctgcatcctgtgcaaagctattttctttctcctgatcatcttcggcacacttgggaagcgctttaagcagtatagagaactgaaacctcagacctgtacaatttgcgagaccacgcccgtcaacgccatcgacgccgagatgcacgatctcaattgttcctacaacatttgcccttattgtgctagccggctgacatctgacggactggcccgccatgtgacccagtgcccgagacggaaggaaaaagtggaggaaacagagctctacctgaatcttgaacgcatcccctgggtcgttagaaagctgctccaagtgtccgagagcaccggcaccgtgctgaaacggtcctcttggcttattgtcctgctcgtgctgttcacagttagcctgtcccctgtgcagagcgctcccatcgggcacggaaagacgatcgagacctaccgcgtcagagaagagtatacatctatttgtctctttgtgctgggctccatccttttcattgttagctttctgatgaaagggctcgtggacggagtcggcaacatcttcttccctggcctgtctgtgtgcaagacctgtagcattgggtccatcaatggatttgaaatcgagtctcacaagtgctactgtagccttttctgctgcccctattgtcggcattgctccgccgatggcgaaattcaccagctgcatctcagcatctgtaaaaagagaaaaacagggtctaacgtcatgctggcggtgtgcaagcgcatgtgttttcgggccaccatggaggtttccaataaagctctgttcattagaagcatcattaacacgacatttgtggtctgcatcctcattctggccgtgtgtgttgtgtctacctccgctgtcgagatggaaagccttccggccggaacctgggagcgcgaagaggacctgacaaatttctgccaccaggaatgtcaagtgaccgagacagagtgcctctgtccttacgaagcgctggtgctgcggagacccctttttctcgattccatcgttaagggcatgaagaacctgctgaactctacgagcctcgagacctccctgtctatcgaagccccttggggcgctattaatgtccagagcacatataaacccaccgtgtccacagccaacatcgctcttagctggtcttccgtggagcaccgcgggaataaggtcctggtgagcggacggtctgagtccattatgaaactcgaagagagaaccggcatcagctgggacctgggggttgaagatgcctctgagagcaagctgcttacggtgtccgtcatggacctcagccagatgtactctcccgtgttcgaatatctgtccggagatcgccaagttgaggagtggcctaaagctacctgcacaggcgactgcccggaacggtgtgggtgcaccagctccacatgtctgcataaggagtggccccactctagaaactggcgctgcaatcctacctggtgttggggagtgggcacggggtgcacatgttgcggcctcgatgtcaaggacctgtttaccgattacatgttcgtgaaatggaaggttgaatacattaaaacagaggccatcgtgtgtgtcgaacttaccagccaggagcggcagtgctccctgatcgaggcgggaaccagatttaacctcggctctgtgacaattacgctgagcgaaccccggaatatccagcaaaagctgcctcccgagattatcacccttcatccgaaaattgaagaggggttctttgacctcatgcacgtgcagaaggtcctgtccgcctctacagtttgtaagctgcagagctgcacccatggagtgcctggcgacctccaggtgtatcacatcgggaacctgcttaaaggagatcgcgtcaatggccacctgatccataagattgaacaacacttcaacacatcctggatgagctgggacgggtgcgatctcgactactattgtaatatgggcgattggccctcttgcacctacacgggagtgacacagcataaccacgcttccttcgttaatctgctgaacatcgagaccgactataccaaaacatttcacttccatagcaagagagtgaccgcccacggcgatacacctcagcttgacctcaaagcccggcccacgtacggggctggagaggtcaccgtgctggttgaagtggccgatatggagctgcatacaaagaaaattgaaatctctggcctcaagtttgcggggctgacctgtacaggatgctatgcttgttccagcggcatttcttgcaaggtcagaatccacgtggacgagcctgatgagcttaccgttcatgtgaaatccgacgatcccgacgtcgtggccgccagctccagcctgatggctcgcaagctcgagttcgggacggactctacctttaaagccttcagcgctatgccgaagacatccctgtgtttttacatcgtggaacgggaatactgcaaatcttgtagcaaggaggatacccagaagtgcgtcaatacaaaactggaacaacctcagtccattcttatcgagcacaagggcaccattatcggaaaacagaacaacacatgtaccgccaaggcgtcttgctggctggagagcgttaaatccttcttttatggcctcaagaatatgcttgggggaattttcggcaacgtgtttatcgggattttcacgtttctcacacccttcatcctgcttatcctgttctttatgttcggatggcgcattctcttttgcttcaagtgttgcagaagaacccggggcctgtttaaataccgccacctgaaggacgatgaagagaccggctatagaaaaatcattgaacggcttaataacaagaaagggaagaatcgcctgctcgacggagagagactggccgatcggaagatcgctgaactcttctctacaaaaacccatattggc

SEQ ID NO: 13762 - RNA, 3495 nt, synthetic construct
  misc_feature 1..3495: note = derived and/or modified CDS sequence (opt5) from CCHVF(CCHVF Kosova Hoti)__EU037902.1__Gn-NSm-Gc
  source 1..3495: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccagaagggccgcggccatgtgaagctgtccagagggtctgaggtggtccttgatgcctgtgacagcaactgcgaagtgatgattcccaaaggaacgggcgatatcctggttgactgttccgggggacagcaacacttcctcaaggataatctgattgacctgggctgccctcatatccccctcctggggaaaatggcgatttacatctgtcggatgagcaaccaccctaagaccacaatggcttttcttttctggttttctttcggatatgtgattacctgcatcttttgcaaagccctgttctactccctcatcattatcggcacactgggcaagaagattaaacagtatcgcgagcttaagccccagacctgtacgatctgcgaaacagcccctgtcaatgctattgatgccgagatgcatgacctgaactgtagctacaatatctgcccgtattgtgcttctagactcacctccgacgggctggcccggcacgtgaaacagtgccccaagcgcaaagagaaggttgaagagacagaactgtacctcaacctggagagaatcccttgggtggtccggaaacttctgcaagtgagcgaatctaccggagtggcgctcaagcgctccagctggctgattgtccttctggttctcctgaccgtgtccctgtctcccgtgcagagcgcccctgtcggccacgggaagacaatcgagacgtaccagaccagagagggatttacatccatttgtctcttcatgctgggcagcatcctttttattgtgtcttgcctggttaaagggctcgtggattccgtcagcgactctttctttcccggactgagcgtgtgtaagacctgctccatcggctctatcaatggcttcgaaattgagagccataaatgttattgctcccttttctgctgtccgtactgccggcactgtagcgctgatcgcgaaatccatcagctgcacctcaacatttgcaagaaaagaaagacagggtctaatgttatgctggccgtgtgtaagcggatgtgctttagagctaccatcgaggcctcccgccgggcgctgctcattagaagcatcattaacacgacattcgtcatctgtatcctgacccttaccatttgcgtggtctctacatccgccgtggaaatggagaatctgcctgctggaacctgggagcgcgaagaggacctcacaaacttttgtcaccaagaatgccaggttacggagaccgaatgtctgtgcccctatgaggccctggtgcttcggaaacctctcttcctggatagcatcgtcaagggcatgaaaaacctgctcaattccacatctctggagaccagcctttccattgaagctccctggggagccatcaacgtgcagtctacatttaagcccaccgttagcacggccaatattgctctgtcctggagctctgtggagcatagagggaacaaaatcctcgtcaccggccgctccgaaagcatcatgaagctggaggagcggacagggatttcttgggacctgggcgtggaagatgcgtccgagagcaaacttctcaccgtgtctatcatggacctgagccaaatgtactcccctgttttcgaatatctgagcggagatagacaggtcgaggaatggccgaaagccacatgcaccggcgactgtccccagcgctgcgggtgtacgtcttccacatgcctccacaaggagtggcctcatagccggaattggagatgtaaccccacctggtgctggggagtgggcacagggtgtacctgctgtggagtggatgtcaaagacctgtttaccgaccacatgttcgtgaagtggaaagttgagtacattaagacagaagctatcgtgtgcgtcgagcttacgtcccaggaacgccaatgttctctgattgaggccggcacccggtttaatctcgggcctgtgacaatcaccctgagcgaacccagaaacatccagcagaagctgccgcctgagattatcacacttcatcccaaaattgaggaaggcttctttgatctcatgcacgttcagaaggtgctgtccgcctctaccgtctgcaaactgcaaagctgcacgcacggaatccctggcgacctccaggtgtatcatattgggaatctgcttaagggagatcgggttaacggccacctgatccataaaatcgagccccacttcaatacatcctggatgtcttgggacgggtgtgatctcgactactactgcaacatgggagattggcctagctgtacctataccggcgtgacacagcacaatcatgctgcctttgtcaacctgctgaatattgaaaccgactacacaaagacgttccacttccattccaaacgcgtgaccgcgcacggggatacaccccagcttgacctcaaggctagaccgacctatggcgccggagagatcacagtgctggtcgaagttgccgatatggagctgcataccaagaaagtggagattagcggcctcaagtttgcttctctggcctgcacggggtgttacgcttgctccagcggaatctcttgtaaagtgcggattcacgtcgacgaacctgatgagcttaccgtgcacgttaagtccagcgaccccgacgtggtcgccgcgggcacatctctgatggccagaaaactcgaatttgggaccgattccacatttaaggctttcagcgccatgcccaagacctccctgtgcttttatatcgtggagaaagagtactgtaagagctgctctgaagacgatacaaagaagtgtgttgacaccaaactggagcaacctcagagcattcttatcgaacatcgcggaacgatcattggcaagcagaacgatacatgcaccgctaaggcctcctgctggctggagtctgtgaaatccttcttttatgggctcaagaacatgctgggcagcgtcttcggaaatttcttcatcggcattctcctgtttcttgcgccgttcgtgctgctcgttctgtttttcatgttcgggtggaaaatcctgttttgtttcaagtgctgtcggagaacccgcggactttttaaatacagacacctgaaggacgatgaagagacaggctaccggcgcattatcgagagactcaacaataagaaagggaagaaccggctgctcgacggagaacgcctggccgatagaaaaatcgctgagcttttctctaccaagacgcatattggc

SEQ ID NO: 13763 - RNA, 3495 nt, synthetic construct
  misc_feature 1..3495: note = derived and/or modified CDS sequence (opt5) from CCHVF(CCHVF YL04057)__FJ562094.1__Gn-NSm-Gc
  source 1..3495: mol_type = other RNA
gccgagggcgggagctccgactgcatctctagaacccagctggtgaagacagaagtcgctgagattcacgaagatagctacggaggccccggggagaaaatcacgatttgtaacggatccaccatcgttgaccaacggctcggccgcgaactggggtgctatacaattaatagagtgcggtcttacaagctgtgtgagaacagcgcctccggaaaatcttgcgagatcgatagcatccctgtgaagtgtaaacagggcttctgcctgaagattacccaggaaggccgcgggcatgtcaagctctccagaggaacagagatcgtgctggacgtttgtgatagctcttgcgaacttatgattccgaaaggcaccggggacatcctggtggattgttccggaggccagcaacactttctccagaataacctgattgacctggggtgccccaatgtccctctcctgggaaagatggcgatctatgtgtgtcggatgagcaaccatcccaaaacaaccatggctttccttttctggttctcttttggctacgttattacgtgcatcgcctgccgcgtgctgttctatctcctgatcgccattggcaccgtcgggaagaaacttaagcagtacagagagctgaagcctcagacatgtatcgtgtgcgagtccgtgcccgtcaatgctattgatgccgaaatgcacgagctcaactgtagctataatatctgcccttactgtgcttctcggctgtccaccgacggactgattcgccatgttacacaatgcccgaaaagacgggaaaaggtggaggaaaccgagctctttctgaaccttgagcgcatcccctggctggtgagaaaactcctgcaggtcagcgaatccacgggcatggcccttaagcggtcttgttggatgatcacactgctcattctgctgctcgtgagcatctcccctgttcagagcgcgcccgtggggaaagagcgcgccattgaaacctaccaggctagagagacatataccggaatctgcctgttcgtccttggctctgtgctgtttgccgtttcctggctcaccaaggctctgattgatgggatcggaaatagcttctttcctggcctttctgtgtgtaaaacatgcagcatcggctccattaacgggttcgaaatcgagtctcacaagtgttactgcagcctgttttgctgtccctattgccgggcctgttccagcgacaagaatacgcacagaatgcatctcaacgtctgcaaaaagcgcaaaatgggatctaatgtgatgctggcggtctgtaagcggatgtgcttcagagccaccattgaggcttccaacaaagccctgctcatccgcagcattatcaactctacattcgtgatttgtatcctgatccttaccatttgcgttgtgtccacaagcgctgtcgatatggaaaatctgccggccggcatctgggagaaggaagaggacctcaccaacttttgtcaccaagaatgccaggtgacggagacagagtgtctgtgcccttacgaagccatggttctgcggaagccccttttcctcgactccattgctaaagggaagaaatctctgctgaatagcacctccctcgagacctctctgagcatcgaagcgccttggggagccattaacgtgcagtccacatttaagcccaccgtcagcgctgccaatatcgccctttcttggtccagcgtggagcatagaggcaacaaaatcctggtgtctgggcgctccgagagcattatgaagctcgaggaacggacaggcgtttcttggaatctgggagtcgaagatgctagcgagtccaagacgctgaccgtgagcgtgatggacctttctcaaatgtattcccccgtcttcgaatacctcagcggcgatagacaggtggaggagtggcctaaagccacatgcaccggggactgtccggaacgctgcggatgtacatcctctacctgcctgcacaaggagtggccccacagccggaactggagatgttcccctacgtggtgctggggcgttgggaccggatgtacatgctgtggcctggatgtgaaagactttttcaccgattatatgctcgtcaagtggaaagtggaatacatcaagacagaggcgattgtttgcgtggaactgacctctcaggagcgccagtgtagccttatcgaggctgggacgcggtttaatctgggccccgtcacaattaccctctccgaacctagaaacgtgcaacagcggctgcccccggagatcgttacactgcatcctaagatcgaagagggattctttgaccttatgcacgtgcagaaaattctctctgccagcaccgtctgcaagctgcagtcctgcacccatggcgtgcccggggatttccaagtgtaccacgtcggaaatctgctccgcggcgacaaagttaacgggcatagcatccacaagattgaacctcactttaatacatcttggatgtcctgggatggatgtgacctggactatttctgcaacatgggcgattggcccagctgtacgtacaccggggtgacacagcataatagagccgcttttatcaacatgcttaacattgagaccgactatacaaaaaccttccacttccattctaagcgggtgacggcccacggcgatacacctcagctggacctcaaagctagacccgcctacggagcgggcgaggtcaccgtgctggttgaagtggccgatctggagcttcacaccaagaagctcgaagtctccgggctgaaaatcgctagcctgacatgctctggatgttatgcctgctccagcggcatctcctgtaaggtgcgcattcatgttaatgagccggacgagtttaccgtgcacgtccggagctctgatcctgacgtggttgctgccgggagctccctcatggcgagaaaaatcgaatttggagccgattctacatttaaggctttcagctccatgcccaaagactctctgtgcttttacattgtggagaaggattattgtagctcctgcacggacgatgacacccagaagtgtgtcaacacaaaacttgaccatccccaatctatcctgattgaacacaagggcaccatcattgggaaacagaatgatacatgcagcaccaagacgtcctgctggctcgagagcgtgaaaggcttcttttacggactgaagaacatgctgtctggcatcttcgggaatgtgtttcttggaatccttctcttcctggccccttttgtcctcctgattttctttttcttctttggctggcgccttctgttctgtctcaagtgctgtagacggacccgcgggctgctgaaatacaagcatcttaaagacgaagaggaggctggatataagaaaatcattgaaagactgaacggcaagaagggcaaatcccagctctttgatggggagcggctggccgaccgcaagatcgccgaactcttcagcacaaaaattcacatcgga

SEQ ID NO: 13764 - RNA, 3495 nt, synthetic construct
  misc_feature 1..3495: note = derived and/or modified CDS sequence (opt5) from CCHVF(CCHVF V42/81)__GU477490.1__Gn-NSm-Gc
  source 1..3495: mol_type = other RNA
agcaaggagcccggcgacgattgcatctccagaacccagctgatgcggacagaaacggccgagattcacgacgataactacgggggacctggcgacaaaatcaccatttgtaatgggtctacaatcgtggatcaacgcctcggaagcgaactgggctgctataccattaacagagtcaagtccttcaaactttgtgaaaattctgctacagggaaggcctgcgaggttgacagcaccccggtgaaatgtcggcagggattttgcctgaagatcacacaggagggccgcggccatgtgaagctctccagagggtctgaggtcgtgctggatgcgtgtgacagctcctgcgaagttatgatccccaaaggaaccggcgatattcttgtggactgtagcgggggacagcaacacttcctgaaggataacctcatcgacctggagtgccctcatattcccctgctcggcaaactggctatctacatttgtcggatgtctaatcaccctcgcacgaccatggcctttcttttctggtttgggttcggatatgtcatcacatgcattctgtgcaaggccctcttttactccctgatcatcattggcacccttggcaaaaagatcaagcagtatagagaactgaaaccccagacatgtaccatttgcgagacggctcctgtgaacgccatcgatgctgagatgcatgacctcaattgtagctacaacatttgcccgtattgtgcctctcggctgacatccgacgggctggcgcgccacgttacccagtgccccaagagaaaagaaaaggtggaggaaacagagctctacctgaatcttgaacggatcccttggatcgtccgcaaactgctccaagtgagcgagtctaccggagtggtcctgaagagatccagctggcttattgttctgctcgtgctgctgaccgtgtccctctctcccgtccagagcgcccctgtgggccacgggaaaacaatcgagacgtaccagacccgggaaggattcacatccatttgtctgtttatgcttggcagcatcctgttcattgtttcttgcatcgtgaaggggctcgtcgattccgtgagcgacagctttttccccggactgtctgtttgtaagacctgctccatctctagcattaacggctttgagatcgaatcccataaatgttattgcagccttttctgctgtccgtactgccgccactgttctgctgatagagagattcatcagctgcacctctccatctgccggaagagacgcacaggcagcaatgtgatgctggccgtctgtaaacggatgtgcttcagagctaccattgaagtgtctcgccgggccctgctcatcagatccattatcaacacgacatttgtcatctgtattctgacccttaccatctgcgtggttagcacatccgcggtggagatggagaatctgcctgccgggacctgggaacgcgaggaagacctcacaaacttctgtcaccaagagtgccaggtcacggaaaccgagtgtctgtgcccctatgaggctctggtgcttcggaagcctctctttctggattctattgttaaaggaaagaagaatctgctcaacagcacatccctggaaacctctcttagcatcgaggccccctggggcgctattaacatccagtccacattcaaacccaccgtgagcgccgccaatatcgctctgtcttggtccagcgtcgaacatagagggaacaagattctcgtgtctggacgctccgagagcatcatgaaactggaggaacggacgggcgtgtcttggaatctgggggttgaggacgcgagcgaatccaaacttctcaccgtcagcattatggatctgtctcaaatgtactcccctgtgtttgagtatctgagcggcgacagacaggtggaagagtggccgaaggccacatgcaccggagattgtcccgagcgctgcggctgtacatcctctacctgcctccacaaggaatggcctcatagccggaactggagatgtaatcccacgtggtgctggggagtcggaacaggctgtacctgctgtggggtggacgttaaggatctgttcatcgaccacatgtttgtgaaatggaaggtcgagtacattaaaacagaagctatcgtgtgcgttgagcttacctcccaggaacggcagtgttctctgatcgaggccggaacccgcttcaacctcggccctgtgacaattacgctgagcgagcccagaaatatccaacagaagctgccgcctgaaattatcacccttcatcccaaaattgaggaagggtttttcgacctcatgcacgtccagaaggtgctgtccgcctctacagtttgcaagctgcagagctgcacccacggcatccctggagatctccaagtgtatcatatcggcaacctgcttaaaggggaccgggtcaatggacacctgattcataagatcgagccccactttaacacatcctggatgagctgggatggctgtgacctcgattactactgcaatatgggggactggccttcttgtacctatacgggagtgacacagcacaaccatgctgccttcgtgaatctgctgaacattgaaaccgattacaccaaaacatttcacttccattccaagagagtcaccgcgcacggcgagacaccccagcttgacctcaaagctcgcccggcctatggggccggcgagatcacggttctggtggaagtggctgatatggagctgcataccaagaaagtcgaaattagcggactcaagttcgcctctctggcttgcacaggctgttacgcctgctccagcgggatctcttgtaaggtgcggattcacgttgacgagcctgatgagcttaccgtgcacgtcaaatccaatgaccccgatgtggttgcggccagcacatccctgatggctagaaagctcgaaagcggaaccgactctacgtttaaagccttcagcgctatgcccaagacctccctgtgcttttatatcgtggagcgcgaatactgtaaatcttgcagcgaggacgatacacagaagtgtgtcgaaaccaagctggagcaacctcagtccatccttattgagcataaaggcacaatcattgggaagcagaacgatacctgcacagccaaagcgtcttgctggctggaaagcgtgaagtccttcttttatggactcaaaaacatgctgggctctgttttcgggaactttttcatcggcattctcctgtttcttgccccgttcgtgctgctcgtcctgtttttcatgtttggatggaagatcctgttctgtttcaagtgctgtagacggacccgcggcctttttaaatacagacacctgaaggaggacgaagagacggggtaccggcgcatcattgaaagactcaatagcaaaaaggggaaaaatcggctgctcgacggcgagcgcctggctgatagaaagatcgccgagcttttctccacaaagacccatattggg

SEQ ID NO: 13765 - RNA, 3495 nt, synthetic construct
  misc_feature 1..3495: note = derived and/or modified CDS sequence (opt5) from CCHVF(CCHVF 79121M18)__GU477493.1__Gn-NSm-Gc
  source 1..3495: mol_type = other RNA
gccgagggcgggagctccgactgcatctctagaacccagctggtgaagacagaagtcgctgagattcacgaagatagctacggaggccccggggagaaaatcacgatttgtaacggatccaccatcgttgaccaaggcctcgggtctgaactgggatgctatacaattaatcgggtgcgcagctacaaactttgtgagaactccgcctctggcaaaagctgcgagatcgattccatccctgtgaagtgtaaacagggcttctgcctgaagattacccaggaagggagaggacatgtcaagctcagccggggcacagagatcgtgctggacgtttgtgattcttcctgcgaacttatgattccgaaagggaccggagacatcctggtggattgtagcggcgggcagcaacactttctccagaataacctgattgacctgggatgccccaatgtccctctcctgggcaagatggcgatctatgtgtgtcgcatgtctaaccatcccaaaacaaccatggctttcctgttttggttctcctttggctacgttattacgtgcatcgcctgcagagtgctgttctatctcctgatcgccattgggaccgtcggaaagaaacttaagcagtaccgggagctgaagcctcagacatgtatcgtgtgcgagagcgtgcccgtcaatgctattgatgccgaaatgcacgagctcaactgttcttataatatctgcccttactgtgcttcccgcctgagcaccgacggcctgattagacatgttacacaatgcccgaaacggcgcgaaaaggtggaggaaaccgagctctttctgaaccttgagagaatcccctggctggtgcggaaactcctgcaggtctccgaatctacggggatggcccttaagcgcagctgttggatgatcacactgctcattctgctgctcgtgtccatcagccctgttcagtctgcgcccgtgggaaaagagagagccattgaaacctaccaggctcgggagacatataccggcatctgcctgttcgtccttgggtccgtgctgtttgccgttagctggctcaccaaggctctgattgatggaatcggcaattctttcagccctggcctttccgtgtgtaaaacatgctctatcgggagcattaacggatttgaaatcgagtcccacaagtgttactgcagcctgttctgctgtccctattgccgcgcctgttcttccgacaagaatacgcacagaatgcatctcaacgtctgcaaaaagcggaaaatgggcagcaatgtgatgctggcggtctgtaagagaatgtgctttcgcgccaccattgaggcttctaacaaagccctgctcatccggtccattatcaacagcacattcgtgatttgtatcctgatccttaccatttgcgttgtgtccacatctgctgtcgatatggaaaatctgccggccgggatctgggagaaggaagaggacctcaccaacttctgtcaccaagaatgccaggtgacggagacagagtgtctgtgcccttacgaagccatggttctgagaaagcccctttttctcgacagcaccgctaaaggaatgaagtccctgcttaattctaccagcctcgagacatccctgagcattgaagcgccttggggcgccatcaacgtgcagtctaccttcaaacccacagtctccgctgccaatattgcccttagctggtcttccgtggagcatcgcgggaacaagatcctggtgagcggccggtctgagagcatcatgaaactcgaagagagaacgggagtttcctggaatctgggcgtcgaagatgctagcgagtctaagaccctgacagtgtccgtgatggaccttagccaaatgtattcccccgtctttgaatacctctctggggatcgccaggtggaggagtggcctaaggcgacctgcacaggagactgtccggaacggtgcggctgtaccagctccacgtgcctgcacaaagagtggccccactctagaaactggcgctgtaatcctacctggtgctggggagttgggacaggctgtacctgctgtgggctggatgtgaaggacttctttacagattatatgctcgtcaaatggaaggtggaatacattaaaaccgaggccatcgtttgcgtggaactgacgagccaggagcggcagtgttcccttattgaggctggcacaagattcaacctgggacccgtcaccatcacactctctgaacctcgcaatgtgcaacagcggctgcccccggagattgttaccctgcatcctaagatcgaagagggctttttcgaccttatgcacgtgcagaagatcctcagcgcctccaccgtctgcaaactgcagagctgcacacatggggtgcccggagattttcaaatttaccacgtgggcaacctgctcagaggggacaaggtcaatggacattctatccacaaaattgaacctcacttcaacacgtcctggatgagctgggatggctgtgacctggactatttttgcaatatgggggattggccctcttgtacctacacaggcgttacccagcataaccgggccgctttcatcaacatgcttaatattgagacagactataccaagacgtttcacttccattccaaacgcgtgacagcccacggagatacccctcagctggacctcaaggctagacccgcctacggcgcgggggaggtgaccgtcctggtggaagttgccgatctggagcttcacacaaagaagctcgaagtgagcggactgaagatcgcttctctgacctgctccggctgttatgcctgcagctccgggatcagctgtaaagtccggattcatgtgaacgagccggacgagttcacagttcacgtgagatctagcgatcctgacgtcgtggctgccggatcctctctcatggcgcgcaagatcgaatttggcgccgatagcacgttcaaggctttttcctctatgcccaaggacagcctgtgcttctacattgttgagaaagattattgttcctcttgcaccgacgatgacacacagaagtgtgtgaataccaaacttgaccatccccaaagcatcctgattgaacacaaagggacaatcattggcaagcagaacgatacctgctccacgaaaaccagctgctggctcgagtctgtcaagggatttttctacggcctgaaaaatatgctgtccgggatctttggaaacgtgttccttggcatctttctgttcctcgccccttttgtgctgctcattttctttttcttctttgggtggcggctgcttttctgtctgaagtgctgtagacgcacaagaggactcctgaagtacaaacatctgaaggacgaagaggaggctggctataaaaagatcattgaacggcttaatggcaaaaagggaaagagccagctgtttgatggggagcgcctcgccgacagaaaaatcgccgaactgttctctaccaagattcacatcggc

SEQ ID NO: 13766 - RNA, 3495 nt, synthetic construct
  misc_feature 1..3495: note = derived and/or modified CDS sequence (opt5) from CCHVF(CCHVF Afg09-2990)__HM452306.1__Gn-NSm-Gc
  source 1..3495: mol_type = other RNA
agcgaggaatccggcgacgattgcatctctagaacccagctgctccggacagagacggccgaagtgcacggggacaactacggaggccccggggataagattaccatctgtaatggaagcacagtcgttgaccaacgcctgggctccgagcttgggtgctataccattaacagagtgcggtctttcaaactgtgtgaaaatagcgctacaggaaagtcctgcgagatcgattctattcctgtgaaatgtaagcagggctactgcctcaaaatcacccaggagggccgcgggcatgtcaagctgagcagaggatccgaagtggttcttgacgtgtgtgatagctcttgcgaggtcatgatcccgaagggcacaggggacattctggtggattgttccggaggccagcaacactatctcaaagacaacctggttgatctggggtgccccaagatccctctcctgggaaaaatggccatttacatctgtcggatgagcaatcatcccaagaccacgatggcgtttcttttctggttttctttcggctatgtgattacctgcatcctgtgcaaagctatctttttcctcctgattatctttggcacacttgggaagcgcttcaagcagtacagagaactgaaacctcagacctgtacaatttgcgagaccacgcccgtcaacgccatcgacgccgagatgcacgatctcaattgttcctataacatttgcccttactgtgctagccggctgacatctgacggactggcccgccatgtgacccagtgcccgagacggaaggaaaaagtggaggaaacagagctctacctgaatcttgaacgcatcccctgggtcgttagaaagctgctccaagtgtccgagagcaccggcaccgtgctgaaacggtcctcttggcttattgtcctgctcgtgctgtttacagttagcctgtcccctgtgcagagcgctcccatcgggcacggaaagacgatcgagacctatcgcgtcagagaagagtacacatctatttgtctcttcgtgctgggctccatcctttttattgttagcttcctgatgaaagggctcgtggacggagtcggcaacatctttttccctggcctgtctgtgtgcaagacctgtagcattgggtccatcaatggattcgaaatcgagtctcacaagtgctattgtagcctgttttgctgcccctactgtcggcattgctccgccgatggcgaaattcaccagctgcatctcagcatctgtaaaaagagaaaaacagggtctaacgtcatgctggcggtgtgcaagcgcatgtgtttccgggccaccatggaggtttccaataaagctctgtttattagaagcatcattaacacgacattcgtggtctgcatcctcattctggccgtgtgtgttgtgtctacctccgctgtcgagatggaaagccttccggccggaacctgggagcgcgaagaggacctgacaaatttttgccaccaggaatgtcaagtgaccgagacagagtgcctctgtccttatgaagcgctggtgctgcggagaccccttttcctcgattccatcgttaagggcatgaagaacctgctgaactctacgagcctcgagacctccctgtctatcgaagccccttggggcgctattaatgtccagagcacatacaaacccaccgtgtccacagccaacatcgctcttagctggtcttccgtggagcaccgcgggaataaggtcctggtgagcggacggtctgagtccattatgaaactcgaagagagaaccggcatcagctgggacctgggggttgaagatgcctctgagagcaagctgcttacggtgtccgtcatggacctcagccagatgtattctcccgtgtttgaatacctgtccggagatcgccaagttgaggagtggcctaaagctacctgcacaggcgactgcccggaacggtgtgggtgcaccagctccacatgtctgcataaggagtggccccactctagaaactggcgctgcaatcctacctggtgttggggagtgggcacggggtgcacatgttgcggcctcgatgtcaaggacctgttcaccgattacatgtttgtgaaatggaaggttgaatatattaaaacagaggccatcgtgtgtgtcgaacttaccagccaggagcggcagtgctccctgatcgaggcgggaaccagattcaacctcggctctgtgacaattacgctgagcgaaccccggaatatccagcaaaagctgcctcccgagattatcacccttcatccgaaaattgaagaggggtttttcgacctcatgcacgtgcagaaggtcctgtccgcctctacagtttgtaagctgcagagctgcacccatggagtgcctggcgacctccaggtgtaccacatcgggaacctgcttaaaggagatcgcgtcaatggccacctgatccataagattgaacaacactttaacacatcctggatgagctgggacgggtgcgatctcgactattactgtaatatgggcgattggccctcttgcacctatacgggagtgacacagcataaccacgcttccttcgttaatctgctgaacatcgagaccgactacaccaaaacattccactttcatagcaagagagtgaccgcccacggcgatacacctcagcttgacctcaaagcccggcccacgtatggggctggagagattaccgtcctggtggaagttgccgatatggagctgcatacaaagaaaatcgaaatttctggcctcaagttcgcggggctgacctgtacaggatgctacgcttgttccagcggcatctcttgcaaggtgagaatccacgtcgacgagcctgatgagcttaccgtgcatgttaaatccgacgatcccgacgtggtcgccgccagctccagcctgatggctcgcaagctcgaatttgggacggactctaccttcaaagcctttagcgctatgccgaagacatccctgtgtttctacattgtggagcgggaatattgcaaatcttgtagcaaggaggatacccagaagtgcgtgaatacaaaactggaacaacctcagtccatccttattgagcacaagggcaccatcattggaaaacagaacaacacatgtaccgccaaggcgtcttgctggctggagagcgtcaaatcctttttctacggcctcaagaatatgcttgggggaatctttggcaacgttttcattgggatctttacgttcctcacaccctttatcctgcttattctgttcttcatgtttggatggagaatcctcttctgctttaagtgttgccgcagaacccggggcctgttcaaatatcgccacctgaaggacgatgaagagaccggctacagaaaaattatcgaacggcttaataacaagaaagggaagaatcgcctgctcgacggagagagactggccgatcggaagattgctgaactcttttctacaaaaacccatatcggc

SEQ ID NO: 13767 - RNA, 3495 nt, synthetic construct
  misc_feature 1..3495: note = derived and/or modified CDS sequence (opt5) from CCHVF(CCHVF Sudan Al-Fulah 3-2008)__HQ378184.1__Gn-NSm-Gc
  source 1..3495: mol_type = other RNA
agcgaggaaccctccgacgattgcatctctagaacccagctgctccggacagagacggccgaaattcacggcgacaactacgggggacctggcgataagatcaccatttgtaatgggagcacaatcgtggaccaacgcctgggatccgagcttggctgctataccattaacagagtcaaatctttcaagctgtgtgaaaatagcgctacagggaaatcctgcgttatcgattctgtgccggtgaagtgtcggcagggatactgcctccgcatcacccaggagggcagaggccatgtcaaactgagccgggggtccgaggtggttcttgacgcctgtgatacaagctgcgaaattatgatccccaagggaaccggcgacattctggtggattgttctgggggacagcaacactttctcaaggacaacctggtcgatctgggctgccctaaaatccccctcctggggaagatggcgatttatatctgtcgcatgtccaatcatcctaaaacgaccatggctttcctgttttggttcagctttggatacgtgattacatgcatcctttgcaaggccatcttctatctcctgattatcattggcacccttggcaaaagatttcggcagtaccgcgagctgaagccccagacatgtaccatctgcgaaacgacacctgttaacgccattgacgctgagatgcacgatctcaattgttcttataacatctgcccgtactgtgcctccagactgaccagcgacgggctggctcggcatgtgacacagtgccccaagcgcaaagagaaggtcgaagagaccgaactctacctgaatcttgagagaatcccttgggtggtgcggaaactgctccaagtctctgaatccaccggagttgccctgaagcgcagctcctggcttattgtgctgctcgtgctgttcacagtctctctgagccccgtgcagtccgcgcctatcggccacgggaaaacgattgaggcctatagagctcgggagggatacaccagcatctgtctctttgttctgggctctattcttttcatcgtgtcctgcctgatgaaggggctcgtcgacagcgtgggaaacagctttttccccggcctgtctatctgtaaaacatgctccatttctagcatcaatggctttgaaattgagtcccacaagtgttattgcagccttttctgctgtccgtactgcagacattgttctgccgataaggaaatccacaaactgcatctctccatttgcaagaaacgcaagaccgggagcaacgttatgctggctgtgtgtaaacggatgtgcttcagagccacaatggaggtctctaatcgcgcgctgtttatccggtccattatcaacaccacgttcgtgctctgtatcctgattcttgccgtctgcgtggttagcacatccgctgtggaaatggagaatctgcctgccggaacctgggagagagaagaggacctcaccaacttttgtcaccaggaatgccaggtcacagagaccgaatgtctgtgcccctatgaggctctggtgcttcgccggcctctcttcctggattctatcgttaagggcatgaagaacctgctcaatagcacatccctggagacgtctcttagcattgaagccccctggggagccatcaacgtgcaatccacctacaaacccacagtcagcaccgctaatattgcgctgtcttggtccagcgtggagcacagagggaacaagatcctcgtgtctggccgctccgaaagcatcatgaaactggaggagcggacagggatttcttgggacctgggcgttgaagatgccagcgagtccaaacttctcaccgtcagcgtgatggacctgtctcagatgtattcccctgtgtttgaatacctgagcggagatagacaggtcgaggaatggccgaaggctacgtgcaccggcgactgtcccgagcgctgcgggtgtacatcctctacctgcctccataaggagtggcctcacagccggaattggagatgtaaccccacatggtgctggggagtgggcaccgggtgtacgtgctgtggactggatgttaaggaccttttcacagattacatgtttgtgaaatggaaggtcgaatatatcaaaaccgaggccattgtgtgcgttgaactgacatcccaagagcggcagtgttctctcatcgaagccggcacccgcttcaatctggggcctgtgaccattacactgagcgagcccagaaacatccagcagaaacttccgcctgagatcattacgctccatccccggatcgaagagggctttttcgacctgatgcacgtccaaaaggtgctgtccgcttctaccgtttgcaagctccagagctgcacacatggagtgcctggcgacctgcaggtctaccacattgggaatcttctgaagggagataaagtgaacggccacctcatccataagattgaaccccactttaatacctcctggatgagctgggacgggtgtgatctggactattactgcaacatgggagattggccttcttgtacatataccggcgtgacgcagcataatcacgcctccttcgtcaacctgcttaatatcgagacagactacaccaaaaactttcacttccatagcaagagagttaccgcgcacggggatacaccccaactcgacctgaaagctcgcccgacctatggcgccggagaaatcacagtgctggtggaggtcgccgatatggagctccatacgaagaaaattgaaatctctggcctgaagttcgcttcccttacctgcacagggtgttacgcctgcagctctggaatttcctgtaaggtgcggatccacgttgacgagcctgatgaactgaccgtgcatgtcaaaagcgacgatcccgacgtggttgctgcctccagctctctcatggcgagaaagctggagtttggcacagacagcaccttcaaagccttttccgctatgcccaagacgtctctgtgcttctacattgtggagaaagaatattgtaagagctgctccgaggaagataccaagaaatgtgtcaacacaaaacttgagcagcctcagtctatcctgattgaacacaaggggaccatcatcggaaagcagaatagcacatgcaccgccaaagtgtcctgctggctcgagtctgctaagagctttttctacggcctgaaggacatgctctccgggatttttggcaacgttttcatcggaatttttctgttccttgccccgtttgtgctgctcgtcctgttctttatgttcggctggcgcatcctgctttgtttcagatgctgtcggcgcacaagagggctgtttaaatatcggcacctcaaggatgacgaggaaaccggataccgcagaattatcgagcggctgaataacaaaaagggcaaaaataagctcctggatggggaacgccttgcggacagaaagatcgccgagctgttcagcacgaaaacacatattgga

SEQ ID NO: 13768 - RNA, 3495 nt, synthetic construct
  misc_feature 1..3495: note = derived and/or modified CDS sequence (opt5) from CCHVF(CCHVF Sudan AB1-2009)__HQ378187.1__Gn-NSm-Gc
  source 1..3495: mol_type = other RNA
agcgaggaaccctccgacgattgcatctctagaacccagctgctccggacagagacggccgaaattcacggcgacaactacgggggacctggcgataagatcaccatttgtaatgggagcacaatcgtggaccaacgcctgggatccgagcttggctgctataccattaacagagtcaaatctttcaagctgtgtgaaaatagcgctacagggaaaaactgcgagatcgattccgttccggtgaagtgtcggcagggatactgcctccgcatcacccaggagggcagaggccatgtgaaactgtctcgggggagcgaagtcgtgcttgacgcctgtgatacatcctgcgagattatgatccccaagggaaccggcgacattctggttgattgtagcgggggacagcaacactttctcaaggacaatctgatcgatctgggctgccctaaaattcccctcctggggaagatggcgatctatatttgtcgcatgtctaaccatcctaaaacgaccatggctttcctcttttggttctcctttggatacctgatcacatgcatcctctgcaaggccattttctatctgcttatcattatcggcaccctgggcaaaagactcaagcagtaccgggaactgaagccccagacatgtaccatttgcgagacgacacctgtgaatgccatcgacgctgagatgcacgatctgaactgtagctataatatctgcccgtactgtgcctctcgcctcacctccgacgggctggctagacatgtcattcagtgccccaaacggaaggaaaaagtggaggaaacagagctttacctgaacctcgaacgcatcccttgggttgtgagaaagctgcttcaagtcagcgagtctaccggagtggccctgaaacggtccagctggctcattgtgctgctggtcctctttaccgtttccctgtctcccgtgcagagcgcgcctatcggccaggggaagacaattgaggcctatcgcgctagagaaggatacacgtccatctgtcttttcgtgctgggcagcatcctctttattgtctcttgcctgatgaaagggcttgtggactccgttggaaatagcttctttcccggcctgtctatctgtaagacctgcagcatttcctctatcaacggcttcgagattgaaagccacaagtgttattgctccctcttttgctgtccgtactgccggcactgtagcacagataaagagatccataagctgcacctgtctatttgcaaaaagagaaaaaccgggtccaatgtgatgctcgccgtctgtaagcgcatgtgcttccgggctacaatggaagtgagcaacagagccctgttcatccgctctatcattaataccacgtttgttctttgtatcctgattctcgcggtgtgcgtcgtgtccacaagcgccgtcgagatggagaacctgcctgctggaacctgggaacgggaggaagacctgaccaacttctgtcatcaggagtgccaagtgacagaaaccgagtgtctttgcccctatgaggccctcgttctgagaaagcctctgtttctcgattccatcgctaaaggcatgaagaatctgcttaactctacaagcctggaaacgtccctctctattgaggccccctggggagccatcaatgtgcagagcacctacaaacccacagtctccaccgctaacatcgcgctgagctggtcttccgtggaacaccgcgggaataagattctggttagcggccggtctgagtccatcatgaaacttgaggaaagaacagggattagctgggacctcggcgtggaggatgcctctgaaagcaagctgctgaccgtctccgtgatggacctcagccagatgtattctcctgtgttcgagtacctgtccggagatcgccaagttgaagagtggccgaaggctacgtgcaccggcgactgtcccgagcggtgcgggtgtacaagctctacctgccttcacaaagaatggcctcattccagaaactggcgctgtaatcccacatggtgctggggagtcggcaccgggtgtacgtgctgtggactggatgtgaaggacctctttacagattacatgttcgtgaaatggaaggtcgagtatatcaaaaccgaagccattgtgtgcgttgagctgacaagccaggaacggcagtgttccctgatcgaggccggcaccagatttaaccttgggcctgtgaccatcacactctctgagccccggaatattcagcaaaagctgccgcctgaaatcattacgctgcacccccgcatcgaggaaggcttctttgacctcatgcatgtccagaaggtgctgagcgcttccaccgtttgcaaacttcagtcttgcacacacggagtgcctggcgacctgcaggtctaccatattgggaacctcctgaagggagataaagtgaatggccacctgatccacaagatcgagccccatttcaacaccagctggatgtcctgggacgggtgtgatcttgactattactgcaatatgggagattggcctagctgtacatataccggcgttacgcaacacaaccatgcctcttttgtgaatctcctgaacattgaaacagactacaccaaaaacttccactttcactccaagagagtcaccgcgcatggggatacaccccagctggacctcaaagctcggccgacctatggcgccggagagatcacagtgctggtggaggtcgccgatatggaacttcacacgaagaagattgagatcagcggcctgaaattcgcttctcttacctgcacagggtgttacgcctgctccagcggaatttcttgtaaggttagaatccatgtggacgaacctgatgagctgaccgtgcacgtcaaatccgacgatcccgacgtggttgctgccagctccagcctgatggcgcgcaaacttgagttcggcacagactctacctttaaggccttcagcgctatgcccaagacgtccctgtgcttttacattgtggaacgggagcattgtaagtcttgcaatgaagaggataccaaaaagtgtgtcaacacaaaactcgaacagcctcagagcatcctgatcgagcacaaggggaccattatcggaaaacaaaattccacatgcaccgccagagcttcttgctggctcgagagcgtgaagtccttcttttatggcctgaagaacatgctttctgggattttcggcaatgtttttatgggaatcttcctgtttctcgccccgttcattctgctgatcctgtttttcatgtttggctggcgcatccttttctgtttcaaatgctgtagacggacacgcgggctctttaagtacagacacctgaaagacgatgaagagaccggatatcggcgcattatcgaaagactcaacaataagaaaggcaagaacaagctgcttgacggggagcggctggcggatcgcagaattgccgaactcttcagcacgaaaacacatatcgga

SEQ ID NO: 13769 - RNA, 3495 nt, synthetic construct
  misc_feature 1..3495: note = derived and/or modified CDS sequence (opt5) from CCHVF(CCHVF NIVA 118595)__JN572083.1__Gn-NSm-Gc
  source 1..3495: mol_type = other RNA
agcgaggaatccggcgacgattgcatctctagaacccagctgctccggacagagacggccgaagtgcacggggacaactacggaggccccggggataagattaccatctgtaatggaagcacagtcgttgaccaacgcctgggctccgagcttgggtgctataccattaacagagtgaaatctttcaagctgtgtgaaaatagcgctacaggaaaatcctgcgagatcgattctattcctgtgaagtgtcggcagggctactgcctcaaaatcacccaggagggccgcgggcatgtcaagctgagcagaggatccgaagtggttcttgacgcctgtgatagctcttgcgaggtgatgatcccgaagggcacaggggacattctggtcgattgttccggaggccagcaacactttctcaaagacaacctgatcgatctggggtgccccaagattcctctcctgggaaaaatggcgatctatatttgtcggatgagcaatcatcccaagaccacgatggctttcctgttttggttctcttttggctacgtgattacctgcatcctttgcaaagttatcttctatctcctgatcatttttggcacacttgggaagcgcttcaagcagtacagagaactgaaacctcagacctgtacaatctgcgagaccacgcccgtgaacgccattgacgccgagatgcacgatctcaattgttcctataacatctgcccttactgtgctagccggctgacatctgacggactggcccgccatgtcacccagtgcccgaagagaaaagaaaaggtggaggaaacagagctctacctgaatcttgaacggattccctgggtggtccgcaaactgctccaagtttccgagagcaccggcatcgctctgaagagatcctcttggcttatcgtgctgctcgtgctgtttaccgtcagcattacacctgtgcagtccgcccccatcgggcacggaaaaacgattgaggcgtatcgggcccgcgaagagtacaccagcatctgtctgttcgttctcggctctgtgctgtttgtcgtgtcctgccttatgaaggggctggttgacagcgtgggaaacattttctttcctggcctcttcatctgtaagacatgctctatcggcagcattaatgggttcgaaatcgagtcccacaaatgttattgctctctgttttgctgtccctactgcagacattgtagcgctgatcgggaaattcaccagcttcatctgtccatctgcaagaaaagaaagaccggaagcaacgtcatgctcgccgtgtgtaaacgcatgtgcttccggacaaccatggaggtctctaataaggctctgtttgtgagatccattatcaacacgacattcgttgtgtgtattctgatcctcgccgtctgcgtggttagcacctctgcggtggagatggaatccctgccggccggcacctgggagcgcgaagaggaccttacaaatttttgtcaccaggaatgccaagtcaccgagacagagtgtctgtgcccttatgaagctctcgtgctgcggagacccctgttccttgatagcatcgtgaaggggatgaaaaacctcctgaactccacgtctctggagaccagcctctccattgaagccccttggggagctatcaatgttcagtctacatacaagcccaccgtcagcgccgccaacattgctctgtcctggagctctgtggagcaccgcggcaataaaatccttgtgtccgggcggagcgagtctattatgaagctggaagagagaacaggcatctcctgggacctcggagtcgaagatgcgagcgagtctaaactgctgaccgtgagcgttatggacctttcccagatgtatagccccgtgtttgaatacctctctggcgatcgccaagtcgaggagtggcctaaggccacgtgcaccggggactgtccggaacggtgcggatgtacatccagcacatgcctgcataaggagtggccccactccagaaactggcgctgtaatcctacctggtgctggggcgtggggaccggatgtacgtgctgtggcctggatgttaaagacctcttcacagattacatgtttgtgaagtggaaagtcgaatatatcaagaccgaggctattgtgtgcgttgaactgacatctcaggagcggcagtgtagccttatcgaggccgggaccagattcaacctgggctccgtgaccattacactctctgaaccccggaatatccagcaaaaactgcctcccgagattatcacgctgcatccgcgcatcgaagagggatttttcgaccttatgcacgtccagaaggtgctcagcgcctccaccgtgtgcaagctgcagtcttgcacacatggcgtccctggggacctgcaggtttaccacattggaaacctcctgaaaggcgatagagtgaatgggcaccttatccataagattgaacaacacctgaacaccagctggatgtcctgggacggatgtgatctcgactattactgcaatatgggcgattggcccagctgtacatataccggggtgacgcagcataaccacgcttcttttgtcaatctgctgaacatcgagacagactacaccaaaaccttccacttccattccaagcgggtgacagcccacggcgatacccctcagcttgacctcaaagcgagacccacatatggagctggcgagattacggttctggtggaagtcgccgatatggagctgcataccaagaaaatcgaaatcagcgggctcaagtttgcctctctgtcctgcacaggatgttacgcttgcagctctggcatttcctgtaaggtgcgcatccacgttgacgagcctgatgagcttaccgtgcatgtcaaaagcgacgatcccgacgtggttgccgcttccagctctctgatggcccggaagctcgaaagcgggacagactccaccttcaaagcgttttctgccatgccgaagacgagcctgtgcttctacattgtggagagagaatattgtaaaggatgctccaaggaggatacccagaagtgtgtcaatacaaaactggaacaacctcagtctatccttattgagcacaagggcaccatcattgggaaacagaacaacacatgcaccgctaaggccagctgctggctggagtccgtgaaatctttcttttacggcctcaagaatatgctgagcggaatctttggcaacgtgttcctcgggatcttttccttcctggctccctttgtccttctgattctcttctttatgttcggatggcgcatcctgttctgttttaagtgctgtagacggacacgcggcctgttcaaatatagacaccttaaggacgatgaagagaccgggtaccggaaaattatcgaacgcctgaataacaagaaaggaaagaataagctcctggacggcgagagactcgccgatcggaaaattgcggaactgtttagcacgaagacacatatcggc

SEQ ID NO: 13770 - RNA, 3495 nt, synthetic construct
  misc_feature 1..3495: note = derived and/or modified CDS sequence (opt5) from CCHVF(CCHVF NIV 112143)__JN572085.1__Gn-NSm-Gc
  source 1..3495: mol_type = other RNA
agcgaggaatccggcgacgattgcatctctagaacccagctgctccggacagagacggccgaagtgcacggggacaactacggaggccccggggataagattaccatctgtaatggaagcacagtcgttgaccaacgcctgggctccgagcttgggtgctataccattaacagagtgaaatctttcaagctgtgtgaaaatagcgctacaggaaaatcctgcgagatcgattctattcctgtgaagtgtcggcagggctactgcctcaaaatcacccaggagggccgcgggcatgtcaagctgagcagaggatccgaagtggttcttgacgcctgtgatagctcttgcgaggtgatgatcccgaagggcacaggggacattctggtcgattgttccggaggccagcaacactttctcaaagacaacctgatcgatctggggtgccccaagattcctctcctgggaaaaatggcgatctatatttgtcggatgagcaatcatcccaagaccacgatggctttccttttctggttctcttttggctacgtgattacctgcatcctgtgcaaagttatcttctatctcctgatcatttttggcacacttgggaagcgcttcaagcagtacagagaactgaaacctcagacctgtacaatctgcgagaccacgcccgtgaacgccattgacgccgagatgcacgatctcaattgttcctataacatctgcccttactgtgctagccggctgacatctgacggactggcccgccatgtcacccagtgcccgaagagaaaagaaaaggtggaggaaacagagctctacctgaatcttgaacggattccctgggtggtccgcaaactgctccaagtttccgagagcaccggcatcgctctgaagagatcctcttggcttatcgtgctgctcgtgctgtttaccgtcagcattacacctgtgcagtccgcccccatcgggcacggaaaaacgattgaggcgtatcgggcccgcgaagagtacaccagcatctgtctgttcgttctcggctctgtgctgtttgtcgtgtcctgccttatgaaggggctggttgacagcgtgggaaacattttctttcctggcctcttcatctgtaagacatgctctatcggcagcattaatgggttcgaaatcgagtcccacaaatgttattgctctctgttttgctgtccctactgcagacattgtagcgctgatcgggaaattcaccagcttcatctgtccatctgcaagaaaagaaagaccggaagcaacgtcatgctcgccgtgtgtaaacgcatgtgcttccgggctacaatggaggtctctaataaggccctgtttgtgagatccattatcaacaccacgttcgttgtgtgtattctgatcctcgcgatctgcgtcgtgagcacatctgccgttgagatggaatccctgccggctggcacctgggagcgcgaagaggaccttaccaatttttgtcaccaggaatgccaagtgacagagaccgagtgtctgtgcccttatgaagccctcgtcctgcggagacccctgttccttgatagcattgtgaaggggatgaaaaacctcctgaactccacatctctggagacgagcctctccatcgaagctccttggggagccattaatgtgcagtctacctacaagcccacagttagcgccgctaacatcgcgctgtcctggagctctgtcgagcaccgcggcaataaaattcttgtgtccgggcggagcgagtctatcatgaagctggaagagagaaccggcatctcctgggacctcggagtggaagatgccagcgagtctaaactgctgacagtcagcgtgatggacctttcccagatgtatagccccgtttttgaatacctctctggcgatcgccaagtggaggagtggcctaaggctacctgcacgggggactgtccggaacggtgcggatgtacctccagcacatgcctgcataaggagtggccccactccagaaactggcgctgtaatcctacctggtgctggggcgtcgggacaggatgtacctgctgtggcctggatgtgaaagacctcttcacggattacatgtttgttaagtggaaagtggaatatattaagacagaggccatcgtctgcgtggaactgacctctcaggagcggcagtgtagccttattgaggccgggacaagattcaacctgggctccgttaccatcaccctctctgaaccccggaatattcagcaaaaactgcctcccgagatcatcacactgcatccgcgcattgaagagggatttttcgaccttatgcacgtgcagaaggtcctcagcgcttccacggtgtgcaagctgcagtcttgcacccatggcgtgcctggggacctgcaggtctaccacatcggaaacctcctgaaaggcgatagagttaatgggcaccttattcataagatcgaacaacacctgaacacaagctggatgtcctgggacggatgtgatctcgactattactgcaatatgggcgattggcccagctgtacctatacaggggtgacccagcataaccacgcctcttttgtgaatctgctgaacattgagacggactacacaaaaaccttccacttccattccaagcgggtcaccgcgcacggcgatacacctcagcttgacctcaaagctagacccacctatggagccggcgagatcacagtgctggttgaagtggccgatatggagctgcatacgaagaaaatcgaaattagcgggctcaagtttgcttctctgtcctgcaccggatgttacgcctgcagctctggcatctcctgtaaggtccgcattcacgtggacgagcctgatgagcttacagttcatgtgaaaagcgacgatcccgacgtcgtggctgcctccagctctctgatggcgcggaagctcgaatttgggaccgacagcacatttaaagccttctccgctatgccgaagacctctctgtgcttttacatcgttgagagagaatattgtaaaggatgcagcaaggaggatacgcagaagtgtgtgaataccaaactggaacaacctcagtccattcttatcgagcacaagggcacaattatcgggaaacagaacaatacctgcacagccaaggcttcttgctggctggagagcgtcaaatccttcttttacggcctcaagaacatgctgtctggaatcttcggcaacgtgtttctcgggattttcagctttctggcccccttcgtgcttctgatcctctttttcatgttcggatggcgcattctgttttgtttcaagtgctgtagacggacccgcggcctgtttaaatatagacaccttaaggacgatgaagagacagggtaccggaaaatcattgaacgcctgaataacaagaaaggaaagaataagctcctggacggcgagagactcgcggatcggaaaatcgccgaactgttctccaccaagacgcatatcggc

SEQ ID NO: 13771 - RNA, 3495 nt, synthetic construct
  misc_feature 1..3495: note = derived and/or modified CDS sequence (opt5) from CCHVF(CCHVF SCT ex Afghanistan)__KC344856.1__Gn-NSm-Gc
  source 1..3495: mol_type = other RNA
agcgaggaatccggcgacgattgcatctctagaacccagctgctccggacagagacggccgaagtgcacaacgacaattacgggggacccggcgataagattaccatctgtaacgggagcacaattgtcgaccaacgcctgggatccgagcttggctgctataccatcaatagagttaaatctttcaagctgtgtgaaaacagcgctacagggaaatcctgcaagattgattctacccctgtgaaatgtcggcagggattttgcctcaagatcacacaggagggccgcggccatgtgaagctgagcagagggtccgaggtcgtgcttgacgcctgtgatagctcttgcgaaatcatgattccgaaaggaaccggcgacatcctggttgattgttccgggggacagcaacacttcctcaaggacaatctgattgatctgggctgccccaacatccctctcctggggaaaatggcgatttacatctgtcggatgagcaatcatcccaagacgaccatggcttttcttttctggttttctttcggatatgtgattacatgcatcttttgcaaagtcatcttctacctgctcattgtggttggcaccctgggcaagaagtttaaacagtatcgcgagcttaagcctcagacatgtaccatctgcgaaacgacacccaccaacgccattgacgccgagatgcacgatctgaattgttcctacaacatctgcccttattgtgctagcagactcacatctgacgggctggcccggcatgtgacccagtgcccgaaacgcaaggagaaagtcgaagagaccgaactgtacctcaatctggagcggattccctggatcgtgcggaaacttctgcaagtgtccgaaagcacaggagtcgctctcaaacgctcctcttggctgatcgttcttctggtgctcctgacggtgagcctgtcccctgtccagagcgcccccattggccacgggaagaccatcgagacataccagaccagagagggatatatttctgtgtgtctcttcgttctgggcgggatcctttttgtggtctcctgcctgattaagggactcgtggacagcgttggcaactctttctttcctggcctgagcatctgtaaaacatgctccatcgggtctgtgaatggattcgaaattgagagccacaagtgttactgctcccttctgtgctgtccctattgccggcattgtagcaccgatcgcgaaatccaccagctccatctgtctatttgcaaaaagagacggacgggcgggaacgtcatgctggcggtgtgtaaaagaatgtgcttccgcgccacaatggaggtctccaataaggtgctctttatccggaacattatcaacaccaccttcgttatttgtatcctgatccttgctgtgtgcgtcgtgagcacatctgccgttgaaatggagtccctgccggctggaacctgggagagagaagaggacctcacaaatttttgtcaccaagaatgccaggtgacggagaccgaatgtctgtgcccttacgaggccctggtccttcgcaagcccctcttcctgaacagcattgtgaaaggcatgaagaatctgctcaactccacaaatctggagacctctcttagcatcgaagcgccttggggcgccattaacgtgcagtccacatttaaacccaccgtttctacggctaatatcgccctgagctggtccagcgtcgagcaccgggggaacaagattctcgtgtctggaagatccgaaagcatcatgaaactggaggagcgcaccggcatctcttgggatctgggggtggaagacgcttccgagagcaagtctcttacagtcagcgtgatggatctctcccaaatgtatagccccgttttcgaatacctgtctggagacagacaggtggaggaatggcctaaggctacctgcacaggcgattgtccggagagatgcgggtgtacctccagcacgtgcctgcataaagagtggccccactcccgcaattggcggtgtaaccctacatggtgctggggagtcggcaccgggtgtacatgctgtggcctcgacgtgaaggatctgtttaccgactatatgttcgttaaatggaaggtggaatacattaaaaccgaggccatcgtctgcgtggaacttacatctcaggagagacagtgtagcctgattgaagccggaacgcgctttaatctcggccccgttaccatcacactgtccgagcctcggaacattcaacagaagctgcccccggagatcatcacccttcatcctagaattgaagaggggttctttgatctcatgcacgtgcagaaggtcctgtctgcgagcacagtgtgcaaactgcagtcctgcacccatggagtgcccggcgacctccaagtctaccacatcgggaatctgcttaagggagacaaactgaacggccacatgattcataagatcgaacctcacttcaatacgtcttggatgagctgggatgggtgtgacctcgattattactgcaacatgggcgactggccctcctgtacatataccggagttacccagcataaccacgccgcttttgtgaatctgctgaacattgagacagattacaccaaaaatttccacttccatagcaagcgggtgacagcccacggcgacacgcctcagcttgatctcaaagcccgccccacctatggggctggagaaatcacagtcctggtggaggttgccgacatggagctgcataccaagaagatcgatatttctggcctcaaatttgcgtccctgacatgcgctgggtgttacgcctgcagctctggaatctcctgtaaggtgcggattcacgtcgacgaaccggatgagcttaccgtgcatgttaaaagcgaagaccctgatatcgtggccgcttctacgtccctgattgccagaaagctcgagctgggcaccgacagcacattcaaggctttttccgccatgcccaagaccagcctgtgcttctatatcgtcgagagagaatactgtaagtcttgcagcaaagaggacacacagaagtgtgtgaacaccaaacttgaacacccccaagggattctgatcgagcacaagggcacaatcattggaaaacagaatgatacctgcacggcgaaggccggctgctggctcgaatccgttaagagctttttctacgggctgaaaaacatgctctctggaatctttggcaatgtgttcattgggatctttctgttccttgctccttttgtcctgctcattctgttctttatgttcggatggcgcctgcttttctgttttaagtgctgtcggagaacacgcggcctgttcaaatatagacatctcaaggaggacgaggaatccggctaccggcgcatcatcgagagactgaacaataaaaaggggaagaacaaactcctggatggagaacggcttgccgaccgcagaattgctgagctgttttctaccaagacccacatcggc

SEQ ID NO: 13772 - RNA, 3495 nt, synthetic construct
  misc_feature 1..3495: note = derived and/or modified CDS sequence (opt5) from CCHVF(CCHVF Zahedan 2007)__KC867273.1__Gn-NSm-Gc
  source 1..3495: mol_type = other RNA
agcgaggaatccggcgacgattgcatctctagaacccagctgctccggacagagacggccgaagtgcacggggacaactacggaggccccggggataagattaccatctgtaatggaagcacagtcgttgaccaacgcctgggctccgagcttgggtgctataccattaacagagtgcggtctttcaaactgtgtgaaaatagcgctacaggaaagtcctgcgagatcgattctattcctgtgaaatgtaagcagggcttttgcctcaaaatcacccaggagggccgcgggcatgtcaagctgagcagaggatccgaagtggttcttgacgtgtgtgatagctcttgcgaggtcatgatcccgaagggcacaggggacattctggtggattgttccggaggccagcaacacttcctcaaagacaacctggttgatctggggtgccccaagatccctctcctgggaaaaatggccatttacatctgtcggatgagcaatcatcccaagaccacgatggcgtttcttttctggttttctttcggctatgtgattacctgcatcctgtgcaaagctatctttttcctcctgattatctttggcacacttgggaagcgcttcaagcagtacagagaactgaaacctcagacctgtacaatttgcgagaccacgcccgtcaacgccatcgacgccgagatgcacgatctcaattgttcctataacatttgcccttactgtgctagccggctgacatctgacggactggcccgccatgtgacccagtgcccgagacggaaggaaaaagtggaggaaacagagctctatctgaatcttgaacgcatcccctgggtcgttagaaagctgctccaagtgtccgagagcaccggcaccgtgctgaaacggtcctcttggcttattgtcctgctcgtgctgtttacagttagcctgtcccctgtgcagagcgctcccatcgggcacggaaagacgatcgagacctaccgcgtcagagaagagtacacatctatttgtctcttcgtgctgggctccatcctttttattgttagcttcctgatgaaagggctcgtggacggagtcggcaacatcttctttcctggcctgtctgtgtgcaagacctgtagcattgggtccatcaatggattcgaaatcgagtctcaccggtgctattgtagcctgttttgctgcccctactgtagacattgctccgccgatggcgaaattcaccagcttcatctcagcatctgtaagaaacgcaagacagggtctaacgtcatgctggcggtgtgcaaacggatgtgtttcagagccaccatggaggtttccaataaggtgctgtttattcgcagcatcattaacacgacattcgtcgtgtgcatcctcattctggctgtttgtgtggtctctacctccgccgtggagatggaaagccttccggctggaacctgggagcgggaagaggacctgacaaatttttgccaccaggaatgtcaagtgaccgagacagagtgcctctgtccttatgaagccctggttctgagacgcccccttttcctcgattccatcgtcaaagacatgaagaacctgctgaactctacgagcctcgagacctccctgtctatcgaagcgccttggggcgccattaatgtgcagagcacatacaagcccaccgtgtccacagctaacatcgcccttagctggtcttccgtcgagcaccgggggaataaagtgctggttagcggcagatctgagtccattatgaagctcgaggaacgcaccggaatcagctgggatctgggcgtggaagacgcttctgagagcaaactgcttacggtctccgtgatggatctcagccagatgtattctcccgtttttgaatacctgtccggggaccggcaagtggaggagtggcctaaggccacatgcacaggagattgcccggaaagatgtggctgcaccagctccacatgtctgcataaagagtggccccactctcgcaactggcggtgcaatcctacctggtgttggggagtcgggacgggctgcacatgttgcgggctcgacgtgaaggatctgttcaccgactatatgtttgttaagtggaaagtggaatacattaagacagaggccatcgtctgtgtggaacttaccagccaggagagacagtgctccctgatcgaggctggcacccggttcaacctcggatctgtgacaattacgctgagcgaaccccgcaatatccagcaaaaactgcctcccgagattatcacccttcatccgaagattgaagagggctttttcgacctcatgcacgtccagaaagttctgtccgcgtctacagtgtgtaagctgcagagctgcacccatggggtgcctggagatctccaggtctaccacatcggcaacctgcttaagggggacagagtgaatggacacctgatccataaaattgaacaacacttcaacacatcctggatgagctgggatggctgcgacctcgattattactgtaatatgggggactggccctcttgcacctatacgggcgttacacagcataaccacgcctcctttgtgaatctgctgaacatcgagaccgattacaccaagacattccactttcatagcaaacgggtcaccgctcacggagacacacctcagcttgatctcaaggccagacccacgtatggcgccggggagattaccgtgctggttgaagtggctgacatggagctgcataccaaaaagatcgaaatttctggactcaaattcgccggcctgacctgtacagggtgctacgcgtgttccagcggaatctcttgcaaggtccgcatccacgtggatgagcctgacgagcttaccgttcatgtgaagtccgatgaccccgacgtcgtggctgccagctccagcctgatggcccggaaactcgaatttggcacggattctaccttcaaggcttttagcgccatgccgaaaacatccctgtgtttctatattgtggagagagaatactgcaagtcttgtagcaaagaggacacccagaagtgcgtcaatacaaagctggaacaacctcagtccatccttattgagcacaaagggaccatcattggcaagcagaacaacacatgtaccgctaaagcctcttgctggctggagagcgttaagtcctttttctacggactcaaaaatatgctgggcgggatctttggaaacgtgttcattggcatctttacgttcctcacacccttcatcctgcttatctttttctttatgttcgggtggcgcattctgttttgcttcaagtgttgcagacggacccgcggactctttaagtatagacacctgaaagatgacgaagagaccggctaccggaagattatcgaacgcctgaataacaaaaagggcaaaaatagacttctggatggggagcggctcgcggaccgcaagattgccgaactgttctctacaaagacccatatcgga

SEQ ID NO: 13773 - RNA, 3495 nt, synthetic construct
  misc_feature 1..3495: note = derived and/or modified CDS sequence (opt5) from CCHVF(CCHVF SPU 44/08)__KJ682805.1__Gn-NSm-Gc
  source 1..3495: mol_type = other RNA
agcgaggaatccaacgacgattgcctgtctagaacccagctcctgcggacagagaatgccgaaatccacagcgacaactacggcgggcccggagataagattacgatctgtaatggctccaccattgtggaccaacgccttgggtctgagctgggatgctatacaatcaacagagtcaaatctttcaagctctgtgaaaattccgctaccggcaaatcttgcgagattgatagcacacctgttcggtgtcgccaggggttttgcctgaagatcacccaggagggaagaggccatgtgaaactttcccggggcagcgaagtggtcctggacgcctgtgattcttcctgcgagatcatgattccgaaggggacaggagacatcctcgtggattgtagcggcgggcagcaacacttcctgaaggacaacctggttgatctcggatgccccaatattcctctgcttggcaaaatggcgatctacatttgtcgcatgtctaaccatcccaagaccacgatggcttttctgttctggttttccttcgggtatgtgattacctgcatcctctgcaaagccatcttttacctgcttatcgtcgtgggaacactgggcaagaaattcaagcagtatagagaactcaagcctcagacctgtacaatttgcgagaccaatcccgttaacgccatcgacgctgagatgcacgatctgaattgtagctacaacatttgcccttattgtgcctctcggctgacgtccgacggcctcgctcgccatgtgatgcagtgcccgaaaagaaaggagaaaatcgaagaaacagagctgtaccttaatctggaacggattccctgggtcgtgcgcaagctcctgcaagtgagcgagtccaccggggtcgcccttaaaagatctagctggctggttatcctcctggtgctgctcacagtgtccctgagccctgtccagtctgcgcccatctcccacggagagaccgtggaagtttaccagacccgggagggctatacaagcatttgtctttttgtgctggggtctatcctcttcctggtcagctgccttatgcgcggactggtggactccgtttctaacagctttttccctggcctctccatttgtaagacgtgcagcatcgggtctattaatggatttgaaatcgagtcccacaaatgttactgcagcctgttctgctgtccctattgcagacattgttctgccgatatcgaaattcacaagctgcatctctccatctgcaagaaacggaagaccggcagcaacgtgatgctggctgtctgtaaaagaatgtgcttccgcgccacagtggaggtctccaacaaggcccttctgattcggaatatcattaacaccacatttgtggtttgtatcctcattctggccgtgtgcgtcgtgtctaccagcgcggttgagatggaaaatctgccggccggcacgtgggagaaagaagaggaccttacaaacttctgtcaccaggaatgccaagtgaccgagaccgagtgtctctgcccttacgaagctctggtcctgagaaagcccctctttctggattccatcgtgaaggggatgaaaaatcttctgaactctacaagcctcgagacctccctgagcatcgaagccccttggggagctattaatgtgcagtctacattcaagcccacggtttccgccgccaacatcgctctgagctggtcttccgtcgagcaccgcggcaataaaattcttgtgagcgggcggtctgagagcatcatgaagctcgaagagagaaccggaatttcctgggacctgggcgtggaagatgcgagcgagtctaaactgctcacagtctccgtgatggacctgagccagatgtattcccccgtttttgaatacctttctggggatcgccaagtggaggagtggcctaaggctacctgcacaggcgactgtccggaacggtgcggatgtaccagctccacgtgcctgcataaggagtggccccactctagaaactggcgctgtaatcctacctggtgctggggcgtcgggacaggatgtacctgctgtggcctcgatgtgaaagacctgttcacagattatatgtttgttaagtggaaagtggactacatcaagaccgaagctatcgtctgcgtggagctgacgagccaggaacggcagtgttcccttattgaggccgggacaagattcaacctcggacccgttaccatcacactgtctgagcctcgcaatattcagcaaaaactgcccccggaaatcgtgaccctccatcctcggattgaggaaggctttttcgacctgatgcacatccagaaggtccttagcgcctccaccgtgtgcaagctgcagagctgcacacatggggtgcccggcgatctccagatctaccacattggaaacctgctgaaaggcgacaaggtcaatgggcaccttatccataaaattgagcctcactttaacacgtcttggatgtcctgggatggatgtgacctcgattattactgcaacatgggcgactggcccagctgttcttataccggggttacacaacataatcacgctgccttcgtgaacatgctgaatatcgaaaccgattacacaaagaactttcacttccattccaaaagagtgaccgcgcacggagacacgcctcagctggatctcaaggctcggcccacatatggcgccggggagattaccgtcctggtggaggttgccgacatggaacttcataccaaaaagatcgagatcagcggcctgaagttcgcttctctcacatgcaccggatgttacgcctgctccagcggcatttcctgtaaagtgcgcatccacgtcgatgaaccggacgagctgacagtgcatgttaagagcgaggatcctgacattgtggctgcctctagctccctgatggcgagaaaacttgaatttgggacggactctaccttcaaggcctttagcgctatgcccaaaacatccctgtgcttctatatcgtcgagcgggaatactgtaagtcttgcagcaaggaggatacccagaaatgtgtgaatacaaagctcgaacagccccaatccattctgatcgagcacaaaggaaccattatcggcaagcagaacgacacgtgcaccgccaaagctagctgctggctcgagagcatcaagtcctttttctacgggctgaagaatatgcttagcggaatttttggcaacgttttcatcgggatttttctgttcctcgccccttttatcatgctgattctgttctttatgttcggctggagaatccttttctgttttaaatgctgtcgccggacaagaggactgttcaagtatcgccacctcaaagatgacgaagagatcggctacagaaagattatcgaacggctgaataacaaaaaggggaagaataaactcctggatggagagcgccttgcggacagaaagattgccgaactgttttctaccaaaacacatatcggc

SEQ ID NO: 13774 - RNA, 3495 nt, synthetic construct
  misc_feature 1..3495: note = derived and/or modified CDS sequence (opt5) from CCHVF(CCHVF SPU 383/87)__KJ682806.1__Gn-NSm-Gc
  source 1..3495: mol_type = other RNA
agcgaggaatccaacgacgattgcctgtctagaacccagctcctgcggacagagaatgccgaaatccacagcgacaactacggcgggcccggagataagattacgatctgtaatggctccaccattgtggaccaacgccttgggtctgagctgggatgctatacaatcaacagagtcaaatctttcaagctctgtgaaaattccgctaccggcaaatcttgcgagattgatagcacacctgttcggtgtcgccaggggttttgcctgaagatcacccaggagggaagaggccatgtgaaactttcccggggcagcgaagtggtcctggacgcctgtgattcttcctgcgagatcatgattccgaaggggacaggagacatcctcgtggattgtagcggcgggcagcaacacttcctgaaggacaacctggttgatctcggatgccccaatattcctctgcttggcaaaatggcgatctacatttgtcgcatgtctaaccatcccaagaccacgatggcttttctgttctggttttccttcgggtatgtgattacctgcattctctgcaaagtcatcttttacctgcttgtggttgtgggaacactgggcaagaaattcaagcagtatagagaactcaagcctcagacctgtacaatctgcgagaccaatcccgtcaacgccattgacgccgagatgcacgatctgaattgtagctacaacatctgcccttattgtgcttctcggctgacgtccgacggcctcgcccgccatgtgattcagtgcccgaaaagaaaggagaaaatcgaagaaacagagctgtaccttaatctggaacggattccctgggtggtccgcaagctcctgcaagttagcgagtccaccggggtggctcttaaaagatctagctggctggtgatcctcctggtcctgctcacagtgtccctgagccctgttcagtctgcccccatctcccacggagagaccgtggaagtctaccagacccgggagggctatacaagcatttgtctttttgtgctggggtctatcctcttcctggttagctgccttatgaagggactggtggactccgtcggcaacagctttttccctgggctcagcatttgtaaaacgtgctccatcggaagcattaatggctttgaaatcgagtctcacaagtgttactgctccctgttctgctgtccctattgccgccattgtagcgcggatatcgaaattcacagactgcatctctctatctgcaagaaacggaagaccggctccaacgtgatgctggccgtctgtaaaagaatgtgcttccgcgctacagtggaggttagcaacaaggcccttctgattcggaatatcattaacaccacatttgtggtctgtatcctcattctggctgtgtgcgttgtgtccacctctgccgtcgagatggaaaatctgccggcggggacgtgggagaaagaagaggaccttacaaacttctgtcaccaggaatgccaagtgaccgagaccgagtgtctctgcccttacgaagccctggtgctgagaaagcccctctttctggatagcatcgttaagggaatgaaaaatcttctgaactccacatctctcgagaccagcctgtccatcgaagctccttggggcgccattaatgtccagagcacattcaagcccacggtgtctgctgccaacatcgccctgtcctggagctctgtggagcaccgcgggaataaaattcttgtctccggacggagcgagtctatcatgaagctcgaagagagaaccggcattagctgggacctgggggtggaagatgcttccgagagcaaactgctcacagtttctgtgatggacctgtcccagatgtatagccccgtctttgaatacctttccggcgatcgccaagtggaggagtggcctaaggcgacctgcacaggagactgtccggaacggtgcggctgtacctctagcacgtgcctgcataaggagtggccccactccagaaactggcgctgtaatcctacctggtgctggggagttgggacaggctgtacctgctgtgggctcgatgtgaaagacctgttcacagattatatgtttgtcaagtggaaagtggactacatcaagaccgaagccatcgtttgcgtggagctgacgtctcaggaacggcagtgtagccttattgaggctggaacaagattcaacctcggccccgtcaccatcacactgtccgagcctcgcaatattcagcaaaaactgcccccggaaatcgtgaccctccatcctcggattgaggaagggtttttcgacctgatgcacatccagaaggtgctttctgccagcaccgtctgcaagctgcagtcctgcacacatggcgttcccggagatctccagatctaccacattggcaacctgctgaaaggggacaaggtgaatggacaccttatccataaaattgagcctcactttaacacgagctggatgtcttgggatggctgtgacctcgattattactgcaacatgggggactggccctcctgtagctataccggagtgacacaacataatcacgccgctttcgtcaacatgctgaatatcgaaaccgattacacaaagaactttcacttccattctaaaagagtgaccgcccacggcgacacgcctcagctggatctcaaggcgcggcccacatatggggctggcgagattaccgttctggtggaggtcgccgacatggaacttcataccaaaaagatcgagatctccggactgaagttcgccagcctcacatgcaccggctgttacgcttgttcttccgggattagctgcaaagtgcgcatccacgttgatgaaccggacgagctgacagtgcatgtcaagtccgaggatcctgacattgtggccgctagctctagcctgatggccagaaaacttgaatttggaacggactccaccttcaaggcgttttctgccatgcccaaaacaagcctgtgcttctatatcgttgagcgggaatactgtaagtcctgctctaaggaggatacccagaaatgtgtgaatacaaagctcgaacagccccaaagcattctgatcgagcacaaaggcaccatttttgggaagcagaacgacacgtgcaccgctaaagcctcctgctggctcgagtctgtcaagagcttcttttacggactgaagaatatgctttccggcatcttcgggaacgtgtttatcggcgtgttcctgtttctcgctcctttcattatgctgatcctgtttttcatgttcggatggagaatcctgttttgtttcaaatgctgtcgccggacaagaggcctttttaagtatcgccacctcaaagatgacgaagagatcgggtacagaaagattatcgaacggctgaataacaaaaagggaaagaataaactcctggatggcgagcgccttgccgacagaaagatcgcggaactgttcagcaccaaaacacatattggg

SEQ ID NO: 13775 - RNA, 3495 nt, synthetic construct
  misc_feature 1..3495: note = derived and/or modified CDS sequence (opt5) from CCHVF(CCHVF SPU 130/89)__KJ682807.1__Gn-NSm-Gc
  source 1..3495: mol_type = other RNA
agcgaggaacccaactacgactgcctgtccagaacccagctcctgcggacagagaatgccgaaatccactctgataactatggcgggcctggagacaagattacgatctgtaatggcagcaccattgtggatcaacgccttgggtccgagctgggatgctacacaatcaacagagtcaaatctttcaagctctgtgaaaatagcgctaccggcaaatcctgcgagattgactctacaccggttcggtgtcgccaggggttttgcctgaagatcacccaggagggaagaggccatgtgaaacttagccggggctccgaagtggtcctggatgcctgtgacagctcttgcgagatcatgattcccaaggggacaggagatatcctcgtggactgttccggcgggcagcaacacttcctgaaggataacctggttgacctcggatgccctaatattcccctgcttggcaaaatggcgatctatatttgtcgcatgagcaaccatcctaagaccacgatggcttttctgttctggttttctttcgggtacgtgatcacatgcattctctgcaaagtcatcttttatctgcttatcgtggttggaacactgggcaagaaattcaagcagtacagagaactcaagccccagacctgtacaatttgcgagaccaatcctgtgaacgccatcgatgccgagatgcacgacctgaattgttcctataacatttgcccgtactgtgctagccggctgacgtctgatggcctcgcccgccatgtcatgcagtgccccaaaagaaaggaaaagatcgaggaaacagagctgtaccttaatctggaacggattccttgggtggtgcgcaagctcctgcaagtctccgagagcaccggggttgctcttaaaagatcctcttggctggtggtgctcctggtcctgctcacagtgagcctgtcccccgttcagagcgcccctatctctcacggagagaccgtggaagtctatcagacccgggagggctacacatccatctgtctttttgtgctggggagcattctcttcctggtttcttgccttatgaagggactggtggacagcgtcggcaactcctttttccccgggctctctatctgtaaaacgtgcagcattggatccatcaatggctttgaaattgagagccacaagtgttattgctctctgttctgctgtccgtactgccgccattgttccgcggacatcgaaatccacaagctgcatctcagcatttgcaaaaagagaaaaaccggctctaacgtgatgctggccgtctgtaagcggatgtgcttcagagctacagtggaggtttccaacaaagcccttctgatccgcaatattatcaacaccacatttgtggtctgtattctcatcctggctgtgtgcgttgtgagcacctccgccgtcgagatggaaaatctgcctgcggggacgtgggagaaggaagaggatcttacaaacttctgtcaccaggaatgccaagtgaccgagaccgagtgtctctgcccctatgaagccctggtgctgcggaagcctctctctctggacagcattgttaaaggaatgaagaatcttctgaactccacatctctcgagaccagcctgtccatcgaagctccctggggcgccatcaatgtccagagcacatttaaacccacggtgtctgctgccaacattgccctgtcctggagctctgtggagcacagagggaataagatccttgtctccggacgcagcgagtctattatgaaactcgaagaacggaccggcatcagctgggatctgggggtggaagacgcttccgagagcaagctgctcacagtttctgtgatggatctgtcccagatgtacagccctgtcttcgaatatctttccggcgacagacaagtggaggagtggccgaaggcgacctgcacaggagattgtcccgaacgctgcggctgtacctctagcacgtgcctgcataaagagtggcctcactcccggaactggagatgtaatcccacctggtgctggggagttgggacaggctgtacctgctgtgggctcgacgtgaaggatctgtttacagactacatgttcgtcaaatggaaggtggattacattaaaaccgaagccatcgtttgcgtggagctgacgtctcaggaacgccagtgtagccttatcgaggctggaacacggtttaacctcggccctgtcaccattacactgtccgagcccagaaatatccagcaaaagctgccgcctgaaattgtgaccctccatccccgcatcgaggaagggttctttgacctgatgcacattcagaaggtgctttctgccagcaccgtctgcaaactgcagtcctgcacacatggcgttcctggagacctccagatctatcacatcggcaacctgctgaagggggataaagtgaatggacaccttattcataagatcgagccccacttcaacacgagctggatgtcttgggacggctgtgatctcgactactattgcaacatgggggattggccttcctgtagctacaccggagtgacacaacataatcacgccgcttttgtcaacatgctgaatattgaaaccgactataccaaaaacttccactttcattctaagcgggtgaccgcccacggcgatacgccccagctggacctcaaagcgagaccgacatacggggctggcgagatcaccgttctggtggaggtcgccgatatggaacttcataccaagaaggtggagatttccggactgaaattcgccagcctcacatgcaccggctgttatgcttgttcttccgggatcagctgcaaggttcggatccacgtggacgaacctgatgagctgacagtccatgtgaaatccgaggaccccgatattgttgccgctagctctagcctgatggcccgcaaacttgagttcggaacggactccacctttaaagcgttctctgccatgcccaagacaagcctgtgcttttacatcgtggagagagaacactgtaagtcctgctctaaagaggacacccagcggtgtgtcaatacaaagctcgaacagcctcaaagcattctgatcgagcacaaaggcaccattatcgggaagcagaacgatacgtgcaccgctaaagcctcctgctggctcgagtctattaagagcttcttttacggactgaagaatatgctttccggcatcttcgggaacgtgtttatcggcgtgttcctgtttctcgctccgttcattatcctgattctgtttttcatgtttggatggagaatccttttctgtttcaaatgctgtcgccggacaagaggcctgctcaagtatcgccatctgaaagacgatgaagagattgggtacagaaagatcatcgaacggctcaataacaaaaagggaaagaataaactgcttgacggcgagcgcctggccgatagaaagattgcggaactctttagcaccaaaacacacatcggg

SEQ ID NO: 13776 - RNA, 3495 nt, synthetic construct
  misc_feature 1..3495: note = derived and/or modified CDS sequence (opt5) from CCHVF(CCHVF SPU 497/88)__KJ682808.1__Gn-NSm-Gc
  source 1..3495: mol_type = other RNA
agcgaggaatccaacgacgattgcctgtctagaacccagctcctgcggacagagaatgccgaaatccacagcgacaactacggcgggcccggagataagattacgatctgtaatggctccaccattgtggaccaacgccttgggtctgagctgggatgctatacaatcaacagagtcaaatctttcaagctctgtgaaaattccgctaccggcaaatcttgcgagattgatagcacacctgttcggtgtcgccaggggttttgcctgaagatcacccaggagggaaaaggccatgtgaagctgtccagaggcagcgaagtggtcctggacgcctgtgattcttcctgcgagatcatgattccgaaggggacaggagacatcctcgtggattgtagcggcgggcagcaacacttcctgaaagacaacctggttgatctcggatgccccaatattcctctgcttggcaagatggcgatctacatttgtcggatgtctaaccatcccaaaaccacgatggtgtttctgttctggttttccttcgggtatgtcattacctgcattctctgcaaggtgatcttttacctgcttatcgttgtgggaacactgggcaaaaagttcaagcagtatcgcgaactcaaacctcagacctgtacaatttgcgagaccaatcccgtcaacgctatcgacgccgagatgcacgatctgaattgtagctacaacatttgcccttattgtgcctctagactgacgtccgacggcctcgctcggcatgtgatgcagtgcccgaagcgcaaagaaaagatcgaggaaacagagctgtaccttaatctggaaagaatcccctgggtggtccggaaactcctgcaagttagcgagtccaccggggtggcccttaagcgctctagctggctggtgatcctcctggtcctgctcacagtgtccctgagccctgttcagtctgctcccatctcccacggagagaccgtggaagtctaccagaccagagagggctatacaagcatttgtctttttgtgcttgggggaatcctcttcctggtttcttgccttatgaaaggcctggtggacagcgtcgggaactcctttttccctggactctctatttgtaagacgtgcagcatcggctccattaatggctttgaaatcgagagccacaagtgttactgctctctgttctgctgtccctattgccggcattgttccgccgatatcgaaattcacaaactgcatctcagcatctgcaagaaacgcaagacctggtctaacgtgatgctggcggtctgtaaaagaatgtgcttccgggccacagtggaggtttccaacaaggcccttctgattagaaatatcattaacaccacatttgtggtctgtatcctcattctggctatctgcgtggttagcacctccgctgtggagatggaaaatctgccggccgggacgtgggagaaggaagaggaccttacaaacttctgtcaccaggaatgccaagtcaccgagaccgagtgtctctgcccttacgaagcgctggtgctgcgcaaacccctctttctggattctatcgtgaagggaatgcggaatcttctgaacagcacatccctcgagacctctctgagcattgaagccccttggggcgctatcaatgttcagtccacattcaaacccacggtcagcgccgctaacattgccctgtcttggtccagcgtggagcacagagggaataagatccttgtgtctggacgctccgagagcattatgaaactcgaggaacggaccggcatctcttgggacctgggggtcgaagatgccagcgagtccaagctgctcacagtgagcgttatggacctgtctcagatgtattcccccgtgtttgaataccttagcggcgatagacaagtcgaggagtggcctaaggctacctgcacaggagactgtccggaacgctgcggctgtacctcctctacgtgcctgcataaagagtggccccacagccggaactggagatgtaatcctacctggtgctggggagtggggacaggctgtacctgctgtgggctcgatgttaaggacctgttcacagattatatgtttgtgaaatggaaggtcgactacatcaaaaccgaagcgattgtgtgcgttgagctgacgtcccaggaacgccagtgttctcttatcgaggccggaacacggttcaacctcggccccgtgaccattacactgagcgagcctagaaatatccagcaaaagctgcccccggaaattgtcaccctccatcctcgcatcgaggaagggtttttcgacctgatgcacatccagaaggtgctttccgcttctaccgtgtgcaaactgcagagctgcacacatggcgtccccggagatctccagatttaccacatcggcaacctgctgaagggggacaaagttaatggacaccttattcataagatcgagcctcactttaacacgtcctggatgagctgggatggctgtgacctcgattattactgcaacatgggggactggccctcttgttcctataccggagtgacacaacataatcacgccgccttcgtgaacatgctgaatattgaaaccgattacacaaagaactttcacttccatagcaagcgggtcaccgctcacggcgacacgcctcagctggatctcaaagccagacccacatatggggcgggcgagatcaccgtgctggttgaggtggctgacatggaacttcataccaagaagatcgagatttctggactgaaattcgcctccctcacatgcaccggctgttacgcctgcagctctgggatctcctgtaaggtccggattcacgtggatgaaccggacgagctgacagttcatgtgaaaagcgaggatcctgacatcgtcgctgcctccagctctctgatggctcgcaaacttgaatttggaacggacagcaccttcaaagccttttccgcgatgcccaagacatctctgtgcttctatattgtggagagagaatactgtaagagctgctccaaagaggatacccagaagtgtgttaatacaaaactcgaacagccccaatctatcctgattgagcacaagggcaccatcatcgggaaacagaacgacacgtgcaccgcccgggctagctgctggctcgagtccattaagagctttttctacggactgaagaatatgcttagcggcatctttgggaacgtgttcattggcatctttctgttctttgcccctttcattatgctcatcctgtttttcatgttcggatggagaatcctgttttgtttcaaatgctgtcgccggacaagaggcctttttaagtatcgccacctgaaagatgacgaagaggtcgggtacagaaagattatcgaacggctcaataacaaaaagggaaagaataaactgctcgatggcgagcgcctggctgacagaaagattgccgaacttttctccaccaaaacacatatcggg

SEQ ID NO: 13777 - RNA, 3495 nt, synthetic construct
  misc_feature 1..3495: note = derived and/or modified CDS sequence (opt5) from CCHVF(CCHVF SPU 18/88)__KJ682810.1__Gn-NSm-Gc
  source 1..3495: mol_type = other RNA
agcgaggaatccaacgacgattgcctgtctagaacccagctcctgcggacagagaatgccgaaatccacagcgacaactacggcgggcccggagataagattacgatctgtaatggctccaccattgtggaccaacgccttgggtctgagctgggatgctatacaatcaacagagtcaagagcttcaaactctgtgaaaattccgctaccggcaaatcttgcgagattgatagcacacctgttcggtgtcgccaggggttttgcctgaagatcacccaggagggaagaggccatgtgaaactttcccggggcagcgaagtggtcctggacgcctgtgattcttcctgcgagatcatgattccgaaggggacaggagacatcctcgtggattgtagcggcgggcagcaacacttcctgaaggacaacctggttgatctcggatgccccaatattcctctgcttggcaaaatggcgatctacatttgtcgcatgtctaaccatcccaagaccacgatggggtttctgttctggttttccttcggatatgtgattacctgcatcctctgcaaagtcatcttttacctgcttatcgtggttggcacactgggcaagaaattcaagcagtatagagaactcaagcctcagacctgtacaatttgcgagaccaatcccgtgaacgctatcgacgccgagatgcacgatctgaattgtagctacaacatttgcccttattgtgcctctcggctgacgtccgacgggctcgctcgccatgtcatgcagtgcccgaaaagaaaggagaaaatcgaggaaacagagctgtaccttaatctggaacggattccctgggtggtgcgcaagctcctgcaagtcagcgagtccaccggagttgcccttaaaagatctagctggctggtgatcctcctggtgctgctcacagtctccctgagccctgtgcagtctgctcccatctcccacggcgagaccgttgaagtgtaccagacccgggaggggtatacaagcatttgtctttttgtcctgggatctatcctcttcctggtgagctgccttatgaagggcctggttgactccgtggggaactcttttagccctggactctccatttgtaaaacgtgcagcatcggctctattaatggcttcgaaatcgagtcccacaagtgttactgcagcctgttttgctgtccctattgccgccattgttctgccgatatcgaaattcacaagctgcatctctccatctgcaaaaagagaaaaaccgggagcaacgtcatgctggcggtgtgtaagcggatgtgcttcagagccacagtcgaggtgtccaacaaagcccttctgattcgcaatatcattaacaccacattcgttgtgtgtatcctcattctggctgtctgcgtggtttctaccagcgctgtggagatggaaaatctgccggccggaacgtgggagaaggaagaggaccttacaaacttttgtcaccaggaatgccaagtcaccgagaccgagtgtctctgcccttacgaagcgctggtgctgcggaagcccctcttcctggattccatcgtgaaaggcaagaaaaatcttctgaactctacaagcctcgagacctccctgagcatcgaagccccttggggagctattaatgttcagtctacatttaagcccacggtctccgccgctaacatcgccctgagctggtcttccgtggagcacagaggaaataaaattcttgtgagcggccgctctgagagcatcatgaagctcgaagaacggaccgggatttcctgggacctgggcgtcgaagatgccagcgagtctaagctgctcacagtgtccgttatggacctgagccagatgtattcccccgtgttcgaatacctttctggagatagacaagtcgaggagtggcctaaagctacctgcacaggcgactgtccggaacgctgcgggtgtaccagctccacgtgcctgcataaggagtggccccactctcggaactggagatgtaatcctacctggtgctggggagtgggcacagggtgtacctgctgtggactcgatgttaaagacctgtttacagattatatgttcgtgaagtggaaagtcgactacatcaagaccgaagcgatcgtgtgcgttgagctgacgagccaggaacgccagtgttcccttattgaggccggcacacggtttaacctcgggcccgtgaccatcacactgtctgagcctagaaatattcagcaaaagctgcccccggaaatcgtcaccctccatcctcgcattgaggaaggcttctttgacctgatgcacatccagaaagtgcttagcgcttccaccgtgtgcaagctgcagagctgcacacatggagtccccggcgatctccagatctaccacattgggaacctgctgaaaggagacaaggttaatggccaccttatccataaaattgagcctcacttcaacacgtcttggatgtcctgggatgggtgtgacctcgattattactgcaacatgggagactggcccagctgttcttataccggcgtgacacaacataatcacgccgcctttgtgaacatgctgaatatcgaaaccgattacacaaagaacttccactttcattccaaacgggtcaccgctcacggggacacgcctcagctggatctcaaggccagacccacatatggcgcgggagagattaccgtgctggttgaggtggctgacatggaacttcataccaagaaaatcgagatcagcggcctgaagttcgcctctctcacatgcaccgggtgttacgcctgctccagcggaatttcctgtaaagtccggatccacgtggatgaaccggacgagctgacagttcatgtcaagagcgaggatcctgacattgtggctgcctctagctccctgatggctcgcaaacttgagttcggcacggactctacctttaaggccttcagcgcgatgcccaagacatccctgtgcttttatatcgtggaaagagaatactgtaaatcttgcagcaaggaggatacccagaaatgtgttaatacaaagctcgaacagccccaatccattctgatcgagcacaaagggaccattatcggaaagcagaacgacacgtgcaccggcaaggccgggtgctggctcgagtctatcaagagcttcttttacggcctgaaaaatatgctttccggaattttcggcaacgtgtttatcgggattttcctgtttctcgctcctttcatcatgctgattctgtttttcatgtttggatggcggatccttttctgtttcaaatgctgtagacgcacacggggcctgtttaagtatagacacctcaaagatgacgaagagatcgggtaccgcaagattatcgaaagactgaagaataaaaaggggaaaaacaagctcctggatggcgagcggcttgccgaccgcaaaattgctgaactgttcagcaccaagacacatatcggc

SEQ ID NO: 13778 - RNA, 3495 nt, synthetic construct
  misc_feature 1..3495: note = derived and/or modified CDS sequence (opt5) from CCHVF(CCHVF SPU 556/87)__KJ682811.1__Gn-NSm-Gc
  source 1..3495: mol_type = other RNA
agcgaggaatccgacggcgattgcatctctagaacccagctgctccggacagagacggccgaaattcacagcgacaactacgggggacccggcgataagatcaccatttgtaatgggtccacaatcgtggaccaacgcctgggatctgagcttggctgctataccattaacagagtcaagagcttcaaactgtgtgaaaattccgctacagggaaatcttgcgagatcgatagcacccctgttaagtgtcggcagggattttgcctcaaaatcacacaggagggccgcggccatgtgaagctgtccagagggagcgaaattgtgcttgacgcctgtgattcttcctgcgagatcatgattccgaagggaaccggcgacatcctggtcgattgtagcgggggacagcaacacttcctcaaagacaacctgattgatctgggctgccccaatatccctctcctggggcggatggcgatttacatctgtcgcatgtctaaccatcccaagacgaccatggcttttcttttctggttttccttcggatatgtgatcacatgcattctgtgcaaagttatcttttacctcctgattgtggccggcaccgtcggcaagaaattcaagcagtatagagaacttcggcctcagacatgtaccatctgcgagacgacacccgtgaatgccattgacgctgagatgcacgatctgaactgtagctacaatatctgcccttattgtgcctctcgcctcacctccgacgggctggctagacatgttatgcagtgcccgaagcggaaagaaaagatcgaggaaacagagctgtacctcaacctggaacgcattccctgggtggtcagaaaacttctgcaagtgagcgagtccaccggagtggccctcaagcggtctagctggctgaccgtccttctggttctcctgatcgtgtccctgagccctgtgcagtctgcgcccattggccacgggaaaacaatcgagacgtaccaggcccgcgaaggatatacctccttttgtctcttcattctgggcagcatcctttttatcgtctcttgcctggtgaaggggctcattgacagcgttggaaattccttctttcctggcctgtctatctgtaaaacatgcagcattggctccgtgaacgggttcgagatcgaaagccacaagtgttactgctctcttttctgctgtccctattgcagacattgttccgctgatcgggagattcacaagctgcatctcagcatctgcaaaaagagaaaaaccggatctaatgtcatgtccgccgtgtgtaagcgcatgtgctttcgggctacaattgaagttagcaacagagccctgctgatccgctccatcattaataccacgttcgcggtgtgtatcctcacactggccgtctgcgtggtctctaccagcgctgtggagatggagtcccttccggccggcacctgggaacgggaggaagacctgacaaacttttgtcaccaggagtgccaagttaccgaaacagagtgtctctgcccttacgaggctctggtgctgagaaaaccccttttcctcgattctattgtcaaggggaagaaaaacctgctgaatagcacgtccctcgaaaccagcctgtctatcgaggccccttggggagccattaacgtgcagtccacatttaagcccaccgttagcgctgcgaatatcgccctttcttggtccagcgtggaacaccgcggcaacaaaatcctggtctctgggcggagcgagtccattatgaagctcgaggaaagaacaggcatcagctgggacctgggagtggaggatgcttctgaatccaaactgcttaccgtgagcgttatggacctctcccagatgtattctcccgtcttcgagtacctgagcggcgatcgccaagtggaagagtggcctaaggccacgtgcaccggggactgtccggagcggtgcggatgtacatcctctacctgcctgcataaggaatggccccacagcagaaattggcgctgtaaccctacatggtgctggggcgtggggaccggatgtacgtgctgtggcctcgatgtcaaagacctgtttacagattatatgttcgtgaagtggaaagttgagtacattaagaccgaagccatcgtgtgcgtcgagcttacatcccaggaacggcagtgttctctgattgaggctgggaccagatttaatctcggccccgtgaccatcacactgagcgagcctcggaacatccagcaaaaactgcccccggaaattatcacgcttcatcctcgcattgaggaaggattctttgacctcatgcacgttcagaaggtgctgtccgccagcaccgtctgcaagctgcagtcttgcacacatggcgtgcccggggacctccaggtttaccacatcggaaatctgcttaaaggcgataaggtgaacgggcacctgattcataaaatcgagcctcacttcaatacctcctggatgagctgggacggatgtgatctcgactattactgcaacatgggcgattggccctcttgtacatataccggggtcacgcaacataatcacgcggcttttgtgaacctgctgaatatcgaaacagactacaccaagaacttccacttccattccaaaagagtgaccgcccacggcgatacacctcagcttgacctcaaggcccggcccacctatggagctggcgaggtcacagttctggtggaggtggccgatatggaactgcatacgaaaaagattgagatcagcgggctcaagtttgcttctctgtcctgcaccggatgttacgcctgcagctccggcattagctgtaaagtcagaatccacgtggacgaaccggatgagcttacagttcatgtgaagtctgaggaccctgatattgtcgcggccgggagctccctgatggctcgcaaactcgagttcggagccgactctacctttaaggctttcagcgccatgcccaaaacatccctgtgcttttatatcgtggaacgggaatactgtaagtcttgcagcagagaggacacccagaagtgtgttaacacgaaactggaacgcccccagtccattcttatcgagcacaagggcaccatcattgggaaacaaaatgatacatgcaccgcgaaggcctcttgctggctggagagcgtgaaatccttcttttacggcctcaagagcatgctgtctggaatcttcggcaacgtctttattgggatcttcctctttattgctcctttcgtgctgcttatcctgtttttcatgttcggatggagaatcctcttttgtttcaagtgctgtcggcgcacaagaggcctgtttaaatatcggcacctgaaggacgatgaagagaccgggtaccgcaaaattatcgaaagacttaataacaagaaaggaaagaataagctgctcgacggcgagcggctggccgatcgcaaaattgctgaactcttctccacaaagagccatatcggc

SEQ ID NO: 13779 - RNA, 3495 nt, synthetic construct
  misc_feature 1..3495: note = derived and/or modified CDS sequence (opt5) from CCHVF(CCHVF SPU 431/85)__KJ682812.1__Gn-NSm-Gc
  source 1..3495: mol_type = other RNA
agcgaggaatccgacggcgattgcatctctagaacccagctgctccggacagagacgaccgaaattcacagcgacaactacgggggacccggcgataagatcacaatttgtaatgggtccaccatcgtggaccaacgcctgggatctgagcttggctgctatacaattaacagagtcaagagcttcaagctgtgtgaaaattccgccaccgggaaatcttgcgagatcgatagcacacctgttaagtgtcggcagggattttgcctcaaaatcacccaggagggccgcggccatgtgaagctgtccagagggagcgaaattgtgcttgacgcttgtgattctaactgcgagatcatgattccgaagggaacgggcgacatcctggtcgattgttccgggggacagcaacacttcctcaaagacaatctgattgatctgggctgccccaacatccctctcctggggaagatggccatttacatctgtcggatgagcaatcatcccaaaaccacaatggcgtttcttttctggttttctttcggatatgtgattacctgcatcctgtgcaaggttatcttttacctcctgattgtggctggcacagtcggcaaaaagttcaagcagtatcgcgaacttagacctcagacctgtacgatctgcgagacaattcccgtgaacgccatcgacgccgagatgcacgatctgaattgttcctacaacatctgcccttattgtgctagccggctcacctctgacgggctggcccgccatgttatgcagtgcccgaaaagaaaggaaaaagtggaggaaacagagctgtacctcaatctggaacggattccctgggtcgtgcgcaaacttctgcaagtgtccgagagcaccggagtcgctctcaaaagatcctcttggctgaccgttcttctggtgctcctgatcgtgagcctgtcccctgtccagagcgcccccattggccacgggaagacaatcgagacgtaccaggcgcgggaaggatatacctctttttgtctcttcattctgggctccatcctttttgtggttagctgcctggtgaaagggctcatcgactctgtcggaaacagcttctttcctggcctgtccatttgtaagacatgctctatcggcagcattaatgggttcgagatcgaatcccacaagtgttactgcagccttttctgctgtccctattgccgccattgtccggccgatagagagattcacaaactgcatctctctatctgcaagaaacggaagaccggatccaacgtgatgctggctgtttgtaaaagaatgtgctttcgcgccacaattgaagtgagcaatcgggctctgctcatcagaaacatcattaacaccacgttcgtcgtgtgtatcctgacacttgccgtctgcgtggtttctacctccgcggtggagatggagagcctgcctgccggcacctgggaaaaggaggaagacctcacaaatttttgtcaccaggagtgccaagtcaccgaaacagagtgtctgtgcccctacgaggctctggtgcttcgcaagcctctcttcctggattccattgttaaagggcggaagaacctgctcaattctacgagcctggaaacctccctttctatcgaggccccctggggagctattaacgtgcagagcacatttaaacccaccgtctccgccgccaatatcgctctgagctggtcttccgtggaacacagaggcaacaagatcctcgtgagcgggcgctctgagtccattatgaaactggaggaacggacaggcatcagctgggacctgggagttgaggatgcgtctgaaagcaaacttctcaccgtctccgtgatggacctgagccagatgtattctcctgtgttcgagtacctgtccggcgatagacaagtcgaagagtggccgaaggccacgtgcaccggggactgtcccgagcgctgcggatgtacaagctctacctgcctccataaagaatggcctcactctcggaattggagatgtaaccccacatggtgctggggcgtggggaccggatgtacgtgctgtggcctggatgttaaggacctttttacagattatatgttcgtgaaatggaaggtcgagtacattaaaaccgaagctatcgtgtgcgttgagctgacaagccaggaacgccagtgttccctcattgaggccgggacccggtttaatctgggccctgtgaccatcacactgtctgagcccagaaacatccagcaaaaacttccgcctgaaattatcacgctccatccccggattgaggaaggattctttgacctgatgcacgtccagcgcgtgctgagcgcctccaccgtttgcaagctccagtcttgcacacatggcgtgcctggggacctgcaggtctaccacatcggaaatcttctgaagggcgataaggtgaacgggcacctcattcataaaatcgagccccacttcaataccagctggatgtcctgggacggatgtgatctggactattactgcaacatgggcgattggcctagctgtacatataccggggtgacgcaacataatcacgctgcctttgtcaacctgcttaacatcgaaacagactacaccaagaatttccacttccattctaaaagagttaccgcgcacggcgatacaccccagctcgacctgaaggctcggccgacctatggagccggcgaggtgacagtgctggtcgaggtggccgatatggaactccatacgaaaaagattgagatctccgggctgaagtttgctagccttacctgcacaggatgttacgcctgctcctccggcattagctgtaaagttaagatccacgtggacgaacctgatgagctgaccgtccatgtgaaatctgaggaccccgatattgttgctgccgggtccagcctcatggcgagaaagctggagttcggagccgactccacatttaaggctttcagcgccatgcccaagacctctctgtgcttttatatcgtggaacgcgaatactgtaagagctgctcccgggaggacacgagaaaatgtgtcaacaccaaacttgatcgccctcagtctattctgatcgaacacaagggcacaatcattgggaagcagaataatacctgcacagctaaagccagctgctggctcgagtccgtgaagtctttcttttacggcctgaagaacatgctcagcggaatcttcggcaacgtttttattgggatcttcctgtttattgcgccgttcgtgcttctgatcctctttttcatgttcggatggagaatcctgttttgtttcaaatgctgtcggcgcaccagaggcctgtttaagtatcggcaccttaaagacgatgaggaaacagggtaccgcaagattatcgagagactgaataacaaaaagggaaagaataaactcctggacggcgaacggctcgccgatcgcaagattgctgagctgttctccaccaaatctcatatcggc

SEQ ID NO: 13780 - RNA, 3495 nt, synthetic construct
  misc_feature 1..3495: note = derived and/or modified CDS sequence (opt5) from CCHVF(CCHVF SPU 48/90)__KJ682813.1__Gn-NSm-Gc
  source 1..3495: mol_type = other RNA
agcgaggaaccctccgacgattgcatctctagaacccagctgctccggacagagacggccgaaattcacggcgacaactacgggggacctggcgataagatcaccatttgtaatgggagcacaatcgtggaccaacgcctgggatccgagcttggctgctataccattaacagagtcaaatctttcaagctgtgtgaaaatagcgctacagggaaatcctgcgttatcgattctgtgccggtgaagtgtcggcagggatactgcctccgcatcacccaggagggcagaggccatgtcaaactgagccgggggtccgaggtggttcttgacgcctgtgatacaagctgcgaaattatgatccccaagggaaccggcgacattctggtggattgttctgggggacagcaacactttctcaaggacaacctgatcgatctgggctgccctaaaattcccctcctggggaagatggcgatctatatttgtcgcatgtccaatcatcctacgaccacaatggctttcctgttttggttcagctttggatacgtcattacctgcatcctttgcaaagccattttctatctcctgatcattatcggcacacttggcaagagatttcggcagtaccgcgagctgaaaccccagacctgtacgatttgcgaaacaacccctgtgaacgccatcgacgctgagatgcacgatctcaattgttcttataacatctgcccgtactgtgcctccagactgacaagcgacgggctggctcggcatgttacccagtgccccaagcgcaaggagaaagtggaagagaccgaactctacctgaatcttgagagaatcccttgggtcgtgcggaagctgctccaagtgtctgaatccacaggagtcgccctgaaacgcagctcctggcttatcgttctgctcgtgctgttcacggtgtctctgagccccgtccagtccgcgcctattggccacgggaagaccatcgaggcctatagagctcgggagggatacacaagcatttgtctctttgtgctgggctctatccttttcgttgtgtcctgcctgatgaaaagactcgtcgacagcgtggggaacagctttttccccggactgagcatctgtaagacctgctccatttctagcatcaatggctttgaaattgagtcccacaaatgttattgcagccttttctgctgtccgtactgccgccattgttctgccgataaggaaatccacaagctgcatctctccatttgcaaaaagcggaaaacaggcagcaacgttatgctggctgtgtgtaagagaatgtgcttccgcgccaccatggaggtctctgaccgggcgctgtttatcagatccattatcaatacgacattcgtgctctgtatcctgattcttgccgtctgcgtggttagcacctccgctgtggaaatggagaacctgcctgccgggacctgggagcgcgaagaggatctcacaaatttttgtcaccaggaatgccaggtcaccgagacagaatgtctgtgcccctatgaggctctggtgcttcggaaacctctcttcagagactctatcgttaagggaatgaagaacctgctgaacagcacgtccctcgagacctctctgagcattgaagccccctggggcgccatcaatgtgcaatccacatacaaacccaccgtcagcacagctaacattgcgctttcttggtccagcgtggagcaccgcgggaataagatcctggtgtctggacggtccgaaagcatcatgaaactcgaggagagaaccggcatttcttgggatctgggggttgaagacgccagcgagtccaagctgcttacggtcagcgtgatggatctctctcagatgtattcccctgtgtttgaatacctgagcggcgaccgccaggtcgaggaatggccgaaagctacctgcacaggagattgtcccgagcggtgcggctgtacctcctctacatgcctgcataaggagtggcctcacagcagaaactggcggtgtaatcccacctggtgctggggagtggggacgggctgtacatgctgtgggctcgacgttaaggatctgttcaccgactacatgtttgtgaaatggaaggtcgaatatatcaaaacagaggccattgtgtgcgttgaacttacctcccaagagcgccagtgttctctgatcgaagccggaaccagattcaacctcggccctgtgacaattacgctgagcgagccccggaatatccagcagaagctgccgcctgagatcattacccttcatcccagaatcgaagaggggtttttcgacctcatgcacgtccaaaaagtgctgtccgcttctacagtttgcaagctgcagagctgcacccatggcgtgcctggagatctccaggtctaccacattggcaacctgcttaagggggacaaagtgaatggacacctgatccataagattgaaccccactttaacacatcctggatgagctgggatggctgtgacctcgattattactgcaatatgggggactggccttcttgtacctatacgggagtgacacagcataaccgcgcctccttcgtcaatctgctgaacatcgagaccgattacaccaaaaattttcacttccacagcaagcgggttacagcgcatggcgacacaccccaacttgatctcaaagctagaccgacctatggggccggcgaaatcacggtgctggtggaggtcgccgacatggagctgcacaccaagaaaattgaaatctctggactcaagttcgcttccctgacatgcaccggctgttacgcctgcagctctgggatttcctgtaaggtgcgcatccatgttgatgagcctgacgaacttacagtgcacgtcaaaagcgatgaccccgacgtggttgctgcctccagctctctgatggcgagaaagctcgagtttggaaccgatagcacgttcaaagccttttccgctatgcccaagacctctctgtgcttctacattgtggagaaagaatattgtaagagctgctccgaggaagacacaaagaaatgtgtcaacaccaagctggagcagcctcagtctatccttattgaacataaaggcacaatcatcgggaagcagaactctacctgcacagccaaagtgtcctgctggctggagtctgctaagagctttttctacggactcaaggatatgctgtccggcatttttgggaatgttttcatcggcatttttctcttcctggccccgtttatccttctgattctcttctttatgttcggatggcggatcctgctgtgtttcaaatgctgtcgcagaacccggggcctttttaagtatcgccacctgaaagacgatgaggaaacggggtacagacggatcattgagcgcctcaacaataagaaaggaaagaacaagctgctcgacggcgaaagactggcggatcggcgcatcgccgagcttttcagcacaaaaacccacattggg

SEQ ID NO: 13781 - RNA, 3495 nt, synthetic construct
  misc_feature 1..3495: note = derived and/or modified CDS sequence (opt5) from CCHVF(CCHVF SPU 187/90)__KJ682814.1__Gn-NSm-Gc
  source 1..3495: mol_type = other RNA
agcgaggaaccctccgacgattgcatctctagaacccagcttctccggacagagacggccgaaattcacggcgacaactacgggggacctggcgataagatcaccatttgtaatgggagcacaatcgtggaccagcgcctgggatccgagcttggctgctataccattaacagagtcaaatctttcaagctgtgtgaaaatagcgctacagggaaatcctgcgagatcgattctgttccggtgaagtgtcggcagggatactgcctccgcatcacccaggagggcagaggccatgtgaaactgagccgggggtccgaagtcgtgcttgacgcctgtgatacaagctgcgagattatgatccccaagggaaccggcgacattctggttgattgttctgggggacagcaacactttctcaaggacaacctgatcgatctgggctgccctaaaattcccctcctggggaagatggcgatctatatttgtcgcatgtccaatcatcctaaaacgaccatggctttcctgttttggttcagctttggatacgtgatcacatgcatcctgtgcaaggccattttctatctcctgatcattatcggcacccttggcaaaagatttaagcagtaccgggaactgaagccccagacatgtaccatttgcgagacgacacctgtcaacgccatcgacgctgagatgcacgatctcaattgttcttataacatctgcccgtactgtgcctcccgcctgaccagcgacgggctggctagacatgtgacacagtgccccaaacggaaggaaaaagttgaggaaaccgagctctacctgaatcttgaacgcattccttgggtggtcagaaagctgctccaagtgtctgagtccaccggagtggccctgaaacggagctcctggcttatcgtcctgctcgttctgttcacagtgtctctgagccccgtgcagtccgcgcctattggccacgggaagacgatcgaggcctatcgcgctagagaaggatacaccagcatttgtctctttgtcctgggctctatccttttcgtggtttcctgcctgatgaaagggctcgtggacagcgtcggaaactcctttttccccggcctgagcatctgtaagacatgctccattggctctatcaatgggtttgagattgaaagccacaagtgttattgctcccttttctgctgtccgtactgccggcattgtagcgccgataaagagatccacaagctgcatctctctatttgcaaaaagagaaaaaccggatccaacgtgatgctggctgtttgtaagcgcatgtgcttccgggccacaatggaagtgagcaatagagcgctgtttatccgctctattatcaacaccacgttcgtcctctgtatcctgattcttgccgtgtgcgtcgtgtccacaagcgctgttgagatggagaatctgcctgccggcacctgggaacgggaggaagacctcaccaacttttgtcaccaggagtgccaggtgacagaaaccgagtgtctgtgcccctatgaggctctggtccttagacgccctctcttcctggattccatcgtgaaggggatgaaaaacctgctcaattctacaagcctggaaacgtccctttctattgaggccccctggggagccatcaacgttcaaagcacctacaagcccacagtgtccaccgctaatattgcgctgagctggtcttccgtcgaacaccggggcaacaaaatcctcgtgagcgggagatctgagtccatcatgaagctggaggaacgcacaggcattagctgggacctgggagtggaggatgcctctgaaagcaaacttctcaccgtttccgtcatggacctgagccagatgtattctcctgtgtttgagtacctgtccggcgatagacaggtggaagagtggccgaaggctacgtgcaccggggactgtcccgagcggtgcggatgtacaagctctacctgcctccataaggaatggcctcactctcgcaattggcggtgtaaccccacatggtgctggggcgtcgggaccggatgtacgtgctgtggcctggatgtgaaagaccttttcacagattacatgtttgttaagtggaaagtggagtatatcaagaccgaagccattgtctgcgtggagctgacaagccaagaaagacagtgttccctcatcgaggccgggacccggttcaatctgggccctgttaccattacactgtctgagccccgcaacatccagcagaaacttccgcctgaaatcattacgctccatcccagaatcgaggaaggatttttcgacctgatgcacgtgcaaaaggtcctgagcgcttccaccgtgtgcaagctccagtcttgcacacatggcgttcctggggaccttcaggtgtaccacattggaaatcttctgaaaggcgataaggtcaacgggcacctcatccataaaattgagccccactttaataccagctggatgtcctgggacggatgtgatctggactattactgcaacatgggcgattggcctagctgtacatataccggggtgacgcagcataatcacgcctctttcgtgaacctgcttaatatcgaaacagactacaccaagaactttcacttccattccaaacgggtcaccgcgcacggcgatacaccccaactcgacctgaaggctagaccgacctatggagccggcgagatcacagttctggtggaggtggccgatatggaactccatacgaaaaagattgagatcagcgggctgaagttcgcttctcttacctgcacaggatgttacgcctgctccagcggcatttcttgtaaagtccgcatccacgtggacgaacctgatgagctgaccgttcatgtgaagtccgacgatcccgacgtcgtggctgccagctccagcctcatggcgcggaaactggagtttgggacagactctattttcaaggcctttagcgctatgcccaaaacctccctgtgcttctacatcgttgaaagagagcactgtaagtcttgcagcgaagaggatacgaagaaatgtgtgaacaccaaacttgaacagcctcagtccattctgatcgagcacaagggaacaatcattggcaagcaaaattctacctgcacagccaaaaccagctgctggctcgagtccgtcaagagctttttctatgggctgaagaacatgctctctggcatctttggaaatgtgttcattggcatctttctgttccttgctccgtttattctgctcatcctgttctttatgttcgggtggcgcatcctgttctgttttaaatgctgtagacggacacgcggacttttcaagtacagacatctgaaagacgatgaagagaccggctatcggcgcattatcgaaagactcaacaataagaaagggaagaacaagctgctcgacggagagcggctggccgatcgcagaattgcggaactgttttccacgaaaacacacatcggc

SEQ ID NO: 13782 - RNA, 3495 nt, synthetic construct
  misc_feature 1..3495: note = derived and/or modified CDS sequence (opt5) from CCHVF(CCHVF Haskovo-V46/13)__KR092379.1__Gn-NSm-Gc
  source 1..3495: mol_type = other RNA
agcgaggaactgggcgacgattgcatctccagaacccagctcctgcggacagagacggccgaaattcacgacgataactacgggggacccggcgacaagatcaccatttgtaatgggtctacaatcgtggatcaacgccttggaagcgagctgggctgctataccattaacagagggaaatccttcaagctctgtgaaaattctgctacaggaaaaacctgcgagatcgacagcacacctgtcaagtgtcggcagggcttttgcctgaaaatcacccaggagggccgcgggcatgttaagctctccagaggatctgaagtggtgctggatgcctgtgacagctcctgcgaggtcatgattccgaagggcacgggggatatcctcgtggactgtagcggaggccagcaacacttcctgaaagataacctgattgacctcgggtgcccccatatccctctgcttggaaagatggcgatttacatctgtcggatgtctaatcacccccgcaccacaatggcttttctgttctggttttccttcggctatgttattacctgcatcttttgcaaagccctcttctacagcctgatcattatcggcacacttgggaagaaaattaagcagtatagagaactgaagcctcagacctgtacgatctgcgagacaacccccgtgaacgccattgatgctgagatgcatgacctcaattgttcttacaacatctgcccttattgtgcctcccggctgacaagcgacggactggctcgccacgtcacccagtgcccgaaaagaaaggaaaaagtggaggaaaccgagctctacctgaatcttgaacggatcccctggattgttcgcaagctgctccaagtgtctgagtccacaggcgtcgccctgaaaagaagctcctggcttatcgtgctgctcgtgctgctgcctgtctctctcagccccgttcagtccgcgcctgtggggcacggaaagacgattgagacctaccagacacgggaaggctttaccagcatctgtctgttcatgcttgggtctattctgtttatcgtgtcctgcctcgtcaaaggactggtggatagcgttggcgactctttctttcccggccttagcgtgtgtaagacatgctccatcgggtctattaacggattcgagatcgaaagccataagtgttattgctccctgttctgctgtccgtactgccgccactgtagcgccgatagagagattcatcagctccacctgtctatctgcaaaaagcggaaaaccggctccaatgtcatgctggctgtgtgtaagagaatgtgctttcgcgccacgattgaagctagccggagagccctcctgatccgctctattatcaacacaaccttcgcgatgtgtatccttaccctgacaatttgcgttgtgtccaccagcgccgtcgagatggagaatctccctgctgggacatgggaacgggaggaagacctgacgaacttttgtcaccaagagtgccaggtgaccgaaacagagtgtctgtgcccctatgaggcccttgtcctcagaaaacctctgttcctggattccatcgtgaagggaatgaagaatctcctgaactctaccagccttgaaacatccctgtctattgaggctccctggggcgccatcaacgttcagagcacctttaaacccacggtgtccaccgccaatattgctctcagctggtcttccgtcgaacatcgcgggaacaagatcctggtgacaggccggagcgagtctatcatgaaactggaggaaagaaccggagtttcctgggaccttggcgtggaggatgcgagcgaatctaagctcctgacagtcagcattatggacctgtcccaaatgtacagccctgtgttcgagtatctctctggggatcgccaggtggaagagtggccgaaagctacctgcacgggagactgtcccgagcggtgcggctgtacatccagcacatgcctgcacaaggaatggcctcattccagaaattggcgctgtaaccccacctggtgctggggagttgggaccggctgtacctgctgtggggtcgatgtgaaggacctttttacagaccacatgttcgtgaaatggaaggtcgagtacatcaaaacggaagccattgtgtgcgttgagctgacctctcaggaacggcagtgtagcctcatcgaggccggcacaagatttaatctgggacctgtgaccattacactgtccgagccccggaacatccaacagaaacttccgcctgaaatcattaccctccatcccaagatcgaggaaggcttctttgatctgatgcacgtccagaaggtgctgtctgccagcacggtttgcaagctccagtcctgcacacacgggattcctggagacctgcaagtgtatcatatcggcaatcttctgaaaggggatcgcgtcaacggacacctcattcataagatcgagccccacttcaatacctcttggatgagctgggacggctgtgatctggactactactgcaacatgggggattggccttcctgtacctatacaggcgtgacccagcacaatcatgctgcctttgttaacctgcttaatatcgaaacagactacacgaaaaccttccacttccatagcaagagagtgacagcgcacggagatacaccccagctcgacctgaaagctcggccgacctatggcgccggggagattaccgtcctggtggaggtggccgatatggaactccatacgaagaaagtcgagatctctggactgaagtttgcttcccttacctgcacaggctgttacgcctgcagctctgggatttcctgtaaggttagaatccacgtggacgaacctgatgagctgaccgtgcacgtcaaaagctctgaccccgacgtggttgctgccggaacatccctcatggcgcgcaagctggagttcggcaccgatagcacatttaaagccttctccgctatgcccaagaccagcctgtgcttttatattgtggaacgggagtactgtaaatcttgcagcgaagacgatacgcagaagtgtgtcgacacaaaacttgagcaacctcagtccatcctgattgaacataaggggaccatcatcggcaagcagaacgatacctgcacagccagagcttcttgctggctcgagagcgtgaaatccttcttttatggactgaagaatatgctcggctctgttttcgggaactttctgattggaatccttctgttcctcgccccgtttgtgctgctggtccttttctttatgttcggctggaaaattctgttctgttttaagtgctgtcgcagaacccgggggcttttcaagtaccgccacctgaaagacgatgaggaaacgggatacagacggatcattgagcgcctcaacagcaagaaaggcaagaatagactgcttgacggcgaacggctggcggatcgcaaaatcgccgagctcttttccacaaagacccatatcggg

SEQ ID NO: 13783 - RNA, 3495 nt, synthetic construct
  misc_feature 1..3495: note = derived and/or modified CDS sequence (opt5) from CCHVF(CCHVF 24-R-2012)__KR814856.1__Gn-NSm-Gc
  source 1..3495: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacacgagctgcgaggtgatgattcccaagggaaccggcgatatcctggttgactgttccgggggacagcaacacttcctcaaagataacctgattgacctgggctgccctcatatccccctcctggggaagatggcgatttacatctgtcggatgagcaatcaccctcgcacaaccatggcttttcttttctggttttctttcggatatgtgattacatgcatcttttgcaaagccctgttctactccctcatcattatcggcaccctgggcaagaaaattaagcagtatagagaacttaagccccagacgtgtacaatctgcgagaccgcccctgtcaacgctattgatgccgagatgcatgacctgaattgtagctacaacatctgcccgtattgtgcttctcggctcacatccgacgggctggcccgccacgtgccccagtgccctaaaagaaaggaaaaagttgaggaaaccgagctgtacctcaatctggaacggatcccctggattgtgcgcaaacttctgcaagtcagcgagtctaccggagtggcgctcaagagatccagctggctgatcgtgcttctggtcctcctgacagtttccctgtctcctgtgcagagcgcccccgtgggccacgggaagacgattgagacctaccagacacgggaaggatttacctccgtctgtctcttcatgctgggcagcatcctttttctggtgtcttgcctcgttaaagggctggtggattccgtcagcgactctttctttccgggacttagcgtgtgtaagacatgctccattggctctatcaacggcttcgagatcgaaagccataagtgttattgctccctgttctgctgtccttactgccgccactgtagcgctgatagagagattcatcagctccacctgtctatctgcaaaaagcggaaaatggggtccaatgttatgctggccgtgtgtaagagaatgtgctttcgcgctaccattgaagccagccggagagcgctcctgatccgctctattatcaacacgacattcgtcatttgtatccttaccctgaccatctgcgtggtctccacaagcgccgtggagatggagaatctcccctccggaacctgggaacgggaggaagacctgacaaacttttgtcaccaagagtgccaggttacggaaaccgagtgtctgtgcccttatgaggctcttgtgctcagaaaacccctgttcctggattctattgtcaagggcatgaagaatctcctgaacagcacatcccttgaaacctctctgagcatcgaggccccctggggagctattaacgtgcagtccacatttaaacctaccgttagcacggccaatatcgccctctcttggtccagcgtggaacatcgcggaaacaagattctggtcaccggccggtctgagtccatcatgaaactggaggaaagaacaggggtgagctgggaccttggcgtggaggatgcttctgaaagcaagctcctgaccgtttccatcatggacctgagccaaatgtactctccggtcttcgagtatctctccggagatcgccaggtggaagagtggcccaaagcgacatgcaccggcgactgtcctgagcggtgcgggtgtacgagctccacatgcctgcacaaggaatggccccattctagaaattggcgctgtaaccctacctggtgctggggagtgggcacagggtgtacctgctgtggagtcgatgtgaaggacctttttaccgaccacatgttcgttaaatggaaggtggagtacattaaaacagaagccatcgtctgcgtggagctgacgagccaggaacggcagtgttccctcattgaggctggcaccagatttaatctggggcccgttacaatcaccctgtctgagccgcggaacattcaacagaaacttcctcccgaaatcatcacactccatcctaaggtggaggaaggcttctttgatctgatgcacgtccagaaggtgctgagcgcctccaccgtttgcaagctccagtcttgcacgcacgggattcccggcgacctgcaagtgtatcatatcgggaatcttctgaaaggagatcgcgtcaacggccacctcattcataagatcgagcctcacttcaatacaagctggatgtcctgggacgggtgtgatctggactactactgcaacatgggagattggcccagctgtacctataccggcgtgacacagcacaatcatgccgcttttgtgaacctgcttaatattgaaaccgactacacaaaaacgttccacttccattctaagagagtcaccgcccacggggatacaccgcagctcgacctgaaagcgcggcctacctatggcgctggagagatcacagttctggtggaggtggccgatatggaactccataccaagaaagtcgagatctccggcctgaagtttgccagccttgcttgcacggggtgttacgcctgttcttccggaattagctgcaaggtgagaatccacgttgacgaacccgatgagctgaccgtgcacgtcaaatctaacgaccccgacgtggttgctgcctccacaagcctcatggcgcgcaagctggagttcggcaccgattccacatttaaagccttcagcgctatgcctaagacctctctgtgcttttatattgtggaacgggagtactgtaaaagctgctccgaagaggacacacagaagtgtgtcgataccaaacttgaacaaccgcagtctatcctgattgagcataaggggacgatcattggaaagcagaatgacacatgcaccgccaaagctagctgctggctcgagtccgtgaagtctttcttttatggcctgaaaaacatgctcgggagcgttttcggcaactttttcatcggaatcctgctttttctggcccccttcgtgctcctggtcctgtttttcatgttcggctggaagattctgttttgtttcaagtgctgtagacgcaccagagggcttctcaaataccggctgctcaaggatgacgaagagacaggataccgcagaatcattgaacggctgaataacaaaaagggcaaaaatcgccttctggatggggagagactcgcggaccggaagatcgccgaactgttttccaccaagacgcacattgga

SEQ ID NO: 13784 - RNA, 3495 nt, synthetic construct
  misc_feature 1..3495: note = derived and/or modified CDS sequence (opt5) from CCHVF(CCHVF 36-ST-2014)__KR814857.1__Gn-NSm-Gc
  source 1..3495: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgcctgtgacagctcctgcgagattatgatccccaaaggaacgggcgatattctggtggactgtagcgggggacagcaacacttcctcaaggataacctgatcgacctgggctgccctcatattcccctcctggggaaaatggcgatctacatttgtagaatgtctaatcaccctcggaccacaatggcttttcttttctggttttccttcggatatgttattacctgcatcttttgcaaggccctgttctacagcctcattatcattggcacactgggcaaaaagatcaagcagtatcgcgaacttaaaccccagacctgtacgatttgcgagacagcccctgtgaacgctatcgatgccgagatgcatgacctgaattgttcttacaacatctgcccgtattgtgcttccagactcaccagcgacgggctggcccggcacgtcacacagtgccccaagcgcaaagaaaaggtggaggaaaccgagctgtacctcaatctggaaagaatcccttggatcgttcggaaacttctgcaagtgtctgagtccaccggagtcgcgctcaagcgcagctcctggctgattgtgcttctggtgctcctgacagtctctctgagccccgttcagtccgcccctgtgggccacgggaaaacgatcgagacctaccagacaagagaaggatttaccaacatttgtctcttcatgctgggcagcatcctttttatcgtgtcttgcctggtcaaggggctcgtggattccgttagcgactctttctttcccggactgagcgtgtgtaagacatgctccattggctctatcaatggcttcgagattgaaagccataaatgttattgctcccttttctgctgtccgtactgccggcactgtagcgctgatcgcgagatccatcagctgcacctcgggatttgcaagaaaagaaagaccggatctaacgtcatgctggccgtgtgtaaacggatgtgctttaaggctacgatcgaagcctccagacgcgcgctgctcattcggagcatcatcaatacaaccttcgttatttgtatcctgacccttgccatttgcgtggtctctacatccgctgtggagatggagaacctgcctgccggcacctgggaaagagaggaagacctcacaaatttttgtcaccaagagtgccaggtcagcgaaacggagtgtctgtgcccctatgaggctctggtgcttcgcaagcctctcttcctggattccatcgttaaagggatgaagaacctgctcaactctaccagcctggaaacatccctttctattgaggccccctggggagccatcaatgtgcagagcacctttaaacccacagtctccaccgctaacatcgcgctgagctggtcttccgtggaacatcggggcaataagattctcgttacggggagaagcgagtctatcatgaaactggaggaacgcaccggcgtgtcctgggacctgggagtcgaggatgccagcgaatctaaacttctcacagtgagcattatggacctgtcccaaatgtacagccctgtgttcgagtatctgtctggcgatcggcaggttgaagagtggccgaaggctacctgcacaggggactgtcccgagagatgcggatgtacctccagcacgtgcctccacaaggaatggcctcattcccgcaactggcggtgtaatcccacatggtgctggggcgtcgggaccggatgtacatgctgtggcgtggatgtgaaggacctgtttaccgaccacatgttcatcaaatggaaggtcgagtacattaaaaccgaagccatcgtgtgcgttgagcttacatctcaggaaagacagtgtagcctgatcgaggccgggacgcgctttaacctcggccctgtgaccattacactgtccgagccccggaatatccaacagaagctgccgcctgaaattatcacccttcatcccaagattgaggaaggattctttgatctcatgcacgtccagaaagtgctgtctgctagcacagtttgcaagctgcagtcctgcacccacggcatccctggggacctccaaatctatcatattggaaacctgcttaaaggcgatagactgaatgggcacctcatccataagattgagccccacttcaacacgtcttggatgagctgggacggatgtgatctggactactactgcaatatgggcgattggccttcctgtacatataccggggtgacccagcacaaccatgccgcgtttgtcaatctgcttaacatcgaaacagactacaccaaaacattccacttccatagcaagcgggtgacggctcacggcgatacaccccagctcgacctgaaagcccgcccgacctatggagccggcgagattaccgttctggtggaggtcgctgatatggaactccatacaaagaaggtggagatctctgggctgaaatttgcctcccttgcttgcaccggatgttacgcctgcagctctggcatttcctgtaaggtgagaatccacgtcgacgaacctgatgagctgacggttcacgtgaaaagctctgaccccgacgtggtcgcggcctccaccagcctcatggctcggaagctggagttcgggacagattccacctttaaagccttcagcgctatgcccaagacatctctgtgcttttatatcgtggaaagagagtactgtaagagctgctccgaagacgataccaaaaagtgtgttgacacaaaacttgatcagcctcaatctattctgatcgagcataagggaaccattatcggcaaacagaatgacacgtgcacagccaaggcgagctgctggctcgaatccgtgaagtctttcttttatgggctgaaaaacatgctcggcagcgtcttcggaaactttttcgtgggcattctgctttttctggccccgttcgttctcctggtgctgtttttcatgtgtgggtggaagttcctgttttgcttcaaatgttgccgccggaccagaggactgtttaagtaccgccacctcaaagatgacgaggagaccggctacagacggatcatcgaacgccttaattccaagaaggggaaaaacagactcctggatggagagcggcttgctgaccgcaagattgccgaactgttctctacaaaaagccatatcggc

SEQ ID NO: 13785 - RNA, 3495 nt, synthetic construct
  misc_feature 1..3495: note = derived and/or modified CDS sequence (opt5) from CCHVF(CCHVF 37-R-2013)__KR814858.1__Gn-NSm-Gc
  source 1..3495: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacacgagctgcgaggtgatgattcccaagggaaccggcgatatcctggttgactgttccgggggacagcaacacttcctcaaagataacctgattgacctgggctgccctcatatccccctcctggggaagatggcgatttacatctgtcggatgagcaatcaccctcgcacaaccatggcttttcttttctggttttctttcggatatgtgattacatgcatcttttgcaaagccctgttctactccctcatcattatcggcaccctgggcaagaaaattaagcagtatagagaacttaagccccagacgtgtacaatctgcgagaccgcccctgtcaacgctattgatgccgagatgcatgacctgaattgtagctacaacatctgcccgtattgtgcttctcggctcacatccgacgggctggcccgccacgtgccccagtgccctaaaagaaaggaaaaagttgaggaaaccgagctgtacctcaatctggaacggatcccctggattgtgcgcaaacttctgcaagtcagcgagtctaccggagtggcgctcaagagatccagctggctgatcgtgcttctggtcctcctgacagtttccctgtctcctgtgcagagcgcccccgtgggccacgggaagacgattgagacctaccagacacgggaaggatttacctccgtctgtctcttcatgctgggcagcatcctttttctggtgtcttgcctcgttaaagggctggtggattccgtcagcgactctttctttccgggacttagcgtgtgtaagacatgctccattggctctatcaacggcttcgagatcgaaagccataagtgttattgctccctgttctgctgtccttactgccgccactgtagcgctgatagagagattcatcagctccacctgtctatctgcaaaaagcggaaaatggggtccaatgttatgctggccgtgtgtaagagaatgtgctttcgcgctaccattgaagccagccggagagcgctcctgatccgctctattatcaacacgacattcgtcatttgtatccttaccctgaccatctgcgtggtctccacaagcgccgtggagatggagaatctcccctccggaacctgggaacgggaggaagacctgacaaacttttgtcaccaagagtgccaggttacggaaaccgagtgtctgtgcccttatgaggctcttgtgctcagaaaacccctgttcctggattctattgtcaagggcatgaagaatctcctgaacagcacatcccttgaaacctctctgagcatcgaggccccctggggagctattaacgtgcagtccacatttaaacctaccgttagcacggccaatatcgccctctcttggtccagcgtggaacatcgcggaaacaagattctggtcaccggccggtctgagtccatcatgaaactggaggaaagaacaggggtgagctgggaccttggcgtggatgacgcttctgagagcaagctcctgaccgtttccatcatggatctgagccaaatgtactctccggtcttcgaatatctctccggagaccgccaggtggaggaatggcccaaagcgacatgcaccggcgattgtcctgagcggtgcgggtgtacgagctccacatgcctgcacaaggagtggccccattctagaaattggcgctgtaaccctacctggtgctggggagtgggcacagggtgtacctgctgtggagtcgacgtgaaggacctttttaccgatcacatgttcgttaaatggaaggtggaatacattaaaacagaggccatcgtctgcgtggaactgacgagccaggagcggcagtgttccctcattgaagctggcaccagatttaatctggggcccgttacaatcaccctgtctgagccgcggaacattcaacagaaacttcctcccgagatcatcacactccatcctaaggtggaagagggcttctttgacctgatgcacgtccagaaggtgctgagcgcctccaccgtttgcaagctccagtcttgcacgcacgggattcccggcgatctgcaagtgtatcatatcgggaatcttctgaaaggagaccgcgtcaacggccacctcattcataagatcgaacctcacttcaatacaagctggatgtcctgggatgggtgtgacctggattactactgcaacatgggagactggcccagctgtacctataccggcgtgacacagcacaatcatgccgcttttgtgaacctgcttaatattgagaccgattacacaaaaacgttccacttccattctaagagagtcaccgcccacggggacacaccgcagctcgatctgaaagcgcggcctacctatggcgctggagaaatcacagttctggtggaggtggccgacatggagctccataccaagaaagtcgaaatctccggcctgaagtttgccagccttgcttgcacggggtgttacgcctgttcttccggaattagctgcaaggtgagaatccacgttgatgagcccgacgaactgaccgtgcacgtcaaatctaacgaccccgatgtggttgctgcctccacaagcctcatggcgcgcaagctggagttcggcaccgactccacatttaaagccttcagcgctatgcctaagacctctctgtgcttttatattgtggagcgggaatactgtaaaagctgctccgaggaagatacacagaagtgtgtcgacaccaaacttgagcaaccgcagtctatcctgattgaacataaggggacgatcattggaaagcagaatgtgacatgcaccgccaaagctagctgctggctcgagtccgttaagtctttcttttatggcctgaaaaacatgctcgggagcgtgttcggcaactttttcatcggaatcctgctttttctggcccccttcgtcctcctggtgctgtttttcatgttcggctggaagattctgttttgtttcaagtgctgtagacgcaccagagggcttctcaaataccggctgctcaaggatgacgaggaaacaggataccgcagaatcattgagcggctgaataacaaaaagggcaaaaatcgccttctggatggggaaagactcgcggaccggaagatcgccgagctgttttccaccaagacgcacattgga

SEQ ID NO: 13786 - RNA, 3495 nt, synthetic construct
  misc_feature 1..3495: note = derived and/or modified CDS sequence (opt5) from CCHVF(CCHVF 44-ST-2010)__KR814859.1__Gn-NSm-Gc
  source 1..3495: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgcctgtgacagctcctgcgagattatgatccccaaaggaacgggcgatattctggtggactgtagcgggggacagcaacacttcctcaaggataacctgatcgacctgggctgccctcatattcccctcctggggaaaatggcgatctacatttgtagaatgtctaatcaccctcggaccacaatggcttttcttctgtggttctcctttggatatgttattacctgcatcttctgcaaggccctcttttacagcctgattatcattggcacacttggcaaaaagatcaagcagtatcgcgaactgaaaccccagacctgtacgatttgcgagacagcccctgtgaacgctatcgatgccgagatgcatgacctcaattgttcttacaacatctgcccgtattgtgcttccagactgaccagcgacgggctggcccggcacgtcacacagtgccccaagcgcaaagaaaaggtggaggaaaccgagctctacctgaatcttgaaagaatcccttggatcgttcggaaactgctccaagtgtctgagtccaccggagtcgcgctgaagcgcagctcctggcttattgtgctgctcgtgctgctgacagtctctctcagccccgttcagtccgcccctgtgggccacgggaaaacgatcgagacctaccagacaagagaaggattcaccaacatttgtctgtttatgcttggcagcatcctgttcatcgtgtcttgcctcgtcaaggggctggtggattccgttagcgacagctttttccccggactttctgtgtgtaagacatgctcctttggctctattaatggcttcgagatcgaaagccataaatgttattgctccctgttctgctgtccgtactgccggcactgtagcgctgatcgcgagattcatcagctccacctggggatctgcaagaaaagaaagaccggatctaacgtcatgctggccgtgtgtaaacggatgtgctttaaggctacgattgaagcctccagacgcgcgctcctgatccggagcattatcaatacaaccttcgttatctgtattcttaccctggccatctgcgtggtctctacatccgctgtggagatggagaacctccctgccggcacctgggaaagagaggaagacctgacaaatttttgtcaccaagagtgccaggtcagcgaaacggagtgtctgtgcccctatgaggctcttgtgctccgcaagcctctgttcctggattccattgttaaagggatgaagaacctcctgaactctaccagccttgaaacatccctgtctatcgaggccccctggggagccattaatgtgcagagcacctttaaacccacagtctccaccgctaacatcgcgctcagctggtcttccgtggaacatcggggcaataagatcctggttacggggagaagcgagtctattatgaaactggaggaacgcaccggcgtgtcctgggaccttggagtcgaggatgccagcgaatctaagctcctgacagtgagcatcatggacctgtcccaaatgtacagccctgtgttcgagtatctctctggcgatcggcaggttgaagagtggccgaaggctacctgcacaggggactgtcccgagagatgcggatgtacctccagcacgtgcctgcacaaagaatggcctcattcccgcaactggcggtgtaatcccacatggtgctggggcgtcgggaccggatgtacatgctgtggcgtggatgtgaaggacctttttaccgaccacatgttcattaaatggaaggtcgagtacatcaaaaccgaagccattgtgtgcgttgagctgacatctcaggaaagacagtgtagcctcatcgaggccgggacgcgctttaacctgggccctgtgaccatcacactgtccgagccccggaatattcaacagaaacttccgcctgaaatcattaccctccatcccaagatcgaggaaggattctttgatctgatgcacgtccagaaggtgctgtctgctagcacagtttgcaagctccagtcctgcacccacggcattcctggggacctgcaaatctatcatatcggaaaccttctgaaaggcgatagactcaatgggcacctgattcataagatcgagccccacttcaacacgtcttggatgagctgggacggatgtgatctggactactactgcaatatgggcgattggccttcctgtacatataccggggtgacccagcacaaccatgccgcgtttgtcaatcttctcaacattgaaacagactacaccaaaacattccacttccatagcaagcgggtgacggctcacggcgatacaccccagctggacctgaaagcccgcccgacctatggagccggcgagatcaccgttctcgtggaggtcgctgatatggaactgcatacaaagaaggtggagatttctgggcttaaatttgcctccctggcttgcaccggatgttacgcctgcagctctggcatctcctgtaaggtgcggattcacgtcgacgaacctgatgagctcacggttcacgtgaaaagctctgaccccgacgtggtcgcggcctccaccagcctgatggctagaaagctggagttcgggacagattccacctttaaagccttcagcgctatgcccaagacatctctttgcttttatatcgtggaaagagagtactgtaagagctgctccgaagacgataccaaaaagtgtgttgacacaaaactggatcagcctcaatctatcctcattgagcataagggaaccatcattggcaaacagaatgacacgtgcacagccaaggcgagctgctggctggaatccgtgaagtctttcttttatgggctcaaaaacatgctgggcagcgtcttcggaaactttttcgtgggcatccttctgtttctcgccccgttcgttctgctggtgctgtttttcatgtgtgggtggaagattcttttctgctttaaatgttgccgccggaccagaggactcttcaagtaccgccacctgaaagatgacgaggagaccggctacagacggatcatcgaacgcctcaattccaagaaggggaaaaacagactgcttgatggagagcggctggctgaccgcaagattgccgaactcttttctacaaaaagccatatcggc

SEQ ID NO: 13787 - RNA, 3495 nt, synthetic construct
  misc_feature 1..3495: note = derived and/or modified CDS sequence (opt5) from CCHVF(CCHVF 46-ST-2012)__KR814860.1__Gn-NSm-Gc
  source 1..3495: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacagctcctgcgaggtgatgattcccaagggaacgggcgatatcctggttgactgtagcgggggacagcaacacttcctcaaagataacctgattgacctgggctgccctcatatccccctcctggggaagatggcgatttacatctgtcggatgtctaatcaccctcgcaccacaatggcttttcttttctggttttccttcggatatgtgattacctgcatcttttgcaaagccctgttctacagcctcatcattatcggcacactgggcaagaaaattaagcagtatagagaacttaagccccagacctgtacgatctgcgagacagcccctgtcaacgctattgatgccgagatgcatgacctgaattgttcttacaacatctgcccgtattgtgcttcccggctcaccagcgacgggctggcccgccacgtgccccagtgccctaaaagaaaggaaaaagttgaggaaacagagctgtacctcaatctggaacggatcccctggattgtgcgcaaacttctgcaagtctctgagtccaccggagtggcgctcaagagaagctcctggctgatcgtgcttctggtcctcctgaccgtttctctgagccctgtgcagtccgcccccgtgggccacgggaagacaattgagacgtaccagacccgggaaggatttacaagcatctgtctcttcatgctgggctctattctttttctggtctcctgcctcgtgaaagggctggttgatagcgtgtctgacagcttctttccgggactttccgtctgtaagacctgctctatcggcagcatcaacggcttcgagattgaatcccataagtgttattgcagcctgttctgctgtccttactgccgccactgttctgctgatagagagatccatcagctccacctgtccatttgcaaaaagcggaaaacagggagcaatgtgatgctggccgtttgtaagagaatgtgctttcgcgctaccatcgaagcctctcggagagcgctcctgattcgctccatcattaacgccacgttcgtgatctgtatccttacactgaccatttgcgtcgtgagcacctccgctgtcgagatggagtctctccccgccggaacatgggaacgggaggaagacctgaccaatttttgtcaccaagagtgccaggtgacagaaacggagtgtctgtgcccttatgaggctcttgttctcagaaaacccctgttcctggatagcatcgtgaagggcatgaagaacctccttaattccacctctcttgaaacaagcctgtccattgaggccccctggggagccatcaacgtccagagcacctttaaacctacagtgtctaccgctaacattgcgctctcctggagctctgttgaacatcgcgggaataagatcctggtgacgggccggtccgagagcatcatgaaactggaggaaagaaccggggtctcttgggaccttggcgtggaggatgccagcgaatccaagctcctgacagtgagcattatggacctgtctcaaatgtactccccggttttcgagtatctcagcggagatcgccaggtcgaagagtggcccaaagctacctgcacaggcgactgtcctgagcggtgcgggtgtacctcctctacgtgcctgcacaaggaatggccccatagcagaaactggcgctgtaatcctacatggtgctggggagtgggcaccgggtgtacatgctgtggagtggatgtcaaggacctttttaccgaccacatgttcgtgaaatggaaggttgagtacatcaaaaccgaagccattgtgtgcgtcgagctgacatcccaggaacggcagtgttctctcatcgaggccggcacgagatttaacctggggcccgtgaccattacactgagcgagccgcggaatatccaacagaaacttcctcccgaaatcattaccctccatcctaaggttgaggaaggcttctttgatctgatgcacgtgcagaaggtcctgtccgcttctacagtgtgcaagctccagagctgcacccacggaatccccggcgacctgcaagtttatcatattgggaaccttctgaaaggagatcgcatcaatggccacctcattcataagatcgagcctcacttcaacacgtcctggatgagctgggacgggtgtgatctggactactactgcaatatgggagattggccctcttgtacatataccggcgtgacccagcacaaccatgccgcgtttgtcaatctgcttaacatcgaaacagactacaccaaaacattccacttccattccaagagagtgacggctcacggggataccccgcagctcgacctgaaagcccggcctacatatggcgccggagagattaccgtgctggtcgaggttgctgatatggaactccatacaaagaaagtggagatcagcggcctgaagtttgcctctcttgcttgcaccgggtgttacgcctgctccagcggaatttcttgtaaggtgagaatccacgtcgacgaacccgatgagctgacggtgcacgttaaatccagcgaccccgacgtggtcgcggcctccaccagcctcatggctcgcaagctggagttcggcacagattctacctttaaagccttcagcgctatgcctaagacatccctgtgcttttatattgtggaacgggagtactgtaaatcttgcagcgaagaggacacccagaagtgtgttgatacaagacttgaacaaccgcagtccatcctgattgagcataaggggaccatcatcggaaaacagaatgacacgtgcacagccaaggcgtcttgctggctcgagagcgtgaaatccttcttttatggcctgaagaacatgctcgggtctgtcttcggcaactttttcattggaatcctgctttttctggcccccttcgtgctcctggttctgtttttcatgttcggctggaaaattctgttttgtttcaagtgctgtcgcagaacccgggggctgctcaagtaccgccacctgaaagatgacgaagagaccggatacagacggatcattgaacgcctcaataacaagaaaggcaagaatagactgcttgatggggagcggctggctgaccgcaaaatcgccgaactctttagcacaaagacccatatcgga

SEQ ID NO: 13788 - RNA, 3495 nt, synthetic construct
  misc_feature 1..3495: note = derived and/or modified CDS sequence (opt5) from CCHVF(CCHVF 47-ST-2013)__KR814861.1__Gn-NSm-Gc
  source 1..3495: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtgaagtccttcaaactgtgtaaaaattctgctacagggaagacctgcgaaatcgacagcacaccggttaagtgtagacagggattttgcctcaagatcacccaggagggccggggccatgtgaaactgtcccgcgggtctgaggtggtccttgatgcctgtgacagctcctgcgaaattatgatccccaagggaacgggcgatattctggtggactgtagcgggggacagcaacacttcctcaaagataacctgatcgacctgggctgccctcatattcccctcctggggaagatggcgatctacatttgtagaatgtctaatcaccctcggaccacaatggcttttcttttctggttttccttcggatatgttattacctgcatcttttgcaaagccctgttctacagcctcattatcattggcacactgggcaagaagatcaaacagtatcgcgagcttaagccccagacctgtacgatttgcgaaacagcccctgtgaacgctatcgatgccgagatgcatgacctgaattgttcttacaacatctgcccgtattgtgcttccagactcaccagcgacgggctggcccggcacgtcacacagtgccccaaacgcaaggagaaagtggaagagaccgaactgtacctcaatctggagagaatcccttggatcgttcggaagctgctgcaagtgtctgaatccaccggagtcgcgctcaaacgcagctcctggctgattgtgcttctggtgctcctgacagtctctctgagccccgttcagtccgcccctgtgggccacgggaagacgatcgagacctaccagacaagagagggatttaccagcatttgtctcttcatgctgggctctatcctttttatcgtgtcctgcctggtcaaggggctcgtggatagcgtttctgacagcttctttcccggactgtccgtgtgtcggacatgctctattggcagcatcaacggcttcgaaattgagtcccataaatgttattgcagccttttctgctgtccgtactgccgccactgttctgctgatagagaaatccatcagctgcacctctccatttgcaagaaacggaagaccgggagcaatgtcatgctggccgtgtgtaaaagaatgtgctttaaggctacgatcgaggcctctcgccgggcgctgttcattagatccatcatcaacacaacctttgttacctgtattctcacactggccatctgcgtggtcagcacctccgctgtggaaatggaggaccttcctgccggaacatgggagcgcgaagaggatctgacgaatttctgtcaccaagaatgccaggtcaccgagacagaatgtctctgcccctatgaggctctggtgctgcggaagcctctttttctcgactctattgttaaaggcatgaagaacctgctgaatagcacctccctcgagacatctctgagcatcgaagccccctggggagccattaacgtgcagtccaccttcaaacccacggtcagcaccgctaacatcgcgctttcttggtccagcgtggagcatagaggaaataagatcctggttacaggccgctctgaatccattatgaaactcgaggagcggaccggggtgagctgggatctgggcgtcgaagacgcctctgagagcaagctgcttacagtgtccatcatggatctcagccaaatgtactctcctgtgtttgaatatctgtccggagacagacaggttgaggaatggccgaaggctacctgcacgggcgagtgtcccgagcgctgcgggtgtacaagctctacctgcctgcacaaagaatggcctcattctcggaactggagatgtaatcccacatggtgctggggagtcggcaccgggtgtacctgctgtggagtggatgtgaaggacctcttcacagaccacatgtttattaaatggaaggtcgagtacatcaaaacggaagccattgtgtgcgttgagctgaccagccaggaacgccagtgttcccttatcgaggccggcacacggttcaacctggggcctgtgaccatcacactctctgagcccagaaatattcaacagaagctgccgcctgaaatcattaccctgcatcccaagatcgaggaaggctttttcgatcttatgcacgtccagaaagtgctcagcgcttccacggtttgcaagctgcagtcttgcacacacgggattcctggcgacctgcaaatctatcatatcgggaacctcctgaaaggagatcgggtgaatggccaccttattcataagatcgagccccactttaacaccagctggatgtcctgggacgggtgtgatctggactactactgcaatatgggagattggcctagctgtacctatacaggcgtcacccagcacaaccatgccgcgttcgtgaatctcctgaacattgaaacagactacacgaaaaccttccactttcattctaagcgcgttacagctcacggggatacaccccagctggaccttaaagccagaccgacctatggcgccggagagatcaccgtgctcgtcgaggtggctgatatggaactgcatacgaagaaggtggaggtctccggcctgaaattcgccagcctcgcttgcaccgggtgttacgcctgctcctccggaattagctgtaaggttcggatccacgtggacgaacctgatgagctgacagtgcacgtcaaatcttccgaccccgacgtggttgcggccagcacctcccttatggctagaaagctggagtttggcacagatagcaccttcaaagccttttctgctatgcccaagacaagcctctgcttctatattgtggaacgcgagtactgtaagtcctgctctgaagacgataccaaaaagtgtgtcgacacgaaactggagcagcctcaaagcatcctgatcgaacataaggggacaattatcggaaaacagaatgatacctgcaccgccaaggcgtcctgctggcttgagtctgttaagagctttttctatggcctgaaaaacatgctcgggtccgtgtttggcaatttctttgtgggcattcttctcttcctggccccgtttgtccttctggtcctcttcttcatgtttggatggaagatcctgttctgttttaaatgctgtcggagaacacgcgggctgttcaagtacagacaccttaaagacgatgaggaaaccggataccggcgcattatcgagagactgaactctaagaagggcaaaaaccggctcctggacggggaacgcctcgctgatagaaagatcgccgagctgtttagcacgaaaacacatattgga

SEQ ID NO: 13789 - RNA, 3495 nt, synthetic construct
  misc_feature 1..3495: note = derived and/or modified CDS sequence (opt5) from CCHVF(CCHVF 52-R-2014)__KR814862.1__Gn-NSm-Gc
  source 1..3495: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacacgagctgcgaggtgatgattcccaagggaaccggcgatatcctggttgactgttccgggggacagcaacacttcctcaaagataacctgattgacctgggctgccctcatgtgcccctcctggggaagatggcgatctacatttgtcggatgagcaatcaccctcgcacaaccatggcttttcttttctggttttctttcggatatgtcatcacatgcatcttttgcaaagccctgttctactccctcattatcattggcaccctgggcaagaaaatcaagcagtatagagaacttaagccccagacgtgtacaatttgcgagaccgcccctgtgaacgctatcgatgccgagatgcatgacctgaattgtagctacaacatttgcccgtattgtgcttctcggctcacatccgacgggctggcccgccacgttccccagtgccctaaaagaaaggaaaaagtggaggaaaccgagctgtacctcaatctggaacggatcccctggatcgtccgcaaacttctgcaagtgagcgagtctaccggagtggcgctcaagagatccagctggctgattgtccttctggttctcctgacagtgtccctgtctcctgtgcagagcgcccccgtcggccacgggaagacgatcgagacctaccagacacgggaaggatttacctccgtgtgtctcttcatgctgggcagcattctttttctggtttcttgcctcgtgaaagggctggtcgattccgtgagcgactctttctttccgggacttagcgtttgtaagacatgctccatcggctctattaacggcttcgagatcgaaagccataagtgttattgctccctgttctgctgtccttactgccgccactgtagcgctgatagagagatccatcagctccacctgtctatttgcaaaaagcggaaaatggggtccaatgtgatgctggccgtctgtaagagaatgtgctttcgcgctaccatcgaagccagccggagagcgctcctgattcgctctatcattaacacgacattcgtgatctgtattcttaccctgaccatctgcgtcgtgtccacaagcgccgttgagatggagaatctcccctccggaacctgggaacgggaggaagacctgacaaacttttgtcaccaagagtgccaggtgacggaaaccgagtgtctgtgcccttatgaggctcttgtcctcagaaaacccctgttcctggattctatcgtgaagggcatgaagaatctcctgaacagcacatcccttgaaacctctctgagcattgaggccccctggggagctatcaacgttcagtccacatttaaacctaccgtgagcacggccaatattgccctctcttggtccagcgtcgaacatcgcgggaacaagatcctggtgaccggccggtctgagtccattatgaaactggaggaaagaacaggggtgagctgggaccttggcgttgatgacgcttctgagagcaagctcctgaccgtctccatcatggatctgagccaaatgtactctccggtgttcgaatatctctccggagaccgccaggtggaggaatggcccaaagcgacatgcaccggcgattgtcctgagcggtgcgggtgtacgagctccacatgcctgcacaaggagtggccccattctagaaattggcgctgtaaccctacctggtgctggggagtcggcacagggtgtacctgctgtggagtggacgttaaggacctttttaccgatcacatgttcgtgaaatggaaggtcgaatacatcaaaacagaggccattgtgtgcgttgaactgacgagccaggagcggcagtgttccctcatcgaagctggcaccagatttaatctggggcccgtgacaattaccctgtctgagccgcggaacatccaacagaaacttcctcccgagattatcacactccatcctaaggtcgaagagggcttctttgacctgatgcacgtgcagaaggttctgagcgcctccaccgtgtgcaagctccagtcttgcacgcacggaatccccggcgatctgcaagtctatcatattgggaatcttctgaaaggagaccgcgtgaacggccacctcatccataagattgaacctcacttcaatacaagctggatgtcctgggatgggtgtgacctggattactactgcaacatgggagactggcccagctgtacctataccggcgtgacacagcacaatcatgccgcttttgtcaacctgcttaatatcgagaccgattacacaaaaacgttccacttccattctaagagagttaccgcccacggggacacaccgcagctcgatctgaaagcgcggcctacctatggcgctggagaaattacagtgctggtggaggtcgccgacatggagctccataccaagaaagtggaaatctccggcctgaagtttgccagccttgcttgcacggggtgttacgcctgttcttccggaatcagctgcaaggttcgcattcacgtggatgagcccgacgaactgaccgtccacgtgaaatctaacgaccccgatgttgtggctgcctccacaagcctcatggcgagaaagctggagttcggcaccgactccacatttaaagccttcagcgctatgcctaagacctctctgtgcttttatatcgtcgagcgggaatactgtaaaagctgctccgaggaagatacacagaagtgtgtggacaccaaacttgagcaaccgcagtctattctgatcgaacataaggggacgattatcggaaagcagaatgatacatgcaccgccaaagctggctgctggctcgagagcgttaagtccttcttttatgggctgaaaaacatgctcggctctgtgttcggaaactttttcattggcatcctgctttttctggcccccttcgtcctcctggtgctgtttttcatgttcgggtggaagatcctgttttgtttcaagtgctgtagacgcaccagaggacttctcaaataccggctgctcaaggacgatgaggaaacaggctaccgcagaattatcgagcggctgaataacaaaaaggggaaaaatcgccttctggacggagaaagactcgcggatcggaagattgccgagctgtttagcaccaagacgcacatcggc

SEQ ID NO: 13790 - RNA, 3495 nt, synthetic construct
  misc_feature 1..3495: note = derived and/or modified CDS sequence (opt5) from CCHVF(CCHVF 75-R-2012)__KR814863.1__Gn-NSm-Gc
  source 1..3495: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcgccccggttaagtgtcggcagggattttgcctcaaaatcacacaggagggccgcggccatgtgaagctgtccagagggtctgaagtggtccttgatgcgtgtgacagctcctgcgaggtgatgattcccaagggaaccggcgatatcctggttgactgtagcgggggacagcaacacttcctcaaagataacctgattgacctgggctgccctcatatccccctcctggggaagatggctatttacatctgtcggatgtctaatcaccctcgcacgaccatggcctttcttttctggttttccttcggatatgtgattacatgcatcttttgcaaagccctgttctacagcctcatcattatcggcaccctgggcaagaaaattaagcagtatagagaacttaagccccagacatgtaccatctgcgagacggctcctgtcaacgccattgatgctgagatgcatgacctgaattgttcttacaacatctgcccgtattgtgcctcccggctcacaagcgacgggctggcgcgccacgtgccccagtgccctaaaagaaaggaaaaagttgaggaaaccgagctgtacctcaatctggaacggatcccctggattgtgcgcaaacttctgcaagtctctgagtccacaggagtggccctcaaaagaagctcctggctgatcgtgcttctggtcctcctgaccgtttctctgagccctgtgcagtccgctcccgtgggccacgggaagaccattgagacataccagacgcgggaaggatttaccagcatctgtctcttcatgctgggctctattctttttctggtctcctgcctcgtgaaagggctggttaacagcgtgtctgatagcttctttccgggactttccgtctgtaagacatgctctatcggcagcatcaatggcttcgagattgaatcccataagtgttattgcagcctgttctgctgtccttactgccgccactgttctgccgacagagagatccatcagctccacctgtccatttgcaaaaagcggaaaaccgggagcaacgtgatgctggctgtttgtaagagaatgtgctttcgcgccacaatcgaagcgtctcggagagccctcctgattcgctccatcattaataccacgttcgtgatctgtatccttacactgaccatttgcgtcgtgagcacctccgctgtcgagatggagaacctcccctctggaacatgggaacgggaggaagatctgaccaatttttgtcaccaagagtgccaggtgacagaaacggagtgtctgtgcccttatgaggcccttgttctcagaaaacccctgttcctggacagcatcgtgaagggcatgaagaacctcctgaactccacctctcttgaaacaagcctgtccattgaggctccctggggagccatcaatgtccagagcacctttaaacctacagtgtctaccgccaacattgctctctcctggagctctgttgaacatcgcggaaataagatcctggtgacgggccggtccgagagcatcatgaaactggaggaaagaaccggggtctcttgggatcttggcgtggaggacgcgagcgaatccaagctcctgacagtgagcattatggatctgtctcaaatgtactccccggttttcgagtatctcagcggagaccgccaggtcgaagagtggcccaaagctacctgcacaggcgattgtcctgagcggtgcgggtgtacctcctctacgtgcctgcacaaggaatggccccatagcagaaactggcgctgtaatcctacatggtgctggggagtgggcaccgggtgtacatgctgtggagtggacgtcaaggatctttttaccgaccacatgttcgtgaaatggaaggttgagtacatcaaaaccgaagccattgtgtgcgtcgagctgacatcccaggaacggcagtgttctctcatcgaggccggcacgagatttaacctggggcccgtgaccattacactgagcgagccgcggaatatccaacagaaacttcctcccgaaatcattaccctccatcctaaggttgaggaaggcttctttgacctgatgcacgtgcagaaggtcctgtccgcctctacagtgtgcaagctccagagctgcacccacggaatccccggcgatctgcaagtttatcatattgggaaccttctgaaaggagaccgcgtgaatggccacctcatccataagattgagcctcacttcaacacgtcctggatgagctgggatgggtgtgacctggattactactgcaatatgggagactggccctcttgtacatataccggcgtcacccagcacaaccatgctgcctttgtgaatctgcttaacatcgaaacagattacaccaaaacattccacttccattccaagagagtgacggcgcacggggacaccccgcagctcgatctgaaagctcggcctacatatggcgccggagagatcaccgtcctggttgaggtggccgacatggaactccatacaaagaaagtggagattagcggcctgaagtttgcttctcttgcctgcaccgggtgttacgcttgctccagcggaatctcttgtaaggtccgcattcacgtggatgaacccgacgagctgacggttcacgtgaaatccagcgatcccgacgtcgtggccgcgtccaccagcctcatggccagaaagctggagttcggcacagactctacctttaaggctttcagcgccatgcctaagacatccctgtgcttttatatcgttgaacgggagtactgtaaatcttgcagcgaagaggatacccagaagtgtgtggacacaaaacttgaacaaccgcagtccattctgatcgagcataaggggaccattatcggaaagcagaatgatacgtgcacagctaaagcctcttgctggctcgagagcgtcaagtccttcctgtatggcctcaaaaacatgctggggtctgtgtttggcaacttctttatcgggattcttctgttcctcgcgccctttgttctgctggtgcttttctttatgttcggctggaagatcctgttctgttttaagtgctgtagacgcaccagagggctcctgaaataccggctcctgaaggacgatgaagagaccggataccgcagaattatcgaacggcttaataacaaaaagggcaaaaatcgcctgctcgacggggagagactggccgatcggaagattgctgaactgttcagcacaaagacccacatcgga

SEQ ID NO: 13791 - RNA, 3495 nt, synthetic construct
  misc_feature 1..3495: note = derived and/or modified CDS sequence (opt5) from CCHVF(CCHVF 75-ST-2010)__KR814864.1__Gn-NSm-Gc
  source 1..3495: mol_type = other RNA
agcgaggaatccggcgacgattgcatctctagaacccagctgctccggacagagacggccgaaattcacgacgataactacgggggacccggcgacaagatcaccatttgtaatgggagcacaatcgtggatcaacgcctgggatccgagcttggctgctataccattaacagagtcaaatctttcaagctgtgtgaaaatagcgctacagggaaaacctgcgagatcgactccacacctgttaagtgtcggcagggattttgcctcaaaatcacccaggagggccgcggccatgtgaagctgtctagagggagcgaagtggtccttgatgcctgtgactccagctgcgaggtgatgattccgaagggaacgggcgatatcctggttgactgttctgggggacagcaacacttcctcaaagataacctgattgacctgggctgcccccatatccctctcctggggaagatggcgatttacatctgtcggatgtccaatcacccccgcaccacaatggcttttcttttctggtttagcttcggatatgtgattacctgcctgttttgcaaagccctcttctactctctgatcatcattggcacacttggcaagaaaatcaagcagtatagagaactgcggcctcagacctgtacgatttgcgagacagcccccgtcaacgctatcgatgccgagatgcatgacctcaattgttcctacaacatttgcccttattgtgctagccgcctgacctctgacgggctggccagacacgtgccgcagtgccccaagcggaaagaaaaggttgaggaaacagagctctacctgaatcttgaacgcatcccttggatcgtgagaaaactgctccaagtctccgagagcaccggagtggcgctgaagcggtcctcttggcttattgtgctgctcgtcctgctgaccgttagcctctcccccgtgcagagcgcccctgtgggccacgggaaaacaatcgagacgtaccagacccgcgaaggatttacatctatttgtctgttcatgcttggctccatcctgtttctcgtcagctgcctggtgaaggggcttgttgattctgtgagcgactccttctttcccggactgtctgtctgtaaaacctgcagcattggctccatcaacggcttcgagatcgaaagccataagtgttattgctctctcctgtgctgtccgtactgcagacactgttccgctgatcgggagattcatcagctgcacctcagcatctgcaagaaaagaaagacagggtctaatgtgatgctggccgtttgtaaacgcatgtgcttccgggctaccattgaagcctccagacgcgcgcttctgatccggagcattatcaacacgacatttgtgatttgtatcctcaccctgaccatctgcgtcgtgtccacatctgccgtcgagatggagaatctgcctagcggaacctgggaaaaggaggaagaccttacaaacttctgtcaccaagagtgccaggtgacggaaaccgagtgtctctgcccctatgaggctctggttctgagaaaacctctctttctggattccattgtgaagggcatgaagaatcttctgaactctacaagcctcgaaacctccctgagcatcgaggccccctggggagctattaacgtccagtctacattcaaacccaccgtgtccacggccaatatcgccctgagctggtcttccgttgaacatcgcggaaacaagattcttgtgaccggccggagcgagtctatcatgaaactcgaggaaagaacaggggtcagctgggacctgggcgtggaggatgcttccgaaagcaagctgctcaccgtgtctatcatggacctgtcccaaatgtacagccctgtttttgagtatctttccggagatcgccaggtcgaagagtggccgaaagcgacatgcaccggcgactgtcccgagcggtgcgggtgtacgtctagcacatgcctgcacaaggaatggcctcattccagaaattggcgctgtaaccccacctggtgctggggagtgggcacagggtgtacctgctgtggagtggatgtcaaggacctcttcaccgaccacatgtttgtgaaatggaaggttgagtacattaaaacagaagccatcgtgtgcgtcgagctgacgtctcaggaacggcagtgtagcctgattgaggctggcaccagattcaatcttgggcctgtgacaatcaccctctccgagccccggaacattcaacagaagctgccgcctgaaatcatcacactgcatcccaaagttgaggaaggctttttcgatctcatgcacgtgcagaaggtcctgtctgccagcaccgtgtgcaagctgcagtcctgcacgcacgggattcctggcgacctgcaagtttatcatatcgggaatctcctgaaaggagatcgcgtgaacggccacctgattcataagatcgagccccactttaatacaagctggatgtcttgggacgggtgtgatcttgactactactgcaacatgggagattggccttcctgtacctataccggcgtcacacagcacaatcatgccgctttcgtgaacctcctgaatattgaaaccgactacacaaaaacgtttcacttccatagcaagagagtgaccgcccacggggatacaccccagctggacctcaaagcgcggccgacctatggcgctggagagatcacagtcctggttgaggtggccgatatggaacttcataccaagaaagtggagatctctggcctgaagttcgcctccctcgcttgcacggggtgttacgcctgcagctctggaatttcctgtaaggtcagaatccacgtggacgaacctgatgagctgaccgttcacgtgaaaagctccgaccccgacgtcgtggctgccagcacatctctgatggcgcgcaaacttgagtttggcaccgatagcacattcaaggccttttccgctatgcccaagacctctctgtgcttctatattgttgaacgggagtactgtaaaagctgctccgaagaggacacacagaagtgtgtggataccaagctcgaacaacctcagtctatcctgattgagcataaagggacgatcattggaaagcagaacgacacatgcaccgccaaagctagctgctggctcgagtccgtcaagagctttttctatggcctgaaaaatatgcttgggtctgtgtttggcaacttctttatcggaatccttctcttcctggccccgtttgttctgcttgtgctgttctttatgttcggctggaagattctcttctgttttaagtgctgtagacgcgcgagagggctgctcaaataccggcacctgaaggatgacgaagagaccggataccgcaaaatcattgaaagacttaacaataagaaaggcaagaaccggctgctcgatggggagcgcctggccgacagaaagatcgctgaactgttctccacaaaaacccatattgga

SEQ ID NO: 13792 - RNA, 3495 nt, synthetic construct
  misc_feature 1..3495: note = derived and/or modified CDS sequence (opt5) from CCHVF(CCHVF 81-R-2014)__KR814865.1__Gn-NSm-Gc
  source 1..3495: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacagctcctgcgaggtgatgattcccaagggaacgggcgatatcctggttgactgtagcgggggacagcaacacttcctcaaagataacctgattgacctgggctgccctcatatccccctcctggggaagatggcgatttacatctgtcggatgtctaatcaccctcgcaccacaatggcttttcttttctggttttccttcggatatgtgattacctgcatcttttgcaaagccctgttctacagcctcatcattatcggcacactgggcaagaaaattaagcagtatagagaacttaagccccagacctgtacgatctgcgagacagcccctgtcaacgctattgatgccgagatgcatgacctgaattgttcttacaacatctgcccgtattgtgcttcccggctcaccagcgacgggctggcccgccacgtgccccagtgccctaaaagaaaggaaaaagttgaggaaacagagctgtacctcaatctggaacggatcccctggattgtgcgcaaacttctgcaagtctctgagtccaccggagtggcgctcaaaagaagctcctggctgatcgtgcttctggtcctcctgaccgtttctctgagccctgtgcagtccgcccccgtgggccacgggaagacaattgagacgtaccagacccgggaaggatttacaagcatctgtctcttcatgctgggctctattctttttctggtctcctgcctcgtgaaagggctggttgatagcgtgtctgacagcttctttccgggactttccgtctgtaagacctgctctatcggcagcatcaacggcttcgagattgaatcccataagtgttattgcagcctgttctgctgtccttactgccgccactgttctgctgatagagagatccatcagctccacctgtccatttgcaaaaagcggaaaacagggagcaatgtgatgctggccgtttgtaagagaatgtgctttcgcgctaccatcgaagcctctcggagagcgctcctgattcgctccatcattaacacgacattcgtgatctgtatccttaccctgaccatttgcgtcgtgagcacatccgccgtcgagatggagaatctccccgctggaacctgggaacgggaggaagacctgacaaacttttgtcaccaagagtgccaggtgacggaaaccgagtgtctgtgcccttatgaggcccttgttctcagaaaacccctgttcctggattctatcgtgaagggcatgaagaatctcctgaacagcacatcccttgaaacctctctgagcattgaggctccctggggagccatcaacgtccagtccacatttaaacctaccgtgagcacggccaatattgctctctcttggtccagcgttgaacatcgcgggaacaagatcctggtgaccggccggtctgagtccatcatgaaactggaggaaagaacaggggtcagctgggaccttggcgtggaggatgcgtctgaaagcaagctcctgaccgtgtccattatggacctgagccaaatgtactctccggttttcgagtatctctccggagatcgccaggtcgaagagtggcccaaagccacatgcaccggcgactgtcctgagcggtgcgggtgtacgagctccacatgcctgcacaaggaatggccccattctagaaattggcgctgtaaccctacctggtgctggggagtgggcacagggtgtacctgctgtggagtggatgtcaaggacctttttaccgaccacatgttcgtgaaatggaaggttgagtacatcaaaacagaagctattgtgtgcgtcgagctgacgagccaggaacggcagtgttccctcatcgaggccggcaccagatttaatctggggcccgtgacaattaccctgtctgagccgcggaacatccaacagaaacttcctcccgaaatcattacactccatcctaaggttgaggaaggcttctttgatctgatgcacgtgcagaaggtcctgagcgcctccaccgtgtgcaagctccagtcttgcacgcacggaatccccggcgacctgcaagtttatcatattgggaatcttctgaaaggagatcgcatcaacggccacctcattcataagatcgagcctcacttcaatacaagctggatgtcctgggacgggtgtgatctggactactactgcaacatgggagattggcccagctgtacctataccggcgtgacacagcacaatcatgctgcctttgtcaacctgcttaatatcgaaaccgactacacaaaaacgttccacttccattctaagagagtgaccgcgcacggggatacaccgcagctcgacctgaaagctcggcctacctatggcgccggagagattacagtgctggtcgaggttgccgatatggaactccataccaagaaagtggagatctccggcctgaagtttgctagccttgcctgcacggggtgttacgcttgcagctccggaattagctgtaaggtgagaatccacgtcgacgaacccgatgagctgaccgtgcacgttaaatcttccgaccccgacgtggtcgccgcgagcacatccctcatggcccgcaagctggagttcggcaccgatagcacatttaaggctttctctgccatgcctaagaccagcctgtgcttttatattgtggaacgggagtactgtaaatcctgctctgaagaggacacacagaagtgtgttgataccagacttgaacaaccgcagagcatcctgattgagcataaggggacgatcatcggaaaacagaacgacacatgcaccgctaaggcctcctgctggctcgagtctgtgaaatctttcttttatggcctgaagaatatgctcgggtccgtcttcggcaactttttcattggaatcctgctttttctggcgcccttcgtgctcctggttctgtttttcatgttcggctggaaaattctgttttgtttcaagtgctgtcgcagaacccgggggcttctcaagtaccgccacctgaaagatgacgaagagacaggatacagacggatcattgaacgcctcaacaataagaaaggcaagaacagactgcttgatggggagcggctggccgaccgcaaaatcgctgaactcttttctaccaagacgcatatcgga

SEQ ID NO: 13793 - RNA, 3495 nt, synthetic construct
  misc_feature 1..3495: note = derived and/or modified CDS sequence (opt5) from CCHVF(CCHVF 3756-ST-2007)__KR814866.1__Gn-NSm-Gc
  source 1..3495: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgcctgtgacagctcctgcgagattatgatccccaaaggaacgggcgatattctggtggactgtagcgggggacagcaacacttcctcaaggataacctgatcgacctgggctgccctcatattcccctcctggggaaaatggcgatctacatttgtagaatgtctaatcaccctcggaccacaatggcttttcttttctggttttccttcggatatgttattacctgcatcttttgcaaggccctgttctacagcctcattatcattggcacactgggcaaaaagatcaagcagtatcgcgaacttaaaccccagacctgtacgatttgcgagacagcccctgtgaacgctatcgatgccgagatgcatgacctgaattgttcttacaacatctgcccgtattgtgcttccagactcaccagcgacgggctggcccggcacgtcacacagtgccccaagcgcaaagaaaaggtggaggaaaccgagctgtacctcaatctggaaagaatcccttggatcgttcggaaacttctgcaagtgtctgagtccaccggagtcgcgctcaagcgcagctcctggctgattgtgcttctggtgctcctgacagtctctctgagccccgttcagtccgcccctgtgggccacgggaaaacgatcgagacctaccagacaagagaaggatttaccagcatttgtctcttcatgctgggctctatcctttttatcgtgtcctgcctggtcaaggggctcgtggatagcgtttctgacagcttctttcccggactgtccgtgtgtaagacatgctctattggcagcatcaacggcttcgagattgaatcccataaatgttattgcagccttttctgctgtccgtactgccggcactgttctgctgatcgcgagatccatcagctgcacctctccatttgcaagaaaagaaagaccgggagcaatgtcatgctggccgtgtgtaaacggatgtgctttaaggctacgatcgaagcctctagacgcgcgctgctcattcggtccatcatcaacacaaccttcgttatttgtatcctgacccttgccatttgcgtggtcagcacatccgctgtggagatggaggacctgcctgccggaacctgggaaagagaggaagatctcacaaatttttgtcaccaagagtgccaggtcacggaaaccgagtgtctgtgcccctatgaggctctggtgcttcgcaagcctctcttcctggactctatcgttaaaggcatgaagaacctgctcaatagcacatccctggaaacctctcttagcattgaggccccctggggagccatcaacgtgcagtccacatttaaacccaccgtcagcacggctaacatcgcgctgtcttggtccagcgtggaacatcggggaaataagattctcgttaccggcagatctgagtccatcatgaaactggaggaacgcacaggggtgagctgggatctgggcgtcgaggacgcctctgaaagcaaacttctcaccgtgtccattatggatctgagccaaatgtactctcctgtgttcgagtatctgtccggagaccggcaggttgaagagtggccgaaggctacatgcaccggcgattgtcccgagagatgcgggtgtacgagctccacatgcctccacaaagaatggcctcattctcgcaactggcggtgtaatcccacctggtgctggggagtcggcacagggtgtacctgctgtggagtggacgtgaaggacctgtttaccgatcacatgttcatcaaatggaaggtcgagtacattaaaacagaagccatcgtgtgcgttgagcttacgagccaggaaagacagtgttccctgatcgaggccggcacccgctttaacctcgggcctgtgacaattaccctgtctgagccccggaatatccaacagaagctgccgcctgaaattatcacacttcatcccaagattgaggaaggcttctttgacctcatgcacgtccagaaagtgctgagcgcttccaccgtttgcaagctgcagtcttgcacgcacggaatccctggcgatctccaaatctatcatattgggaacctgcttaaaggagacagagtgaatggccacctgatccataagattgagccccacttcaacacaagctggatgtcctgggatgggtgtgacctcgattactactgcaatatgggagactggcctagctgtacctataccggcgtcacacagcacaaccatgccgcgtttgtgaatctgctgaacatcgaaaccgattacacaaaaacgttccacttccattctaagcgggttaccgctcacggggacacaccccagcttgatctcaaagcccgcccgacctatggcgccggagagattacagtgctggtcgaggtggctgacatggaactgcataccaagaaggtggagatctccggcctcaaatttgccagcctgacgtgcaccgggtgttacgcttgttcttccggaattagctgcaaggtcagaatccacgttgatgaacctgacgagcttacagtgcacgtgaaatcttccgaccccgatgtcgtggccgcgagcacctccctgatggcccggaagctcgagttcggcacagacagcacctttaaggctttctctgccatgcccaagacaagcctgtgcttttatatcgttgaaagagagtactgtaagtcctgctctgaagatgacaccaaaaagtgtgtggatacgaaactggagcagcctcaaagcattcttatcgaacataaggggacaattatcggaaaacagaatgatacctgcaccgctaaggcctcctgctggctggagtctgtcaagagcttcttttatggcctcaaaaacatgctggggtccgtgttcggcagctttttcgttgggattctcctgtttcttacaccgttcgtgctgctcgtcctgtttttcatgttcggctggaagatcctgttttgtttcaaatgctgtcgccggaccagagggctttttaagtaccgccacctgaaagacgacgaggaaacgggatacagacggatcattgagcgcctcaattctaagaagggcaaaaacagactgctcgatggggaacggctggcggaccgcaagatcgccgagcttttctccacaaaaacccatattgga

SEQ ID NO: 13794 - RNA, 3495 nt, synthetic construct
  misc_feature 1..3495: note = derived and/or modified CDS sequence (opt5) from CCHVF(CCHVF 3809-ST-2007)__KR814867.1__Gn-NSm-Gc
  source 1..3495: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacagctcctgcgaggtgatgattcccaagggaacgggcgatatcctggttgactgtagcgggggacagcaacacttcctcaaagataacctgattgacctgggctgccctcatatccccctcctggggaagatggcgatttacatctgtcggatgtctaatcaccctcgcaccacaatggcttttcttttctggttttccttcggatatgtgattacctgcatcttttgcaaagccctgttctacagcctcatcattatcggcacactgggcaagaaaattaagcagtatagagaacttaagccccagacctgtacgatctgcgagacagcccctgtcaacgctattgatgccgagatgcatgacctgaattgttcttacaacatctgcccgtattgtgcttcccggctcaccagcgacgggctggcccgccacgtgccccagtgccctaaaagaaaggaaaaagttgaggaaacagagctgtacctcaatctggaacggatcccctggattgtgcgcaaacttctgcaagtctctgagtccaccggagtggcgctcaaaagaagctcctggctgatcgtgcttctggtcctcctgaccgtttctctgagccctgtgcagtccgcccccgtgggccacgggaagacaattgagacgtaccagacccgggaaggatttacaagcatctgtctcttcatgctgggctctattctttttctggtctcctgcctcgtgaaagggctggttgatagcgtgtctgacagcttctttccgggactttccgtctgtaagacctgctctatcggcagcgtgaacggcttcgagatcgaatcccataagtgttattgcagcctgttctgctgtccttactgccgccactgttctgctgatagagagattcatcagctccacctgtccgtttgcaaaaagcggaaaacagggagcaatgtgatgctggccgtctgtaagagaatgtgctttcgcgctaccatcgaagcctctcggagagcgctcctgattcgctccatcattaacacgacattcgtgatctgtattcttaccctgaccatctgcgtcgtgagcacatccgccgttgagatggagaatctccccgctggaacctgggaacgggaggaagacctgacaaacttttgtcaccaagagtgccaggtgacggaaaccgagtgtctgtgcccttatgaggcccttgtcctcagaaaacccctgttcctggattctatcgtgaagggcatgaagaatctcctgaacagcacatcccttgaaacctctctgagcattgaggctccctggggagccatcaacgttcagtccacatttaaacctaccgtgagcacggccaatattgctctctcttggtccagcgtcgaacatcgcgggaacaagatcctggtgaccggccggtctgagtccattatgaaactggaggaaagaacaggggtgagctgggaccttggcgttgaggatgcgtctgaaagcaagctcctgaccgtctccatcatggacctgagccaaatgtactctccggtgttcgagtatctctccggagatcgccaggtggaagagtggcccaaagccacatgcaccggcgactgtcctgagcggtgcgggtgtacgagctccacatgcctgcacaaggaatggccccattctagaaattggcgctgtaaccctacctggtgctggggagtcggcacagggtgtacctgctgtggagtggatgttaaggacctttttaccgaccacatgttcgtgaaatggaaggtcgagtacatcaaaacagaagctattgtgtgcgttgagctgacgagccaggaacggcagtgttccctcatcgaggccggcaccagatttaatctggggcccgtgacaattaccctgtctgagccgcggaacatccaacagaaacttcctcccgaaattatcacactccatcctaaggtcgaggaaggcttctttgatctgatgcacgtgcagaaggttctgagcgcctccaccgtgtgcaagctccagtcttgcacgcacggaatccccggcgacctgcaagtctatcatattgggaatcttctgaaaggagatcgcgtgaacggccacctcatccataagattgagcctcacttcaatacaagctggatgtcctgggacgggtgtgatctggactactactgcaacatgggagattggcccagctgtacctataccggcgtgacacagcacaatcatgctgcctttgtcaacctgcttaatatcgaaaccgactacacaaaaacgttccacttccattctaagagagttaccgcgcacggggatacaccgcagctcgacctgaaagctcggcctacctatggcgccggagagattacagtgctggtggaggtcgccgatatggaactccataccaagaaagtggagatctccggcctgaagtttgctagccttgcctgcacggggtgttacgcttgttcttccggaatcagctgcaaggttcgcattcacgtggacgaacccgatgagctgaccgtccacgtgaaatcttccgaccccgacgttgtggccgcgagcacatccctcatggccagaaagctggagttcggcaccgatagcacatttaaggctttctctgccatgcctaagaccagcctgtgcttttatatcgtcgaaaaagagtactgtcggtcctgctctgaagaggacacacagaagtgtgtggataccaaacttgaacaaccgcagagcattctgatcgagcataaggggacgattatcggaaagcagaacgacacatgcaccgctaaagcctcctgctggctcgagtctgttaagagcttcttttatggcctgaaaaatatgctcgggtccgtgttcggcaactttttcattggaatcctgctttttctgacccccttcgtcctcctggtgctgtttttcatgttcggctggaagatcctgttttgtttcaagtgctgtagacgcacaagagggcttctcaaataccggcacctgaaggatgacgaagagaccggataccgcagaattatcgaacggctcaacaataaaaagggcaaaaaccgcctgcttgatggggagagactggcggaccggaagattgccgaactcttttctacgaagacacatatcgga

SEQ ID NO: 13795 - RNA, 3495 nt, synthetic construct
  misc_feature 1..3495: note = derived and/or modified CDS sequence (opt5) from CCHVF(CCHVF 3820-ST-2007)__KR814868.1__Gn-NSm-Gc
  source 1..3495: mol_type = other RNA
agcgaggaacccggcgacgattgcatctccagaacccagctgctcaagacagagacggccgaaattcacgacgataactacgggtctcctggagacaaaatcaccatttgtaatggcagcacaatcgtggatcaacggctggggtccgagcttggatgctataccattaaccgcgtcaagtctttcaaactgtgtgaaaatagcgctacaggcaagacctgcgagatcgactccacaccggttaaatgtagacaggggttttgcctcaagatcacccaggagggacggggccatgtgaagctgtctcgcggcagcgaagtggtccttgatgcctgtgactccagctgcgagattatgatccccaaagggacgggagatattctggtggactgttctggcgggcagcaacacttcctcaaggataacctgatcgacctgggatgccctcatattcccctcctgggcaaaatggcgatctacatttgtagaatgtccaatcaccctcggaccacaatggcttttcttttctggtttagcttcgggtatgttattacctgcatcttttgcaaggccctgttctactctctcattatcattggaacactgggcaaaaagatcaagcagtatcgcgaacttaaaccccagacctgtacgatttgcgagacagcccctgtgaacgctatcgatgccgagatgcatgacctgaattgttcctacaacatctgcccgtattgtgctagcagactcacctctgacggcctggcccggcacgtcacacagtgccccaagcgcaaagaaaaggtggaggaaaccgagctgtacctcaatctggaaagaatcccttggatcgttcggaaacttctgcaagtgtccgagagcaccggggtcgcgctcaagcgctcctcttggctgattgtgcttctggtgctcctggccgtcagcctgtcccccgttcagagcgctcctgtgggacacggcaaaacaatcgagacgtaccagaccagagaagggtttacatctatttgtctcttcatgctgggatccatcctttttatcgtgagctgcctggtcaagggcctcgtggattctgttagcgactccttctttcccgggctgtctgtgtgtaagacctgcagcattggatccatcaacggcttcgagattgaaagccataaatgttattgctctcttttctgctgtccgtactgccggcactgttccgccgatcgcgagatccatcagctgcacctcagcatttgcaagaaaagaaagacaggctctaatgtcatgctggctgtgtgtaaacggatgtgctttaaggccaccatcgaagcgtccagacgcgccctgctcattcggagcatcatcaacacgacattcgttatgtgtattctgacccttgctatctgcgtggtctccacctctgccgtggagatggaggacctgcctgctgggacatgggaaagagaggaagatctcaccaatttttgtcaccaagagtgccaggtcacagaaacggagtgtctgtgcccctatgaggccctggtgcttcgcaagcctctcttcctggacagcattgttaaaggaatgaagaacctgctcaattccacctctctggaaacaagcctttccatcgaggccccctggggcgctattaacgtgcagagcacctttaaacccacagtctctaccgcgaacatcgccctgtcctggagctctgtggaacatcgggggaataagatcctcgttacgggaagatccgagagcattatgaaactggaggaacgcaccggcgtgtcttgggatctgggggtcgaggacgctagcgaatccaaacttctcacagtgagcatcatggatctgtctcaaatgtactcccctgtgttcgagtatctgagcggcgaccggcaggttgaagagtggccgaaggctacctgcacaggagattgtcccgagagatgcggctgtacctcctctacgtgcctccacaaggaatggcctcatagccgcaactggcggtgtaatcccacatggtgctggggagtcggaaccggctgtacatgctgtggggtggacgtgaaggacctgtttaccgatcacatgttcattaaatggaaggtcgagtacatcaaaaccgaagccattgtgtgcgttgagcttacatcccaggaaagacagtgttctctgatcgaggccggaacgcgctttaacctcggccctgtgaccatcacactgagcgagccccggaatattcaacagaagctgccgcctgaaatcattacccttcatcccaagatcgaggaagggttctttgacctcatgcacgtccagaaagtgctgtccgcctctacagtttgcaagctgcagagctgcacccacggcattcctggagatctccaaatctatcatatcggcaacctgcttaaaggggacagagtgaatggacacctgattcataagatcgagccccacttcaacacgtcctggatgagctgggatggctgtgacctcgattactactgcaatatgggggactggccttcttgtacatataccggagtcacccagcacaaccatgcggcttttgtgaatctgctgaacattgaaacagattacaccaaaacattccacttccattccaagcgggttacggcccacggcgacacaccccagcttgatctcaaagcccgcccgacatatggggctggcgagatcaccgtgctggtcgaggtggccgacatggaactgcatacaaagaaggtggagattagcggactcaaatttgcttctctgacctgcacgggctgttacgcctgctccagcgggatctcttgtaaggtccggattcacgttgatgaacctgacgagcttaccgtgcacgtgaaatccagcgaccccgatgtcgtggcggcctccacaagcctgatggctagaaagctcgagttcggaaccgactctacatttaaagccttcagcgctatgcccaagacctccctgtgcttttatatcgttgaaagagagtactgtaagtcttgcagcgaagatgacaccaaaaagtgtgtggataccaaactggagcagcctcaatccatccttattgaacataagggcacgatcattgggaaacagaatgacacatgcaccgccaaggcgtcttgctggctggagagcgtcaagtccttcttttatggactcaaaaacatgctgggctctgtgttcgggagctttttcgttggcatcctcctgtttcttgccccgttcgtgctgctcgtcctgtttttcatgttcggatggaagattctgttttgtttcaaatgctgtcgccggaccagaggcctttttaagtaccgccacctgaaagatgacgaggaaacagggtacagacggatcatcgagcgcctcaattccaagaaggggaaaaacagactgctcgatggcgaacggctggctgaccgcaagattgccgagcttttcagcaccaaaacgcatatcggg

SEQ ID NO: 13796 - RNA, 3495 nt, synthetic construct
  misc_feature 1..3495: note = derived and/or modified CDS sequence (opt5) from CCHVF(CCHVF 4495-ST-2008)__KR814869.1__Gn-NSm-Gc
  source 1..3495: mol_type = other RNA
agcgaggaatccggcgacgattgcatctctagaacccagctgctccggacagagacggccgaaattcacgacgataactacgggggacccggcgacaagatcaccatttgtaatgggagcacaatcgtggatcaacgcctgggatccgagcttggctgctataccattaacagagtcaaatctttcaagctgtgtgaaaatagcgctacagggaaaacctgcgagatcgactccacacctgttaagtgtcggcagggattttgcctcaaaatcacccaggagggccgcggccatgtgaagctgtctagagggagcgaagtggtccttgatgcctgtgactccagctgcgaggtgatgattccgaagggaacgggcgatatcctggttgactgttctgggggacagcaacacttcctcaaagataacctgattgacctgggctgcccccatatccctctcctggggaagatggcgatttacatctgtcggatgtccaatcacccccgcaccacaatggcttttcttttctggtttagcttcggatatgtgattacctgcctgttttgcaaagccctcttctactctctgatcatcattggcacacttggcaagaaaatcaagcagtatagagaactgcggcctcagacctgtacgatttgcgagacagcccccgtcaacgctatcgatgccgagatgcatgacctcaattgttcctacaacatttgcccttattgtgctagccgcctgacctctgacgggctggccagacacgtgccgcagtgccccaagcggaaagaaaaggttgaggaaacagagctctacctgaatcttgaacgcatcccttggatcgtgagaaaactgctccaagtctccgagagcaccggagtggcgctgaagcggtcctcttggcttattgtgctgctcgtcctgctgaccgttagcctctcccccgtgcagagcgcccctgtgggccacgggaaaacaatcgagacgtaccagacccgcgaaggatttacatctatttgtctgttcatgcttggctccatcctgtttctcgtcagctgcctggtgaaggggcttgttgattctgtgagcgactccttctttcccggactgtctgtctgtaaaacctgcagcattggctccatcaacggcttcgagatcgaaagccataagtgttattgctctctcctgtgctgtccgtactgcagacactgttccgctgatcgggagattcatcagctgcacctcagcatctgcaagaaaagaaagacagggtctaatgtgatgctggccgtttgtaaacgcatgtgcttccgggctaccattgaagcctccagacgcgcgcttctgatccggagcattatcaacacgacatttgtgatttgtatcctcaccctgaccatctgcgtcgtgtccacatctgccgtcgagatggagaatctgcctagcggaacctgggaaaaggaggaagaccttacaaacttctgtcaccaagagtgccaggtgacggaaaccgagtgtctctgcccctatgaggctctggttctgagaaaacctctctttctggattccattgtgaagggcatgaagaatcttctgaactctacaagcctcgaaacctccctgagcatcgaggccccctggggagctattaacgtccagtctacattcaaacccaccgtgtccacggccaatatcgccctgagctggtcttccgttgaacatcgcggaaacaagattcttgtgaccggccggagcgagtctatcatgaaactcgaggaaagaacagggatcagctgggacctgggcgtcgaggatgcttccgaaagcaagctgctcaccgtgtctattatggacctgtcccaaatgtacagccctgtgtttgagtatctttccggagatcgccaggttgaagagtggccgaaagcgacatgcaccggcgactgtcccgagcggtgcgggtgtacgtctagcacatgcctgcacaaggaatggcctcattccagaaattggcgctgtaaccccacctggtgctggggagtcggcacagggtgtacctgctgtggagtggatgtgaaggacctcttcaccgaccacatgtttgtcaaatggaaggtggagtacatcaaaacagaagccattgtttgcgtggagctgacgtctcaggaacggcagtgtagcctgatcgaggctggcaccagattcaatcttgggcctgtcacaattaccctctccgagccccggaacatccaacagaagctgccgcctgaaatcattacactgcatcccaaagtggaggaaggctttttcgatctcatgcacgttcagaaggtgctgtctgccagcaccgtctgcaagctgcagtcctgcacgcacggaatccctggcgacctgcaagtgtatcatattgggaatctcctgaaaggagatcgcgttaacggccacctgatccataagattgagccccactttaatacaagctggatgtcttgggacgggtgtgatcttgactactactgcaacatgggagattggccttcctgtacctataccggcgtgacacagcacaatcatgccgctttcgtcaacctcctgaatatcgaaaccgactacacaaaaacgtttcacttccatagcaagagagtgaccgcccacggggatacaccccagctggacctcaaagcgcggccgacctatggcgctggagagatcacagtgctggtcgaggttgccgatatggaacttcataccaagaaagtggagatttctggcctgaagttcgcctccctcgcttgcacggggtgttacgcctgcagctctggaatctcctgtaaggtgcgcattcacgtcgacgaacctgatgagctgaccgtgcacgttaaaagctccgaccccgacgtggtcgctgccagcacatctctgatggcgagaaaacttgagtttggcaccgatagcacattcaaggccttttccgctatgcccaagacctctctgtgcttctatatcgtggaacgggagtactgtaaaagctgctccgaagaggacacacagagatgtgttgataccaagctcgaacaacctcagtctattctgatcgagcataaggggacgattatcggaaaacagaacgacacatgcaccgccaaggctagctgctggctcgagtccgtgaaatctttcttttatggcctgaagaatatgcttgggagcgtctttggcaacttctttatcgggattcttctcttcctggccccgtttgtgctgcttgttctgttctttatgttcggctggaaaatcctcttctgttttaagtgctgtcgcagagcgcgggggctgctcaagtaccgccacctgaaagatgacgaagagaccggatacagaaagattatcgaacggcttaacaataaaaagggcaaaaaccgcctgctcgatggggagagactggccgaccggaagattgctgaactgttctccacaaagacccatatcgga

SEQ ID NO: 13797 - RNA, 3495 nt, synthetic construct
  misc_feature 1..3495: note = derived and/or modified CDS sequence (opt5) from CCHVF(CCHVF 4691-ST-2009)__KR814871.1__Gn-NSm-Gc
  source 1..3495: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgcctgtgacagctcctgcgagattatgatccccaaaggaacgggcgatattctggtggactgtagcgggggacagcaacacttcctcaaggataacctgatcgacctgggctgccctcatattcccctcctggggaaaatggcgatctacatttgtagaatgtctaatcaccctcggaccacaatggcttttcttttctggttttccttcggatatgttattacctgcatcttttgcaaggccctgttctacagcctcattatcattggcacactgggcaaaaagatcaagcagtatcgcgaacttaaaccccagacctgtacgatttgcgagacagcccctgtgaacgctatcgatgccgagatgcatgacctgaattgttcttacaacatctgcccgtattgtgcttccagactcaccagcgacgggctggcccggcacgtcacacagtgccccaagcgcaaagaaaaggtggaggaaaccgagctgtacctcaatctggaaagaatcccttggatcgttcggaaacttctgcaagtgtctgagtccaccggagtcgcgctcaagcgcagctcctggctgattgtgcttctggtgctcctgacagtctctctgagccccgttcagtccgcccctgtgggccacgggaaaacgatcgagacctaccaggctagagaaggatttacaagcatttgtctcttcatgctgggctctatcctttttatcgtgtcctgcctggtcaaggggctcgtggatagcgtttctgacagcttctttcccggactgtccgtgtgtaagacctgctctattggcagcatcaacggcttcgagattgaatcccataaatgttattgcagccttttctgctgtccgtactgccggcactgttctgccgatcgcgagatccatcagctgcacctctccatttgcaagaaaagacggacagggagcaatgtcatgctggctgtgtgtaagagaatgtgctttaaagccaccatcgaagcgtctcgccgggccctgctcattagatccatcatcaacacgacattcgttatttgtatcctgacccttgctatttgcgtggtcagcacctccgccgtggagatggagaatctgcctgctggaacatgggaacgcgaggaagacctcaccaacttttgtcaccaagagtgccaggtcacagaaacggagtgtctgtgcccctatgaggccctggtgcttcggaagcctctcttcctggattctatcgttaagggcatgaaaaatctgctcaacagcacctccctggaaacatctcttagcattgaggccccctggggagctatcaacgtgcagtccacctttaagcccgcggtcagcacagccaatatcgctctgtcttggtccagcgtggaacatagaggaaacaaaattctcgttaccggccgctctgagtccatcatgaagctggaggaacggacgggggtgagctgggacctgggcgtcgaggatgcctctgaaagcaaacttctcaccgtgtccattatggacctgagccaaatgtactctcctgtgttcgagtatctgtccggagatagacaggttgaagagtggccgaaggccacatgcaccggcgactgtcccgagcgctgcgggtgtacaagctctacctgcctccacaaggaatggcctcattctcggaattggagatgtaaccccacgtggtgctggggagtcggcacagggtgtacctgctgtggagtggatgtgaaagacctgtttacagaccacatgttcatcaagtggaaagtcgagtacattaagaccgaagctatcgtgtgcgttgagcttaccagccaggaacgccagtgttccctgatcgaggccggcacacggtttaatctcgggcctgtgacgattaccctgtctgagcccagaaacatccaacagaaactgccgcctgaaattatcacacttcatcccaagattgaggaaggcttctttgatctcatgcacgtccagaaggtgctgagcgcgtccaccgtttgcaaactgcagtcttgcacacacggaatccctggcgacctccaaatctatcatattgggaatctgcttaagggagatcgggtgaacggccacctgatccataaaattgagccccacttcaataccagctggatgtcctgggacgggtgtgatctcgactactactgcaacatgggagattggcctagctgtacgtatacaggcgtcacccagcacaatcatgctgcctttgtgaacctgctgaatatcgaaaccgactacacaaagaccttccacttccattctaaacgcgttacagcccacggggatacgccccagcttgacctcaaggctagaccgacctatggcgccggagagattacagtgctggtcgaggtggctgatatggaactgcataccaaaaaggtggagatctccggcctcaagtttgccagcctggcgtgcacagggtgttacgcctgctcctccggaattagctgtaaagtccggatccacgttgacgaacctgatgagcttaccgtgcacgtgaagtcttccgaccccgacgtcgtggctgccagcacgtccctgatggctagaaaactcgagttcggcaccgatagcacatttaaggccttctctgcgatgcccaaaaccagcctgtgcttttatatcgttgaacgcgagtactgtaagtcctgctctgaagacgatacaaagaaatgtgtggacaccaagctggagcagcctcaaagcattcttatcgaacataaagggacaattatcggaaagcagaacgatacctgcacggccaaagcctcctgctggctggagtctgtcaagagcttcttttatggcctcaagaatatgctggggtccgtgttcggcaactttttcgttgggattctcctgtttcttgctccgttcgtgctgctcgtcctgtttttcatgttcggctggaaaatcctgttttgtttcaagtgctgtcggagaacacgcgggctttttaaatacagacacctgaaggacgatgaggaaaccggataccggcgcatcattgagagactcaactctaaaaagggcaagaatcggctgctcgacggggaacgcctggctgatagaaaaatcgccgagcttttcagcaccaagacacatattgga

SEQ ID NO: 13798 - RNA, 3495 nt, synthetic construct
  misc_feature 1..3495: note = derived and/or modified CDS sequence (opt5) from CCHVF(CCHVF 4701-ST-2009)__KR814872.1__Gn-NSm-Gc
  source 1..3495: mol_type = other RNA
agcgaggaacccggcgacgattgcatctccagaacccagctgctcaagacagagacggccgaaattcacgacgataactacgggggacctggcgacaaaatcaccatttgtaatgggtctacagtggtcgatcaacggctgggaagcgagcttggctgctataccatcaaccgcgttaagtccttcaaactgtgtgaaaattctgctacagggaagacctgcgagattgacagcacaccggtgaaatgtagacagggattttgcctcaagatcacccaggagggccggggccatgtgaagctgtcccgcgggtctgaagtcgtgcttgatgcctgtgacagctcctgcgagatcatgattcccaaaggaacgggcgatatcctggttgactgtagcgggggacagcaacacttcctcaaggataacctgattgacctgggctgccctcatatccccctcctggggaaaatggcgatttacatctgtagaatgtctaatcaccctcggaccacaatggcttttcttttctggttttccttcggatatgtgattacctgcatcttttgcaaggccctgttctacagcctcatcattatcggcacactgggcaaaaagattaagcagtatcgcgaacttaaaccccagacctgtacgatctgcgagacagcccctgtcaacgctattgatgccgagatgcatgacctgaattgttcttacaacatctgcccgtattgtgcttccagactcaccagcgacgggctggcccggcacgtgacacagtgccccaagcgcaaagaaaaggttgaggaaaccgagctgtacctcaatctggaaagaatcccttggattgtgcggaaacttctgcaagtctctgagtccaccggagtggcgctcaagcgcagctcctggctgatcgtgcttctggtcctcctgacagtttctctgagccccgtgcagtccgcccctgtgggccacgggaaaacgattgagacctaccagacaagagaaggatttaccagcatctgtctcttcatgctgggctctattctttttatcgtctcctgcctggtgaaggggctcgttgatagcgtgtctgacagcttctttcccggactgtccgtctgtaagacatgctctatcggcagcattaacggcttcgagatcgaatcccataaatgttattgcagccttttctgctgtccgtactgccggcactgttctgctgatcgcgagattcatcagctgcacctctccatctgcaagaaaagaaagaccgggagcaatgtgatgctggccgtttgtaaacggatgtgctttaaggctacgattgaagcctctagacgcgcgctgctcatccggtccattatcaacacaaccttcgtgatgtgtatcctgacccttgccatttgcgtcgtgagcacatccgctgtcgagatggaggacctgcctgccggaacctgggaaagagaggaagatctcacaaatttttgtcaccaagagtgccaggtgacggaaaccgagtgtctgtgcccctatgaggctctggttcttcgcaagcctctcttcctggactctatcgtgaaaggcatgaagaacctgctcaatagcacatccctggaaacctctcttagcattgaggccccctggggagccatcaacgtccagtccacatttaaacccaccgtgagcacggctaacattgcgctgtcttggtccagcgttgaacatcgggggaataagatcctcgtgaccggcagatctgagtccatcatgaaactggaggaacgcacaggggtcagctgggatctgggcgtggaggacgcctctgaaagcaaacttctcaccgtgtccattatggatctgagccaaatgtactctcctgttttcgagtatctgtccggagaccggcaggtcgaagagtggccgaaggctacatgcaccggcgattgtcccgagagatgcgggtgtacgagctccacatgcctccacaaagaatggcctcattctcgcaactggcggtgtaatcccacctggtgctggggagtgggcacagggtgtacctgctgtggagtggacgtcaaggacctgtttaccgatcacatgttcatcaaatggaaggtggagtacattaaaacagaagccatcgtttgcgtggagcttacgagccaggaaagacagtgttccctgattgaggccggcacccgctttaacctcgggcctgtcacaatcaccctgtctgagccccggaatatccaacagaagctgccgcctgaaattatcacacttcatcccaagattgaggaaggcttctttgacctcatgcacgtgcagaaagttctgagcgcttccaccgtgtgcaagctgcagtcttgcacgcacggaatccctggcgatctccaaatttatcatatcgggaacctgcttaaaggagacagagtcaatggccacctgatccataagattgagccccacttcaacacaagctggatgtcctgggatgggtgtgacctcgattactactgcaatatgggagactggcctagctgtacctataccggcgtgacacagcacaaccatgccgcgtttgttaatctgctgaacatcgaaaccgattacacaaaaacgttccacttccattctaagcgggtgaccgctcacggggacacaccccagcttgatctcaaagcccgcccgacctatggcgccggagagattacagtcctggtggaggtggctgacatggaactgcataccaagaaggtcgagatctccggcctcaaatttgccagcctgacgtgcaccgggtgttacgcttgcagctccggaattagctgtaaggttagaatccacgtggatgaacctgacgagcttacagtgcacgtcaaatcttccgaccccgatgtggttgccgcgagcacctccctgatggcccggaagctcgagttcggcacagacagcacctttaaggctttctctgccatgcccaagacaagcctgtgcttttatattgtggaaagagagtactgtaagtcctgctctgaagatgacaccaaaaagtgtgtcgatacgaaactggagcagcctcaaagcatccttatcgaacataaggggacaattatcggaaaacagaatgatacctgcaccgctaaggcctcctgctggctggagtctgtgaagtctttcttttatggcctcaaaaacatgctggggtccgttttcggcggatttttcgtgggcattctcctgtttcttgcgccgttcgtcctgctcgtgctgtttttcatgttcgggtggaagatcctgttttgtttcaaatgctgtcgccggacaagaggactttttaagtaccgccacctgaaagacgacgaggaaaccggctacagacggattatcgagcgcctcaattctaagaaggggaaaaacagactgctcgatggagaacggctggccgaccgcaagatcgctgagcttttcagcacgaaaacacatattggc

SEQ ID NO: 13799 - RNA, 3495 nt, synthetic construct
  misc_feature 1..3495: note = derived and/or modified CDS sequence (opt5) from CCHVF(CCHVF 5170-R-2011)__KR814873.1__Gn-NSm-Gc
  source 1..3495: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgtgtgtgacagctcctgcgagattatgatccccaaaggaacgggcgatattctggttgactgtagcgggggacagcaacacttcctcaaggataacctgatcgacctgggctgccctcatattcccctcctggggaaaatggccatctacatttgtagaatgtctaatcaccctcggaccacaatggcgtttcttttctggttttccttcggatatgtgattacctgcatcttttgcaaggctctgttctacagcctcattatcattggcacactgggcaaaaagatcaagcagtatcgcgaacttaaaccccagacctgtacgatttgcgagacagcccctgtcaacgccatcgatgctgagatgcatgacctgaattgttcttacaacatctgcccgtattgtgcctccagactcaccagcgaagggctggctcggcacgtgacacagtgccccaagcgcaaagagaaggttgaagagaccgaactgtacctcaatctggagagaatcccttggatcgtgcggaaacttctgcaagtctctgagtccaccggagtggccctcaagcgcagctcctggctgattgtgcttctggtcctcctgacagtttctctgagccccgtgcagtccgcgcctgtgggccacgggaaaacgatcgaaacctaccagacaagagagggatttaccagcatttgtctcttcatgctgggctctatcctttttatcgtctcctgcctggtgaaggggctcgttgacagcgtgtctgatagcttctttcccggactgtccgtctgtaagacatgctctattggcagcatcaacggcttcgaaattgagtcccataaatgttattgcagccttttctgctgtccgtactgccggcactgttctgccgaccgcgaaatccatcagctgcacctctccatttgcaagaaaagaaagaccgggagcaatgtgatgctggctgtttgtaaacggatgtgctttaaggccacgatcgaggcttctagacgcgccctgctcattcggtccatcatcaacacaaccttcgtgatttgtatcctgacccttgcgatttgcgtcgtgagcacatccgccgtcgagatggaagatctgcctgctggaacctgggagagagaagaggacctcacaaatttttgtcaccaagaatgccaggtgacggagaccgagtgtctgtgcccctatgaagccctggttcttcgcaagcctctcttcctggattctatcgtgaaaggcatgaagaacctgctcaatagcacatccctggagacctctcttagcattgaagctccctggggagccatcaacgtccagtccacatttaaacccaccgtgagcacggccaacatcgctctgtcttggtccagcgttgagcatcggggaaataagattctcgtgaccggcagatctgagtccatcatgaaactggaggaacgcacaggggtcagctgggacctgggcgtggaagatgcgtctgagagcaaacttctcaccgtgtccattatggacctgagccaaatgtactctcctgttttcgaatatctgtccggagatcggcaggtcgaggagtggccgaaggccacatgcaccggcgactgtcccgaaagatgcgggtgtacgagctccacatgcctccacaaggagtggcctcattctcgcaactggcggtgtaatcccacctggtgctggggagtgggcacagggtgtacctgctgtggagtggatgtcaaggacctgtttaccgaccacatgttcatcaaatggaaggtggaatacattaaaacagaggctatcgtttgcgtggaacttacgagccaggagagacagtgttccctgatcgaggccggcacccgctttaacctcgggcctgtcacaattaccctgtctgaaccccggaatatccaacagaagctgccgcctgagattatcacacttcatcccaagattgaagagggcttctttgatctcatgcacgtgcagaaagttctgagcgcctccaccgtgtgcaagctgcagtcttgcacgcacggaatccctggcgacctccaaatctatcatattgggaacctgcttaaaggagatagagtcaatggccacctgatccataagattgaaccccacttcaacacaagctggatgtcctgggacgggtgtgatctcgactactactgcaatatgggagattggcctagctgtacctataccggcgtgacacagcacaaccatgctgcctttgttaatctgctgaacatcgagaccgactacacaaaaacgttccacttccattctaagcgggtgaccgcgcacggggatacaccccagcttgacctcaaagctcgcccgacctatggcgccggagagattacagtcctggtggaagtggccgatatggagctgcataccaagaaggtcgaaatctccggcctcaaatttgctagcctgacgtgcaccgggtgttacgcctgttcttccggaattagctgcaaggttagaatccacgtggacgagcctgatgagcttacagtgcacgtcaaatcttccgaccccgacgtggttgctgccagcacctccctgatggcgcggaagctcgaatttggcacagatagcacctttaaagccttctctgctatgcccaagacaagcctgtgcttttatatcgtggagagagaatactgtaagtcctgctctgaggacgataccaaaaagtgtgtcgacacgaaactggaacagcctcaaagcattcttatcgagcataaggggacaattatcggaaaacagaatgatacctgcaccgccaaggcttcctgctggctggagtctgttaagagcttcttttatggcctcaaaaacatgctggggtccgtgttcggctctttcttcgtggggattctcctgtttcttgccccgttcgtcctgctcgtgctgtttttcatgttcggctggaagatcctgttttgtttcaaatgctgtcgccggacaagagggctttttaagtaccgccacctgaaagacgatgaagagaccggatacagacggatcattgaacgcctcaatagcaagaagggcaaaaacagactgctcgacggggagcggctggcggatcgcaagatcgccgaacttttctccacgaaaacacatattgga

SEQ ID NO: 13800 - RNA, 3495 nt, synthetic construct
  misc_feature 1..3495: note = derived and/or modified CDS sequence (opt5) from CCHVF(CCHVF Oman-199809166)__KR864901.1__Gn-NSm-Gc
  source 1..3495: mol_type = other RNA
agcgaggaatccggcgaggactgcatctctagaacccagctgctccggacagaaacggccgagattcacggggataactacggaggccccggggacaagatcaccatttgtaatggaagcacaatcgtggatcaacgcctgggctccgaacttgggtgctataccattaacagagtcaaatctttcaagctgtgtgagaatagcgctacaggaaaatcctgcgagatcgacaacacccctgttaagtgtaaacagggcttttgcctcaagatcacacaggaaggccgggggcatgtgaagctgtctcgcgatagcgaggtggtccttgacgcctgtgattccagctgcgaaattatgatcccgaaaggaaccggcgacattctggtggattgttctgggggacagcaacacttcctcaaggacaatctgatcgatctgggctgccccaacattcctctcctggggaaaatggcgatctacatttgtagaatgtccaatcatcccaagacgaccatggcttttcttttctggtttagcttcggatatgttatcacatgcatcctgtgcaaagtgatcttttacctcctgattgtcgtgggcacccttggcaagaagttcaaacagtatcgggagctgaagcctcagacatgtaccatttgcgagacgacacccgttaacgccatcgacgccgaaatgcacgatctcaattgttcttacaacatttgcccttattgtgcttcccgcctgaccagcgacgggctggccagacatgtgatgcagtgcccgaaacggaaggagaaaatcgaagagacagaactctacctgaatcttgagcgcatcccctgggtcgtgagaaagctgctccaagtgtctgagtccaccggagtcgctctgaaacggagctcctggcttattgttctgctcgtgctgctgaccgtgtctctcagccctgtccagtccgcccccatcggccacgggaagacaattgaaacgtaccagacccgcgagggatatacaagcatctgtctgtttgtgcttggctctattctgttcatcgtttcccacctcatgaaggggctggtggacagcgtcggaaacagctttttccctggcctttctatctgcaaaacctgttccattggctctatcaatgggtttgaaattgagagccataagtgctactgttccctgttctgctgcccctattgtagacactgcagcgcggataaagaaatccataagctccacctgtctatttgtaaaaagcggaaggccggatccaacgtgatgctggctgtttgcaaacgcatgtgtttcagagccacaatggaggtgagcaataaggctctcctgatccggtctgtcattaacaccacgtttgtggtctgcatccttatcctggccgtgtgtgttgtgtccacaagcgcggtcgagatggaatccctcccggccggcacctgggagagagaagaggacctgaccaacttctgccaccaggaatgtcaagtgacagagaccgagtgcctgtgtccttacgaagctcttgttctccgcaaacccctgtttctggattctattgccaaggggatgaaaaatctcctgaacagcacatcccttgagacgtctctgagcatcgaagctccttggggagccattaatgtgcagtccaccttcaagcccacagtcagcaccgccaacatcgctctctcttggtccagcgtggagcatcggggcaataagattctggtgtctgggagatccgagagcatcatgaaactggaagagagaacaggcatctcttgggaccttggagttgaagatgcgagcgagtccaagctcctgaccgtcagcgtgatggacctgtctcagatgtattcccccgtgtttgaatacctcagcggcgatcggcaagtcgaggagtggcctaaagccacgtgcaccggggactgcccggaaagatgtggatgcacatcctctacctgtctgcacaaggagtggccccatagccgcaactggcggtgcaatcctacatggtgttggggcgtggggaccggatgcacgtgttgcggccttgatgttaaagacctgttcacagattatatgtttgtgaagtggaaggtcgaatacattaaaaccgaggctatcgtgtgtgttgaactcacatcccaggagagacagtgctctctgattgaggccgggacccgcttcaacctgggccccgtgaccatcacacttagcgaacctcggaatattcagcaaaagctgcccccggagatcgtcacgctccaccctagaatcgaagagggatttttcgacctgatgcatgtgcagaaagttctctccgcctctaccgtgtgtaagctgcagagctgcacacacggcgtccccggggaccttcaggtgtaccacattggaaacctgctcaaaggcgataaggtgaatgggcatctgatccacaaagtcgaacctcattttaacacctcctggatgagctgggacggatgcgatctggactattactgtaatatgggcgattggccctcttgcacatataccggggttacgcaacacaaccacgctgccttcgtgaatcttctcaacattgagacagactacaccaagaactttcatttccactccaagcgcgtgaccgcgcatggcgatacacctcagctggacctgaaagctcggcccaattatggagccggcgagatcaccgtcctcgtggaagttgccgatatggagctgcacacaaagaaaattgaaatcagcgggcttaagttcgcttctctgacgtgtaccggatgctacgcctgttccagcggcatctcttgcaaagtgcgcattcatgtcgacgagccggatgagctcacagtgcacgttaagtccgaagaccctgatatcgtggctgccagctccagcctgatggcgcggaagctggagtttgggaccgactctacattcaaagcctttagcgctatgcccaagacctccctttgtttctatattgtcgaacgcgagtactgcaaatcttgtagcaaggaagacacgcagaaatgcgtgaacgccaagctggagagaccccagtccatcctcattgagcacaagggaaccatcattggcaaacaaaatgatacatgtaccgctaaggcctcttgctggctggaaagcgttaaatcctttttctacgggctcaagaacatgctgtctggcatctttggaaatgtgttcatcggcatttttcttttcctggcgccttttatcctcctgattctgttctttatgttcgggtggcggatccttttctgctttaaatgttgcagacgcacacggggactgttcaagtatagacatctcaaggacgatgaggaaaccggctaccgcaaaattatcgagagactgaacaataagaaagggaagaacaaactcctggacggagaacggcttgccgatcgcaagatcgctgagctgtttagcacaaaaacccacattggc

SEQ ID NO: 13801 - RNA, 3495 nt, synthetic construct
  misc_feature 1..3495: note = derived and/or modified CDS sequence (opt5) from CCHVF(CCHVF 200406546-Turkey)__KR864902.1__Gn-NSm-Gc
  source 1..3495: mol_type = other RNA
agcgaggaacccggcgacgattgcatctccagaacccagcttctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgtgtgtgacagctcctgcgaggttatgattcccaagggaacgggcgatatcctggtggactgtagcgggggacagcaacacttcctcaaagataacctgattgacctgggctgccctcatgtccccctcctggggcggatggccatctacatttgtcgcatgtctaatcaccctagaaccacaatggcgtttcttttctggttttccttcggatatgtgattacctgcatcttttgcaaggctctgttctacagcctcatcatcattggcacactgggcaaaaagtttaaacagtatcgggaacttaagccccagacctgtacgatctgcgagacagcccctgttaacgccattgatgctgagatgcatgacctgaattgttcttacaacatctgcccgtattgtgcctcccgcctcaccagcgacgggctggctagacacgtgccccagtgccctaagcggaaagaaaaggtcgaggaaacagagctgtacctcaatctggaacgcattccctggatcgtgagaaaacttctgcaagtgtctgagtccaccggagtcgccctcaagcggagctcctggctgatcgttcttctggtgctcctgaccgtgtctctgagccctgtccagtccgcgcccgtgggccacgggaaaacaattgagacgtaccagacccgcgaaggattcacaagcatctgtctctttatgctgggctctattcttttcatcgtttcctgcctggtgaaggggctcgtcgatagcgtgtctgacagctttttcccgggactgtccgtttgtaaaacctgctctattggcagcatcaacggcttcgagatcgaatcccataagtgttattgcagcctgttttgctgtccttactgcagacactgttctgccgatcgggagattcatcagcttcacctctccatctgcaagaaaagaaagacagggagcaatgtgatgctggctgtctgtaaacgcatgtgcttccgggccaccattgaggcttctagacgcgccctgctcatccggtccattatcaacacgacatttgtgatttgtatcctgacccttaccatctgcgtcgtgagcacatccgcggttgaaatggagaatctgcccgccggaacctgggaaagagaggaagacctcacaaacttctgtcaccaagagtgccaggtgacggaaaccgagtgtctgtgcccttatgaggctctggtccttcgcaagcccctctttctggattctattgtgaaaggcatgaagaatctgctcaacagcacatccctggaaacctctcttagcatcgaggccccctggggagctattaacgttcagtccacattcaagcctaccgtgagcacggccaatatcgccctgtcttggtccagcattgaacatcggggaaacaaaatcctcgtcaccggcagatctgagtccatcatgaagctggaggaacgcacaggggtgagctgggacctgggcgtggaggatgcttctgaaagcaaacttctcaccgtttccattatggacctgagccaaatgtactctccggtctttgagtatctgtccggagatagacaggtggaagagtggcccaaggcgacatgcaccggcgactgtcctgagcggtgcgggtgtacgagctccacatgcctccacaaagaatggccccattctcgcaattggcggtgtaaccctacctggtgctggggagtgggcacagggtgtacctgctgtggagtcgatgtgaaggacctgttcaccgaccacatgtttgttaagtggaaagtggagtacatcaagacagaagccattgtctgcgtggagcttacgagccaggaaagacagtgttccctgatcgaggctggcacccggttcaatctcgggcccgttacaattaccctgtctgagccgcgcaacatccaacagaaactgcctcccgaaatcattacacttcatcctaaggtggaggaaggctttttcgatctcatgcacgtccagaaagtgctgagcgcctccaccgtttgcaagctgcagtcttgcacgcacggaatccccggcgacctccaagtgtatcatattgggaatctgcttaagggagatagagtcaacggccacctgatccataaaattgagcctcactttaatacaagctggatgtcctgggacgggtgtgatctcgactactactgcaacatgggagattggcccagctgtacctataccggcgtgacacagcacaatcatgccgctttcgtgaacctgctgaatatcgaaaccgactacacaaagacgttccactttcattctaaacgggtcaccgcccacggggatacaccgcagcttgacctcaaggcgagacctacctatggcgctggagagatcacagttctggtggaggtggccgatatggaactgcataccaaaaaggtcgagatttccggcctcaaattcgccagcctggcttgcacggggtgttacgcctgttcttccggaatcagctgcaaggtgcgcattcacgttgacgaacccgatgagcttaccgtgcacgtcaagtcttccgaccccgacgtggttgctgccagcacatccctgaccgcgcggaaactcgagtttggcacagatagcaccttcaaggccttttctgctatgcctaaaacaagcctgtgcttctatatcgtggaaaaggagtactgtaaatcctgcaacgaagacgatacccagaagtgtgtcgacacgaagctggagcaaccgcagtctattcttatcgaacataaagggacaattatcggaaagcagaatgatacctgcaccgccaaagctagctgctggctggagtccgtgaagtctttcttttatggcctcaaaaacatgctggggagcgtttttggcaacttctttatcgggattctcctgttccttgccccctttgtgctgctcgtcctgttcttcatgtttggctggaagatcctgttctgttttaagtgctgtagacgcacaagagggcttttcaaataccggcacctgaaggacgatgaggaaaccggatacaaacgcattatcgagagactcaataacaagaaaggcaagaatcggctgctcgacggggaacgcctggcggatagaaagattgccgagctgttttccacgaaaacacatatcgga

SEQ ID NO: 13802 - RNA, 3495 nt, synthetic construct
  misc_feature 1..3495: note = derived and/or modified CDS sequence (opt5) from CCHVF(CCHVF 1-CR/HU-2015)__KU161584.1__Gn-NSm-Gc
  source 1..3495: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacagctcctgcgaggtgatgattcccaagggaacgggcgatatcctggttgactgtagcgggggacagcaacacttcctcaaagataacctgattgacctgggctgccctcatatccccctcctggggaagatggcgatttacatctgtcggatgtctaatcaccctcgcaccacaatggcttttcttttctggttttccttcggatatgtgattacctgcatcttttgcaaagccctgttctacagcctcatcattatcggcacactgggcaagaaaattaagcagtatagagaacttaagccccagacctgtacgatctgcgagacagcccctgtcaacgctattgatgccgagatgcatgacctgaattgttcttacaacatctgcccgtattgtgcttcccggctcaccagcgacgggctggcccgccacgtgacacagtgccccaaaagaaaggaaaaagttgaggaaaccgagctgtacctcaatctggaacggatcccttggattgtgcgcaaacttctgcaagtctctgagtccaccggagtggcgctcaagagaagctcctggctgatcgtgcttctggtcctcctgacagtttctctgagccccgtgcagtccgcccctgtgggccacgggaagacgattgagacctaccagacacgggaaggatttaccagcatctgtctcttcatgctgggctctattctttttatcgtctcctgcctggtgaaagggctcgttgatagcgtgtctgacagcttctttcccggactgtccgtctgtcgcacatgctctatcggcagcattaacggcttcgagatcgaatcccataagtgttattgcagccttttctgctgtccgtactgcagacactgttctgctgatcgggagattcatcagctgcacctctccatctgcaagaaaagaaagaccgggagcaatgtgatgctggccgtttgtaaacgcatgtgctttcgggctacgatggaagcctctagacgcgcgctgctcattcggtccatcattaacacaaccttcgtgatctgtatcctgacccttacaatttgcgtcgtgagcacctccgccgtcgagatggagaatctgcctgctggaacatgggaaagagaggaagacctcacgaacttttgtcaccaagagtgccaggtgaccgaaacagagtgtctgtgcccctatgaggccctggttcttcgcaagcctctcttcctggattctatcgtgaaaggcatgaagaatctgctcaacagcacctccctggaaacatctcttagcattgaggctccctggggagccatcaacgtccagtccacctttaagcccacggtgagcaccgccaatattgctctgtcttggtccagcgttgaacatcggggaaacaaaatcctcgtgacaggcagatctgagtccatcatgaagctggaggaacgcaccggggtcagctgggacctgggcgtggaggatgcgtctgaaagcaaacttctcacagtgtccattatggacctgagccaaatgtactctcctgttttcgagtatctgtccggagatcggcaggtcgaagagtggccgaaggctacctgcacgggcgactgtcccgagagatgcgggtgtacaagctctacctgcctccacaaagaatggcctcattctcgcaattggcggtgtaaccccacatggtgctggggagtgggcaccgggtgtacctgctgtggagtggatgtcaaggacctgtttacagaccacatgttcgtgaagtggaaagttgagtacatcaagacggaagccattgtgtgcgtcgagcttaccagccaggaaagacagtgttccctgatcgaggccggcacacggtttaatctcgggcctgtgaccattacactgtctgagccccgcaacatccaacagaaactgccgcctgaaatcattacccttcatcccaagatcgaggaaggcttctttgatctcatgcacgttcagaaagtgctgagcgcctccacggtctgcaagctgcagtcttgcacacacgggattcctggcgacctccaagtgtatcatatcgggaatctgcttaagggagatagagttaacggccacctgattcataaaatcgagccccacttcaataccagctggatgtcctgggacgggtgtgatctcgactactactgcaacatgggagattggcctagctgtacctatacaggcgtgacccagcacaatcatgctgcctttgtcaacctgctgaatatcgaaacagactacacgaagaccttccacttccattctaaacgggtgacagcgcacggggatacaccccagcttgacctcaaggctagaccgacctatggcgccggagagattaccgtgctggtcgaggttgccgatatggaactgcatacgaaaaaggtggagatctccggcctcaaatttgctagcctggcctgcaccgggtgttacgcttgctcctccggaattagctgtaaggtgcgcatccacgtcgacgaacctgatgagcttacagtgcacgttaagtcttccgaccccgacgtggtcgccgcgagcacctccctgatggcccggaaactcgagttcggcacagatagcacctttaaggctttctctgccatgcccaaaacaagcctgtgcttttatattgtggaaagagagtactgtaagtcctgctctgaagacgataccaaaaagtgtgttgacacgaagctggagcagcctcaaagcatccttattgaacataaagggacaatcatcggaaagcagaacgatacctgcaccgctaaagcctcctgctggctggagtctgtcaagagcttcttttatggcctcaaaaatatgctggggtccgtgttcggcaactttttcattggaatcctcctgtttcttgcgccgttcgtgctgctcgttctgtttttcatgttcggctggaagattctgttttgtttcaagtgctgtcgcagaacacgggggctttttaaataccgccacctgaaggacgatgaggaaaccggatacagacggatcattgagcgcctcaacaataaaaagggcaaaaacagactgctcgacggggaacggctggccgatcgcaagatcgctgagcttttctctacgaagacacatatcgga

SEQ ID NO: 13803 - RNA, 3495 nt, synthetic construct
  misc_feature 1..3495: note = derived and/or modified CDS sequence (opt5) from CCHVF(CCHVF 1231-CR/TI-2015)__KU161585.1__Gn-NSm-Gc
  source 1..3495: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacagctcctgcgaggtgatgattcccaagggaacgggcgatatcctggttgactgtagcgggggacagcaacacttcctcaaagataacctgattgacctgggctgccctcatatccccctcctggggaagatggcgatttacatctgtcggatgtctaatcaccctcgcaccacaatggcttttcttttctggttttccttcggatatgtgattacctgcatcttttgcaaagccctgttctacagcctcatcattatcggcacactgggcaagaaaattaagcagtatagagaacttaagccccagacctgtacgatctgcgagacagcccctgtcaacgctattgatgccgagatgcatgacctgaattgttcttacaacatctgcccgtattgtgcttcccggctcaccagcgacgggctggcccgccacgtgacacagtgccccaaaagaaaggaaaaagttgaggaaaccgagctgtacctcaatctggaacggatcccttggattgtgcgcaaacttctgcaagtctctgagtccaccggagtggcgctcaagagaagctcctggctgatcgtgcttctggtcctcctgacagtttctctgagccccgtgcagtccgcccctgtgggccacgggaagacgattgagacctaccagacacgggaaggatttaccagcatctgtctcttcatgctgggctctattctttttatcgtctcctgcctggtgaaagggctcgttgagagcgtgtctgatagcttctttcccggactgtccgtctgtcgcacatgctctatcggcagcattaacggcttcgaaatcgagtcccataagtgttattgcagccttttctgctgtccgtactgcagacactgttctgctgaccgggaaattcatcagctgcacctctccatctgcaagaaaagaaagaccgggagcaatgtgatgctggccgtttgtaaacgcatgtgctttcgggctacgatggaggcctctagacgcgcgctgctcattcggtccatcattaacacaaccttcgtgatctgtatcctgacccttacaatttgcgtcgtgagcacctccgccgtcgagatggaaaatctgcctgctggaacatgggagagagaagaggatctcacgaacttttgtcaccaagaatgccaggtgaccgagacagagtgtctgtgcccctatgaagccctggttcttcgcaagcctctcttcctggactctatcgtgaaaggcatgaagaatctgctcaacagcacctccctggagacatctcttagcattgaagctccctggggagccatcaacgtccagtccacctttaagcccacggtgagcaccgccaatattgctctgtcttggtccagcgttgagcatcggggaaacaaaatcctcgtgacaggcagatctgagtccatcatgaagctggaagaacgcaccggggtcagctgggatctgggcgtggaagacgcgtctgagagcaaacttctcacagtgtccattatggatctgagccaaatgtactctcctgttttcgaatatctgtccggagaccggcaggtcgaggagtggccgaaggctacctgcacgggcgattgtcccgaaagatgcgggtgtacaagctctacctgcctccacaaagagtggcctcattctcgcaattggcggtgtaaccccacatggtgctggggagtgggcaccgggtgtacctgctgtggagtggacgtcaaggatctgtttacagaccacatgttcgtgaagtggaaagttgaatacatcaagacggaggccattgtgtgcgtcgaacttaccagccaggagagacagtgttccctgatcgaggccggcacacggtttaatctcgggcctgtgaccattacactgtctgaaccccgcaacatccaacagaaactgccgcctgagatcattacccttcatcccaagatcgaagagggcttctttgacctcatgcacgttcagaaagtgctgagcgcctccacggtctgcaagctgcagtcttgcacacacgggattcctggcgatctccaagtgtatcatatcgggaatctgcttaagggagacagagttaacggccacctgattcataaaatcgaaccccacttcaataccagctggatgtcctgggatgggtgtgacctcgattactactgcaacatgggagactggcctagctgtacctatacaggcgtgacccagcacaatcatgctgcctttgtcaacctgctgaatatcgagacagattacacgaagaccttccacttccattctaaacgggtgacagcgcacggggacacaccccagcttgatctcaaggctagaccgacctatggcgccggagagattaccgtgctggtcgaagttgccgacatggagctgcatacgaaaaaggtggaaatctccggcctcaaatttgctagcctggcctgcaccgggtgttacgcttgctcctccggaattagctgtaaggtgcgcatccacgtcgatgagcctgacgagcttacagtgcacgttaagtcttccgatcccgacgtggtcgccgcgagcacctccctgatggcccggaaactcgagttcggcacagacagcacctttaaggctttctctgccatgcccaaaacaagcctgtgcttttatattgtggagagagaatactgtaagtcctgctctgaggatgacaccaaaaagtgtgttgatacgaagctggaacagcctcaaagcatccttattgagcataaagggacaatcatcggaaagcagaacgatacctgcaccgctaaagcctcctgctggctggagtctgtcaagagcttcttttatggcctcaaaaatatgctggggtccgtgttcggcaactttttcattggaatcctcctgtttcttgcgccgttcgtgctgctcgttctgtttttcatgttcggctggaagattctgttttgtttcaagtgctgtcgcagaacacgggggctttttaaataccgccacctgaaggacgacgaagagaccggatacagacggatcattgaacgcctcaacaataaaaagggcaaaaacagactgctcgatggggagcggctggccgaccgcaagatcgctgaacttttctctacgaagacacatatcgga

SEQ ID NO: 13804 - RNA, 3495 nt, synthetic construct
  misc_feature 1..3495: note = derived and/or modified CDS sequence (opt5) from CCHVF(CCHVF Gaib)__KX013445.1__Gn-NSm-Gc
  source 1..3495: mol_type = other RNA
agcgaggaatcctctgacgattgcatcagcagaacccagctgctccggacagagacggccgaaattcacaacgacaattacggcgggcccggagataagatcaccatttgtaacggctccacaatcgtggaccaacgcctggggtctgagcttggatgctataccattaatagagtcaagagcttcaagctgtgtgaaaactccgctacaggcaaatcttgcgagatcgatagcatccctgttaagtgtcggcaggggttttgcctcaaaattacccaggagggacgcggccatgtgaagctgtccagaggcagcgaagtggtccttgacgcctgtgattcttcctgcgagatcatgattccgaaggggacaggagacatcctggtggattgtagcggcgggcagcaacacttcctcaaagacaatctgattgatctgggatgccccaacatccctctcctgggcaagatggcgatttacatctgtcggatgtctaatcatcccaaaaccacgatggcttttcttttctggttttccttcgggtatgttattacctgcatcttttgcaaggccatcttctacctgctcattatcgtgggaacactgggcaaaaagtttaagcagtatcgcgaacttaaacctcagacctgtacaatttgcgagaccacgcccgtcaacgccatcgacgctgagatgcacgatctgaattgtagctacaacatctgcccttattgtgcctctagactcacatccgacggcctggctcggcatgtggttcactgcccgaagcgcaaagaaaagattgaggaaaccgagctgtacctcaatctggaaagagtgccctgggtcgtgcggaaacttctccaggtgagcgagtccacaggggtcgccctgaagcgctctagctggctgatcgttcttctggtgctcctgaccgtgtccctgagccctgtccaatctgcgcccattggacacggcaaaaccatcgagacataccagacgagagaagggtatacctccatttgtctcttcgtgctgggaggcatcctttttatcgttagctgcctgatgaaggggctcgtggactctgtcggaaacaatttctttcctggcctgacaatttgtaagacctgcagcatctcctctattaacggcttcgagatcgaaagccataaatgttactgctcccttctgtgctgtccctattgccggcactgtagcgccgatcgcgagattcatcagctccacctgtctatctgcaagaaaagaaagacagggtccaatgtgatgctggctgtttgtaaacggatgtgcctcagagtgaccacggaagtcagcaaccgcgccctgttcattcggtctatcatcaacacaacctttgtgatttgtatccttattctggctgtctgcgtgatctccaccagcgccgttgagatggagaatctcccggcgggaacatgggaaagagaggaagacctgaccaacttctgtcaccaggagtgccaagtgacagaaacggagtgtctgtgcccttacgaggcccttgtcctccgcaagcccctgttttccgattctattgtgaagggcatgaaaaatctgctcaacagcacctccctggaaacatctcttagcatcgaggctccttggggagccatcaatgttcagtccaccttcaagcccacagtgagcaccgctaacattgccctgtcttggtccagcatcgaacatcgggggaataaaattctcgtctctggcagatccgagagcatcatgaagctggaggaacgcacggggatttcttgggacctgggcgtggaggatgccagcgaatcccggcttctcaccgtgagcgttatggacctgtctcagatgtattcccccgtctttgagtacctgagcggagatagacaagtggaagagtggcctaaagctacatgcaccggcgactgtccggagcgctgcgggtgtacatcctctacctgcctccacaaggaatggccccatagccggaactggagatgtaatcctacgtggtgctggggagtgggcacagggtgtacctgctgtggactggatgtcaaggaccttttcacagattatatgtttgtgaaatggaaggttgagtacatcaaaaccgaagcgatcgtgtgcgtcgagctgacctcccaggaacgccagtgttctctcattgaggccggcacacggttcaacctggggcccgtgacgatcaccctgagcgagcctagaaatattcagcaaaaacttcccccggaaatcattacactccaccctcggatcgaggaaggctttttcgacctgatgcatgttcagaaagtgctgtccgcttctaccgtctgcaagctccagagctgcacacacggagtgcccggcgacctgcaggtttaccacatcgggaaccttctgaagggagataaagtgaatggccatctcattcacaagatcgagcctcattttaacacctcctggatgagctgggacgggtgtgatctggactattactgcaatatgggagattggccctcttgtacgtatacaggcgtcacccaacacaaccacgccgccttcgtgaacctgcttaatattgaaaccgactacacaaagaactttcatttccactccaagcgcgtgaccgctcatggggatacacctcagctcgacctgaaagccagacccacgtatggcgcgggagagatcaccgtcctggttgaggtggctgatatggaactccacacaaagaaaattgagatcagcggcctgaagttcgcctctcttacctgcacagggtgttacgcctgctccagcggaatttcttgtaaggtgcggatccatgtcgacgaaccggatgagctgaccgtgcacgttaaatccgaggaccctgatatcgtggctgccagctccagcctcatggctagaaagctggaatttggcacggactctaccttcaaagcctttagcgcgatgcccaagacatccctgtgcttctatattgtcgagcgcgaatactgtaaatcttgcagccgggaggacacccagaagtgtgtgtccacaaaacttgaacagccccaatctatcctgattgagcacaaagggaccatcattggaaagcagaataacacatgcaccacgaaaacaacctgctggctcgagagcgttaagtcctttttctacggcctgaaaaatatgctctctagcatctttgggaacgtgttcgtcggcatcttttccttcctggccccttttattcttctgatcctcttctttatgttcggatggcgcattctgttctgttttaagtgctgtagaagaacccggggcctgttcaagtatcgccatcttaaagatgacgaagagacagggtacagacggatcattgaacgcctgaataacaagaaaggaaagagcaaactcctggatggcgagagactcgctgaccggaagatcgccgaactgttttctaccaagacgcacatcggg

SEQ ID NO: 13805 - RNA, 3495 nt, synthetic construct
  misc_feature 1..3495: note = derived and/or modified CDS sequence (opt5) from CCHVF(CCHVF Hodzha)__KX013448.1__Gn-NSm-Gc
  source 1..3495: mol_type = other RNA
agcgaggaatccggcgacgattgcatctctagaacccagctgctccggacagagacggccgaaattcacggggacgattacggaggccccggggacaagatcaccatttgtaacggaagcacaatcgtggatcaacgcctgggctccgagcttgggtgctataccattaatagagtcaaatctttcaagctgtgtgaaaacagcgctacaggaaaatcctgcgagatcgactctacccctgttaagtgtcggcagggctactgcctcaaaatcacacaggagggccgcgggcatgtgaagctgagcagaggatccgaagtggtccttgatgcctgtgacagctcttgcgaggtgatgattccgaagggcaccggggatatcctggttgactgttccggaggccagcaacactttctcaaagataatctgattgacctggggtgcccccggatccctctcctgggaaagatggcgatttatatctgtcgcatgagcaaccatcccgaaacgaccatggctttccttttctggttctcttttggctacgtgattacatgcatcctgtgcaaagccatcttctatctcctgattatcgtcggcacccttgggaagagatttaaacagtaccgggagctgaagcctcagacatgtaccatttgcgagacgacacccgccaatgctatcgatgccgaaatgcacgacctcaactgttcctataatatttgcccttactgtgctagccgcctgacctctgacggactggccagacatgtgacacagtgcccgaagcggaaagagaaggttgaagagaccgaactctacctgaaccttgagcgcatcccctggatcgtgagaaaactgctccaagtctccgagagcaccggcgtggcgctgaagcggtcctcttggcttattgtgctgctcgtcctgttcgccgttagcctgtcccctgtgcagagcgctcccatcgggcacggaaaaacaattgaaacgtatcaggcccgcgaggaatacacctctatctgtctctttgtgctgggctccattcttttcatcgtcagctgcctgatgaaggggctcgtggattctatcggaaatatctttttccctggcctgacaatttgtaaaacctgcagcattggctccatcaacgggtttgagattgaatctcacaagtgttattgcagccttctgtgctgtccctactgcagacattgtccggctgaccgggagatccaccagctccatctgtccatttgcaagaaaagaaagacaggaagcaatgttatgctggccgtgtgtaaacgcatgtgcttccgggcgaccatggaggtctctaacaaggccctcctgatcagatccatcattaatacgacattcgtggtttgtatccttattctggctgtgtgcgtcgtgagcacctctgccgtcgaaatggagtccctccctgctggcacctgggaacgcgaggaagatctgacaaacttttgtcaccaagagtgccaggtgaccgagacagaatgtctgtgcccctatgaggcccttgttctccggagacctctgttcctggacagcatcgtgaaagggaagaagaatctcctgaactccacgtctcttgaaaccagcctgtccattgaggccccctggggagctatcaacgtccagtctacatacaaacccaccgtgagcacagcgaatatcgccctctcctggagctctgttgagcaccgcggcaacaagattctggtgtccgggcggagcgaatctatcatgaaactggaggaaagaaccggcatttcctgggatcttggagtcgaggacgctagcgaatctaagctcctgacggtgagcgtgatggatctgtcccaaatgtatagccctgtttttgagtacctctctggcgaccgccaggtcgaggaatggccgaaagctacctgcacaggggattgttccgagcggtgcggatgtaccagctccacatgcctgcataaggaatggccccactctagaaattggcgctgtaaccctacctggtgctggggcgtggggacgggatgtacatgctgtggccttgacgtgaaggatctgttcaccgactacatgtttgtcaaatggaaggtggactatatcaaaacagaggccattgtttgcgtggaactcaccagccaggagcggcagtgttccctggtcgaggctgggaccagattcaatctgggccccgtgacaatcacgctttctgaacctcggaacatccaacagaagctcccgcccgagattatcaccctgcatcctcgcattgaagagggatttttcgatctgatgcacgttcagaaagtgctcagcgcctccacagtctgcaagctgcagtcttgcacccatggcgtgcccggggaccttcaagtttaccacatcggaaatctgctcaagggcgataaagtgaacgggcacctgattcataagatcgaacctcactttaatacaagctggatgtcctgggacggatgtgatctggactattactgcaacatgggcgattggcccagctgtacctatacgggggtcacacagcataatcacgcgtctttcgtgaaccttctcaatatcgagaccgactacaccaaatcctttcacttccatagcaagagagtgacagctcacggcgatacccctcagctggacctgaaagcccggcccacatatggagccggcgagattacggtcctcgttgaagtggctgatatggagctgcataccaagaaaatcgaaattacagggcttaagtttgcctctctgacctgcacaggatgttacgcttgctccagcggcatctcttgtaaggtgcgcattcacgtcgacgagccggatgagctcaccgtgcatgttaaatccgacgaccctgatgtggtcgccgcgagctccagcctgatggccagaaagctggaatttgggacggactctaccttcaaagcctttagcgccatgcccaagacatccctttgcttctacatcgtggagcgggaatattgtaaatcttgcagcaaggaggatacccagaagtgtgttaacacaaaactggaacaaccccagtccattctcatcgagcagaagggaaccatcattggcaaacagaataacacatgcaccgctaaggcctcttgctggctggagagcgtgaaatcctttttctacgggctcaagaacatgctgtctggcatctttggaaatgtcttcgtgggcatttttcttttcctggcgccttttatcctcctgattctgttctttatgttcgggtggagaatcctgttttgtttcaagtgctgtcgcagaacgcggggacttttcaaatataagcacctcaaagacgatgaagagacaggctaccgcagaatcattgaacggctgaacaataagaaagggaagaacaagctcctggacggagagcgccttgccgatagacggatcgctgaactgtttagcaccaaaacccacattggc

SEQ ID NO: 13806 - RNA, 3495 nt, synthetic construct
  misc_feature 1..3495: note = derived and/or modified CDS sequence (opt5) from CCHVF(CCHVF IbAn7620)__KX013451.1__Gn-NSm-Gc
  source 1..3495: mol_type = other RNA
agcgaggaaccctccgacgattgcatctctagaacccagctgctccggacagagacggccgaaattcacggcgacaactacgggggacctggcgataagatcaccatttgtaatgggagcacaatcgtggaccaacgcctgggatccgagcttggctgctataccattaacagagtcaaatctttcaagctgtgtgaaaatagcgctacagggaaaaactgcgagatcgattccgttccggtgaagtgtcggcagggatactgcctccgcatcacccaggagggcagaggccatgtgaaactgtctcgggggagcgaaattgtccttgacgcctgtgatacatcctgcgagatcatgattcccaagggaaccggcgacatcctggtggattgtagcgggggacagcaacactttctcaaggacaatctgattgatctgggctgccctaaaatccccctcctggggaagatggcgatttatatctgtcgcatgtctaaccatcctaaaacgaccatggctttcctgttttggttctcctttggatacgttatcacatgcattctttgcaaggccatcttctatctcctgattatcattggcacccttggcaaaagactgaagcagtaccgggaactcaagccccagacatgtaccatctgcgagacgacacctgtgaatgccatcgacgctgagatgcacgatctgaactgtagctataatatttgcccgtactgtgcctctcgcctgacctccgacgggctcgctagacatgtcatccagtgccccaaacggaaggaaaaagtggaggaaacagagctgtaccttaacctggaacgcattccttgggttgtgagaaagctcctgcaagtcagcgagtctaccggagtggcccttaaacggtccagctggctgatcgtgctcctggtcctgtttaccgtttccctctctcccgtgcagagcgcgcctattggccaggggaagacaacggaggcctatcgcgctagagaaggatacacctccatctgtctgttcgtgcttggcagcatcctgtttattgtctcttgcctcatgaaagggctggtggactccgttggaaatagcttctttcccggcctttctatctgtaagacatgcagcatttcctctatcaacggcttcgagattgaaagccacaagtgttattgctccctgttttgctgtccgtactgccggcactgtagcaccgataaagagatccataagctccacctgtctatttgcaaaaagagaaaaacagggtccaatgtgatgctggccgtctgtaagcgcatgtgcttccgggctaccatggaagtgagcaacagagccctcttcatccgctctatcattaatacgacatttgttctgtgtatccttattctggcggtgtgcgtcgtgtccaccagcgccgtcgagatggagaacctccctgctggaacctgggaacgggaggaagacctgacaaacttctgtcatcaggagtgccaagtgaccgaaacagagtgtctgtgcccctatgaggcccttgttctcagaaagcctctgtttctggattccatcgctaaaggcatgaagaatcccctcaactctacgagcctggaaacctccctttctattgaggccccctggggagccatcgacgtgcagagcacatacaaacctaccgtctccacagctaatatcgcgctgagctggtcttccgtggaacaccgcgggaacaagattctcgttagcggccggtctgagtccatcatgaaactggaggaaagaaccgggattagctgggatctgggcgtggaggacgcctctgaaagcaaacttctcacggtctccgtgatggatctgagccagatgtattctccggtgttcgagtacctgtccggagaccgccaagttgaagagtggcccaaggctacctgcacaggcgattgtcctgagcggtgcgggtgtaccagctccacatgcctccacaaagaatggccccattctagaaattggcgctgtaaccctacctggtgctggggagtcggcacggggtgtacatgctgtggactggacgtgaaggatctttttaccgactacatgttcgtgaaatggaaggtcgagtatatcaaaacagaagccattgtgtgcgttgagctgaccagccaggaacggcagtgttccctcatcgaggccggcaccagatttaatctggggcccgtgacaatcacgctgtctgagccgcggaacattcagcaaaaacttcctcccgaaatcattaccctccaccctcgcatcgaggaaggcttctttgacctgatgcatgtccagaaggtgctgagcgcttccacagtttgcaagctccagtcttgcacccacggagtgcccggcgatctgcaggtctaccatattgggaatcttctgaagggagacaaagtgaacggccacctcatccacaagatcgagcctcatttcaatacaagctggatgtcctgggatgggtgtgacctggattattactgcaacatgggagactggcccagctgtacctatacgggcgttacacaacacaatcatgcctcttttgtgaacctgcttaatattgaaaccgattacaccaaaaacttccactttcactccaagagagtcacagcgcatggggacaccccgcagctcgatctgaaagctcggcctacatatggcgccggagagatcacggtgctggtggaggtcgccaacatggaactccacaccaagaagattgagatcagcggcctgaaattcgcttctcttacatgcaccgggtgttacgcctgctccagcggaatttcttgtaaggttagaatccatgtggacgaacccgatgagctgacagtgcacgtcaaatccgacgatcccgacgtggttgctgccagctccagcctcatggcgcgcaagctggagttcggcaccgactctacgtttaaagccttcagcgctatgcctaagacctccctgtgcttttacattgtggaacgggagcattgtaagtcttgcagcgaagaggatacaaagaagtgtgtcaataccaaacttgaacagccgcagtccatcctgatcgagcacaaggggacaattatcggaaaacaaaactctacctgcacagccaaggctagctgctggctcgagtccgtgaagtctttcttttatggcctgaaaaatatgctcagcgggattttcggcaacgtttttatgggaatcttcctgtttcttgcccccttcattctgctcatcctgtttttcatgtttggctggagaatcctgttctgtttcaagtgctgtcgcagaacccgggggctttttaaataccgccacctgaaggacgatgaagagacgggatatagacggattatcgaacgcctcaataacaaaaagggcaagaataaactgctcgacggggagagactggcggatcggcgcattgccgaacttttctccacaaagacccatatcgga

SEQ ID NO: 13807 - RNA, 3495 nt, synthetic construct
  misc_feature 1..3495: note = derived and/or modified CDS sequence (opt5) from CCHVF(CCHVF K128_76)__KX013454.1__Gn-NSm-Gc
  source 1..3495: mol_type = other RNA
agcgacgagtccggcgatgactgcatctctagaacccagctgctccggacagaaacggccgagattcacggggataactacggaggccccggggacaagatcaccatttgtaatggaagcacaatcgtggatcaacgcctgggctccgaacttgggtgctataccattaacagagtcaaatctttcaagctgtgtgagaatagcgctacaggaaaatcctgcgaaatcgactctatccctgttaagtgtcggcagggctactgcctcaaaattacccaggagggccgcgggcatgtgaagctgagcagaggatccgaggtggtccttgatgcctgtgacagctcttgcgaagtgatgatcccgaagggcacaggggatattctggttgactgttccggaggccagcaacactttctcaaagataacctgatcgacctggggtgccccaagattcctctcctgggaaaaatggcgatctatatttgtcggatgagcaatcatcccaagaccacgatggctttcctcttttggttctcttttggctacgtgattacctgcatcgtctgcaaagccattttctatctgctcatcattgtgggcacactggggaagcgctttaagcagtacagagagcttaaacctcagacctgtacaatctgcgaaaccacgcccacaaacgccattgatgctgagatgcacgacctgaattgttcctataacatctgcccttactgtgccagccggctcacctctgacggactggctcgccatgttacacactgcccgaagagaaaagagaaggtggaagagaccgaactgtacctcaatctggagcggatcccctgggtcgtgcgcaaacttctccaggtgtccgaaagcaccggcgtcgccctcaagagatcctcttggctgattgttcttctggtgcttttcgcggtgagcctgtcccctgtccaaagcgcccccatctctcacgggaaaacaattgagacgtatcaggtgcgggaggaatacacctccatctgtctgtttgttctcggaagcattctgttcatcgtgtcttgccttatgaagggcctggtcaacagcgtggggaatatctttttccctggactctccatttgtaagacatgctctatcggcagcattaacggctttgagatcgaatcccataaatgttattgcagcctgctttgctgtccctactgccgccactgttctgctgatagagagattcatcagctgcacctctccatctgcaagaaacggaagaccgggagcaatgttatgctggccgtgtgtaaaagaatgtgcttccgcgctacaatggaagtctctaacaaggccctgttcattcggtccatcatcaataccacgtttgtggtctgtattctcatcctggcggtgtgcgttgtgagcacatccgccgtcgagatggagtctcttccggctggaacctgggaaagagaggaagacctgaccaacttctgtcaccaggagtgccaagtgacagaaaccgagtgtctctgcccttatgaggccctggttctgcgccggcccctttttcaggatagcattgtgaagggcatgaaaaacctcctgaatagcacatctctggaaacgagcctctccatcgaggctccttggggagccattaacgtccagagcacctacaagcccgccgtgtctgctgcgaatatcgccctgtcctggagctctgtggaacatagagggtccaaaatccttgttagcggccgctctgagagcattatgaagctggaggaacggacagggatctcctgggacctcggcgtcgaggatgctagcgaatctaaactgctgaccgtgtccgtgatggaccttagccaaatgtattcccccgtcttcgagtacctctctggagatagacaggtggaagagtggcctaaggccacatgcaccggcgactgtccggagcgctgcgggtgtacgagctctacctgcctgcacaaggaatggccccattcccggaactggagatgtaatcctacatggtgctggggagttggcaccgggtgtacatgctgtggactggatgtgaaagacctctttaccgattacatgttcgtcaagtggaaagtggagtatattaagacggaagccatcgtttgcgtggagctgacaagccaggaacgccagtgttcccttattgaggctggcacccggtttaacctggggcccgtcacaatcaccctctctgagcctagaaatatccaacagaaactgcccccggaaattatcaccctgcaccctcggattgaggaaggcttctttgaccttatgcatgtgcagaaggttctcagcgcctccacagtgtgcaagctgcagagctgcacgcacggagtccccggcgacctgcaagtgtaccacatcgggaacctcctgaaaggagatcgcgtgaatggccatcttattcacaagatcgagcctcatttcaacacctcttggatgtcctgggacgggtgtgatctggactattactgcaatatgggagattggcccagctgtacatataccggcgtcacacagcacaaccacgcgtcttttgttaatctcctgaacatcgaaaccgactacacgaaatccttccattttcacagcaagagagtgacagctcatggggatacccctcagctggaccttaaagcccggcccaattatggcgccggagagattaccgtgctcgtcgaggtggctgatatggaactgcacacaaagaaaatcgagatttctggcctgaagttcgcctccctgacctgcacagggtgttacgcttgcagctccggaatcagctgtaaggttagaatccatgtggacgaaccggatgagctgacggtccacgtgaaatctgacgatcctgacgttgtggccgcgagctcctctcttatggcccgcaagctggagttcggcaccgacagcacatttaaggctttctccgccatgcccaaaacctctctctgcttttacatcgtcgaacgggagtattgtaaaagctgctccaaggaagatacacagaagtgtgtgaacaccaaactggagcaaccccagtctattctgatcgaacacaaggggacgatcattggaaaacagaacaatacctgcacagctaagaccagctgctggcttgagtccgttaaatccttcttttacggcctgaagaacatgctctctgggatcttcggcaatgtgtttgtcggaattttcctgtttctcgcccctttcatcctgcttattctgtttttcatgtttggctggagaatcctcttctgtttcaagtgctgtcgcagaacacgggggctgtttcgctataaacatctggagaacgacgaagagaccggatacagacggatcattgaacgccttaataacaagaaaggcaagaataaactgctcgatggggagagactggcggaccggcgcatcgccgaactcttctccacaaagacccacattgga

SEQ ID NO: 13808 - RNA, 3495 nt, synthetic construct
  misc_feature 1..3495: note = derived and/or modified CDS sequence (opt5) from CCHVF(CCHVF K168_40)__KX013457.1__Gn-NSm-Gc
  source 1..3495: mol_type = other RNA
agcgacgagtccggcgatgactgcatctctagaacccagctgctccggacagaaacggccgagattcacggggataactacggaggccccggggacaagatcaccatttgtaatggaagcacaatcgtggatcaacgcctgggctccgaacttgggtgctataccattaacagagtcaaatctttcaagctgtgtgagaatagcgctacaggaaaatcctgcgaagttgactctatccctgtgaagtgtcggcagggctactgcctcaaaatcacccaggagggccgcgggcatgtgaagctgagcagaggatccgaggtcgtgcttgatgcctgtgacagctcttgcgaagttatgattccgaagggcacaggggatatcctggtggactgttccggaggccagcaacactttctcaaagataacctgattgacctggggtgccccaagatccctctcctgggaaaaatggcgatttatatctgtcggatgagcaatcatcccaagaccacgatggctttcctcttttggttctcttttggctacgtcattacctgcatcgtgtgcaaagccatcttctatctgctcattatcgttggcacactggggaagcgctttaagcagtacagagagcttaaacctcagacctgtacaatttgcgaaaccacgcccacaaacgccatcgatgctgagatgcacgacctgaattgttcctataacatttgcccttactgtgccagccggctcacctctgacggactggctcgccatgtgacacactgcccgaagagaaaagagaaggtcgaagagaccgaactgtacctcaatctggagcggatcccctgggtggtgcgcaaacttctgcaggtctccgaaagcaccggcgttgccctcaagagatcctcttggctgatcgtgcttctggtgcttttcgcggtcagcctgtcccctgtgcaaagcgcccccattgggcacggaaaaacaatcgagacgtatcaggttcgggaggaatacacctctatttgtctgtttgtgctcggctccatcctgttcattgtcagctgccttatgaaggggctggtgaactctgttggaaatatctttttccctggcctcagcatctgtaagacatgctccattggctctatcaacgggtttgagattgaaagccataaatgttattgctccctgctttgctgtccctactgccgccactgtagcgctgatagagagatccatcagctgcacctctctatttgcaagaaacggaagaccggatccaatgtgatgctggccgtctgtaaaagaatgtgcttccgcgctacagtggaagtcagcaacaaggccctgtctatccggtccattatcaataccacgttcgtggtttgtatcctcattctggcggtgtgcgtcgtgagcacatccgccgttgagatggagtctcttccggctggcacctgggaaagagaggaagacctgaccaacttttgtcaccaggagtgccaagtgacagaaaccgagtgtctctgcccttatgaggccctggtcctgcgccggccccttttcctcgatgggatcgtgaagggaatgaaaaacctgctgaatagcacatccctcgaaacgtctctgagcattgaggctccttggggcgccatcaacgtgcagtccacctacaagcccacagttagcgccgctaatattgcgctttcttggtccagcgtcgaacatagagggaacaaaatcctggtgtctggccgctccgagagcatcatgaagctcgaggaacggaccggaatttcttgggacctgggcgtggaggatgccagcgaatccaaactgcttacagtcagcgtgatggacctctctcagatgtattcccccgtttttgagtacctgagcggggatagacaagtggaagagtggcctaaggctacctgcacgggagactgtccggagcgctgcggctgtacctcctctacatgcctgcacaaggaatggccccatagccggaattggagatgtaaccctacctggtgctggggagtcggaacaggctgtacctgctgtgggctcgatgtgaaagacctgttcacggattacatgtttgttaagtggaaagtggagtatatcaagacagaagccattgtctgcgtggagcttacctcccaggaacgccagtgttctctgatcgaggccggcacacggttcaatctcggacccgttaccattaccctgagcgagcctagaaacatccagcaaaaactgcccccggaaatcattacacttcaccctcggatcgaggaaggctttttcgacctcatgcatgtgcagaaggtcctgtccgcttctacggtgtgcaagctgcagagctgcacccacggggtgcccggagacctccaggtctaccacattggcaatctgcttaaaggggataaggttaacggacatctgatccacaaaattgagcctcattttaatacatcctggatgagctgggacggctgtgatctcgactattactgcaacatgggggattggccctcttgtacctatacaggcgtgacccaacacaatcacgcctccttcatcaacctgctgaatatcgaaacggactacacaaagagctttcatttccactctaaacgcgtgaccgcgcatggagatacccctcagcttgacctcaaggctagacccaactatggcgccggggagattacagtcctggtggaggttgccgatatggaactgcacaccaaaaagatcgagatttccggactcaagtttgctagcctgacatgcacgggctgttacgcctgctctagcgggatcagctgtaaagtgcggattcatgtcgacgaaccggatgagcttaccgtgcacgttaagtccgacgatcctgacgtggtcgctgccagctctagcctgatggcgagaaaactcgagttcggaacagactccaccttcaaggccttttctgctatgcccaaaacaagcctgtgcttctacatcgtggaacgcgagtattgtaagtcctgctctaaggaagatacccagaaatgtgttaacacgaagctggagcacccccagagcattcttatcgaacataaaggcaccatcattgggaagcaaaataacacatgcaccgccaaaacatcctgctggctggagtctgtgaagtcctttttctacggcctcaagaatatgctgtccggaatctttggcaacgtcttcgtggggatttttctcttcctggctccttttatccttctgattctcttctttatgttcggatggcggatcctgttttgtttcaaatgctgtagacgcaccagaggcctgttccggtataagcaccttgaggacgatgaagagacagggtaccgcagaatcattgaacggctgaataacaaaaaggggaaaaataagctcctggacggcgagcgcctcgccgatagacggatcgcggaactgtttagcaccaagacgcatattggc

SEQ ID NO: 13809 - RNA, 3495 nt, synthetic construct
  misc_feature 1..3495: note = derived and/or modified CDS sequence (opt5) from CCHVF(CCHVF K168_125)__KX013460.1__Gn-NSm-Gc
  source 1..3495: mol_type = other RNA
agcgacgagtccggcgatgactgcatctctagaacccagctgctccggacagaaacggccgagattcacggggataactacggaggccccggggacaagatcaccatttgtaatggaagcacaatcgtggatcaacgcctgggctccgaacttgggtgctataccattaacagagtcaaatctttcaagctgtgtgagaatagcgctacaggaaaatcctgcgaagttgactctatccctgtgaagtgtcggcagggctactgcctcaaaatcacccaggagggccgcgggcatgtgaagctgagcagaggatccgaggtcgtgcttgatgcctgtgacagctcttgcgaagttatgattccgaagggcacaggggatatcctggtggactgttccggaggccagcaacactttctcaaagataacctgattgacctggggtgccccaaggtccctctcctgggaaaaatggcgatctatatttgtcggatgagcaatcatcccaagaccacgatggctttcctgttttggttctcttttggctacgtgattacctgcattgtttgcaaagccatcttctatctgctcatcattgtgggcacactggggaagcgctttaagcagtacagagagcttaaacctcagacctgtacaatctgcgaaaccacgcccacaaacgccattgatgctgagatgcacgacctgaattgttcctataacatctgcccttactgtgccagccggctcacctctgacggactggctcgccatgtcacacactgcccgaagagaaaagagaaggtggaagagaccgaactgtacctcaatctggagcggattccctgggtggtccgcaaacttctgcaggtttccgaaagcaccggcgtggccctcaagagatcctcttggctgatcgtgcttctggtcctcttcgcggtgagcctgtcccctgttcaaagcgcccccatcgggcacggaaaaacaattgagacgtatcaggtgcgggaggaatacacctctatctgtctgtttgtcctcggctccattctgttcatcgtgagctgccttatgaaggggctggttaactctgtgggaaatatctttttccctggcctcagcatctgtaagacatgctccatcggctctattaacgggtttgagatcgaaagccataaatgttattgctccctgctttgctgtccctactgccgccactgtagcgctgatagagagattcatcagctgcacctctctatctgcaagaaacggaagaccggatccaatgtcatgctggccgtgtgtaaaagaatgtgcttccgcgctacagtcgaagtgagcaacaaggccctgtctattcggtccatcattaataccacgttcgttgtgtgtatcctcatcctggcggtctgcgtggttagcacatccgccgtggagatggagtctcttccggctggcacctgggaaagagaggaagacctgaccaacttttgtcaccaggagtgccaagtcacagaaaccgagtgtctctgcccttatgaggccctggtgctgcgccggccccttttcctcgatagcattgtgaaggggaaaaagaacctgcttaattccacatctctcgaaacgagcctgtccatcgaggctccttggggagccattaacgttcagagcacctacaaacccacagtctctgccgctaatatcgcgctttcctggagctctgtggaacatagaggcaacaagattctggtgtccgggcgcagcgagtctatcatgaaactcgaggaacggaccggcatcagctgggacctgggagtcgaggatgcctccgaaagcaagctgcttacagtgtctgttatggacctctcccagatgtatagccccgtgtttgagtacctgtccggcgatagacaagtcgaagagtggcctaaggctacctgcacgggggactgtccggagcgctgcggatgtacctctagcacatgcctgcacaaagaatggccccattcccggaattggagatgtaaccctacctggtgctggggcgtggggacaggatgtacctgctgtggcctcgatgttaaggacctgttcacggattacatgtttgtgaaatggaaggtcgagtatattaaaacagaagccatcgtgtgcgttgagcttacctctcaggaacgccagtgtagcctgattgaggccgggacacggttcaatctcggccccgtgaccatcaccctgtccgagcctagaaacattcagcaaaagctgcccccggaaatcatcacacttcaccctcggattgaggaaggatttttcgacctcatgcatgtccagaaggtgctgtctgctagcacggtgtgcaaactgcagtcctgcacccacggcgtccccggggacctccaggtttaccacatcggaaatctgcttaagggcgataaagtgaacgggcatctgattcacaagatcgagcctcattttaatacaagctggatgtcttgggacggatgtgatctcgactattactgcaacatgggcgattggccctcctgtacctatacaggggtgacccaacacaatcacgccagcttcattaacctgctgaatatcgaaacggactacacaaaatcttttcatttccactccaagcgcgtcaccgcgcatggcgatacccctcagcttgacctcaaagctagacccaactatggagccggcgagatcacagtgctggttgaggtggccgatatggaactgcacaccaagaagattgagatcagcgggctcaaatttgcttctctgacatgcacgggatgttacgcctgctccagcggcatttcctgtaaggtccggatccatgtggacgaaccggatgagcttaccgttcacgtgaaaagcgacgatcctgacgtcgtggctgcctctagctccctgatggcgagaaagctcgagttcgggacagactctaccttcaaagcctttagcgctatgcccaagacatccctgtgcttctacattgttgaacgcgagtattgtaagtcttgcagcaaagaagatacccagaagtgtgtgaacacgaaactggagcacccccagtccatccttattgaacataagggaaccatcatcggcaaacaaaataacacatgcaccgccaagacatcttgctggctggagagcgtcaagtcctttttctacgggctcaaaaatatgctgagcggcatttttggaaacgtgttcgtgggcatctttctcttcctggctccttttattcttctgatcctcttctttatgttcgggtggcggattctgttttgtttcaagtgctgtagacgcaccagaggactgttccggtataaacaccttgaggacgatgaagagacaggctaccgcagaatcatcgaacggctgaataacaagaaagggaagaataagctcctggacggagagcgcctcgccgatagacggattgcggaactgttttctaccaaaacgcatatcggc

SEQ ID NO: 13810 - RNA, 3495 nt, synthetic construct
  misc_feature 1..3495: note = derived and/or modified CDS sequence (opt5) from CCHVF(CCHVF K229_194)__KX013463.1__Gn-NSm-Gc
  source 1..3495: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgcctgtgacagctcctgcgagattatgatccccaaaggaacgggcgatattctggtggactgtagcgggggacagcaacacttcctcaagggcaacctgatcgatctggggtgccctcatattcccctcctgggaaaaatggcgatctacatttgtagaatgtctaatcaccctcggaccacaatggcttttcttttctggttttccttcggctatgttattacctgcatcttttgcaaggccctgttctacagcctcattatcattggcacactggggaaaaagatcaagcagtatcgcgaacttaaaccccagacctgtacgatttgcgagacagcccctgtgaacgctatcgacgccgagatgcatgatctgaattgttcttacaacatctgcccgtattgtgcttccagactcaccagcgacggactggcccggcacgtcacacagtgccccaagcgcaaagaaaaggtggaggaaaccgagctgtacctcaatctggaaagaatcccttggatcgttcggaaacttctgcaagtgtctgagtccaccggcgtcgcgctcaagcgcagctcctggctgattgtgcttctggtgctcctgacagtctctctgagccccgttcagtccgcccctgtggggcacggaaaaacgatcgagacctaccagacaagagaaggctttaccaacatttgtctcttcatgctggggagcatcctttttatcgtgtcttgcctggtcaagggactcgtggactccgttagcgattctttctttcccggcctgagcgtgtgtaagacatgctccattggctctatcaatgggttcgagattgaaagccataaatgttattgctcccttttctgctgtccgtactgccggcactgtagcgctgaccgcgagatccatcagctgcacctcggaatttgcaagaaaagaaagaccggctctaacgtcatgctggccgtgtgtaaacggatgtgctttaaggctacgatcgaagcctccagacgcgcgctgctcattcggagcatcatcaatacaaccttcgttatttgtatcctgacccttgccatttgcgtggtctctacatccgctgtggagatggagaacctgcctgccgggacctgggaaagagaggaagatctcacgagcttttgtcaccaagagtgccaggtcacagaaaccgagtgtctgtgcccctatgaggctctggtgcttcgcaagcctctcttcctggactccatcgttaaaggaaagaaaaatctgctcaactctacaagcctggaaacctccctttctattgaggccccctggggcgccatcaacgtgcagagcacatttaagcccaccgtctccacggctaatatcgcgctgagctggtcttccgtggaacatcgggggaacaaaattctcgttaccggcagaagcgagtctatcatgaagctggaggaacgcacaggagtgtcctgggatctgggcgtcgaggacgccagcgaatctaaacttctcaccgtgagcattatggatctgtcccaaatgtacagccctgtgttcgagtatctgtctggggaccggcaggttgaagagtggccgaaggctacatgcaccggagattgtcccgagagatgcggctgtacgtccagcacatgcctccacaaggaatggcctcattcccgcaattggcggtgtaaccccacctggtgctggggagtcggaacaggctgtacctgctgtggggtggacgtgaaagatctgtttaccgaccacatgttcatcaagtggaaagtcgagtacattaagacagaagccatcgtgtgcgttgagcttacgtctcaggaaagacagtgtagcctgatcgaggccggcacccgctttaatctcggacctgtgacaattaccctgtccgagccccggaacatccaacagaagctgccgcctgaaattatcacacttcatcccaaaattgaggaaggcttctttgacctcatgcacgtccagaaggtgctgtctgctagcaccgtttgcaaactgcagtcctgcacgcacgggatccctggagatctccaaatctatcatattggcaatctgcttaagggggacagactgaacggacacctcatccataaaattgagccccacttcaatacatcttggatgagctgggatggctgtgacctggattactactgcaacatgggggactggccttcctgtacctataccggcgtgacacagcacaatcatgccgcgtttgtcaacctgcttaatatcgaaaccgattacacaaagacgttccacttccatagcaaacgggtgaccgctcacggagacacaccccagctcgatctgaaggcccgcccgacctatggcgccggggagattacagttctggtggaggtcgctgacatggaactccataccaagaaagtggagatctctggactgaagtttgcctcccttgcttgcacgggctgttacagctgcagctccgggattagctgtaaagtgagaatccacgtcgatgaacctgacgagctgaccgttcacgtgaagtcttccgatcccgacgtggtcgccgcgagcacatccctcatggcccggaaactggagttcggaaccgacagcacatttaaggctttctctgccatgcccaagaccagcctgtgcttttatatcgtggaaagagagtactgtaaatcctgctctgaagatgacacaaagaaatgtgttgataccaaacttgagcagcctcaaagcattctgatcgaacataagggcacgattatcgggaagcagaacgacacatgcaccgctaaggcctcctgctggctcgagtctgtgaaatctttcttttatggcctgaagaatatgctcggatccgtcttcggcaactttttcgtggggattctgctttttctggcgccgttcgttctcctggtgctgtttttcatgttcggatggaaaatcctgttttgtttcaagtgctgtcgccggaccagaggcctttttaaataccgccacctcaaggatgacgaggaaacagggtacagaaagatcattgagcggctgaactctaaaaaggggaaaaatcgcctcctggatggcgaaagacttgccgaccggaagatcgctgagctgttcagcaccaaaacgcatattggc

SEQ ID NO: 13811 - RNA, 3495 nt, synthetic construct
  misc_feature 1..3495: note = derived and/or modified CDS sequence (opt5) from CCHVF(CCHVF K229_243)__KX013466.1__Gn-NSm-Gc
  source 1..3495: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacagctcctgcgaggtgatgattcccaagggaacgggcgatatcctggttgactgtagcgggggacagcaacacttcctcaaagataacctgattgacctgggctgccctcatatccccctcctggggaagatggcgatttacatctgtcggatgtctaatcaccctcgcaccacaatggcttttcttttctggttttccttcggatatgtgattacctgcatcttttgcaaagccctgttctacagcctcatcattatcggcacactgggcaagaaaattaagcagtatagagaacttaagccccagacctgtacgatctgcgagacagcccctgtcaacgctattgatgccgagatgcatgacctgaattgttcttacaacatctgcccgtattgtgcttcccggctcaccagcgacgggctggcccgccacgtgccccagtgccctaaaagaaaggaaaaagttgaggaaacagagctgtacctcaatctggaacggatcccctggattgtgcgcaaacttctgcaagtctctgagtccaccggagtggcgctcaaaagaagctcctggctgatcgtgcttctggtcctcctgaccgtttctctgagccctgtgcagtccgcccccgtgggccacgggaagacaattgagacgtaccagacccgggaaggatttacaagcatctgtctcttcatgctgggctctattctttttctggtctcctgcctcgtgaaagggctggttgatagcgtgtctgacagcttctttccgggactttccgtctgtaagacctgctctatcggcagcatcaacggcttcgagattgaatcccataagtgttattgcagcctgttctgctgtccttactgccgccactgttctgctgatagagagatccatcagctccacctgtccatttgcaaaaagcggaaaacagggagcaatgtgatgctggccgtttgtaagagaatgtgctttcgcgctaccatcgaagcctctcggagagcgctcctgattcgctccatcattaacacgacattcgtgatctgtatccttaccctgaccatttgcgtcgtgagcacatccgccgtcgagatggagaatctccccgctggaacctgggaacgggaggaagacctgacaaacttttgtcaccaagagtgccaggtgacggaaaccgagtgtctgtgcccttatgaggcccttgttctcagaaaacccctgttcctggattctatcgtgaagggcatgaagaatctcctgaacagcacatcccttgaaacctctctgagcattgaggctccctggggagccatcaacgtccagtccacatttaaacctaccgtgagcacggccaatattgctctctcttggtccagcgttgaacatcgcggaaacaagatcctggtgaccggccggtctgagtccatcatgaaactggaggaaagaacaggggtcagctgggaccttggcgtggaggatgcgtctgaaagcaagctcctgaccgtgtccattatggacctgagccaaatgtactctccggttttcgagtatctctccggagatcgccaggtcgaagagtggcccaaagccacatgcaccggcgactgtcctgagcggtgcgggtgtacgagctccacatgcctgcacaaggaatggccccattctagaaattggcgctgtaaccctacctggtgctggggagtgggcacagggtgtacctgctgtggagtggatgtcaaggacctttttaccgaccacatgttcgtgaaatggaaggttgagtacatcaaaacagaagctattgtgtgcgtcgagctgacgagccaggaacggcagtgttccctcatcgaggccggcaccagatttaatctggggcccgtgacaattaccctgtctgagccgcggaacatccaacagaaacttcctcccgaaatcattacactccatcctaaagttgaggaaggcttctttgatctgatgcacgtgcagaaggtcctgagcgcctccaccgtgtgcaagctccagtcttgcacgcacggaatccccggcgacctgcaagtttatcatattgggaatcttctgaaaggagatcgcgtgaacggccacctcatccataagattgagcctcacttcaatacaagctggatgtcctgggacgggtgtgatctggactactactgcaacatgggagattggcccagctgtacctataccggcgtcacacagcacaatcatgctgcctttgtgaacctgcttaatatcgaaaccgactacacaaaaacgttccacttccattctaagagagtgaccgcgcacggggatacaccgcagctcgacctgaaagctcggcctacctatggcgccggagagatcacagtcctggttgaggtggccgatatggaactccataccaagaaagtggagatttccggcctgaagtttgctagccttgcctgcacggggtgttacgcttgttcttccggaatcagctgcaaggtccgcattcacgtggacgaacccgatgagctgaccgttcacgtgaaatcttccgaccccgacgtcgtggccgcgagcacatccctcatggccagaaagctggagttcggcaccgatagcacatttaaggctttctctgccatgcctaagaccagcctgtgcttttatatcgttgaaaaagagtactgtaagtcctgctctgaagaggacacacagaagtgtgtggataccaaacttgaacaaccgcagagcattctgatcgagcataaggggacgattatcggaaaacagaacgacacatgcaccgctaaggcctcctgctggctcgagtctgtcaagagcttcttttatggcctgaagaatatgctcgggtccgtgttcggcaactttttcatcgggattctgctttttctgacccccttcgttctcctggtgctgtttttcatgttcggctggaagatcctgttttgtttcaaatgctgtcggagaacacgcgggcttctcaagtacagacacctgaaagatgacgaagagaccggataccggcgcattatcgaaagactcaacaataagaaaggcaagaaccggctgcttgatggggagcgcctggcggacagaaagattgccgaactcttttctacgaaaacacatatcgga

SEQ ID NO: 13812 - RNA, 3495 nt, synthetic construct
  misc_feature 1..3495: note = derived and/or modified CDS sequence (opt5) from CCHVF(CCHVF K315_14)__KX013469.1__Gn-NSm-Gc
  source 1..3495: mol_type = other RNA
agcgaggaacccggcgacgattgcatctccagaacccagctgctcaagacagagacggccgaaattcacgacgataactacgggggacctggcgacaaaatcaccatttgtaatgggtctacagtggtcgatcaacggctgggaagcgagcttggctgctataccatcaaccgcgttaagtccttcaaactgtgtaaaaattctgctacagggaaaacctgcgaaattgacagcacaccggtgaagtgtagacagggattttgcctcaagatcacccaggagggccggggccatgtgaaactgtcccgcgggtctgaggtcgtgcttgatgtttgtgacagctcctgcgaaatcatgattcccaagggaacgggcgatatcctggtggactgtagcgggggacagcaacacttcctcaaagataacctgattgacctgggctgccctcatatccccctcctggggaagatggccatttacatctgtagaatgtctaatcaccctcggaccacaatggcgtttcttttctggttttccttcggatatgtcattacctgcatcttttgcaaagctctgttctacagcctcatcattatcggcacactgggcaagaagattaaacagtatcgcgagcttaagccccagacctgtacgatctgcgaaacagcccctgtgaacgccattgatgctgagatgcatgacctgaattgttcttacaacatctgcccgtattgtgcctccagactcaccagcgaggggctggctcggcacgttacacagtgccccaaacgcaaggaaaaagtggaggaaaccgagctgtacctcaatctggaaagaatcccttggattgtccggaaacttctgcaagtgtctgagtccaccggagtggccctcaagcgcagctcctggctgatcgtccttctggttctcctgacagtgtctctgagccccgtgcagtccgcgcctgtcggccacgggaagacgattgagacctaccagacaagagaaggatttaccagcatctgtctcttcatgctgggctctattctttttatcgtgtcctgcctggttaaggggctcgtgtatagcgtctctgacagcttctttcccggactgtccgtgtgtaaaacatgctctatcggcagcattaacggcttcgagatcgaatcccataagtgttactgcagccttttctgctgtccgtattgccggcactgttctgccgatcgcgagattcatcagctgcacctctccatctgcaaaaagagaaaaaccgggagcaatgttatgctggctgtgtgtaagcggatgtgctttaaggccacgattgaggcttctagacgcgccctgctcatccggtccattatcaacacaaccttcgtcatctgtattctgacccttgcgatctgcgtggtcagcacatccgccgtggaaatggaggacctgcctgctggaacctgggaaagagaggaagatctcacaaatttttgtcaccaagagtgccaggttacggaaaccgagtgtctgtgcccctacgaggccctggtgcttcgcaaacctctcttcctggactctattgtcaagggcatgaaaaagctgctcaacagcacatccctggaaacctctcttagcatcgaggctccctggggagccattaatgtgcagtccacatttaaacccaccgttagcacggccaacatcgctctgtcttggtccagcgtggaacatcggggaaacaagatcctcgtcaccggcagatctgagtccattatgaagctggaggaacgcacaggggtgagctgggatctgggcgtggaggacgcgtctgaaagcaaacttctcaccgtttccatcatggatctgagccaaatgtattctcctgtcttcgagtacctgtccggagacagacaggtggaagagtggccgaaggccacatgcaccggcgattgtcccgagagatgcgggtgtacgagctccacatgcctccacaaagaatggcctcattctcgcaattggcggtgtaaccccacctggtgctggggagtgggcacagggtgtacctgctgtggagtcgacgtgaaggatctgtttaccgaccacatgttcattaaatggaaggttgagtatatcaagacagaagctattgtgtgcgtcgagcttacgagccaggaaagacagtgttccctgatcgaggccggcacccgctttaatctcgggcctgtgacaatcaccctgtctgagccccggaacattcaacagaaactgccgcctgaaatcattacacttcatcccaagatcgaggaaggcttctttgacctcatgcacgttcagaaagtgctgagcgcctccaccgtctgcaagctgcagtcttgcacgcacgggattcctggcgatctccaaatctaccatatcgggaatctgcttaaaggagacagagtgaacggccacctgattcataagatcgagccccacttcaatacaagctggatgtcctgggatgggtgtgacctcgattactattgcaacatgggagactggcctagctgtacctacaccggcgttacacagcacaatcatgctgcctttgtgaacctgctgaatattgaaaccgattatacaaaaacgttccacttccattctaagcgggtcaccgcgcacggggacacaccccagcttgatctcaaggctcgcccgacctacggcgccggagagatcacagtgctggtggaggtcgccgacatggaactgcataccaaaaaggttgagatttccggcctcaaatttgctagcctgacgtgcaccgggtgttatgcctgttcttccggaatcagctgcaaggtgcggattcacgtggatgaacctgacgagcttacagtccacgtgaaatcttccgatcccgacgttgtggctgccagcacctccctgatggcgcggaagctcgagttcggcacagacagcacctttaaggccttctctgctatgcccaaaacaagcctgtgcttttacatcgtcgaaagagagtattgtaagtcctgctctgaagatgacaccaaaaagtgtgtggatacgaaactggagcagcctcaaagcatccttattgaacataaggggacaatcattggaaagcagaacgatacctgcaccgccaaggcttcctgctggctggagtctgttaagagcttcttttacggcctcaaaaatatgctggggtccgtgttcggcagctttttcgtcggaatcctcctgtttcttgccccgttcgtgctgctcgttctgtttttcatgttcggctggaagattctgttttgtttcaaatgctgtcgccggacaagagggctttttaagtaccgccacctgaaggacgacgaggaaaccggatatagacggatcatcgagcgcctcaactctaaaaagggcaaaaatagactgctcgatggggaacggctggcggaccgcaagattgccgagcttttctccacgaaaacacatatcgga

SEQ ID NO: 13813 - RNA, 3495 nt, synthetic construct
  misc_feature 1..3495: note = derived and/or modified CDS sequence (opt5) from CCHVF(CCHVF K323_27)__KX013472.1__Gn-NSm-Gc
  source 1..3495: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgcctgtgacagctcctgcgagattatgatccccaaaggaacgggcgatattctggtggactgtagcgggggacagcaacacttcctcaaggataacctgatcgacctgggctgccctcatattcccctcctggggaaaatggcgatctacatttgtagaatgtctaatcaccctcggaccacaatggcttttcttttctggttttccttcggatatgttattacctgcatcttttgcaaggccctgttctacctcctgattatcattggcacacttggcaaaaagatcaagcagtatcgcgaactgaaaccccagacctgtacgatttgcgagacagcccctgtgaacgctatcgatgccgagatgcatgacctcaattgtagctacaacatctgcccgtattgtgcttctagactgacctccgacgggctggcccggcacgtcacacagtgccccaagcgcaaagaaaaggtggaggaaaccgagctctacctgaatcttgaaagaatcccttggatcgttcggaaactgctccaagtgagcgagtctaccggagtcgcgctgaagcgctccagctggcttacagtgctgctcgtgctgctgacggtctccctctctcccgttcagagcgcccctgtgggccacgggaacaccattgagacataccagaccagagaaggatttacatccatctgtctgttcatgcttggcagcattctgtttatcgtgtcttgcctcgtcaaagggctggtggattccgttagcgactctttctttcccggacttagcgtgtgtaagacctgctccatcggctctattaatggcttcgagatcgaaagccataagtgttattgctccctgttctgctgtccgcactgccggcatcgcagcgctgatagagagattcaccagctccacctgtctatctgtaaaaagcggaaaacggggtccaacgtcatgctggccgtgtgcaagagaatgtgtcctaaagctacaattgaagccagccgccgggcgctccccatcagatctattatcaataccaccctggttatgtgcatccttacactggccatttgtgtggtctccaccagcgctgtggagatggaggacctccctgccggaacatgggaacgcgaggaagatctgacgaacttttgccatcaagagtgtcaggtcaccgaaacagagtgcctgtgtccctacgaggctcttgtgctccggaagcccctgttcctggactccatcgccaagggcatgaaaaatctcctgaactctaccagccttgaaacatccctgtctattgaggccccttggggagctatcaacgttcagagcacctttaagccgacggtgtccaccgcgaatattgccctcagctggtcttccgtcgaacacagaggaaacaaaatcctggtgacaggccgcagcgagtctatcatgaagctggaggaacggaccggggtttcctgggatcttggcgtggaggacgctagcgaatctaaactcctgacagtcagcattatggatctgtcccaaatgtatagccccgtgttcgagtacctctctggagacagacaggtggaagagtggcctaaggctacctgcacgggcgattgccccgagcgctgtgggtgcacatccagcacctgtctgcataaggaatggcctcactcccggaattggagatgcaaccccacatggtgttggggagttggcaccgggtgcacctgttgcggagtcgacgtgaaagacctttttacagatcatatgttcatcaagtggaaagtggagtatattaagacggaagccatcgtctgtgtggagctgaccggccaggaacgccagtgctctctcattgaggccgggacacggtttaatctgggcccggttaccatcacactgagcgagcctagaaacatccaacagaaacttccccctgaaattatcaccctccaccccaagattgaggaaggattctttgacctgatgcacgtgcagaaggtcctgtccgcctctacggtgtgtaaactccagagctgcacacatggcatccctggggatctgcaaatttaccacatcggaaatcttctgaagggcgaccgggttaacgggcatctcatccacaaaattgagccccacttcaatacctcctggatgtcttgggatggatgcgacctggattattactgtaacatgggcgactggccgagctgcacctacacaggggtgacccagcataatcacgcggcttttgtcaacctgcttaatatcgaaacagattatacgaagaccttccattttcactccaaacgcgtgacagcccatggcgacacccctcagctcgatctgaaggccagacccacatacggagctggcgagattaccgttctggtggaggtcgccgacatggaactccacacgaaaaaggtggagatcagcgggctgaagttcgcttctcttacctgtacaggatgctatgcctgttccagcggcatttcttgcaaagtgcggatccacgtcgatgaacccgacgagctgaccgttcatgtgaagtccagcgaccctgatgtggtcgcggcctctacatccctcatggctagaaaactggagttcgggaccgacagcacatttaaggccttctccgctatgccgaaaaccagcctgtgtttttacattgtggaacgcgagtattgcaagtcttgtagcgaagatgacacgaagaaatgcgttgatacaaaacttgagcagccccaatccatcctgatcgaacacaagggaaccattatcggcaagcagaacgacacctgtacagccaaagcgtcttgctggctcgagagcgtgaagtccttcttttacgggctgaagaatatgctcggctctgtcttcgggagctttttcgtgggcattctgctttttctggcccctttcgttctcctggtgctgtttttcatgtttgggtggaaaatccttttctgcttcaagtgttgccggagaacccgcggactgtttaaatatagacatctcaacgatgacgaggaaacgggctaccggcgcattatcgagagactgaactccaagaaagggaagaatcggctcctggatggagaacgccttgctgacagaaagatcgccgagctgttctctacaaaaacccacattggc

SEQ ID NO: 13814 - RNA, 3495 nt, synthetic construct
  misc_feature 1..3495: note = derived and/or modified CDS sequence (opt5) from CCHVF(CCHVF K340_6)__KX013475.1__Gn-NSm-Gc
  source 1..3495: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctacaaccgggaagacatgcgagatcgacagcaccccggttaaatgtagacagggattttgcctcaagatcacgcaggagggccggggccatgtgaagctgtcccgcgggtctgaagtggtccttgatgcttgtgacagctcctgcgagattatgatccccaaaggaaccggcgatattctggtggactgtagcgggggacagcaacacttcctcaaggataacctgatcgacctgggctgccctcatattccccctctcgggaaaatggccatctacatttgtagaatgtctaatcacccccggacaaccatggcgtttctgttctggttttccttcggatatgttatcacatgcatcttttgcaaggctcttttctacagcctgattatcattggcaccctcggcaaaaagatcaagcagtatcgcgaactgaaacctcagacgtgtacaatttgcgagaccgccccggtgaacgccatcgatgctgagatgcatgaccttaattgttcttacaacatctgcccctattgtgcctccagactgacaagcgacgggctcgctcggcacgtcacccagtgccctaagcgcaaagaaaaggtggaggaaaccgagctgtacctgaatctcgaacggattccctggatcgttagaaaactgcttcaagtgtctgagtccacaggagtcgccctgaagcgcagctcctggctcattgtgctgcttgtgctgctcacggtctctctgagccctgttcagtccgcgcccgtgggccacgggaaaaccatcgagacataccagaccagagaaggatttacaagcatttgtctgttcatgctcggctctatcctgtttatcgtgtcctgccttgtcaaggggctggtggatagcgtttctgacagcttctttccgggactctccgtgtgtaagacctgctctattggcagcatcaacggcttcgagattgaatcccataaatgttattgcagcctgttctgctgtccttactgccggcactgttctgccgatcgcgagatccatcagcttcacctgtccatttgcaagaaaagaaagacggggagcaatgtcatgctcgctgtgtgtaaacggatgtgctttaaggccacaatcgaggcttctagacgcgccctgctgattcggtccatcatcaacaccaccttcgttatgtgtattctcacactggcgatctgcgtggtcagcacctccgccgtggagatggaggaccttcccgctggaacatgggaaagagaggaagatctgacgaatttttgtcaccaagagtgccaggtcaccgaaacagagtgtctctgcccttatgaggccctggtgctgcgcaagcccctttctctcgacagcattgttaaaggcatgaagaacctgctcaattccacctctctcgaaacaagcctgtccatcgaggctccctggggagccattaacgtgcagagcaccttcaaacctacggtctctaccgccaacatcgctctttcctggagctctgtggaacatcggggaaataagatcctggttacaggcagatccgagagcattatgaaactcgaggaacgcaccggggtgtcttgggatctgggcgtcgaggacgcgagcgaatccaagctgcttacagtgagcatcatggatctctctcaaatgtactccccggtgtttgagtatctgagcggagaccggcaggttgaagagtggcccaaggctacctgcacgggcgattgtcctgagagatgcgggtgtacatcctctacctgcctgcacaaagaatggccccatagccgcaactggcggtgtaatcctacatggtgctggggagtcggcaccgggtgtacctgctgtggagtggacgtgaaggacctcttcacagatcacatgtttattaaatggaaggtcgagtacatcaaaacggaagccattgtgtgcgttgagctgacctcccaggaaagacagtgttctcttatcgaggccggcacacgcttcaacctggggcccgtgaccatcacactcagcgagccgcggaatattcaacagaagctgcctcccgaaatcattaccctgcatcctaagatcgaggaaggctttttcgaccttatgcacgtccagaaagtgctctccgcctctacggtttgcaagctgcagagctgcacacacgggattcccggcgatctgcaaatctatcatatcgggaacctcctgaaaggagacagagtgaatggccaccttattcataagatcgagcctcactttaacacctcctggatgagctgggatgggtgtgacctggattactactgcaatatgggagactggccctcttgtacctatacaggcgtcacccagcacaaccatgctgccttcgtgaatctcctgaacattgaaacagattacacgaaaacctttcacttccattccaagcgggttacagcgcacggggacaccccgcagctggatcttaaagctcgccctacatatggcgccggagagatcaccgtgctcgtcgaggtgacggacatggaactgcataccaagaaggtggagattagcggcctgaaattcgcctctctcacatgcaccgggtgttacgcttgctccagcggaatctcttgtaaggtccggattcacgttgatgaacccgacgagctgacagtgcacgtgaaatccagcgaccccgatgtcgtggccgcttccaccagccttatggccagaaagctggagtttggcacagactctaccttcaaagcgtttagcgccatgcctaagacgtccctctgcttctatatcgttgaaagagagtactgtaagtcttgcagcgaagatgacaccaaaaagtgtgtggatacaaaactggagcagccgcaatccatcctgattgaacataaggggaccatcattggaaaacagaatgacacatgcaccgctaaggcctcttgctggcttgagagcgtcaagtcctttttctatggcctgaaaaacatgctcgggtctgtgtttggcagcttctttgttggaatcctgctgttcctggctccctttgtgcttctggtcctcttctttatgttcggctggaagattctgttctgttttaaatgctgtcgccggacgagagggctgttcaagtaccgccactttaaagatgacgaggaaacaggatacagacggatcatcgagcgccttaattccaagaagggcaaaaacagactgctcgatggggaacggctggccgaccgcaagattgcggaactcttcagcaccaaaacacatatcgga

SEQ ID NO: 13815 - RNA, 3495 nt, synthetic construct
  misc_feature 1..3495: note = derived and/or modified CDS sequence (opt5) from CCHVF(CCHVF Mamon)__KX013478.1__Gn-NSm-Gc
  source 1..3495: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtcagcgatgcctgtgactccagctgcgaggtgatgattcccaagggaacgggcgatatccttgttgactgttctgggggacagcaacacttcctgaaagataacctcattgacctgggctgccctcatatccccctgctcgggaagatggcgatttacatctgtcggatgtccaatcaccctcgcaccacagtggcttttctgttctggtttagcttcggatatgtcattacctgcatcttttgcaaagcccttttctactctctgatcattatcggcacactcggcaagaaaattaagcagtatagagaactgaagccccagacctgtacgatctgcgagacagcccctgtgaacgctattgatgccgagatgcatgaccttaattgttcctacaacatctgcccgtattgtgctagccggctgacctctgacgggctcgcccgccacgttccccagtgccctaaaagaaaggaaaaagtggaggaaacagagctgtacctgaatctcgaacggatcccctggattgtccgcaagctgcttcaagtgtccgagagcaccggagtggcgctgaaaagatcctcttggctcatcgtcctgcttgttctgctcaccgtgagcctgtcccctgtgcagagcgcccccgtcggccacgggaagacaattgagacgtaccagacccgggaaggatttacatctatctgtctgttcatgctcggctccattctgtttcttgtgagctgcctggttaaagggctcgtggattctgtcagcgactccttctttccgggactgtctgtgtgtaagacctgcagcatcggctccatcaacggcttcgagattgaaagccataagtgttattgctctcttttctgctgtccttactgccgccactgttccgctgatagagagatccatcagctgcacctcagcatttgcaaaaagcggaaaacagggtctaatgttatgctggccgtgtgtaagagaatgtgctttcgcgctaccatcgaagcctcccggagagcgctgctcattcgcagcatcattaacacgacattcgtcatctgtatcctgacccttaccatttgcgtggtctccacatctgccgtggagatggagaatctgcccagcggaacctgggaacgggaggaagacctcacaaacttttgtcaccaagagtgccaggttacggaaaccgagtgtctgtgcccttatgaggctctggtgcttagaaaacccctcttcctggattccatcgtcaagggcatgaagaatctgctcaactctacaagcctggaaacctcccttagcattgaggccccctggggagctatcaacgtgcagtctacatttaaacctaccgtttccacggccaatattgccctgagctggtcttccgtggaacatcgcggaaacaagatcctcgtcaccggccggagcgagtctatcatgaaactggaggaaagaacaggggtgagctgggacctgggcgtggaggatgcttccgaaagcaaacttctcaccgtttctattatggacctgtcccaaatgtacagcccggtcttcgagtatctgtccggagatcgccaggtggaagagtggcccaaggcgacatgcaccggcgactgtcctgagcggtgcgggtgtacgtctagcacatgcctccacaaggaatggccccattccagaaattggcgctgtaaccctacctggtgctggggagtgggcacagggtgtacctgctgtggagtcgatgtgaaggacctgtttaccgaccacatgttcgttaaatggaaggtggagtacatcaaaacagaagccattgtctgcgtggagcttacgtctcaggaacggcagtgtagcctgatcgaggctggcaccagatttaatctcgggcccgttacaattaccctgtccgagccgcggaacatccaacagaagctgcctcccgaaatcattacacttcatcctaaagtggaggaaggcttctttgatctcatgcacgtccagaaggtgctgtctgccagcaccgtttgcaagctgcagtcctgcacgcacggaatccccggcgacctccaagtgtatcatattgggaatctgcttaaaggagatcgcgtcaacggccacctgatccataagattgagcctcacttcaatacaagctggatgtcttgggacgggtgtgatctcgactactactgcaacatgggagattggccctcctgtacctataccggcgtgacacagcacaatcatgccgcttttgtgaacctgctgaatatcgaaaccgactacacaaaaacgttccacttccatagcaagagagtcaccgcccacggggatacaccgcagcttgacctcaaagcgcggcctacctatggcgctggagagatcacagttctggtggaggtggccgatatggaactgcataccaagaaagtcgagatttctggcctcaagtttgcctccctggcttgcacggggtgttacgcctgcagctctggaatctcctgtaaggtgcgcattcacgttgacgaacccgatgagcttaccgtgcacgtcaaaagctccgaccccgacgtggttgctgccagcacatctctgatggcgagaaagctcgagttcggcaccgatagcacatttaaagccttctccgctatgcctaagacctctctgtgcttttatatcgtggaacgggagtactgtaaaagctgctccgaagaggacacacagaagtgtgtcgataccaagctggaacaaccgcagtctattcttatcgagcataaagggacgattatcggaaagcagaacgacacatgcaccgccaaaaccagctgctggctggagtccgtgaagtctttcttttatggcctcaaaaatatgctggggagcgttttcggcaactttttcatcgggattctcctgtttcttgctcccttcgtgctgctcgtcctgtttttcatgttcggctggaagatcctgttttgtttcaagtgctgtagacgcacaagagggcttctgaaataccggcacctcaaggatgacgaagagaccggataccgcagaattatcgaacggctgaacaataaaaagggcaaaaaccgcctcctggatggggagagacttgccgaccggaagattgcggaactgttttccacgaagacacatatcgga

SEQ ID NO: 13816 - RNA, 3495 nt, synthetic construct
  misc_feature 1..3495: note = derived and/or modified CDS sequence (opt5) from CCHVF(CCHVF Min)__KX013481.1__Gn-NSm-Gc
  source 1..3495: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacagctcctgcgaggtgatgattcccaagggaacgggcgatatcctggttgactgtagcgggggacagcaacacttcctcaaagataacctgattgacctgggctgccctcatatccccctcctggggaagatggcgatttacatctgtcggatgtctaatcaccctcgcaccacaatggcttttcttttctggttttccttcggatatgtgattacctgcatcttttgcaaagccctgttctacagcctcatcattatcggcacactgggcaagaaaattaagcagtatagagaacttaagccccagacctgtacgatctgcgagacagcccctgtcaacgctattgatgccgagatgcatgacctgaattgttcttacaacatctgcccgtattgtgcttcccggctcaccagcgacgggctggcccgccacgtgccccagtgccctaaaagaaaggaaaaagttgaggaaacagagctgtacctcaatctggaacggatcccctggattgtgcgcaaacttctgcaagtctctgagtccaccggagtggcgctcaaaagaagctcctggctgatcgtgcttctggtcctcctgaccgtttctctgagccctgtgcagtccgcccccgtgggccacgggaagacaattgagacgtaccagacccgggaaggatttacaagcatctgtctcttcatgctgggctctattctttttctggtctcctgcctcgtgaaagggctggttgatagcgtgtctgacagcttctttccgggactttccgtctgtaagacctgcacaatcggctctatcaacggcttcgagattgaaagccataagtgttattgctccctgttctgctgtccttactgccgccactgtagcgctgatagagagatccatcagctccacctgtctatttgcaaaaagcggaaaaccgggtccaatgtgatgctggccgtttgtaagagaatgtgctttcgcgctacgatcgaagccagccggagagcgctcctgattcgctctatcattaacacaaccttcgtgatctgtatccttaccctgacaatttgcgtcgtgtccaccagcgccgtcgagatggagaatctcccctccggaacatgggaacgggaggaagacctgacgaacttttgtcaccaagagtgccaggtgaccgaaacagagtgtctgtgcccttatgaggctcttgttctcagaaaacccctgttcctggattctatcgtgaagggcaccaagaatctcctgaacagcacatcccttgaaacctctctgagcattgaggccccctggggagctatcaacgtccagtccacgtttaaacctaccgtgagcacagccaatattgccctctcttggtccagcgttgaacatcgcgggaacaagatcctggtgaccggccggtctgagtccatcatgaaactggaggaaagaacaggggtcagctgggaccttggcgtggaggatgcttctgaaagcaagctcctgaccgtgtccattatggacctgagccaaatgtactctccggttttcgagtatctctccggagatcgccaggtcgaagagtggcccaaagcgacgtgcacaggcgactgtcctgagcggtgcgggtgtaccagctccacatgcctgcacaaggaatggccccattctagaaattggcgctgtaaccctacctggtgctggggagtgggcaccgggtgtacatgctgtggagtggatgtcaaggacctttttacggaccacatgttcgtgaaatggaaggttgagtacatcaaaaccgaagccattgtgtgcgtcgagctgacaagccaggaacggcagtgttccctcatcgaggctggcaccagatttaatctggggcccgtgacaattaccctgtctgagccgcggaacatccaacagaaacttcctcccgaaatcattacgctccatcctaaggttgaggaaggcttctttgatctgatgcacgtgcagaaggtcctgagcgcctccacagtgtgcaagctccagtcttgcacccacggaatccccggcgacctgcaagtttatcatattgggaatcttctgaaaggagatcgcatcaacggccacctcattcataagatcgagcctcacttcaataccagctggatgtcctgggacgggtgtgatctggactactactgcaacatgggagattggcccagctgtacatataccggcgtgacacagcacaatcatgccgcttttgtcaacctgcttaatatcgaaacggactacaccaaaacattccacttccattctaagagagtgaccgcccacggggatacaccgcagctcgacctgaaagcgcggcctacctatggcgctggagagattacggtgctggtcgaggttgccgatatggaactccataccaagaaagtggagatctccggcctgaagtttgccagccttgcttgcacagggtgttacgcctgcagctccggaattagctgtaaggtgagaatccacgtcgacgaacccgatgagctgaccgtgcacgttaaatcttccgaccccgacgtggtcgctgccagcacatccctcatggcgcgcaagctggagttcggcaccgatagcacatttaaagccttctctgctatgcctaagaccagcctgtgcttttatattgtggaacgggagtactgtaaatcctgctctgaagaggacacgcagaagtgtgttgatacaaaacttgaacaaccgcagagcatcctgattgagcataaggggaccatcatcggaaagcagaacgatacctgcacagccaaggcttcctgctggctcgagtctgtgaagtctttcttttatggcctgaaaaatatgctcgggtccgtcttcggcaactttttcattggaatcctgctttttctggcccccttcgtgctcctggttctgtttttcatgttcggctggaagattctgttttgtttcaagtgctgtagacgcaccagagggcttctcaaataccggcacctgaaggacgacgaagagacgggataccgcagaatcattgaacggctcaacaataaaaagggcaaaaaccgcctgcttgatggggagagactggcggaccggaagatcgccgaactcttttctacaaagacccatatcgga

SEQ ID NO: 13817 - RNA, 3495 nt, synthetic construct
  misc_feature 1..3495: note = derived and/or modified CDS sequence (opt5) from CCHVF(CCHVF Nakiwogo)__KX013484.1__Gn-NSm-Gc
  source 1..3495: mol_type = other RNA
gccgagggcgtgagcaacgactgcgtctccagaacccagctgatcaagacagaagttgctgagattcacgaagattcttacgggggacccggcgagaaaatcacgatttgtaatgggagcaccatcgtggaccaacggctcggatccgaactgggctgctatacaattaaccgcgtgaagacctacaaactttgtgagaatagcgccacagagaaggggtgcgaaatcgatagcgtccctgtgaaatgtaagcagggattctgcctgaaggttacccaggagggcagaggccatgtgaaactctcccgggggacagaaatcgtcctggacgtgtgtgatacctcttgcgagcttatgattccgaagggaacgggcgacatcctggttgattgtagcgggggacagcaacactttctccaggacaacctgattgatctgggctgccccaatgtgcctctcctggggaaaatggcgatctatatttgtcgcatgtccaaccatcccaagaccacaatggctttcctgttttggttcagctttggatacgtcattacctgcgtggtgtgcaaagtcctgttctatctcctgatcgttatcggcacacttggcaagaagctgaaacagtacagagagctcaagcctcagacctgtatcgtgtgcgaatctattcccgtgaatgtcatcgacgccgagatgcacgaactgaactgtaattataacatttgcccttactgtgcctcccggctgacgagcgatgggctcgtgcgccatgttacacaatgcccgaaaagaaaggagaaagtggaagagaccgagctgtaccttaatctggaacggatcccctggctcgtccgcagactgcttcaggtgtctgagtccacaggaatggctctgaagcggagctgttggatgaccaccctcctgattctgctcgttgtgtctctgtcccctgtccagagcgcccccgtgggccaggaaaaagctatcgaggtctatcaagtgcgcgaatcctacacatctatgtgcctttttgttctggggagcgtcctcttcgccgtgtcctggctggtgaagggacttatcgacggcattgggaacagctttttccctggactgtctgtttgtaagacgtgctccatcggcagcattaatggctttgagatcgagtctcacaaatgttattgcagcctcttctgctgtccctactgcagagcgtgttcctctgataagattacccaccggatgcatctgaacatctgcaaacgcagaaaggtggggagcaatgtcatgctggccgtgtgtaaacggatgtgctttaaggctacagtggaagcctccaacagcgctctcctgatcagatctattatcaactccaccttcgttatttgtgtccttatcctggtgatttgcgtggtcagcacatctgccgtggacatggagaatctcccggcgggaatctgggaacgcgaggaagacctgaccaacttctgtcaccaggagtgccaggttacggagacagaatgtctgtgcccttatgaggcccttattctccggaagcccctgtacctggattccatcgctaaaggcatgaaaagcctccttaattccaccaaccttgaaacctctctgagcatcgaggccccttggggagctattaatgtgcaatccacatttaaacccaccgtctctgccgccaacatcgctctcagctggtccagcgtggagcatagagggaataagattctggtttctggccgctccgaaagcatcatgaaactggaggaacggacagggatttcttggtcccttggcgtggaggacgcgagcgaatctaagacgctcaccgtcagcgtgatggatctgtcccagatgtatagccccgttttcgagtacctgtctggagacagacaggtggaggaatggcctaaggccacatgcaccggcgattgtccggagcgctgcgggtgtacatcctctacctgcctccacaaagaatggccccactcccggaactggagatgtaatcctacgtggtgctggggagtcggcaccgggtgtacatgctgtggactggacgtgcgcgatctttttaccgactacatgatggtgaagtggaaagtcgagtatgttaagacagaagctatcatgtgcgtggagctgacctctcaggagcggcaatgtagcctcatcgaagccggcacgagattcaacctggggcccgtgacaattaccctgtccgagcctcgcaatgtccagcagcggcttccctctgaaatcgtgacactccatccgaaaattgaggaaggctttttcgatctgatgcacgttcagaaggtgctgttttgcaagcatagcctccaagccacctcctgcacccacggagtccctggcgaccttcaggtgtaccatgttgggaaccttctgaaaggagataaggtgaatggccactctatccacaaaattgagagccatttcaacacatcctggatgagctgggacgggtgtgacctcgattatttttgcaatatgggagactggccctcttgtacgtacaccggcgtcacacagcacaacagagctgccttcgtgaacatgctgaatatcgagaccgattatacaaagacctttcatttccactccaaacgggttacggcgcacggggacacacctcagctggatcttaaggctcgccccacctacggcgccggagaagtgaccgtcctcgtggaggtggccgacctggaactgcatacaaagaagatcgaggtcagcggcctcaagtttgcttctctgacctgctccgggtgttatgcctgcagctctggaatttcctgtaaagttagaatccacgtgaacgagcctgatgaatttacagtgcatgtcaagagcaatgaccccgatgtggttgctgccggctccagccttatggcgcggaaaattgagctgggggccgactctacgttcaaggcttttagctccatgccgaaaaactctctctgcttctacatcgtggaaagagattactgtagctcctgcaccgacgatgacacacaaaagtgtgtcaataccaagctggagcaccctcagtctattctgatcgaacataaaggaacaatcattggcaagcagaacgatacctgccccacgaaaaccagctgctggcttgagtccgtgaagtctttcttctatgggctgaaaaatatgctcggcggaatctttggcaacgttttcctggggatttttctcttcctggccccctttgctctgctgatcctcttctttttctttggatggcgcctgctgttctgtcttaagtgctgtcggagaacacgcggcctgctcaagtacaaacagctgaaggacgaggaagaggccgggtataaaaagattatcgaaagactcaatgacaaaaagggaaagagccggctgttcgatggcgagcgccttgcggacagaaaaattgccgaactgttttccaccaagacacacatcggc

SEQ ID NO: 13818 - RNA, 3495 nt, synthetic construct
  misc_feature 1..3495: note = derived and/or modified CDS sequence (opt5) from CCHVF(CCHVF Saf)__KX013487.1__Gn-NSm-Gc
  source 1..3495: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacagctcctgcgaggtgatgattcccaagggaacgggcgatatcctggttgactgtagcgggggacagcaacactacctcaaagataacctgattgacctgggctgccctcatatccccctcctggggaagatggcgatttatatctgtcggatgtctaatcaccctcgcaccacaatggctttccttttctggttttcctttggatacgtgattacctgcatcttctgcaaagccctgttttatagcctcatcattatcggcacactgggcaagaaaattaagcagtacagagaacttaagccccagacctgtacgatctgcgagacagcccctgtcaacgctattgatgccgagatgcatgacctgaattgttcttataacatctgcccgtactgtgcttcccggctcaccagcgacgggctggcccgccacgtgccccagtgccctaaaagaaaggaaaaagttgaggaaacagagctgtacctcaatctggaacggatcccctggattgtgcgcaaacttctgcaagtctctgagtccaccggagtggcgctcaagagaagctcctggctgatcgtgcttctggtcctcctgaccgtttctctgagccctgtgcagtccgcccccgtgggccacgggaagacaattgagacgtatcagacccgggaaggattcacaagcatctgtctctttatgctgggctctattcttttcctggtctcctgcctcgtgaaagggctggttgatagcgtgtctgacagctttttcccgggactttccgtctgtaagacctgctctatcggcagcatcaacggctttgagattgaatcccataagtgttactgcagcctgttctgctgtccttattgccgccactgttctgctgatagagagatccatcagctccacctgtccatttgcaaaaagcggaaaacagggagcaatgtgatgctggccgtttgtaagagaatgtgcttccgcgctaccatcgaagcctctcggagagcgctcctgattcgctccatcattaacacgacatttgtgatctgtatccttaccctgaccatttgcgtcgtgagcacatccgccgtcgagatggagaatctcccctctggaacctgggaacgggaggaagacctgacaaacttctgtcaccaagagtgccaggtgacggaaaccgagtgtctgtgcccttacgaggctcttgttctcagaaaacccctgtttagcgattccatcgtgaagggcatgaagaatctgctcaactctacaagcctggaaacctcccttagcattgaggccccctggggagctatcaacgtccagtctacattcaaacctaccgtgtccacggccaatattgccctgagctggtcttccgttgaacatcgcggaaacaagatcctcgtgaccggccggagcgagtctatcatgaaactggaggaaagaacaggggtcagctgggacctgggcgtggaggatgcttccgaaagcaaacttctcaccgtgtctattatggacctgtcccaaatgtatagcccggtttttgagtacctgtccggagatcgccaggtcgaagagtggcccaaggcgacatgcaccggcgactgtcctgagcggtgcgggtgtacgtctagcacatgcctccacaaggaatggccccattccagaaattggcgctgtaaccctacctggtgctggggagtgggcacagggtgtacctgctgtggagtggatgtcaaggacctgttcaccgaccacatgtttgtgaaatggaaggttgagtatatcaaaacagaagccattgtgtgcgtcgagcttacgtctcaggaacggcagtgtagcctgatcgaggctggcaccagattcaatctcgggcccgtgacaattaccctgtccgagccgcggaacatccaacagaagctgcctcccgaaatcattacacttcatcctaaagttgaggaaggctttttcgatctcatgcacgtgcagaaggtcctgtctgccagcaccgtgtgcaagctgcagtcctgcacgcacggaatccccggcgacctccaagtttaccatattgggaatctgcttaaaggagatcgcgtgaacggccacctgatccataagattgagcctcactttaatacaagctggatgtcttgggacgggtgtgatctcgactactattgcaacatgggagattggccctcctgtacctacaccggcgtcacacagcacaatcatgccgctttcgtgaacctgctgaatatcgaaaccgactatatgaaaacatttcacttccatagcaagagagtgacggcccacggggataccccgcagcttgacctcaaagcgcggcctacatacggcgctggagagatcaccgtcctggttgaggtggccgatatggaactgcatacaaagaaagtggagatttctggcctcaagttcgtctccctggcctgcaccgggtgttatgcttgcagctctggaatctcctgtaaggtgcgcattcacgttgacgaacccgatgagcttacggtgcacgtcaaaagctccgaccccgacgtggttgccgctagcacctctctgatggccagaaagctcgagtttggcacagatagcaccttcaaagcgttttccgccatgcctaagacatctctgtgcttctacatcgtggaacgggagtattgtaaaagctgctccgaagaggacacccagaagtgtgtcgatacaaagctggaacaaccgcagtctattcttatcgagcataaagggaccattatcggaaagcagaacgacacgtgcacagctaaagccagctgctggctggagtccgtgaagtctttcttttacggcctcaaaaatatgctggggagcgtttttggcaacttctttatcgggattctcctgttccttgctccctttgtgctgctcgtcctgttctttatgttcggctggaagatcctgttctgttttaagtgctgtagacgcaccagagggcttctgaaataccggcacctcaaggatgacgaagagaccggatatcgcagaattatcgaacggctgaacaataaaaagggcaaaaaccgcctcctggatggggagagacttgccgaccggaagattgcggaactgttctccacaaagacccatatcgga

SEQ ID NO: 13819 - RNA, 3495 nt, synthetic construct
  misc_feature 1..3495: note = derived and/or modified CDS sequence (opt5) from CCHVF(CCHVF Ast199)__KX056051.1__Gn-NSm-Gc
  source 1..3495: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgcctgtgacagctcctgcgagattatgatccccaaaggaacgggcgatattctggtggactgtagcgggggacagcaacacttcctcaaggataacctgatcgacctgggctgccctcatattcccctcctggggaaaatggcgatctacatttgtagaatgtctaatcaccctcggaccacaatggcttttcttttctggttttccttcggatatgttattacctgcatcttttgcaaggccctgttctacagcctcattatcattggcacactgggcaaaaagatcaagcagtatcgcgaacttaaaccccagacctgtacgatttgcgagacagcccctgtgaacgctatcgatgccgagatgcatgacctgaattgttcttacaacatctgcccgtattgtgcttccagactcaccagcgacgggctggcccggcacgtcacacagtgccccaagcgcaaagaaaaggtggaggaaaccgagctgtacctcaatctggaaagaatcccttggatcgttcggaaacttctgcaagtgtctgagtccaccggagtcgcgctcaagcgctgtagctggctgattgtgcttctggtgctcctgacagtctccctgtctcccgttcagagcgcccctgtgggccacgggaaaacgatcgagacctaccagacaagagaaggatttaccaacatttgcctcttcatgctgggctccatcctttttatcgtgagctgtctggtcaaggggctcgtggattctgtttccgacagcttctttcccggactgtctgtgtgcaagacatgtagcattggctccatcaatggcttcgagattgaatctcataaatgctattgcagccttttctgttgcccgtactgtcggcactgctccgctgatcgcgagatccatcagctgcacctcgggatttgtaagaaaagaaagaccggaagcaacgtcatgctggccgtgtgcaaacggatgtgttttaaggctacgatcgaagcctctagacgcgcgctgctcattcggtccatcatcaatacaaccttcgttatttgcatcctgacccttgccatttgtgtggtcagcacatctgctgtggagatggagaacctgcctgccggcacctgggaaagagaggaagacctcacaaatttttgccaccaagagtgtcaggtcacggaaaccgagtgcctgtgcccctatgaggctctggtgcttcgcaagcctctcttcctggattccatcgttaaagggatgaagaacctgctcaacagcacatccctggaaacctctcttagcattgaggccccctggggagccatcaatgtgcagtccacatttaaacccaccgtctctacggctaacatcgcgctgagctggtccagcgtggaacatcggggcaataagattctcgttaccgggagatctgagtccatcatgaaactggaggaacgcacaggcgtgagctgggacctgggagtcgaggatgcctctgaatccaaacttctcaccgtgagcattatggacctgtctcaaatgtacagccctgtgttcgagtatctgtccggcgatcggcaggttgaagagtggccgaaggctacatgtaccggggactgccccgagagatgtggatgcacgagctctacatgtctccacaaagaatggcctcattcccgcaactggcggtgcaatcccacctggtgttggggcgtcgggacaggatgcacctgttgcggcgtggatgtgaaggacctgtttaccgaccacatgttcatcaaatggaaggtcgagtacattaaaacagaagccatcgtgtgtgttgagcttacgagccaggaaagacagtgctccctgatcgaggccgggacccgctttaacctcggccctgtgacaattaccctgtctgagccccggaatatccaacagaagctgccgcctgaaattatcacacttcatcccaagattgaggaaggattctttgatctcatgcacgtccagaaagtgctgagcgcttccaccgtttgcaagctgcagtcttgtacgcacggcatccctggggacctccaaatctatcatattggaaacctgcttaaaggcgatagactgaatgggcacctcatccataagattgagccccacttcaacacaagctggatgtcctgggacggatgcgatctggactactactgtaatatgggcgattggccttcttgcacctataccggggtgacacagcacaaccatgccgcgtttgtcaatctgcttaacatcgaaaccgactacacaaaaacgttccacttccatagcaagcgggtgaccgctcacggcgatacaccccagctcgacctgaaagcccgcccgacctatggagccggcgagattacagttctggtggaggtcgctgatatggaactccataccaagaaggtggaggtgtccgggctgaaatttgccagccttgcttgtacgggatgctacgcctgttcttccggcatcagctgcaaggtccggattcacgttgacgaacctgatgagctgaccgtgcacgtgaaatcttccgaccccgacgtcgtggcggccagcacatctctcatggctagaaagctggagttcgggaccgattccacatttaaagccttcagcgctatgcccaagacctccctgtgtttttatatcgttgaaagagagtactgcaagagctgttctgaagacgatacaaagaagtgcgtggacaccaaacttgagcagcctcaaagcatcctgattgaacataagggaacgatcattggcaaacagaatgatacatgcaccgccaaggcgtcctgttggctcgagtctgtcaagagcttcttttatgggctgaaaaacatgctcggctccgtgttcggaaactttttcgttggcatcctgctttttctggccccgttcgtgctcctggtcctgtttttcattttcgggtggaagatcctgttttgcttcaaatgttgccgccggaccagaggactgtttaagtaccgccacctcaaagacgatgaggaaacaggctacagaaagatcattgagcggcttaattctaagaaagggaagaaccgcctcctggacggagaaagacttgctgatcggaaaatcgccgagctgttcagcaccaagacgcatattggc

SEQ ID NO: 13820 - RNA, 3495 nt, synthetic construct
  misc_feature 1..3495: note = derived and/or modified CDS sequence (opt5) from CCHVF(CCHVF Ast149)__KX056054.1__Gn-NSm-Gc
  source 1..3495: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgcctgtgacagctcctgcgagattatgatccccaaaggaacgggcgatattctggtggactgtagcgggggacagcaacacttcctcaaggataacctgatcgacctgggctgccctcatattcccctcctggggaaaatggcgatctacatttgtagaatgtctaatcaccctcggaccacaatggcttttcttttctggttttccttcggatatgttattacctgcatcttttgcaaggccctgttctacagcctcattatcattggcacactgggcaaaaagatcaagcagtatcgcgaacttaaaccccagacctgtacgatttgcgagacagcccctgtgaacgctatcgatgccgagatgcatgacctgaattgttcttacaacatctgcccgtattgtgcttccagactcaccagcgacgggctggcccggcacgtcacacagtgccccaagcgcaaagaaaaggtggaggaaaccgagctgtacctcaatctggaaagaatcccttggatcgttcggaaacttctgcaagtgtctgagtccaccggagtcgcgctcaagcgcagctcctggctgattgtgcttctggtgctcctgacagtctctctgagccccgttcagtccgcccctgtgggccacgggaaaacgatcgagacctaccagacaagagaaggatttaccaacatttgtctcttcatgctgggcagcatcctttttatcgtgtcttgcctggtcaaggggctcgtggattccgttagcgactctttctttcccggactgagcgtgtgtaagacatgctccattggctctatcaatggcttcgagattgaaagccataaatgttattgctcccttttctgctgtccgtactgccggcactgtagcgctgatcgcgagatccatcagctgcacctcgggatttgcaagaaaagaaagaccggatctaacgtcatgctggccgtgtgtaaacggatgtgctttaaggctacgatcgaagcctccagacgcgcgctgcctattcggagcatcatcaatacaaccttcgttatttgtatcctcaccctggccatttgcgtggtctctacatccgctgtggagatggagaaccttcccgccggcacctgggaaagagaggaagacctgacaaatttttgtcaccaagagtgccaggtcacggaaaccgagtgtctctgcccttatgaggctctggtgctgcgcaagccccttttcctcgatagcatcgttaaagggatgaagaacctgctgaactccacatctctcgaaaccagcctgtccattgaggccccctggggagccatcaatgtgcagtctacatttaaacctaccgtcagcacggctaacatcgcgctttcctggagctctgtggaacatcggggcaataagattctggttaccgggagatccgagagcatcatgaaactcgaggaacgcacaggcgtgtcttgggacctgggagtcgaggatgcctccgaaagcaagctgcttaccgtgtctattatggacctcagccaaatgtactccccggtgttcgagtatctgagcggcgatcggcaggttgaagagtggcccaaggctacatgcaccggggactgtcctgagagatgcggatgtacgtcttccacatgcctgcacaaagaatggccccatagccgcaactggcggtgtaatcctacctggtgctggggcgtcgggacaggatgtacctgctgtggcgtggatgtgaaggacctctttaccgaccacatgttcatcaaatggaaggtcgagtacattaaaacagaagccatcgtgtgcgttgagctgacgtcccaggaaagacagtgttctcttatcgaggccgggacccgctttaacctgggccccgtgacaattaccctcagcgagccgcggaatatccaacagaagctgcctcccgaaattatcacactgcatcctaagattgaggaaggattctttgatcttatgcacgtccagaaagtgctctccgcttctaccgtttgcaagctgcagagctgcacgcacggcatccccggggacctgcaaatctatcatattggaaacctcctgaaaggcgatagacttaatgggcacctgatccataagattgagcctcacttcaacacatcctggatgtcttgggacggatgtgatctcgactactactgcaatatgggcgattggcccagctgtacctataccggggtgacacagcacaaccatgccgcgtttgtcaatctgctgaacatcgaaaccgactacacaaaaacgttccacttccattccaagcgggtgaccgctcacggcgatacaccgcagcttgacctcaaagcccgccctacctatggagccggcgagattacagttctggtggaggtcgctgatatggaactgcataccaagaaggtggaggtgagcgggctcaaatttgcctctctggcttgcacgggatgttacgcctgctccagcggcatctcttgtaaggtccggattcacgttgacgaacccgatgagcttaccgtgcacgtgaaatccagcgaccccgacgtcgtggcggcctctacatccctgatggctagaaagctcgagttcgggaccgatagcacatttaaagccttctccgctatgcctaagaccagcctgtgcttttatatcgttgaaagagagtactgtaagtcttgcagcgaagacgataccaaaaagtgtgtggacacaaaactggagcagccgcaatccatccttattgaacataagggaacgatcattggcaaacagaatgatacatgcaccgccaaggcgtcttgctggctggagagcgtcaagtccttcttttatgggctcaaaaacatgctgggctctgtgttcggaaactttttcgttggcatcctcctgtttcttgcccccttcgtgctgctcgctctgtttttcattttcgggtggaagatcctgttttgtttcaaatgctgtcgccggaccagaggactttttaagtaccgccacctgaaagacgatgaggaaacaggctacagaaagatcattgagcggctcaatagcaagaaagggaagaaccgcctgctcgacggagaaagactggccgatcggaaaatcgctgagcttttctccaccaagacgcatattggc

SEQ ID NO: 13821 - RNA, 3495 nt, synthetic construct
  misc_feature 1..3495: note = derived and/or modified CDS sequence (opt5) from CCHVF(CCHVF Ast137)__KX056057.1__Gn-NSm-Gc
  source 1..3495: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgcctgtgacagctcctgcgagattatgatccccaaaggaacgggcgatattctggtggactgtagcgggggacagcaacacttcctcaaggataacctgatcgacctgggctgccctcatattcccctcctggggaaaatggcgatccacatttgtagaatgtctaatcatcctcggaccacaatggcttttcttttctggttttccttcggatacgttattacctgcatcttttgcaaggccctgttctatagcctcattatcattggcacactgggcaaaaagatcaagcagtaccgcgaacttaaaccccagacctgtacgatttgcgagacagcccctgtgaacgctatcgatgccgagatgcacgacctgaattgttcttataacatctgcccgtactgtgcttccagactcaccagcgacgggctggcccggcacgtcacacagtgccccaagcgcaaagaaaaggtggaggaaaccgagctgtatctcaatctggaaagaatcccttggatcgttcggaaacttctgcaagtgtctgagtccaccggagtcgcgctcaagcgcagctcctggctgattgtgcttctggtgctcctgacagtctctctgagccccgttcagtccgcccctgtgggccatgggaaaacgatcgagacctaccagacaagagaaggatttaccaacatttgtctcttcatgctgggcagcatcctttttatcgtgtcttacctggtcaaggggctcgtggattccgttagcgactctttctttcccggactgagcgtgtgcaagacatgttccattggctctatcaatggcttcgagattgaaagccacaaatgctattgttcccttttctgctgcccgtactgtcggcattgcagcgctgatcgcgagatccaccagctgcacctcgggatttgtaagaaaagaaagaccggatctaacgtcatgctggccgtgtgcaaacggatgtgttttaaggctacgatcgaagcctccagacgcgcgctgctcattcggagcatcatcaatacaaccttcgttatttgcatcctgacccttgccatttgtgtggtctctacatccgctgtggagatggagaacctgcctgccggcacctgggaaagagaggaagacctcacaaatttttgccatcaagagtgtcaggtcacggaaaccgagtgcctgtgtccctatgaggctctggtgcttcgcaagcctctcttcctggatagcatcgttaaagggacaaagaacctgctcaactccacctctctggaaacaagcctttccattgaggccccctggggagccatcaatgtgcagtctacctttaaacccacggtcagcaccgctaacatcgcgctgtcctggagctctgtggaacaccggggcaataagattctcgttacagggagatccgagagcatcatgaaactggaggaacgcaccggcgtgtcttgggacctgggagtcgaggatgcctccgaaagcaaacttctcacagtgtctattatggacctgagccaaatgtactcccctgtgttcgagtatctgagcggcgatcggcaggttgaagagtggccgaaggctacctgcacgggggactgccccgagagatgtggatgcacatcttccacctgtctccataaggaatggcctcacagccgcaactggcggtgcaatcccacatggtgttggggcgtcgggaccggatgcacctgttgcggcgtggatgtgaaggacctgtttacagaccatatgttcatcaaatggaaggtcgagtacattaaaacggaagccatcgtgtgtgttgagcttacctcccaggaaagacagtgctctctgatcgaggccgggacacgctttaacctcggccctgtgaccattacactgagcgagccccggaatatccaacagaagctgccgcctgaaattatcacccttcaccccaagattgaggaaggattctttgatctcatgcacgtccagaaagtgctgtccgcttctacggtttgtaagctgcagagctgcacacatggcatccctggggacctccaaatctatcacattggaaacctgcttaaaggcgatagactgaatgggcatctcatccacaagattgagccccacttcaacacctcctggatgtcttgggacggatgcgatctggactactactgtaatatgggcgattggcctagctgcacctatacaggggtgacccagcataaccacgccgcgtttgtcaatctgcttaacatcgaaacagactacacgaaaaccttccatttccactccaagcgggtgacagctcatggcgatacaccccagctcgacctgaaagcccgcccgacctatggagccggcgagattaccgttctggtggaggtcgctgatatggaactccacacgaagaaggtggaggtgagcgggctgaaatttgcctctcttgcttgtaccggatgctacgcctgttccagcggcatctcttgcaaggtccggattcacgttgacgaacctgatgagctgacagtgcatgtgaaatccagcgaccccgacgtcgtggcggcctctacctccctcatggctagaaagctggagttcgggacagatagcacctttaaagccttctccgctatgcccaagacaagcctgtgtttttatatcgttgaaagagagtactgcaagtcttgtagcgaagacgataccaaaaagtgcgtggacacgaaacttgagcagcctcaatccatcctgattgaacacaagggaacaatcattggcaaacagaatgatacctgtaccgccaaggcgtcttgctggctcgagagcgtcaagtccttcttttatgggctgaaaaacatgctcggctctgtgttcggaaactttttcgttggcatcctgctttttctggccccgttcgtgctcctggtcctgtttttcattttcgggtggaagatcctgttttgcttcaaatgttgccgccggacaagaggactttttaagtaccgccatctcaaagacgatgaggaaaccggctacagaaagatcattgagcggctgaatagcaagaaagggaagaaccgcctcctggacggagaaagacttgctgatcggaaaatcgccgagctgttctccacgaagacacacattggc

SEQ ID NO: 13822 - RNA, 3495 nt, synthetic construct
  misc_feature 1..3495: note = derived and/or modified CDS sequence (opt5) from CCHVF(CCHVF Ast133)__KX056060.1__Gn-NSm-Gc
  source 1..3495: mol_type = other RNA
agcgaggaacccgacgatgactgcatctccagaacccagctgctcaagacagagacggccgaaattcacgatgacaactacggcgggcctggagataaaatcaccatttgtaatggctctacaatcgtggaccaacggctggggagcgagcttggatgctataccattaaccgcgtcaagtccttcaaactgtgtgaaaattctgctacaggcaagacctgcgagatcgatagcacaccggttaaatgtagacaggggttttgcctcaagatcacccaggagggacggggccatgtgaagctgtcccgcggctctgaagtggtccttgacgcctgtgatagctcctgcgagattatgatccccaaagggacgggagacattctggtggattgtagcggcgggcagcaacacttcctcaaggacaacctgatcgatctgggatgccctcatattcccctcctgggcaaaatggcgatctacatttgtagaatgtctaatcaccctcggaccacaatggcttttcttttctggttttccttcgggtatgttattacctgcatcttttgcaaggccctgttctacctcctgattatcattggaacacttggcaaaaagatcaagcagtatcgcgaactgaaaccccagacctgtacgatttgcgagacagcccctgtgaacgctatcgacgccgagatgcatgacctcaattgtagctacaacatctgcccgtattgtgcttctagactgacctccgatggcctggcccggcacgtcacacagtgccccaagcgcaaagaaaaggtggaggaaaccgagctctacctgaatcttgaaagaatcccttggatcgttcggaaactgctccaagtgagcgagtctaccggggtcgcgctgaagcgctccagctggcttattgtgctgctcgtgctgctgacagtctccctctctcccgttcagagcgcccctgtgggacacggcaaaacgatcgagacctaccagacaagagaagggtttacctccatttgtctgttcatgcttggaagcatcctgtttatcgtgtcttgcctcgtcaagggcctggtggactccgttagcgattctttctttcccgggcttagcgtgtgtaagacatgctccattggatctatcaacggcttcgagattgaaagccataaatgttattgctccctgttctgctgtccgtactgccggcactgtagcgctgaccgcgagatccatcagctccacctgtctatttgcaagaaaagaaagaccggctccaatgtcatgctggccgtgtgtaaacggatgtgctttaaggctacgatcgaagccagcagacgcgcgctcctgattcggtctatcatcaacacaaccttcgttatgtgtattcttaccctggccatctgcgtggtctccacaagcgctgtggagatggaggatctccctgccgggacctgggaaagagaggaagacctgacaaatttttgtcaccaagagtgccaggtcacggaaaccgagtgtctgtgcccctatgaggctcttgtgctccgcaagcctctgttctccgattctattgttaaaggaatgaagaacctgctcaatagcacatccctggaaacctctcttagcatcgaggccccctggggcgccattaacgtgcagtccacatttaaacccaccgtcagcacggctaacatcgcgctgtcttggtccagcgtggaacatcgggggaataagatcctcgttaccggaagatctgagtccattatgaaactggaggaacgcacaggcgtgagctgggacctgggggtcgaggatgcctctgaaagcaaacttctcaccgtgtccatcatggacctgagccaaatgtactctcctgtgttcgagtatctgtccggcgatcggcaggttgaagagtggccgaaggctacatgcaccggagactgtcccgagagatgcggctgtacgagctccacatgcctccacaaagaatggcctcattctcgcaactggcggtgtaatcccacctggtgctggggagtcggaacaggctgtacctgctgtggggtggacgtgaaggatctgtttaccgaccacatgttcattaaatggaaggtcgagtacatcaaaacagaagccattgtgtgcgttgagcttacgagccaggaaagacagtgttccctgatcgaggccggaacccgctttaacctcggccctgtgacaatcaccctgtctgagccccggaatattcaacagaagctgccgcctgaaatcattacacttcatcccaagatcgaggaagggttctttgatctcatgcacgtccagaaagtgctgagcgcttccaccgtttgcaagctgcagtcttgcacgcacggcattcctggagacctccaaatctatcatatcggcaacctgcttaaaggggatagagtgaatggacacctgattcataagatcgagccccacttcaacacaagctggatgtcctgggacggctgtgatctcgactactactgcaatatgggggattggcctagctgtacctataccggagtcacacagcacaaccatgccgcgtttgtgaatctgctgaacattgaaaccgactacacaaaaacgttccacttccattctaagcgggttaccgctcacggcgatacaccccagcttgacctcaaagcccgcccgacctatggggccggcgagatcacagtgctggtcgaggtggctgatatggaactgcataccaagaaggtggagatttccggactcaaatttgccagcctgacgtgcaccggctgttacgcttgttcttccgggatcagctgcaaggtccggattcacgttgacgaacctgacgagcttacagtgcacgtgaaatcttccgatcccgacgtcgtggccgcgagcacctccctgatggccagaaagctcgagttcggaacagatagcacctttaaggctttctctgccatgcccaagacaagcctgtgcttttatatcgttgaaagagagtactgtaagtcctgctctgaagacgataccaaaaagtgtgtggacacgaaactggagcagcctcaaagcatccttattgaacataagggcacaatcattgggaaacagaatgatacctgcaccgctaaggcctcctgctggctggagtctgtcaagagcttcttttatggactcaaaaacatgctgggctccgtgttcgggagctttttcgttggcatcctcctgtttcttgcgccgttcgtgctgctcgtcctgtttttcatgttcggatggaagattctgttttgtttcaaatgctgtcgccggacaagaggcctttttaagtaccgccacctgaaagacgatgaggaaaccgggtacagacggatcatcgagcgcctcaattctaagaaggggaaaaacagactgctcgacggcgaacggctggccgatcgcaagattgctgagcttttctccagcaaaacgcatatcggg

SEQ ID NO: 13823 - RNA, 3495 nt, synthetic construct
  misc_feature 1..3495: note = derived and/or modified CDS sequence (opt5) from CCHVF(CCHVF SK/2015/human)__KX458183.1__Gn-NSm-Gc
  source 1..3495: mol_type = other RNA
agcgaggaatccggcgacgattgcatctctagaacccggctgctccgcacagagacggccgaaattcacggggacagctacggaggccccggggataagatcaccatttgtaacggatccacaatcgtggaccagagactgggctctgagatggggtgctataccattaatcgggtcaagagcttcaagctgtgtgaaaactccgctacaggaaaatcttgcgagatcgatagcatccctgttcgctgtagacaaggctactgcctgaagattacccaggagggccgggggcatgtgaaactctcccgcggaagcgaagtggtcctggacgcctgtgattcttcctgcgaggtgatgatcccgaagggcacaggggacattcttgttgattgtagcggaggccagcagcactttctgaaggacaatctcatcgatctggggtgccccaacattcctctgctcggaaaaatggcgatctatatttgtagaatgtctaatcatcccaagaccacgatggctttcctgttttggttctcctttggctacgtgattacctgcatcctttgcaaagccatcttctatctgctcatcattgtcggcacactggggaagcggtttaaacaataccgcgaacttaagcctcagacctgtacaatctgcgagaccacgcccgccaacgctattgacgccgagatgcacgatctgaattgtagctatacaatctgcccttactgtgcttctagactcacctccgacggactggcccggcatgtgacacagtgcccgaagcgcaaagaaaaggttgaggaaaccgagctgtacctcaacctggaaagaatcccctgggtggtccggaaacttcttcaggtgagcgagtccaccggcgtggcgctcaagcgctctagctggctgattgtccttctggttctcttcacagtgtccctgagccctgtgcaatctgcccccatcgggcacggaaaaacgattgagacctatcaggctagagaagagtacacaggcatctgtctgtttgtcctcgggtccattctgttcatcgtgagctgccttgttaagggactggtggacggcgtcggcaatatctttttccctgggctctctatttgtaaaacctgcagcatcggatccattaacggctttgaaatcgagtctcacaagtgttattgcagcctgctttgctgtccctactgccggcattgttccgccgatagagaaattcaccagctgcatctcagcatctgcaagaaacgcaagacagggtctaatgtgatgctggctgtttgtaaacggatgtgcttcagagccaccatggaggtgtccaacaaggcgctgctcattcgcagcatcatcaatacgacattcgtcgtgtgtattctgatccttgccgtctgcgtggtttctacctccgctgtggagatggaaagcctgccggccggaacctgggagcgggaagaggacctcacaaacttttgtcaccaggaatgccaagtcaccgagacagagtgtctgtgcccttatgaagctctggtgcttagacgccccctcttcctggattccattgttcggggcatgaaaaatctgctcaactctacgagcctggagacctccctttctatcgaagccccttggggcgccattaacgtgcagagcacatacaagcccaccgtctccacagctaatatcgcgctgagctggtcttccgtggagcacagagggaacaagatcctcgtgagcggacgctctgagtccattatgaaactggaggaacggaccggcgttagctgggacctgggggtcgaagatgcctctgagagcaagctgctcacggtgtccgtgatggacctgagccagatgtattctcccgtctttgaatacctgtccggagatagacaagtggaggagtggcctaaagctacctgcacaggcgactgtccggaacgctgcgggtgtaccacatctacctgcctccataaggagtggccccactcccggaattggagatgtaaccctacgtggtgctggggagttggcacagggtgtacctgctgtggcctggatgtgaaagaccttttcacagattacatgtttgtcaagtggaaggtggaatatatcaaaaccgaggccattgtttgcgtggaactgacctctcagggacggcagtgtagcctcatcgaggccggcacacgcttcaatctggggtccgtcacgattaccctgtctgagcccagaaacatccagcataaacttcctcccgaaatcattacactccacccgcggatcgaggaaggatttttcgacctgatgcatgtgcaaaaagttctgagcgcttccaccgtgtgcaagctccagtcttgcacacacggcgtccctggggaccttcaggtgtaccacattggaaatcttctgaaaggcgataaggtgaacgggcatctcatccacaagattgagccccattttaataccagctggatgtcctgggacggctgtgatctggactattactgcaacatgggagattggcctagctgtacgtatacaggcgtcacccagcacaatcacgcctctttcgttaacctgcttaatatcgaaaccgactacacaaagaactttcatttccactccaagagagtgaccgcgcatggggatacaccccaactcgacctgaaagctcgccctacgtatggagccggcgagatcaccgtgctggtcgaggtggccgatatggaactccacacaaagaaaattgagatcagcgggctgaagtttgcttctcttacctgcacaggatgttacgcctgctccagcggcatttcttgtaaagttcggatccatgtggacgaacccgatgagctgaccgtccacgtgaagtccgacgatccggacgttgtggctgccagctccagcctcatggcgagaaagctggagttcgggacggactctaccttcaaagcctttagcgctatgcctaagacatccctgtgcttctacattgtcgaacgcgagtattgtaaatcttgcagcaaggaagatacccagaaatgtgtgaatacaaaacttgagcagccccagtccatcctgattgaacacagaggcaccatcatcggaaagcaaaacaacacatgcattgccaaagctagctgctggctcgagagcgttaagtcctttttctacggcctgaaaaatatgctctctgggatctttggaaacctgttccttggcatttttctgttcctcgccccctttatcctgctgattcttttctttatgttcgggtggcggatcctgttttgtttcaagtgctgtcgcagaacccggggactcttcaaatatcgccatctgaaggacgatgaggaaacgggctacagacggatcattgagcgcctcaataacaagaaaggcaagaataaactgcttgacggggaaagactggcggatcggcgcatcgccgagctctttagcacaaagacccacattgga

SEQ ID NO: 13824 - RNA, 3495 nt, synthetic construct
  misc_feature 1..3495: note = derived and/or modified CDS sequence (opt5) from CCHVF(CCHVF YL16070)__KY354081.1__Gn-NSm-Gc
  source 1..3495: mol_type = other RNA
gccgagggcgggagctccgactgcatctctagaacccagctggtgaagacagaagtcgctgagattcacgaagatagctacggaggccccggggagaaaatcacgatttgtaacggatccaccatcgttgaccagcggctcggctctgaactggggtgctatacaattaatcgcgtcaagagctacaaactttgtgagaactccgcctctggaaagagctgcgagatcgattccatccctgtgaaatgtaagcagggcttctgcctgaagattacccaggaaggcagagggcatgtgaaactcagccggggaacagagatcgtgctggacgtttgtgattcttcctgcgaacttatgattccgaagggcaccggggacatcctggtggattgtagcggaggccagcaacactttctccagaataacctgattgacctggggtgccccaatgtccctctcctgggaaaaatggcgatctatgtgtgtcgcatgtctaaccatcccaagacaaccatggctttccttttctggttctcctttggctacgttattacgtgcatcgtgtgcagagtcctgttctatctcctgatcgccattggcaccgtggggaaaaagctgaagcagtaccgggagctgaaacctcagacatgtatcgtgtgcgagagcgtccccgttaatgccattgatgctgaaatgcacgagctcaactgttcttataatatctgcccttactgtgcctcccgcctgagcaccgacggactgattagacatgtgacacaatgcccgaagcggcgcgaaaaagtggaggaaaccgagctctttctgaaccttgagagaatcccctggctggtccggaagctccttcaggtgtccgaatctacgggcatggctcttaaacgcagctgttggatgatcacactgctcattctgctgctcgtttccatgagccctgtgcagtctgcccccgtcgggaaggagagagcgatcgaaacctaccaggcccgggaggcttatacaggaatttgcctgttcgtgcttggctccgttctgtttgccgtgagctggctcaccaaagctctgatcgatgggattggaaattctttctttcctggccttagcgtctgtaagacctgctccatcggctctatcaacgggttcgaaattgagagccacaagtgttactgctccctgttttgctgtccctattgccgcgcctgtagctctgacaaaaatacacacagaatgcatctcaacgtgtgcaagaaacggaagatgggatccaatgtcatgctggcggtgtgtaaaagaatgtgcttccgcgccacgatcgaggctagcaacaaggccctgctcattcggtctatcattaactccaccttcgttatctgtattctgatccttacaatctgcgtggtcagcacctccgctgtggatatggaaaatctgccggccggcatttgggagaaggaagaggacctcacaaacttttgtcaccaagaatgccaggttaccgagacggagtgtctgtgcccttacgaagccatggtgctgagaaaaccccttttcctcgactctatcgctaaggggatgaaaagcctgctgaatagcacatctctcgagaccagcctgtccattgaagcgccttggggagccatcaacgtccagagcacctttaagcccacagtgtctgctgccaatattgccctttcctggagctctgtggagcatcgcggcaacaaaatcctggtttccgggcggagcgagtctatcatgaagctcgaagagagaaccggcgtcagctggaatctgggagtggaagatgcttccgagagcaagacactgacggtgtctgtcatggacctttcccaaatgtatagccccgtgttcgaatacctctccggcgatcgccaggttgaggagtggcctaaagcgacctgcacaggggactgtccggaacggtgcggatgtacctctagcacatgcctgcacaaggagtggccccactccagaaactggcgctgtaatcctacctggtgctggggcgtggggacgggatgtacctgctgtggcctggatgtcaaagactttttcacagattatatgctcgtgaagtggaaagttgaatacattaagaccgaggccatcgtgtgcgtcgaactgacatctcaggagcggcagtgtagccttattgaggctgggaccagatttaacctgggccccgtgacgatcacactctccgaacctcgcaatgttcaacagcggctgcccccggagattgtgaccctgcatcctaagatcgaagagggattctttgaccttatgcacgtccagaaaatcctctctgccagcacagtgtgcaagctgcagtcctgcacccatggcgtgcccggggatttccaagtctaccacgttggaaacctgctcagaggcgacaaagtgaatgggcatagcattcacaagatcgaacctcactttaacacctcttggatgtcctgggatggatgtgacctggactatttctgcaatatgggcgattggcccagctgtacatacacgggggtgacccagcataaccgggccgcttttattaacatgcttaatatcgagacagactataccaaaacattccacttccattctaagcgcgtcaccgcccacggcgatacgcctcagctggacctcaaagctagacccgcctacggagcgggcgaggtgacagttctggtggaagtcgccgatctggagcttcacaccaagaagctcgaagtgtccgggctgaaaattgctagcctgacctgctctggatgttatgcctgctccagcggcatctcctgtaaggttcggatccatgtgaacgagccggacgagtttacagtccacgtgagaagctctgatcctgacgttgtggctgccgggagctccctcatggcgcgcaaaattgaatttggagccgattctacctttaaggctttcagctccatgcccaaagactctctgtgcttttacatcgtcgagaaggattattgtagctcctgcacagacgatgacacgcagaagtgtgtgaataccaaacttgaccatccccaatctattctgatcgaacacaagggcacaattatcgggaaacagaacgatacctgcagcacaaagacctcctgctggctcaaatccttcaagggctttttctacggactgaagaatatgctgtctggcatttttgggaacgtgttccttggaatcctgctctttctggcccctttcgtcctcctgatctttttcttctttttcggctggcggcttctgttttgtctcaaatgctgtaagaaaacgaaggggctgctgaaatacaagcatcttaaggacaaagaggaagctggatataagaaaattatcgagagactgaatggcaagaaaggcaagtcccaactcttcgatggggagcgcctggccaacagaaaaattgccgaactctttagcaccaagatccacattgga

SEQ ID NO: 13825 - RNA, 3495 nt, synthetic construct
  misc_feature 1..3495: note = derived and/or modified CDS sequence (opt5) from CCHVF(CCHVF Oman_812956)__KY362518.1__Gn-NSm-Gc
  source 1..3495: mol_type = other RNA
agcgaggaatccggcgaggactgcatctctagaacccagctgctccggacagaaacggccgagattcacggggataactacggaggccccggggacaagatcaccatttgtaatggaagcacaatcgtggatcaacgcctgggctccgaacttgggtgctataccattaacagagtcaaatctttcaagctgtgtgagaatagcgctacaggaaaatcctgcgagatcgacaacacccctgttaagtgtaaacagggcttttgcctcaagatcacacaggaaggccgggggcatgtgaagctgtctcgcgatagcgaggtggtccttgacgcctgtgattccagctgcgaaattatgatcccgaaaggaaccggcgacattctggtggattgttctgggggacagcaacacttcctcaaggacaatctgatcgatctgggctgccccaacattcctctcctggggaaaatggcgatctacatttgtagaatgtccaatcatcccaagacgaccatggcttttcttttctggtttagcttcggatatgttatcacatgcatcctgtgcaaagtgatcttttacctcctgattgtcgtgggcacccttggcaagaagttcaaacagtatcgggagctgaagcctcagacatgtaccatttgcgagacgacacccgttaacgccatcgacgccgaaatgcacgatctcaattgttcttacaacatttgcccttattgtgcttcccgcctgaccagcgacgggctggccagacatgtgatgcagtgcccgaaacggaaggagaaaatcgaagagacagaactctacctgaatcttgagcgcatcccctgggtcgtgagaaagctgctccaagtgtctgagtccaccggagtcgctctgaaacggagctcctggcttattgttctgctcgtgctgctgaccgtgtctctcagccctgtccagtccgcccccatcggccacgggaagacaattgaaacgtaccagacccgcgagggatatacaagcatctgtctgtttgtgcttggctctattctgttcatcgtttcccacctcatgaaggggctggtggacagcgtcggaaacagctttttccctggcctttctatctgcaaaacctgttccattggctctatcaatgggtttgaaattgagagccataagtgctactgttccctgttctgctgcccctattgtagacactgcagcgcggataaagaaatccataagctccacctgtctatttgtaaaaagcggaaggccggatccaacgtgatgctggctgtttgcaaacgcatgtgtttcagagccacaatggaggtgagcaataaggctctcctgatccggtctgtcattaacaccacgtttgtggtctgcatccttatcctggccgtgtgtgttgtgtccacaagcgcggtcgagatggaatccctcccggccggcacctgggagagagaagaggacctgaccaacttctgccaccaggaatgtcaagtgacagagaccgagtgcctgtgtccttacgaagctcttgttctccgcaaacccctgtttttcgattctattgccaaggggatgaaaaatctgctcaacagcacatccctggagacgtctcttagcatcgaagctccttggggagccattaatgtgcagtccacctttaagcccacagtcagcaccgccaacatcgctctgtcttggtccagcgtggagcatcggggcaataagattctcgtgtctgggagatccgagagcatcatgaaactggaagagagaacaggcatctcttgggacctgggagttgaagatgcgagcgagtccaagctgctcaccgtcagcgtgatggacctgtctcagatgtattcccccgtgttcgaatacctgagcggcgatcggcaagtcgaggagtggcctaaagccacgtgcaccggggactgcccggaaagatgtggatgcacatcctctacctgtctccacaaggagtggccccatagccgcaactggcggtgcaatcctacatggtgttggggcgtggggaccggatgcacgtgttgcggcctggatgttaaagacctttttacagattatatgttcgtgaagtggaaggtcgaatacattaaaaccgaggctatcgtgtgtgttgaactgacatcccaggagagacagtgctctctcattgaggccgggacccgctttaacctgggccccgtgaccatcacactgagcgaacctcggaatattcagcaaaaacttcccccggagatcgtcacgctccaccctagaatcgaagagggattctttgacctgatgcatgtgcagaaggttctgtccgcctctaccgtgtgtaagctccagagctgcacacacggcgtccccggggaccttcaggtgtaccacattggaaaccttctgaaaggcgataaggtgaatgggcatctcatccacaaagtcgaacctcatttcaacacctcctggatgagctgggacggatgcgatctggactattactgtaatatgggcgattggccctcttgcacatataccggggttacgcaacacaaccacgctgcctttgtgaatctgcttaacattgagacagactacaccaagaacttccatttccactccaagcgcgtgaccgcgcatggcgatacacctcagctcgacctgaaagctcggcccaattatggagccggcgagatcaccgtcctggtggaagttgccgatatggagctccacacaaagaaaattgaaatcagcgggctgaagtttgcttctcttacgtgtaccggatgctacgcctgttccagcggcatctcttgcaaagtgcgcattcatgtcgacgagccggatgagctgacagtgcacgttaagtccgaagaccctgatatcgtggctgccagctccagcctcatggcgcggaagctggagttcgggaccgactctacatttaaagccttcagcgctatgcccaagacctccctgtgtttttatattgtcgaacgcgagtactgcaaatcttgtagcaaggaagacacgcagaaatgcgtgaacgccaaacttgagagaccccagtccatcctgattgagcacaagggaaccatcattggcaagcaaaatgatacatgtaccgctaaggcctcttgctggctcgaaagcgttaaatccttcttttacgggctgaagaacatgctctctggcatcttcggaaatgtgtttatcggcattttcctgtttcttgcgcctttcatcctgctcattctgtttttcatgttcgggtggcggatcctgttttgcttcaaatgttgcagacgcacacggggactttttaagtatagacatctgaaggacgatgaggaaaccggctaccgcaaaattatcgagagactcaacaataagaaagggaagaacaaactgctcgacggagaacggctggccgatcgcaagatcgctgagcttttcagcacaaaaacccacattggc

SEQ ID NO: 13826 - RNA, 3495 nt, synthetic construct
  misc_feature 1..3495: note = derived and/or modified CDS sequence (opt5) from CCHVF(CCHVF UCCR4405)__KY484029.1__Gn-NSm-Gc
  source 1..3495: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgcctgtgacagctcctgcgaggtgatgattcccaaaggaacgggcgatatcctggttgactgtagcgggggacagcaacacttcctcaaggataacctgattgacctgggctgccctcatatccccctcctggggaaaatggcgatttacatctgtagaatgtctaatcaccctcggaccacaatggcttttcttttctggttttccttcggatatgtgattacctgcatcttttgcaaggccctgttctacagcctcatcattatcggcacactgggcaaaaagattaagcagtatcgcgaacttaaaccccagacctgtacgatctgcgagacagcccctgtcaacgctattgatgccgagatgcatgacctgaagtgttcttacaatatctgcccgtattgtgcttccagactcaccagcgacgggctggcccggcacgtgacacagtgccccaaacgcaaggaaaaagttgaggaaaccgagctgtacctcaacctggaaagaatcccttggattgtgcggaaacttctgcaagtctctgagtccaccggagtggcgctcaagcgcagctcctggctgatcgtgcttctggtcctcctgacagtttctctgagccccgtgcagtccgcccctgtgggccacgggaagacgattgagacctaccagacaagagaaggatttaccagcatctgtctcttcatgctgggctctattctttttatcgtctcctgcctggtgaaggggctcgttgatagcgtgtctgacagcttctttcccggactgtccgtctgtaaaacatgctctatcggcagcattaatggcttcgagatcgaatcccataagtgttattgcagccttttctgctgtccgtactgccggcactattctgctgatcgcgagattcatcagctgcacctctccatctgtaaaaagagaaaaaccgggagcaacgtgatgctggccgtttgcaagcggatgtgttttaaggctacgattgaagcctctagacgcgcgctgctcatccggtccattatcaatacaaccttcgtgatctgcattctgatccttgccatttgtgtcgtgagcacctccgctgtcgagatggagaacctgcctgccggaacatgggaaagagaggaagacctcaccaatttttgccaccaagagtgtcaggtgacagaaacggagtgcctgtgtccctacgaggctctggttcttcgcaaacctctcttcctggattctaccgtgaagggcatgaaaaacctgctcaatagcacatccctggaaacctctcttagcatcgaggccccctggggagccattaacgtccagtccacatttaagcccaccgtgagcacggctaacatcgcgctgtcttggtccagcgttgaacatcgggggaataaaatcctcgtgaccggcagatctgagtccattatgaagctggaggaacgcacaggggtcagctgggacctgggcgtggaggatgcctctgaaagcaaacttctcaccgtgtccatcatggacctgagccaaatgtattctcctgttttcgagtacctgtccggagatcggcaggtcgaagagtggccgaaggctacatgcaccggcgactgccccgagagatgtgggtgcacgagctccacatgtctccacaaggaatggcctcattctcgcaactggcggtgcaatcccacctggtgttggggagtgggcacagggtgcacctgttgcggagtggatgtcaaagacctgtttaccgaccacatgttcgtgaagtggaaagttgagtatattaagacagaagccatcgtgtgtgtcgagcttacgagccaggaaagacagtgctccctgattgaggccggcacccgctttaacctcgggcctgtgacaatcaccctgtctgagccccggaatatccaacagaagctgccgcctgaaattatcacacttcatcccaaaattgaggaaggcttctttgatctcatgcacgttcagaaggtgctgagcgcttccaccgtctgtaaactgcagtcttgcacgcacggaatccctggcgacctccaaatttaccatatcgggaacctgcttaagggagatagagtgaatggccacctgatccataaaattgagccccacttcaacacaagctggatgtcctgggacgggtgcgatctcgactactattgtaatatgggaaactggcctagctgcacctacaccggcgttacacagcacaatcatgccgcgtttgtgaacctgctgaatatcgaaaccgattatacaaagacgttccacttccattctaaacgggtcaccgctcacggggacacaccccagcttgatctcaaggcccgcccgacctacggcgccggagagattacagtgctggtggaggtcgctgacatggaactgcataccaagaaagttgagatctccggcctcaagtttgccagcctggtgtgtacggggtgctatgcttgttcttccggaattagctgcaaagtgagaatccacgtcgatgaacctgacgagcttaccgtgcacgttaagtcttccgatcccgacgtggtcgccgcgagcacatccctgatggcccggaaactcgagttcggcaccgacagcatttttaaggctttctctgccatgcccaagacaagcctgtgtttttacatcgtggaaagagagtattgcaaatcctgttctgaagatgacaccaagaaatgcgttgatacaaagctggagcagcctcaaagcatccttattgaacataaagggaccatcattggaaagcagaacgacacgtgtacagctaaggcctcctgctggctggagtctgtgaaatccttcttttacggcctcaagaatatgctggggagcgtcttcggcaactttttcgtgggaatcctcctgtttcttgcgccgttcgttctgctcgtgctgtttttcatgttcggctggaaaattctgttttgcttcaagtgttgccgccggaccagagggctttttaaataccgccacctgaaggatgacgaggaaaccggatatagacggatcatcgagcgcctcaactctaagaaaggcaagaatagactgctcgatggggaacggctggccgaccgcaaaattgctgagcttttcagcacaaagacccatatcgga

SEQ ID NO: 13827 - RNA, 3495 nt, synthetic construct
  misc_feature 1..3495: note = derived and/or modified CDS sequence (opt5) from CCHVF(CCHVF UCCR4459)__KY484032.1__Gn-NSm-Gc
  source 1..3495: mol_type = other RNA
agcgaggaatccggcgacgattgcatctctagaacccagctgagccggacagagacggccgaaattcactccgacaactacgggggacccggcgataagatcaccatttgtaatgggtctacaatcgtggaccaacgcctcggaagcgagctgggctgctataccattaacagagtcaaatccttcaaactttgtgaaaattctgctacagggaaaagctgcgagatcgattccacccctatcaagtgtcggcagggattttgcctgaaaattacacaggagggccgcggccatgttaagctcagcagagggtctgaagtggtgctggacgcctgtgattccagctgcgagatcatgattccgaagggaaccggcgacatccttgtcgattgttctgggggacagcaacacttcctgaaagacaacctcattgatctgggctgccccaatatccctctgctcgggaagatggcgatttacatctgtcggatgtccaaccatcccaaaacgaccatggcttttctgttctggtttagcttcggatatgtgatcacatgcattctttgcaaggttatcttttacctgctcattgtggtcggcaccctgggcaaaaagttcaagcagtatcgcgaacttaaacctcagacatgtaccatctgcgagacgacacccgtgaatgccattgacgccgagatgcacgatctgaactgttcttacaatatctgcccttattgtgcttccagactcaccagcgacgggctggcccggcatgttatgcagtgcccgaagcgcaaagaaaaggtggaggaaacagagctgtacctcaacctggaaagaatcccctgggtcgtgcggaaacttctgcaagtgtccgagtctaccggagtcgctctcaagcgcagctcctggctggttgtgcttctggtgctcctgaccgtcagcctgtctcctgtgcagtccgcccccattggccacgggaaaacagttgagacgtaccagaccagagaaggatatacaagcatctgtctctttgtgctgggctctattcttttcatcgtcagctgcctgatgaaggggctcgtggactccgttggaaatagctttttccctggcctgtctatttgtaagacctgctccatcggcagcatcaacgggtttgagattgaatctcacaaatgttactgctcccttttctgctgtccctattgccggcattgtagcgcggatcgcgagatccacaagctgcatctctctatttgcaaaaagagaaaaacaggatccaatgtgatgctggccgtctgtaagcggatgtgcttcagagctaccgtggaagtcagcaacaaggccctgctcatccgcaatattatcaacacgacatttgtggtttgtattctgatccttgctgtgtgcgtcgtgtccacctctgccgttgagatggagagcctgccggcgggcacctgggaacgggaggaagacctcacaaacttctgtcaccaggagtgccaagtgaccgaaacagagtgtctgtgcccttacgaggccctggtccttagaaaacccctcttttccgattctatcgtgaaggggatgaaaaatctgctgaacagcacgtccctcgaaaccagcctgtctattgaggctccttggggagccatcaatgtgcagtccacattcaagcccaccgttagcgctgccaacattgccctttcttggtccagcgtcgaacaccgcggcaataaaatcctggtgtctgggcggagcgagtccattatgaagctcgaggaaagaacaggcatcagctgggacctgggagtggaggatgcttctgaatccaagctgcttaccgtcagcatcatggacctctcccagatgtattctcccgtgtttgagtacctgagcggcgatcgccaagttgaagagtggcctaaagcgacgtgcaccggggactgtccggagcggtgcggatgtacatcctctacctgcctgcataaggaatggccccacagcagaaactggcgctgtaatcctacatggtgctggggcgtggggaccggatgtacgtgctgtggcctcgatgtcaaagacctgttcacagattatatgtttgtgaagtggaaagttgagtacattaagaccgaagccatcgtgtgcgtcgagcttacatcccaggaacggcagtgttctctgattgaggctgggaccagattcaacctcggccccgtgaccatcacactgagcgagcctcgcaatattcagcaaaagctgcccccggaaatcgttacgcttcatcctcggatcgaggaaggatttttcgacctcatgcacgtgaaaaaggtcctgtccgccagcaccgtgtgcaaactgcagtcttgcacacatggcgtgcccggggacctccaggtctaccacattggaaacctgcttaagggcgataaagttaatgggcacctgatccataagattgagcctcactttaacacctcctggatgagctgggacggatgtgatctcgactattactgcaatatgggcgattggccctcttgttcctatacaggggtgacccagcataaccacgccgctttcgtgaatatgctgaacatcgaaacggactacacaaaaatttttcacttccatagcaagagagtcaccgcccacggcgatacccctcaactggaccttaaggcgcggcccacatatggagctggcgagatcaccgtgctcgttgaggtggccgatatggaactgcatacaaagaagatcgagatttctgggctgaaattcgcctccctcacgtgcaccggatgttacgcttgcagctccggcatcagctgtaaggtccgcattcacgtggacgaaccggatgagctgacagttcatgtgaaatctgaggaccctgatatcgtcgccgctagctcctctcttatggccagaaagctggaatttgggaccgacagcacattcaaggcgttttccgccatgcccaaaacctctctctgcttctatattgtggagcgggaatactgtaagagctgctccaaagaggacacgcagaagtgtgttaacaccaaactggaacagccccagtctatcctgattgagcacaagggaacaatcatcggcaagcaaaatgatacctgcacaagcaaagctgggtgctggcttgagtccgtcaagagctttttctacggcctgaaaaacatgctctctggaatttttggcaatgtgttcatcgggatttttctgttcctcgccccttttatcctgcttattctgttctttatgttcggatggagaatcctcttctgttttaagtgctgtcgccggaccagaggcctgttcaaatatcgccacctgaaggacgatgaagagacagggtacagaaagatcattgaacggcttaacaataaaaagggcaaaaacaagctgctcgacggagagcgcctggctgatagaaaaatcgccgaactcttttccaccaagacgcatattggc

SEQ ID NO: 13828 - RNA, 3495 nt, synthetic construct
  misc_feature 1..3495: note = derived and/or modified CDS sequence (opt5) from CCHVF(CCHVF UCCR4401)__KY484035.1__Gn-NSm-Gc
  source 1..3495: mol_type = other RNA
agcgaggaaccctccgacgattgcatctctagaacccagctgctccggacagagacggccgaaattcacggcgacaactacgggggacctggcgataagatcaccatttgtaatgggagcacaatcgtggaccaacgcctgggatccgagcttggctgctataccattaacagagtccggtctttcaaactgtgtgaaaatagcgctacagggaagaactgcgagatcgattccgttccggtgaaatgtcgccagggatactgcctcagaatcacccaggagggccggggccatgtgaagctgtctcgcgggagcgaagtcgtgcttgacgcctgtgatacatcctgcgagattatgatccccaaaggaaccggcgacattctggttgattgtagcgggggacagcaacactttctcaaggacaatctgatcgatctgggctgccctaagattcccctcctggggaaaatggcgatctatatttgtagaatgtctaaccatcctaagacgaccatggctttcctgttttggttctcctttggatacgtgatcacatgcatcctttgcaaagccattttctatctcctgatcattgtcggcacccttggcaagcggctgaaacagtaccgcgaactcaagccccagacatgtaccatctgcgagacgacacctgtgaatgccattgacgctgagatgcacgatctgaactgtagctataatatctgcccgtactgtgcctctagactgacctccgacgggctcgctcggcatgttatccagtgccccaagcgcaaagaaaaggtggaggaaacagagctgtaccttaacctggaacggattccttgggtcgtgagaaaactcctgcaagtgagcgagtctaccggagtcgcccttaagcgctccagctggctgatcgttctcctggtgctgtttaccgtgtccctctctcccgtccagagcgcgcctattggccaggggaaaacaatcgaggcctatagagctcgggaaggatacacgtccatttgtctgttcgtgcttggcagcatcctgtttatcgtttcttgcctcatgaaggggctggtggactccgtcggaaatagcttctttcccggcctttctatttgtaaaacctgcagcatctcctctattaacggcttcgagatcgaaagccacaagtgttattgctccctgttttgctgtccgtactgcagacactgtagcacagataaggagattcataaactccacctgtctatctgcaagaaacgcaagaccgggtccaatgtgatgctggccgtttgtaaactcatgtgcttccgggctacaatggaagtgagcaacagagccctgttcattcgctctatcatcaataccacgtttgtcctttgtattctgatcctcgcggtgtgcgtcgtgtccacaagcgccgttgagatggagaacctgcctgctggaacctgggaacgggaggaagacctgaccaacttctgtcatcaggagtgccaagtgacagaaaccgagtgtctttgcccctatgaggccctcgtcctgagaaagcctctgtttctcgattccacagctaagggcatgaaaaatctgcttaactctacgagcctggaaacctccctctctattgaggccccctggggagccatcaatgtgcagagcacatacaagcccaccgtttccacagctaacattgcgctgagctggtcttccgtggaacaccgcgggaataaaatcctggtcagcggccggtctgagtccatcatgaaacttgaggaaagaaccgggattagctgggacctcggcgtggaggatgcctctgaaagcaagctgctgacggtgtccgttatggacctcagccagatgtattctcctgtcttcgagtacctgtccggagatcgccaagtggaagagtggccgaaggctacctgcacaggcgactgtcccgagcggtgcgggtgtaccagctccacatgccttcacaaggaatggcctcattctagaaactggcgctgtaatcccacctggtgctggggagtgggcacggggtgtacatgctgtggactggatgtcaaagacctctttaccgattacatgttcgtgaagtggaaagttgagtatatcaagacagaagccattgtgtgcgtcgagctgaccagccaggaacggcagtgttccctgatcgaggccggcaccagatttaaccttgggcctgtgacaattacgctctctgagccccggaatatccagcaaaaactgccgcctgaaatcattaccctgcacccccgcatcgaggaaggcttctttgacctcatgcatgttcagaaggtgctgagcgcttccacagtctgcaaacttcagtcttgcacccacggagtgcctggcgacctgcaggtttaccatattgggaacctcctgaagggagataaggtgaatggccacctgatccacaaaattgagccccatttcaacacaagctggatgtcctgggacgggtgtgatcttgactattactgcaatatgggagattggcctagctgtacctatacgggcgtcacacaacacaaccatgcctcttttgtgaatctcctgaacatcgaaaccgactacaccaagaacttccactttcactccaaaagagtgacagcgcatggggatacaccccagctggacctcaaggctcggccgacctatggcgccggagagatcacggtcctggttgaggtggccgatatggaacttcacaccaaaaagattgagatcagcggcctgaagttcgcttctctcgcctgcacagggtgttacgcttgctccagcggaatttcttgtaaagtgagaatccatgtcgacgaacctgatgagctgaccgtgcacgttaagtccgacgatcccgacgtggtcgccgcgagctccagcctgatggcccgcaaacttgagttcggcacagactctacctttaaggctttcagcgccatgcccaaaacgtccctgtgcttttacattgtggaacgggagcattgtaagtcttgcagcgaagaggataccaagaaatgtgttaatacaaagctcgaacagcctcagtccatcctgattgagcacaaagggaccatcatcggaaagcaaaactctacatgcaccgctaaagccagctgctggctcgagtccgtgaagtctttcttttatggcctgaagaatatgcttagcgggattttcggcaacgtctttatgggaatcttcctgtttctcgcgccgttcattctgctgatcctgtttttcatgtttggctggcgcattcttttctgtttcaaatgctgtagaagaacacgggggctctttaagtaccgccacctgaaagacgatgaagagaccggatatagacggatcatcgaaaagctcaataacaaaaagggcaagaataaactgcttgacggggagcgcctggccgatagacggattgctgaactcttctccacgaagacacatatcgga

SEQ ID NO: 13829 - RNA, 3495 nt, synthetic construct
  misc_feature 1..3495: note = derived and/or modified CDS sequence (opt5) from CCHVF(CCHVF UCCR4448)__KY484042.1__Gn-NSm-Gc
  source 1..3495: mol_type = other RNA
agcgaggaaacctccgacgattgcatctctagaacacagcttctccggacggagaccgccgaaattcacggcgacaactacgggggacccggcgataagatcacaatttgtaatgggagcaccatcgtggaccagcgcctgggatccgagcttggctgctatacaattaacagagtcaaatctttcaagctgtgtgaaaatagcgctaccgggaaatcctgcgagatcgattctgttcctgtgaagtgtcggcagggatactgcctccgcatcacacaggagggcagaggccatgtgaaactgagccgggggtccgaagtcgtgcttgacgcctgtgataccagctgcgagattatgatcccgaagggaacgggcgacattctggttgattgttctgggggacagcaacactttctcaaggacaacctgatcgatctgggctgccccaaaattcctctcctggggaagatggcgatctatatttgtcgcatgtccaatcatcccaaaaccacaatggctttcctgttttggttcagctttggatacgtgattacctgcatcctgtgcaaggccatcttctatctcctgatcattatcggcacacttggcaaaagatttaagcagtaccgggaactgaagcctcagacctgtacgatttgcgagacaacccccgtcaacgccatcgacgctgagatgcacgatctcaattgttcttataacatctgcccttactgtgcctcccgcctgacaagcgacgggctggctagacatgtgacccagtgcccgaaacggaaggaaaaagttgaggaaaccgagctctacctgaatcttgaacgcattccctgggtggtcagaaagctgctccaagtgtctgagtccacaggagtggccctgaaacggagctcctggcttatcgtcctgctcgttctgttcacgatttctctgagccctgtgcagtccgcgcccatcagccacggcaagaccattgaggcctatcgcgctagagaagggtacacatctatctgtctctttgtgctgggatccatccttttcattgtcagctatctgatgaaaggcctcgtggactctgttgggaacagctttttccctggactgtccatctgcaagacctgttctacaagctccattaatggctttgagatcgaaagccacaagtgctactgttctcttttctgctgcccctattgtcggcattgctccgccgataaagagattcacaagctgcatctcagcatctgtaaaaagagaaaaaccggctctaacgtgatgctggctgtctgcaagcgcatgtgtttccgggccacgatggaagtgtccaatagagcgctgtttattcgcagcatcatcaacacaaccttcgttctctgcattctgatccttgccgtgtgtgtcgtgtccacctctgctgtcgagatggagaatctgccggccgggacatgggaacgggaggaagacctcaccaacttttgccaccaggagtgtcaggtgacagaaacggagtgcctgtgtccttacgaggctctggttcttagaaagcccctcttcctggatagcattgtgaaaggaatgaagaacctgctcaattccacctctctggaaacaagcctttccatcgaggccccttggggcgccattaacgtccaaagcacctataaacccacagtgtctaccgctaatatcgcgctgtcctggagctctgttgaacaccgcgggaacaagatcctcgtgtccggacggagcgagtctattatgaaactggaggaaaagacgggcatcagctgggacctgggggtcgaggatgcctccgaaagcaaacttctcaccgtgtctgtgatggacctgtcccagatgtacagccccgtttttgagtacctgtccggcgatagacaggtcgaagagtggcctaaggctacatgcaccggagactgcccggagcgctgtggctgcacatctagcacctgtctccataaggaatggccccactcccggaattggagatgcaaccctacgtggtgttggggagtggggacaggctgcacctgttgcgggctggatgtgaaagaccttttcacagattatatgtttgtcaagtggaaagtggagtacattaagaccgaagccatcgtttgtgtggagctgacctctcaagaacgccagtgcagcctcattgaggccggaacacggttcaatctgggccccgtcacgatcaccctgtccgagcctagaaacatccagcagaaacttcccccggaaattatcacactccatcctcggattgaggaagggtttttcgacctgatgcacgtgcaaaaggttctgtctgctagcaccgtgtgtaagctccagtcctgcacacatggcgtccccggagaccttcaggtgtatcacatcggcaatcttctgaaaggggataaggttaacggacacctcattcataaaatcgagcctcactttaataccagctggatgtcttgggacggctgcgatctggactactattgtaacatgggggattggccctcctgcacgtacacaggagtgacccagcataatcacgccagcttcgtcaacctgcttaatatcgaaaccgactatacaaagaactttcacttccattctaaacgcgtgaccgcgcacggcgatacacctcaactcgacctgaaggctagacccacgtacggggccggcgagattaccgtgctggtcgaggttgccgatatggaactccatacaaagaaaatcgagatttccggactgaagttcgctagccttacctgtacaggctgctacgcctgttcttccgggatcagctgcaaagtgcggattcacgtggacgaaccggatgagctgaccgtccatgtgaagtccgacgatcctgacgttgtggctgccagctctagcctcatggcgagaaaactggagtttggaacggactccaccttcaaggccttttctgctatgcccaagacaagcctgtgtttctatatcgtcgaacgcgagcactgcaaatcctgttctgaagaggataccaagaaatgcgtgaacacaaaacttgaacagccccagagcattctgatcgagcacaagggcaccatcattgggaagcaaaattccacatgtaccgccaaggcttcttgctggctcgagagcgttaaatcctttttctacggactgaagaacatgctcagcggcatctttgggaatgtgttcattggcatctttctgttccttgccccttttattctgctcatcctgttctttatgttcggatggaaaatcctgttctgctttaagtgttgccggagaacgcgcggccttttcaaatatagacatctgaaggacgatgaagagacagggtaccggcgcattatcgaaagactcaacaataagaaaggaaagaacaaactgctcgacggcgagattctggcggatcggcgcatcgccgaactgttttctaccaagacccacattggg

SEQ ID NO: 13830 - RNA, 3495 nt, synthetic construct; identical to SEQ ID NO: 13746
  misc_feature 1..3495: note = derived and/or modified CDS sequence (opt5) from CCHVF(CCHVF SPU4/81 )__DQ157175.1__Gn-NSm-Gc
  source 1..3495: mol_type = other RNA

SEQ ID NO: 13831 - RNA, 3495 nt, synthetic construct; identical to SEQ ID NO: 13767
  misc_feature 1..3495: note = derived and/or modified CDS sequence (opt5) from CCHVF(CCHVF Sudan Al-Fulah 9-2008)__HQ378185.1__Gn-NSm-Gc
  source 1..3495: mol_type = other RNA

SEQ ID NO: 13832 - RNA, 3495 nt, synthetic construct; identical to SEQ ID NO: 13761
  misc_feature 1..3495: note = derived and/or modified CDS sequence (opt5) from CCHVF(CCHVF NIV161064)__KY213713.1__Gn-NSm-Gc
  source 1..3495: mol_type = other RNA

SEQ ID NO: 13833 - RNA, 3495 nt, synthetic construct; identical to SEQ ID NO: 13783
  misc_feature 1..3495: note = derived and/or modified CDS sequence (opt5) from CCHVF(CCHVF 5180-R-2011)__KR814874.1__Gn-NSm-Gc
  source 1..3495: mol_type = other RNA

SEQ ID NO: 13834 - RNA, 3495 nt, synthetic construct; identical to SEQ ID NO: 13791
  misc_feature 1..3495: note = derived and/or modified CDS sequence (opt5) from CCHVF(CCHVF 4574-ST-2008)__KR814870.1__Gn-NSm-Gc
  source 1..3495: mol_type = other RNA

SEQ ID NO: 13835 - RNA, 3495 nt, synthetic construct; identical to SEQ ID NO: 13743
  misc_feature 1..3495: note = derived and/or modified CDS sequence (opt5) from CCHVF(CCHVF 3010)__DQ019222.1__Gn-NSm-Gc
  source 1..3495: mol_type = other RNA

SEQ ID NO: 13836 - RNA, 3495 nt, synthetic construct; identical to SEQ ID NO: 13743
  misc_feature 1..3495: note = derived and/or modified CDS sequence (opt5) from CCHVF(CCHVF UG3010)__DQ211637.1__Gn-NSm-Gc
  source 1..3495: mol_type = other RNA

SEQ ID NO: 13837 - RNA, 2916 nt, synthetic construct
  misc_feature 1..2916: note = derived and/or modified CDS sequence (opt5) from CCHFV(10200, Artificial)__U39455.2__Gn-4aa-Gc
  source 1..2916: mol_type = other RNA
agcgaggaaccctccgacgattgcgtgtctagaacccagctgctccggacagagacggccgaaatccacggcgacaactacgggggacctggcgataagattaccatctgtaatgggagcacaattgtcgaccaacgcctgggatccgagcttggctgctataccatcaacagagttcggtctttcaaactgtgtgaaaatagcgctacagggaagaactgcgagattgattccgtgccggtgaaatgtcgccagggatactgcctcagaatcacccaggagggccggggccatgtcaagctgtctcgcgggagcgaagtggttcttgacgcctgtgatacatcctgcgagatcatgattcccaaaggaaccggcgacatcctggtggattgtagcgggggacagcaacactttctcaaggacaatctgattgatctgggctgccctaagatccccctcctggggaaaatggcgatttatatctgtagaatgtctaaccatcctaagacgaccatggctttcctcttttggttctcctttggatacgtcattacatgcatcctgtgcaaagccatcttctatctcctgattatcgtgggcacccttggccggcgcctgaagcagtacagagaactcaaaccccagacatgtaccatttgcgagacgacacctgttaatgccatcgacgctgagatgcacgatctgaactgtagctataatatttgcccgtactgtgcctctcggctgacctccgacgggctcgctcgccatgtgatccagtgccccaagagaaaggaaaaagtcgaggaaacagagctgtaccttaacctggaacggatcccttgggtggtgcgcaagctcctgcaagtcagcgagtctaccggagttgcccttaaaagatccagctggctgattgtgctcctggtgctgtttaccgtctccctctctcccgtgcagagcgcgcctatcggccggaagcccctgttccttgactccacagccaaagggatgaagaatctgctcaacagcacgtctctggagacctcccttagcattgaagctccgtggggagccatcaatgttcagtctacatataaacctaccgtgagcacagctaacattgccctgtcctggtctagcgtcgagcacagaggcaataagatcctcgtgtccgggcgcagcgaatctatcatgaagctggaggaacggaccggaatttcctgggatctgggcgttgaggacgcgagcgagtctaaactcctgacggtgtccgtcatggatcttagccagatgtactcccccgtgtttgaatatctgtctggcgacagacaagtcgaggaatggcctaaggccacatgtaccggggattgccccgagcgctgtggatgcaccagctccacatgtctccacaaagaatggccccattctcggaactggagatgcaaccctacctggtgctggggcgtggggacaggatgtacgtgctgtggcctggacgttaaggatctgttcaccgactacatgtttgtgaaatggaaggtcgagtatatcaagacagaggctattgtgtgcgttgaacttaccagccaggagcgccagtgttccctcatcgaagccgggacacggttcaatctgggcccggtgaccattacgctgagcgagcccagaaacatccaacagaaactccctcccgagattatcaccctgcaccctcgcatcgaagagggatttttcgatcttatgcatgtccagaaggtgctgtctgcttccacagtgtgcaaactccagagctgtacccacggcgttcccggggacctgcaagtctaccacattggaaatctgcttaagggcgataaagtgaacgggcatctcatccacaagattgaaccgcatttcaatacatcttggatgtcctgggacggatgcgacctggattattactgtaacatgggcgactggcctagctgcacctacacgggggtgacacagcacaatcatgcctcttttgtcaacctgctcaatatcgagaccgattatacaaagaacttccactttcacagcaaacgggtgaccgcccatggcgacacaccccagctggatcttaaggctagacctacatacggagcgggcgaaattacggttctggtggaggtcgccgacatggagctccacaccaaaaagatcgaaatctccgggctgaaattcgctagcctggcctgtacaggatgctatgcctgttcttccagcatttcctgcaaggtgcgcatccatgttgatgagcccgacgaacttaccgtgcacgtcaagtctgatgaccctgatgtggttgctgccagctcctctctcatggcgcggaaactggagtttggcacagacagcaccttcaaggctttttccgccatgcccaaaacgtctctgtgcttctacattgtggaaagagagcactgtaagagctgctccgaggaagataccaaaaagtgtgtcaataccaaactcgagcagccgcaaagcatcctgattgaacataaggggaccatcatcggaaagcagaactctacatgcaccgccaaggcttcctgttggcttgagagcgtgaagtcctttttctatggcctgaaaaatatgctctctgggatttttggcaacgtgttcatgggaatctttctgttcctggcccctttcattcttctcatcctgtttttcatgtttggctggcggattctgttctgctttaagtgttgccgcagaacacgggggcttttcaaatacagacacctgaaggacgacgaagagacgggatatcgccggatcatcgagaaacttaataacaaaaagggcaaaaacaagctgctcgatggggaaagactggctgacggacgcattgccgagctgtttagcaccaaaacacatatcggc

SEQ ID NO: 13838 - RNA, 2916 nt, synthetic construct
  misc_feature 1..2916: note = derived and/or modified CDS sequence (opt5) from CCHFV(IbAr10200, Artificial)__AF467768.2__Gn-4aa-Gc
  source 1..2916: mol_type = other RNA
agcgaggaaccctccgacgattgcatctctagaacccagctgctccggacagagacggccgaaattcacggcgacaactacgggggacctggcgataagatcaccatttgtaatgggagcacaatcgtggaccaacgcctgggatccgagcttggctgctataccattaacagagtccggtctttcaaactgtgtgaaaatagcgctacagggaagaactgcgagatcgattccgttccggtgaaatgtcgccagggatactgcctcagaatcacccaggagggccggggccatgtgaagctgtctcgcgggagcgaagtcgtgcttgacgcctgtgatacatcctgcgagattatgatccccaaaggaaccggcgacattctggttgattgtagcgggggacagcaacactttctcaaggacaatctgatcgatctgggctgccctaagattcccctcctggggaaaatggcgatctatatttgtagaatgtctaaccatcctaagacgaccatggctttcctgttttggttctcctttggatacgtgatcacatgcatcctttgcaaagccattttctatctcctgatcattgtcggcacccttggcaagcggctgaaacagtaccgcgaactcaagccccagacatgtaccatctgcgagacgacacctgtgaatgccattgacgctgagatgcacgatctgaactgtagctataatatctgcccgtactgtgcctctagactgacctccgacgggctcgctcggcatgttatccagtgccccaagcgcaaagaaaaggtggaggaaacagagctgtaccttaacctggaacggattccttgggtcgtgagaaaactcctgcaagtgagcgagtctaccggagtcgcccttaagcgctccagctggctgatcgttctcctggtgctgtttaccgtgtccctctctcccgtccagagcgcgcctattggcagaaaacccctgttccttgactccacagccaaggggatgaaaaatctgctcaacagcacgtctctggagacctcccttagcatcgaagctccgtggggagccattaatgtgcagtctacatataagcctaccgttagcacagctaacatcgccctgtcctggtctagcgtggagcaccggggcaataagatcctcgtctccgggagaagcgaatctattatgaaactggaggaacgcaccggaatctcctgggatctgggcgtggaggacgcgagcgagtctaagctcctgacggtttccgtgatggatcttagccagatgtactcccccgtctttgaatatctgtctggcgaccggcaagtgggggagtggcctaaagccacatgtaccggagattgccccgaaagatgtggctgcaccagctccacatgtctccacaaggagtggccccattctcgcaactggcggtgcaaccctacctggtgctggggagtcgggacaggctgtacgtgctgtgggctggacgtgaaagatctgttcaccgactacatgtttgttaagtggaaggtggaatatattaaaacagaggctatcgtctgcgtggagcttaccagccaggaaagacagtgttccctcattgaggccggcacacgcttcaatctgggaccggttaccatcacgctgagcgaaccccggaacattcaacagaagctccctcccgagatcatcaccctgcaccctagaattgaggaaggctttttcgatcttatgcatgtgcagaaagtcctgtctgcttccacagtgtgcaagctccagagctgtacccacggggtgcccggagacctgcaagtttaccacatcggcaatctgcttaaaggggataaggtcaacggacatctcattcacaagatcgagccgcatttcaatacatcttggatgtcctgggacggctgcgacctggattattactgtaacatgggggactggcctagctgcacctacacgggcgtgacacagcacaatcatgcctcttttgtgaacctgctcaatattgaaaccgattataccaaaaacttccactttcacagcaagcgcgtcaccgcccatggagacacaccccagctggatcttaaagctcggcctacatacggcgcgggggagatcacggtgctggttgaagtggccgacatggagctccacaccaagaaaatcgagatttccggactgaagttcgctagcctggcctgtacaggctgctatgcctgctctagcgggatcagctgtaaggtccgcattcatgtggatgaacccgacgagcttaccgttcacgtgaaatccgatgaccctgatgtcgtggctgcctctagctccctcatggcgagaaagctggaatttggaacagactctaccttcaaggcttttagcgccatgcccaaaacgtccctgtgcttctacatcgttgagcgggaacactgtaaatcttgcagcgaggaggatacaaagaaatgtgtgaataccaagctcgaacagccgcaatccattctgatcgagcataagggcaccatcattgggaaacagaacagcacatgcaccgccaaggcttcttgttggcttgaatccgtcaaatcctttttctatggcctgaagaatatgctctctggaatctttggcaacgtgttcatggggatttttctgttcctggcccctttcatccttctcattctgtttttcatgtttggatggagaatcctgttctgctttaaatgttgccggcgcacaagaggcctcttcaagtaccggcacctgaaggacgacgaggaaacggggtatagacgcatcattgagaaacttaataacaagaaaggaaagaacaaactgctcgatggcgagcggctggctgacagacgcatcgccgaactgttttccaccaagacacatattggg

SEQ ID NO: 13839 - RNA, 2916 nt, synthetic construct
  misc_feature 1..2916: note = derived and/or modified CDS sequence (opt5) from CCHFV(Turkey-Kelkit06, Artificial)__GQ337054.1__Gn-4aa-Gc
  source 1..2916: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtaaaaattctgctacagggaagacctgcgaagttgacagcacaccggtgaaatgtcggcagggattttgcctcaagatcacccaggagggccgcggccatgtgaagctgtccagagggtctgaggtcgtgcttgatgcctgtgacagctcctgcgaagttatgatccccaaaggaacgggcgatattctggtggactgtagcgggggacagcaacacttcctcaaggataacctgatcgacctgggctgccctcatattcccctcctggggcggatggcgatctacatttgtcgcatgtctaatcaccctagaaccacaatggcttttcttttctggttttccttcggatatgtcattacctgcatcttttgcaaagccctgttctacagcctcatcatcattggcacactgggcaagaaaatcaagcagtatcgggagcttaagccccagacctgtacgatttgcgaaacagcccctgtgaacgctatcgatgccgagatgcatgacctgaattgttcttacaacatttgcccgtattgtgcttcccgcctcaccagcgacgggctggccagacacgttacacagtgccccaaacggaaggagaaagtggaagagaccgaactgtacctcaatctggagcgcatcccttggatcgtcagaaaacttctgcaagtgtctgaatccaccggagtggcgctcaaacggagctcctggctgattgtccttctggttctcctgacagtgtctctgagccccgtgcagtccgcccctgtcggccgcaagcccctctttctggatagcatcgtgaaagggatgaagaaccttctcaattctacgtccctggagaccagcctgtctattgaggctccgtggggagccatcaacgttcagagcacattcaagcctaccgtgtccacagctaatattgccctttcttggagctccgtcgtgcacagaggcaacaaaatcctggttaccgggcggagcgaatctatcatgaagctcgaggaaagaacgggagtgtcctgggacctgggcgtcgaggatgcgagcgaatctaaactgctcacagtgtccattatggacctgagccagatgtactcccccgtctttgagtatctttctggcgatcgccaagtggaggaatggcctaaggccacctgtaccggggactgccccgagcggtgtggatgcacaagctccacctgtctgcataaagaatggtctcacagcagaaattggcgctgcaaccccacatggtgctggggcgttgggacgggatgtacctgctgtggcgtggatgtcaaggacctcttcacagatcatatgtttgtgaagtggaaagttgagtacatcaagaccgaagctattgtgtgcgtcgccctgacatcccaggagcggcagtgtagcctgatcgaggctgggaccagattcaaccttggccctgtgacgattaccctctctgaaccgcgcaatatccaacagaaactgccccctgagattatcacactgcaccccaagatcgaagagggattctttgacctcatgcacgtgcagaaagttctgtccgccagcaccgtctgcaaacttcagtcttgtacacatggcattcctggggatctgcaagtgtatcacatcggaaacctcctgaagggcgaccgggtgaatgggcatctgattcacaaaatcgagtcccatttcaacaccagctggatgtcttgggacggatgcgatcttgactactattgtaatatgggcgattggcccagctgcacgtacacaggggtcacccagcacaaccacgccgcttttgtgaatctcctgaacattgaaacagactataccaagaccttccattttcactccaaaagagttacagcgcatggcgatacgccgcagctggacctcaaggcccgccctacctacggagctggcgggatcacagtgctggtcgaggtggccgatatggaacttcacaccaaaaaggttgagatcagcggactgaagttcgcctctctcgcttgtacaggctgctacgcctgctccagcgggatttcctgtaaagtgcggatccacgtcgacgaacccgatgagctgaccgtgcatgttaagtctagcgaccctgatgtggtcgcggcttccacgtctctgatggccagaaaacttgagtttggaacagacagcaccttcaaggccttttccgctatgcccaaaacctctctctgcttctatattgtggaacgcgagtactgtaagagctgctccgaagatgacacacagaaatgtgtggacacccggctggagcaacctcagagcatcctgattgaacacaagggcacaatcatcgggaagcagaatgatacgtgcaccgccaaggcttcttgttggctcgagtccgtcaagagctttttctatggcctgaaaaacatgcttggatctgtttttggcaatctgttcattgggatcctcctgttcctggccccctttgtgcttctcgtgctgttctttatgttcggatggaagattctgttttgcttcaaatgttgcagacggacacgcggcctctttaagtacagacatctgaaggacgatgaggaaaccgggtatcggagaatcattgagcgccttaactccaaaaagggaaagaatcggctgctcgacggcgatagactggcggaccgcaagatcgccgaactgttcagcacaaaaacccacatcggg

SEQ ID NO: 13840 - RNA, 2919 nt, synthetic construct
  misc_feature 1..2919: note = derived and/or modified CDS sequence (opt5) from CCHFV(SR3, Artificial)__AJ538199.1__Gn-4aa-Gc
  source 1..2919: mol_type = other RNA
agcgaggaatccggcgacgattgcatctctagaacccagctgctccggacagagacggccgaagtgcacggggacaactacggaggccccggggataagattaccatctgtaatggaagcacagtcgttgaccaacgcctgggctccgagcttgggtgctataccattaacagagtgcggtctttcaaactgtgtgaaaatagcgctacaggaaagtcctgcgagatcgattctattcctgtgaaatgtaagcagggctactgcctcaaaatcacccaggagggccgcgggcatgtcaagctgagcagaggatccgaagtggttcttgacgtgtgtgatagctcttgcgaggtcatgatcccgaagggcacaggggacattctggtggattgttccggaggccagcaacactttctcaaagacaacctggttgatctggggtgccccaagatccctctcctgggaaaaatggccatttatatctgtcggatgagcaatcatcccaagaccacgatggcgttcctgttttggttctcttttggctacgtgattacctgcatcctttgcaaagctattttctttctcctgatcatcttcggcacacttgggaagcgctttaagcagtatagagaactgaaacctcagacctgtacaatttgcgagaccacgcccgtcaacgccatcgacgccgagatgcacgatctcaattgttcctacaacatttgcccttattgtgctagccggctgacatctgacggactggcccgccatgtgacccagtgcccgagacggaaggaaaaagtggaggaaacagagctctacctgaatcttgaacgcatcccctgggtcgttagaaagctgctccaagtgtccgagagcaccggcaccgtgctgaaacggtcctcttggcttattgtcctgctcgtgctgttcacagttagcctgtcccctgtgcagagcgctcccatcgggctccgcagacctctgtttcttgactctatcgtcaagggaatgaaaaacctgctcaattccacgagcctggagacctctcttagcattgaagccccctggggcgcgatcaacgtgcagtccacatacaagccgaccgtttctacagccaatattgctctgagctggtccagcgtggagcaccgggggaacaaggtcctcgtgtctggaagatccgaaagcatcatgaaactggaggaacgcaccggcatttcttgggatctgggcgtcgaggacgcctccgagagcaagctcctgacggtgtccgttatggatctttctcagatgtatagccctgtgttcgaatacctgtccggggaccggcaagtcgaggaatggcccaaagctacatgtaccggagattgccctgagagatgtggctgcacctctagcacatgtctccacaaggaatggccccattcccgcaattggcggtgcaaccccacctggtgctggggagtggggacaggctgtacgtgctgtgggctggacgttaaagatctgtttaccgactatatgttcgtgaagtggaaggtcgagtacatcaaaacagaggccatcgtgtgcgtggaacttaccagccaggagagacagtgttctctcattgaagcgggcacacgcttcaacctgggatccgttaccatcacgctgagcgagcctcggaatattcaacagaagctcccgcccgagatcattaccctgcaccctaaaatcgaagagggctttttcgatcttatgcatgtccagaaggtgctgtctgcctccacagtgtgcaaactccagagctgtacccacggggtccccggagacctgcaagtgtatcacattggcaacctgcttaagggggatagagttaatggacatctcatccacaagatcgaacagcattttaacacatcttggatgagctgggacggctgcgacctggattactattgtaatatgggggactggccttcctgcacctacacgggcgtgacacagcacaaccatgctagcttcgtcaatctgctcaacattgagaccgattacacaaaaacctttcacttccactctaagcgcgtgaccgcccatggagacacaccccagctggatcttaaagctcggccgacgtatggcgccggggaaatcaccgttctggtggaggtcgccgacatggagctccacacaaagaaaattgaaatctccggactgaagtttgctggcctgacctgtacagggtgctacgcgtgcagctccggaatttcttgtaaggtgagaatccatgttgatgagcctgacgaacttaccgtgcacgtcaaaagcgatgaccccgatgtggtggccgcttcctctagcctcatggcccgcaagctggagttcggcacggactccacatttaaagccttctctgctatgcctaagaccagcctgtgcttttatatcgtcgaacgggagtactgtaaatcctgcaataaggaggatacccaaaaatgtgttaacacaaagctcgaacagccccagagcattctgatcgagcacaaggggaccattatcggcaaacagaataacacatgcacggccaaggcgtcttgttggcttgaatccgtgaaatctttcttttatggactgaagaatatgctcggcgggattttcggaaacgtgttcatcggcatctttaccttcctgacaccttttattctgcttatcctcttctttatgttcgggtggcggattctgttttgcttcaaatgttgcagacgcaccagaggactgtttaagtaccggcatctcaaggacgacgaggaaacaggctatagaaaaatcattgagcgcctgaataacaagaaagggaagaaccggcttctggatggcgagagactcgctgaccgcaaaatcgccgaactgttcagcaccaagacgcacatcgga

SEQ ID NO: 13841 - RNA, 2919 nt, synthetic construct
  misc_feature 1..2919: note = derived and/or modified CDS sequence (opt5) from CCHFV(UCCR4413, Artificial)__KY484038.1__Gn-4aa-Gc
  source 1..2919: mol_type = other RNA
agcgagtcctctgccagcggctgcatctccagaacccagatgattaagtctgaaacagctgagatccacgacgatatttacgggggacccggcgaaaaactgacgatctgtaacgggaccacagtggtcgaccaacggctcggaagcgagctgggctgctataccattaatcgcatcaagacatacaaactttgtgaaaactccgttaaggagaaaacctgcgagatcgattctgtgcctgtgaagtgtagacaggggctgtgcctcaagattacacaggaaggacggggccatgtcaaactgagccgcggctccgagatcgtgcttgacatttgtgatagctcttgcgaactgatgatcccgaaggggaccggagacattctcgttgattgttccggcgggcagcaacacttcctgcaggacaatctggtggatctcggatgccccaacatccctctgcttggcaaagtcgccatttatatctgtagaatgagcaatcatcccaagacgaccatggcgtttctgttctggttttctttcgggtacgtgatcacatgcattctctgcaaaatcctgttttatcttctgattatcaccggaacactcggcaagaagctgaaacagtaccgggagctgaagcctcagacctgtacgatttgcgagtccacacccgttaacgctatcgacgccgaaatgcacgatctcaattgtagctataacatctgcccttactgtgcctctcgcctgacctccgacggccttattagacatgtgaatctgtgcccgaaacggaaggagaaagtcgaagagacagaactctacctgaaccttgagcgcatcccctggttcgtgagaaagctgctccaagtgagcgagtccaccggggtcgctctgaaacggtctagctggctgctcattctggttatccttctgaccgtgtccatgagccctgtgcagtctgcccccattaatcgcaagcctctctttctgtccagcatcgtcaaggggaaaaagaaccttcttaattctgctagcctcgaaacatccctgtctatcgaggccccctggggcgcgattaacgcccagagcacgttcaaaccgaccatctccacagctaatattgccctgagctggtcttccgtggaacacagagggaacaaggttctcgtgagcggacggtctgagtccatcatgaaactggaagaacgcaccggcattagctggaaccttggggtcgaggatgcttccgaatctagaatgctgacagtgagcgttatggacctctcccagatgtatctgcctgtgtttgagtacctgtctggagaccggcaagtcgaagagtggcccaaggccacctgtacgggcgattgccctgaaagatgtggctgcacaagctccacctgtcttcacaaggagtggccccatagccgcaattggcggtgcaaccccacctggtgctggggagtgggaacaggctgtacctgctgtgggctcgacgtcaaagatctgttcacagactatatgtttgtgaagtggaaagttgagtacatcaagacggaagcgattgtgtgcgtcgagctgacctctcaggaaagacagtgttccctcatcgaggccggaacacgcttcaatctgggccctgtgaccatcacacttagcgagccgcggaacattcaacagaaactgccctctgaaatcgttaccctccaccctaagattgaggaagggtttttcgatctgatgcatgtgcagaaggtcctgtccgctagcacggtgtgcaaacttcagtcttgtacccacggcgtggccggagacctccaagtttatcacgtcggcaatctgctgaagggggataaaatcaacggacatagcattcacaagatcgagccccatctcaatacatcctggatgagctgggacggctgcgatctggactactattgtaacatgggggattggccttcttgcacctacacaggagtgacccagcacaatcatgctgccttcgtgaaccttctgaatatcgaaacggactacacaaaatcctttcacttccacagcaagagagtcaccgcccatggcgacacaccccagctcgatctgaaggctcgcccgatgtatggggcgggcgagattaccgtgctggttgaggtggccgacatggaacttcactccaaaaacatcgagatttctggactcaagtttgctagcctgacctgttccggctgctacgcctgctctagcgggatctcctgtaaagtccggattcatgtggatgaacctgacgagctggccgttcacgtgaagtctgatgacctcgatgtcgtggctgccagctccagcctgatggcgagaaaaatcgagttcggaacagactctacgtttaaggctttctccagcatgcccaaagagtctctttgcttttatatcgttgagcgcgatttctgtaagtcctgcgccgccgaagacacccagaagtgtgtgaaagctaagctggagcaacctcagagcattctcatcgaacacaaaggcacaattatcgggaagcagaatgatacctgctctacaaaaacctcctgttggctggagagctttaagtccttcttttacggactgaagaacatgcttagcggcgtcttcgggtctgccattatgggcatcctcctgtttctggctcccttcatcctcctgattcttttctttttctttggatggcggatcctgttctgcctcagatgttgccgccggacgagaggcctgtttaaatataagcatattaaagacgatgaagaggccgggtacaagaaaatcattgagaagctgaataacaagaaaggaggcacaagcaagctgctggacggggaacggctcgcggaccgcaaaatcgccgagctgttctccaccaaggctcacattgga

SEQ ID NO: 13842 - RNA, 2916 nt, synthetic construct
  misc_feature 1..2916: note = derived and/or modified CDS sequence (opt5) from CCHFV(66019, Artificial)__AB069669.1__Gn-4aa-Gc
  source 1..2916: mol_type = other RNA
agcgaggaatccggcgacgattgcatctctagaacccagctgctccggacagagacggccgaagtgcacggggacaactacggaggccccggggataagattaccatctgtaatggaagcacaattgtcgaccaacgcctgggctccgagcttgggtgctataccatcaacagagttaaatctttcaagctgtgtgaaaatagcggaacaggcaaatcctgcaagattgataacacccctgtgaaatgtcggcagggcttttgcctcaagatcacacaggaggggcgcggacatgtgaagctgtctagaggcagcgaggtcgtgcttgacgcttgtgattccagctgcgaaatcatgattccgaaagggaccggagacatcctggttgattgttctggcgggcagcaacacttcctcaaggacaatctggtggatctgggatgccccaacattcctctcctgggcaaaatggccatctacatttgtcggatgtccaatcatcccaagacgaccatggcgtttcttttctggtttagcttcggctatgtcatcacatgcattttctgcaaaatcatcttctacctgctcattgtggttgggaccctgggaaagaagtttaaacagtatcgcgagcttaagcctcagacatgtaccatctgcgaaacgacacccaccaacgctattgacgccgagatgcacgatctgaaatgttcttacaatatctgcccttattgtgcctccagactcacaagcgacggcctggctcggcatgtgacccagtgcccgaagcgcaaagagaaggtcgaagagaccgaactgtacctcaacctggagcggattccctggatcgtgagaaaacttctgcaagtgtctgaatccacaggggtcgccctcaagcgcagctcctggctgatcgttcttctggtgctcctgacggtgtctctgagccctgtccagtccgctcccattggaagaaagcctctcttcagcgactctatcgtgaaaggcatgaagaatctgcttaactccaccagcctggagacatctctcagcattgaggccccctggggagcgatcaatgttcagtccacctttaaaccgacagtgtctaccgccaacattgctctgagctggtccagcgtcgaacaccgggggaataagatccttgtgtctggccgctccgagagcatcatgaaactggaagagagaacgggcatttcttgggatctcggggttgaagacgcctccgagagcaagctgctgacagtgtccgtcatggatctctctcagatgtacagccctgtgttcgagtatctgtccggagaccggcaagtcgaagagtggcccaaggctacctgtaccggcaactgccctgatagatgtgggtgcacatctagcacctgtcttcacaaagaatggccccattcccgcaactggcggtgcaatcccacatggtgctggggagtgggcacggggtgtacctgctgtggcctggacgttaaggatctctttacagactacatgttcgtgaaatggaaggtcgagtatatcaaaaccgaagccattgtgtgcgttgagctgaacagccaggagagacagtgttctctgatcgaagcgggaacacgcttcaatcttggccctgtgaccattacgctctccgagccgcggaacatccaacagaagctgcccagcgaaattatcaccctgcaccctagaatcgaggaggggtttttcgatctcatgcatgtccagaaggtgctgtctgcctccacagtgtgcaaacttcagagctgtacccacggagttcccggcgacctgcaaatttaccacatcgggaatctcctgaagggagatcgcgtcaacggccatctgattcacaaaatcgaacctcattttaatacatcttggatgagctgggacgggtgcgaccttgattattactgtaacatgggcgactggccctcctgcacctatacgggagtgacacagcacaatcatgctgccttcgtgaacctcctgaatattgagaccgattacacaaagaactttcacttccacagcaaacgggtcaccgctcatggcgacaccccgcagctggatctcaaggccagacctacatacggggccggagaaatcacggtgctggttgaggtggctgacatggaacttcacaccaagaaaatcgcgatttctggcctgaagtttgcctccctcacatgtaccgggtgctatgcttgcagctccggaatctcttgtaaagtccgcattcatgtggatgagcccgacgagctgacagttcacgtcaagagcgaagatcctgacatcgtggccgcctcctctagcctgatggctcggaaacttgagttcggcaccgattccacgtttaaggccttctctgcgatgcccaaaacaagcctctgcttttacattgtggaaagagagtattgtgaatcctgcagcaaggaggacacccagaagtgtgttaataccaaactggagcaacctcagtctatcctgatcgaacacaaggggacaattatcggcaaacagaacgatacctgcacagctaaggcctcctgttggctcgagagcgtgaaatctttcttttacggactgaagaatatgctttccggcattttcgggaacgtcttcatcggaatttttctgttcctcgccccctttatcctgctgatccttttctttatgttcggctggcgcattctcttttgcttcaagtgttgccggagaacgcgggggctgtttaaatatcgctacctgaaggacgacgaagagagcggatatagacggatcattgaaagactcaacaataaaaagggcaaaaacaagctgcttgatggggagcgcctggctgaccggagaatcgccgagctcttttctaccaagacacatattggc

SEQ ID NO: 13843 - RNA, 2916 nt, synthetic construct
  misc_feature 1..2916: note = derived and/or modified CDS sequence (opt5) from CCHFV(7001, Artificial)__AB069670.1__Gn-4aa-Gc
  source 1..2916: mol_type = other RNA
gccgagggcgggagctccgactgcatctctagaacccagctggtgaagacagaagtcgctgagattcacgaagatagctacggaggccccggggagaaaatcacgatttgtaacggatccaccatcgttgaccaacggctcggctctgaactggggtgctatacaattaatcgcgtgagaagctacaaactttgtgagaactccgcctctggaaaaagctgcgagatcgattccatccctgtgaagtgtaaacagggcttctgcctgaagattacccaggaaggccgggggcatgtcaagctcagccgcggaacagagatcgtgctggacgtttgtgattcttcctgcgaacttatgattccgaaaggcaccggggacatcctggtggattgtagcggaggccagcaacactttctccagaataacctgattgacctggggtgccccaatgtccctctcctgggaaagatggcgatctatgtgtgtagaatgtctaaccatcccaaaacaaccatggctttcctcttttggttctcctttggctacgttattacgtgcatcgcctgccgggtgctgttctatctcctgatcgccattggcaccgtcgggaagaaacttaagcagtaccgcgagctgaagcctcagacatgtatcgtgtgcgagagcgtgcccgtcaatgctattgatgccgaaatgcacgagctcaactgttcttataatatctgcccttactgtgcttccagactgagcaccgacggactgattcggcatgttacacaatgcccgaaacgcagagaaaaggtggaggaaaccgagctctttctgaaccttgagcggatcccctggctggtgcgcaaactcctgcaggtctccgaatctacgggcatggcccttaagagaagctgttggatgatcacactgctcattctgctgctcgtgtccatcagccctgttcagtctgcgcccgtggggcggaaacctctgttccttgataatattgccaagggaatgaaatccctgctcaacagcacctctctggagacaagcctttccatcgaagctccctggggcgccattaatgtccagtctacctttaagccgaccgtgagcgctgccaacatcgcgctgtcctggagctctgttgagcaccgcgggaataagatcctcgtgtccggaagaagcgaatctattatgaaactggaggagcggacaggcgtctcctggaacctgggcgtggaagacgccagcgagtccaagacgctcaccgtctctgtgatggatctgagccaaatgtactcccctgttttcgaatatctttctggggacagacaggtggaggaatggcccaaagctacatgcaccggagactgtcctgagcgctgcggctgtacaagctccacgtgcctgcacaaggagtggccccatagccggaactggagatgcaatcccacctggtgttggggagtcgggacaggctgcacctgttgcgggctcgatgtgaaagactttttcaccgattacatgctggttaagtggaaggtggaatatatcaaaacagaggccattgtctgtgtggaactgacctctcaggagcgccaatgctcccttatcgaggctggcacacggtttaacctcggacctgtgacgattaccctgagcgaaccgagaaatgttcagcagcgcctgccccctgagatcgtcacactccaccccaagattgaagagggcttcttcgacctgatgcatgtgcagaaaatcctttctgcctccaccgtgtgtaagctgcaaagctgcacacacggggtccctggagattttcaggtgtaccacgttggcaacctcctgagaggggacaaagtgaatggacattctatccacaagattgaaccccatttcaacaccagctggatgtcctgggatggctgtgacctggattatttttgcaatatgggggactggccgagctgtacgtacaccggcgtcacacagcacaaccgggccgctttcatcaatatgcttaacattgagaccgattatacaaagacctttcatttccactctaaacgcgtgacggcgcacggagacacacctcagctcgacctgaaggcccggcccgcttacggcgccggggaggttaccgtgctggtcgaagtggccgatctcgagctgcatacaaagaaacttgaagtttccggactgaaaatcgctagccttacctgctccggctgctacgcctgttctagcgggatttcctgcaaggtgagaatccacgtcaatgagcctgacgaatttaccgtgcatgtgcgctctagcgatcccgacgtcgttgcggctggatcctctctgatggcccggaagatcgagttcggcgccgatagcacatttaaggctttctccagcatgcctaaggactctctgtgtttttatattgtggagaaagattactgctccagctgtacggacgatgacacccaaaagtgcgtgaacacaaaacttgatcacccccagtctatcctcattgaacacaaggggaccatcattggcaaacagaatgacacatgttccaccaagacgagctgctggctggagtctgtcaagggattcttttatggcctgaaaaacatgctctccgggatcttcggaaatgtgttcctgggcatctttcttttcctggccccgtttgttctcctgattttctttttctttttcgggtggagactgctcttttgtcttaagtgctgtcggcgcacaagaggactgctgaaatacaagcatctcaaagatgaagaggaagctggctataagaagatcattgagcggctgaacgggaaaaagggcaaaagccagcttttcgacggagagagactggccgaccgcaagatcgcggaactcttttccaccaaaattcacatcggc

SEQ ID NO: 13844 - RNA, 2916 nt, synthetic construct
  misc_feature 1..2916: note = derived and/or modified CDS sequence (opt5) from CCHFV(75024, Artificial)__AB069671.1__Gn-4aa-Gc
  source 1..2916: mol_type = other RNA
agcgaggaatccggcgacgattgcatctctagaacccagctgctccggacagagacggccgaaattcacggggacaactacggaggccccggggataagatcaccatttgtaatggaagcacaatcgtggaccaacgcctgggctccgagatggggtgctataccattaacagagtcaaatctttcaaactttgtgaaaatagcgctacaggaaaatcctgcgagatcgattctatccctgttaagtgtcggcagggctactgcctgaaaattacccaggagggccgcgggcatgtgaagctcagcagaggatccgaagtggtcctggacgcctgtgatagctcttgcgaggtgatgatcccgaagggcacaggggacattcttgttgattgttccggaggccagcaacactttctgaaagacaacctcatcgatctggggtgccccagcattcctctgctcggaaagatggcgatctatatttgtcggatgtctaatcatcccaaaaccacgatggctttcctgttttggttctcctttggctacgtgattacctgcatcctttgcaaggccatcttctatctgctcatcattgtcggcacactggggaaacgctttaagcagtacagagaacttaagcctcagacctgtacaatctgcgagaccacgcccgccaacgctattgacgccgagatgcacgatctgaattgtagctataacatctgcccttactgtgcttctcggctcacatccgacggactggcccgccatgtgacccagtgcccgaaaagaaaggaaaaagttgaggaaacagagctgtacctcaatctggaacggatcccctgggtggtccgcaaacttctgcaagtgagcgagtccaccggcgtggcgctcaagagatctagctggctgattgtccttctggttctcttcgccatctccctgagccctgtgcagtctgctcccattgggcggcgccctctgtttctcgactccatcgtgagaggaatgaagaaccagctgaatagcacctctcttgagacaagcctgtccattgaagccccctggggcgctatcaacgtccagtctacgtataaaccgaccgtgagcacagccaatatcgcgctctcctggagctctgttgagcaccgggggaacaagattctggtgtccggaagaagcgaatctatcatgaaacttgaggaacgcaccggcatttcctgggatctgggcgtcgaggacgccagcgagtccaagctcctgacagtgtctgttatggatctgagccaaatgtactcccctgtgttcgaatatctctctggggaccggcaggtcgaggaatggcccaaggctacctgtacgggagattgccctgagagatgtggctgcacaaccagcacctgtctgcacaaagaatggccccattcccgcaattggcggtgcaaccccacatggtgctggggagtggggaccggctgtacatgctgtgggcttgacgtcaaggatctgtttacggactacatgatcgtgaaatggaaggttgagtatattaagaccgaggccatcgtgtgcgtcgaactcacaagccaggagagacaatgttctctgattgaagctggcacccgcttcaacctgggatccgtgacaatcacccttagcgagcctcggaatatccagcagaaactcccgcccgagattatcacgctgcaccctagaattgaagagggctttttcgatctgatgcatgttcagaaggtgctctctgcctccaccgtctgcaaactgcaaagctgtacacacggggtgcccggagaccttcaggtgtaccacgttggcaacctgctcaagggggataaagtcaatggacatctgatccacaagattgaacctcatctgaacacctcttggatgagctgggacggctgcgaccttgattattactgtaatatgggggactggccctcctgcacatacaccggcgtgacgcagcacaaccatgccagcttcgtgaatctcctgaacatcgagacagattataccaagtcttttcacttccactccaaacgcgtcacagctcatggagacaccccgcagctggatctcaaggcgcggcctacctacggcgccggggaaatcacagtgctggttgaggtggctgacatggagtttacgcccaaaaagattgaaatcagcggacttaaattcgcctccctgacctgtacaggctgctatgcctgctctagcgggatttcctgtaaggtcagaatccacgtggatgagcctgacgaactcaccgttcatgtgaagtctgatgaccccgatgtcgtggctgccagctcctctctgatggcgcgcaaactggagtttggaacagacagcaccttcaaggctttttccgccatgcctaaaacgagcctttgcttctacattgttgaacgggagtattgtaagtcttgctccaaagaggatacacaaaagtgtgtgaataccaaactcgaacagccccagagcatcctgatcgagcacaagggcaccattatcgggaagcagaacaatacatgcaccgccaaggcttcttgttggctggaatccgtcaagagctttttctacggcctcaaaaacatgctgtctggaatttttggcaatcttttcatggggatctttctgttcctcgccccgttcattctgctgatcctctttttcatgtttggatggagaatccttttctgctttaagtgttgccggcgcacaagaggcctgttcaaatatcggcacctgaaggacgacgaggaaacggggtacagacgcattatcgagcggctcaacaataagaaaggaaagaacaaactgcttgatggcgagagactggctgaccgcagaattgccgaactcttttccaccaagacacatatcggg

SEQ ID NO: 13845 - RNA, 2916 nt, synthetic construct
  misc_feature 1..2916: note = derived and/or modified CDS sequence (opt5) from CCHFV(7803, Artificial)__AB069672.1__Gn-4aa-Gc
  source 1..2916: mol_type = other RNA
agcgaggaatccggcgacgattgcatctctagaacccagctgctccggacagagacggccgaaattcacggggacaactacggaggccccggggataagatcaccatttgtaatggaagcacaatcgtggaccaacgcctgggctccgagatggggtgctataccattaacagagtcaaatctttcaagctctgtgaaaatagcgctacaggaaaatcctgcgagatcgattctatccctgttaagtgtcggcagggctactgcctgaaaattacccaggagggccgcgggcatgtgaagctcagcagaggatccgaagtgatcctggacgcctgtgatagctcttgcgaggtcatgattccgaagggcacaggggacatccttgtggattgttccggaggccagcaacactttctgaaagacaacctcattgatctggggtgccccagcatccctctgctcggaaagatggcgatttatatctgtcggatgtctaatcatcccaaaaccacgatggctttcctgttttggttctcctttggctacgttattacctgcatcctttgcaaggccatcttctatctgctcattatcgtgggcacactggggaaacgctttaagcagtacagagaacttaagcctcagacctgtacaatttgcgagaccacgcccgccaacgctatcgacgccgagatgcacgatctgaattgtagctataacatctgcccttactgtgcttctcggctcacatccgacggactggcccgccatgtcacccagtgcccgaaaagaaaggaaaaagtggaggaaacagagctgtacctcaatctggaacggattccctgggttgtgcgcaaacttctgcaagtcagcgagtccaccggcgtggcgctcaagagatctagctggctgatcgtgcttctggtcctcttcgccatttccctgagccctgttcagtctgctcccatctcccggcgccctctgtttctcgacagcattgtgagagggatgaagaacccccttaattctaccagccttgagacatccctgtctatcgaagccccgtggggagctatcaacgtgcagagcacgtataaacctaccgtctccacagccaatattgcgctcagctggtcttccgtggagcaccggggcaacaagatcctggttagcgggagatctgaatccattatgaaacttgaggaacgcaccggaatcagctgggatctgggcgtggaggacgcctccgagtctaagctcctgacagtcagcgtgatggatctgtcccagatgtactctcccgttttcgaatatctcagcggcgaccggcaagtggaggaatggcctaaggctacctgtacgggggattgccccgagagatgtggatgcacaacctccacctgtctgcacaaagaatggccccatagccgcaattggcggtgcaaccctacatggtgctggggcgtcgggaccggatgtacatgctgtggccttgacgtgaaggatctgtttacggactacatgattgtcaaatggaaggtggagtatatcaagaccagagggattgtttgcgtggagctcacatctcaggaacgccagtgttccctgatcgaggccggcacccggttcaacctgggaagcgtcacaatcaccctttctgaaccgagaaatattcaacagaaacttccccctgagatcattacgctgcacccccgcatcgaggaaggctttttcgatctgatgcatgtgcagaaggttctctccgctagcaccgtgtgcaaactgcagtcttgtacacacggggtccctggagaccttcaagtgtaccacgtgggcaacctgctcaagggggataaagttaatggacatctgattcacaagatcgagccccatctgaacaccagctggatgtcctgggacggctgcgaccttgattattactgtaatatgggggactggccgagctgcacatacaccggcgtcacgcagcacaaccatgcctctttcgtgaatctcctgaacatcgaaacagattataccaagtcctttcacttccacagcaaacgggtgacagcccatggagacacccctcagctggatctcaaggctagacccacctacggcgcgggggagattacagtcctggtggaagttgccgacatggagtttacgcctaaaaagatcgagatttccggacttaaattcgcttctctgacctgtacaggctgctatgcctgcagctccgggatctcttgtaaggtgcgcattcacgtcgatgaacccgacgagctcaccgtgcatgttaagagcgatgaccctgatgtggtcgccgcttcctctagcctgatggcccggaaactggaatttggaacagactccaccttcaaggcgtttagcgctatgcccaaaacgtctctttgcttctacatcgtggagagagaatattgtaagtcctgcagcaaagaggatacacagaagtgtgttaataccaaactcgagcaaccgcagtctatcctgattgaacacaagggcaccatcattgggaagcagaacaatacatgcaccgccaaagcctcctgttggctggagagcgtgaagtcctttttctacggcctcaaaaacatgctgtctggaatctttggcaatttctttatggggattttccttttcctggctccttttatcctcctgatcctgttctttatgttcggatggcggattctgttttgcttcaagtgttgccgcagaacacggggcctctttaaatatagacacctgaaggacgacgaagagacggggtaccgccggatcattgaaagactgaacaataagaaaggaaagaacaaactcctggatggcgagcgccttgccgacagacggatcgctgagctgttcagcaccaagacacatattggg

SEQ ID NO: 13846 - RNA, 2916 nt, synthetic construct
  misc_feature 1..2916: note = derived and/or modified CDS sequence (opt5) from CCHFV(79121, Artificial)__AB069673.1__Gn-4aa-Gc
  source 1..2916: mol_type = other RNA
gccgagggcgggagctccgactgcatctctagaacccagctggtgaagacagaagtcgctgagattcacgaagatagctacggaggccccggggagaaaatcacgatttgtaacggatccaccatcgttgaccaaggcctcgggtctgaactgggatgctatacaattaatcgggtgcgcagctacaaactttgtgagaactccgcctctggcaagagctgcgagatcgattccatccctgtgaagtgtaaacagggcttctgcctgaagattacccaggaagggagaggacatgtcaagctcagccggggcacagagatcgtgctggacgtttgtgattcttcctgcgaacttatgattccgaaagggaccggagacatcctggtggattgtagcggcgggcagcaacactttctccagaataacctgattgacctgggatgccccaatgtccctctcctgggcaagatggcgatctatgtgtgtcgcatgtctaaccatcccaaaacaaccatggctttcctcttttggttctcctttggctacgttattacgtgcatcgcctgcagagtgctgttctatctcctgatcgccattgggaccgtcggaaagaaacttaagcagtaccgggagctgaagcctcagacatgtatcgtgtgcgagagcgtgcccgtcaatgctattgatgccgaaatgcacgagctcaactgttcttataatatctgcccttactgtgcttcccgcctgagcaccgacggcctgattagacatgttacacaatgcccgaaacggcgcgaaaaggtggaggaaaccgagctctttctgaaccttgagagaatcccctggctggtgcggaaactcctgcaggtctccgaatctacggggatggcccttaagcgcagctgttggatgatcacactgctcattctgctgctcgtgtccatcagccctgttcagtctgcgcccgtgggaagaaaacctctgttccttgattccaccgccaagggcatgaaaagcctgctcaattctacaagcctggagacctccctttctattgaagctccctggggagccatcaacgtccagagcacctttaagccgacagtgtccgctgccaatattgcgctgagctggtcttccgttgagcaccgggggaacaagatcctcgtgagcggccgctctgaatccatcatgaaactggaggagagaacgggcgtcagctggaatctgggggtggaagacgcctccgagtctaagaccctcacagtcagcgtgatggatctgtcccaaatgtactctcctgttttcgaatatcttagcggagacagacaggtggaggaatggcccaaagctacctgcacaggcgactgtcctgagcggtgcgggtgtacctccagcacgtgcctgcacaaggagtggccccattctcgcaactggcggtgcaaccccacatggtgttggggagtcggcaccgggtgcacctgttgcggcctcgatgtgaaagactttttcacagattacatgctggttaagtggaaggtggaatatattaaaaccgaggccatcgtctgtgtggaactgacatcccaggagagacaatgcagccttattgaggctggaacgcgctttaatctcggccctgtgaccatcacactgtctgaaccgcggaacgttcagcagagactgccccctgagattgtcaccctccaccccaagatcgaagaggggttcttcgacctgatgcatgtgcagaaaattctttccgccagcacagtgtgtaagctgcaatcttgcacccacggagtccctggcgattttcagatctaccacgtggggaatctcctgcgcggagacaaagttaacggccatagcatccacaagattgaaccccatttcaatacgtcctggatgagctgggatgggtgtgacctggattatttttgcaacatgggcgactggccgtcttgtacctacacaggagtgacccagcacaatcgggccgctttcatcaacatgcttaatattgagacagattataccaagacgtttcatttccactccaaaagagtcacagcgcacggcgacacccctcagctcgacctgaaggcccgccccgcttacggggccggagaggtgacagttctggtggaagtcgccgatctcgagctgcataccaaaaaccttgaagtgagcggcctgaagatcgcttcccttacctgctctgggtgctacgcctgtagctccggaatttcttgcaaagttcggatccacgtgaatgagcctgacgaatttacagtccatgtgagaagctccgatcccgacgtggtcgcggctggctctagcctgatggcccgcaagatcgagttcggggccgattccacgtttaaggctttcagctctatgcctaaagactccctgtgtttttatattgttgagaaggattactgcagctcttgtaccgacgatgacacacaaaaatgcgtgaacaccaaacttgatcacccccagtccatcctcattgaacacaagggcacaatcattggaaagcagaatgacacctgtagcacgaaaacatcttgctggctggagtccgtgaagggcttcttttatgggctgaagaacatgctcagcggaatcttcggcaatgtcttcctggggatctttcttttcctggccccgtttgtgctcctgattttctttttctttttcggatggcggctgctcttttgtcttaaatgctgtagacggacccgcggcctgctgaagtacaaacatctcaaggatgaagaggaagctgggtataaaaagatcattgagagactgaacggcaagaaaggaaagtcccagcttttcgacggcgagcggctggccgacagaaaaatcgcggaactctttagcaccaagattcacatcggg

SEQ ID NO: 13847 - RNA, 2916 nt, synthetic construct
  misc_feature 1..2916: note = derived and/or modified CDS sequence (opt5) from CCHFV(8402, Artificial)__AB069674.1__Gn-4aa-Gc
  source 1..2916: mol_type = other RNA
agcgaggaatccggcgacgattgcatctctagaacccagctgctccggacagagacggccgaaattcacaacgacaattacgggggacccggcgataagatcaccatttgtaacgggagcacagtggtcgaccaacgcctgggatccgagcttggctgctataccatcaatagagttaaatctttcaagctgtgtgaaaacagcgctacagggaaatcctgcgagattgattctacccctgtgaagtgtcggcagggattttgcctcaaaatcacacaggagggccgcggccatgtgaagctgagcagagggtccgaagtcgtgcttgacgcctgtgatagctcttgcgagatcatgattccgaagggaaccggcgacatcctggttgattgttccgggggacagcaacacttcctcaaagacaatctgattgatctgggctgccccaacatccctctcctggggaagatggcgatttacatctgtcggatgagcaatcatcccaaaacgaccatggcttttcttttctggttttctttcggatatgtggtcacatgcattctgtgcaaggtgatcttttacctcctgatcgttgtgggcacccttggcaaaaagttcaagcagtatcgcgaactgaaacctcagacatgtaccatttgcgagacgacacccgtcaacgccatcgacgccgagatgcacgatctcaattgttcctacaacatttgcccttattgtgctagcagactgacctctgacgggctggcccggcatgtgatgcagtgcccgaagcgcaaagaaaagatcgaggaaacagagctctacctgaatcttgaacggattccctgggtggtcagaaaactgctccaagtttccgagagcaccggagtggctctgaagcgctcctcttggcttgtggtcctgctcgtgctgctgaccgttagcctctcccctgtgcagagcgcccccatcggcagaaaacctctgttttctgactccatcgtcaaggggatgaagaaccttctgaatagcacatctctcgagacgagcctgtccattgaagcgccctggggagccatcaacgtgcagtctaccttcaaaccgacagttagcgctgccaatattgctctttcctggagctctgtggagcaccggggcaacaagatcctggtctccgggcgcagcgaatctattatgaaactcgaggaaagaaccggaatctcctgggatctgggcgtggaggacgccagcgagtccaagctgctcacagtctctgtgatggatctgagccagatgtactcccctgtttttgaatatctttctggcgaccggcaagtggaggaatggcccaaagcgacctgtacgggggattgccctgagagatgtggatgcacaagctccacctgtctgcacaaggaatggccccatagccgcaactggcggtgcaatcccacctggtgctggggcgtcgggacaggatgtacctgctgtggcctcgacgtgaaggatctgttcacagactacatgtttatcaaatggaaggttgagtatattaaaacggaggccatcgtgtgcgtcgaactgacctctcaggagagacagtgtacacttattgaagctgggacccgcttcaacctcggccctgtgacaatcaccctgtccgagccgcggaatattcaacagaagctgccccctgagatcgtgacgctccaccccagaattgaagagggattctttgatctgatgcatgttcagaaagtccttagcgcctctaccgtgtgcaagctgcagtcctgtacacacggcgtgcctggggacctccaagtctaccacatcggaaacctgctgaagggcgataaagtgaatgggcatcttatccacaagattgaaccccatttcaacaccagctggatgtcttgggacggatgcgacctcgattattactgtaatatgggcgactggccgagctgcacatataccggggttacgcagcacaaccatgctgcctttgtgaatatgctgaacatcgagacagattacaccaaaaatttccactttcactccaagcgcgtcacagcccatggcgacacccctcagctggatctcaaagctcggcccacctacggagcgggcgaaattacagtgctggttgaggtggccgacatggagcttcacacgaagaagatcgaaattagcgggctgaaattcgcttctctcacctgtacaggatgctatgcctgctccagcggcatctcctgtaaggtcagaatccatgtggatgagcctgacgaactgaccgttcacgtgaaatctgaggatcccgacattgtcgccgctagctcctctctgatggcccgcaaacttgaatttgggacagatagcaccttcaaggcgttttccgctatgcctaagacgtctctctgcttctacatcgtggagcgggagtattgtaaaagctgctccaaggaagacacacagaagtgtgtgaacaccaaactggagcaaccccagagcattctgatcgaacacaagggaaccattatcggcaaacagtctaatacatgcaccgccaaggcctcctgttggctcgagagcgtcaaatcctttttctacgggctgaagaacatgctttctggcatctttggaaatgttttcattggcgtgttcctgtttttcgctccgtttatcctcctgattctgttctttatgttcgggtggagaatcctcttttgcttcaagtgttgccgccggacaagaggactttttaaatatcggcatctgaaggatgacgaagagacgggctaccgcaaaattatcgagagactgaacaacaagaaagggaagaataagctcctggacggagaacggcttgccgatagaaaaatcgctgagctgttcagcaccaagacacacattggc

SEQ ID NO: 13848 - RNA, 2916 nt, synthetic construct
  misc_feature 1..2916: note = derived and/or modified CDS sequence (opt5) from CCHFV(88166, Artificial)__AB069675.1__Gn-4aa-Gc
  source 1..2916: mol_type = other RNA
agcgaggaatccggcgacgattgcatctctagaacccagctgctccggacagagacggccgaaattcacagcgacaactacgggggacccggcgataagatcaccatttgtaatgggtccacagtggtcgaccaacgcctgggatctgagcttggctgctataccatcaacagagttaagagcttcaaactgtgtgaaaattccgctacagggaaatcttgcgagattgatagcacccctgtgaagtgtcggcagggattttgcctcaaaatcacacaggagggccgcggccatgtgaagctgtccagagggagcgaagtcgtgcttgacgcctgtgattcttcctgcgagatcatgattccgaagggaaccggcgacatcctggttgattgtagcgggggacagcaacacttcctcaaagacaacctgattgatctgggctgccccaatatccctctcctggggaagatggcgatttacatctgtcggatgtctaaccatcccaaaacgaccatgggatttcttttctggttttccttcggctatgtggtcacatgcattctgtgcaaggtgatcttttacctcctgatcgttgtgggcacccttgggaaaaagttcaagcagtatcgcgaactgaaacctcagacatgtaccatttgcgagacgacacccgtcaatgctatcgacgccgagatgcacgatctcaactgtagctacaatatttgcccttattgtgcctctagactgacctccgacggactggctcggcatgtgatgcagtgcccgaagcgcaaagaaaagatcgaggaaacagagctctacctgaaccttgaacggattccctgggtggtcagaaaactgctccaagttagcgagtccaccggcgtggccctgaagcgctctagctggcttgtggtcctgctcgtgctgctgaccgtttccctcagccctgtgcagtctgctcccatcgggagaaaacctctgttttccgacagcatcgtcaagggaatgaagaatcttctgaactctacaagcctcgagacgtccctgtctattgaagccccctggggcgcgatcaatgtgcagagcaccttcaaaccgacaatgtccgccgctaacattgcccttagctggtcttccgttgagcaccgggggaataagatcctggtgagcggacgctctgaatccattatgaaactcgaggaaagaaccggcatcagctggaacctgggcgtcgaggatgcttccgagtctaagctgctcacagtgagcgtcatggacctgtcccagatgtactctcctgtgtttgaatatcttagcggggatcggcaagttgaggaatggcccaaagccacctgtacgggagactgccctgagagatgtggctgcacatccagcacctgtctgcacaaggaatggccccattctcgcaactggcggtgcaatcccacctggtgctggggagtggggacaggctgtacctgctgtgggctcgatgtcaaggacctgttcacagattacatgtttatcaaatggaaggtggagtatattaaaacggaggcgatcgtttgcgtggaactgacctcccaggagagacagtgtacacttattgaagccggcacccgcttcaacctcggacctgtcacaatcaccctgagcgagccgcggaatattcaacagaagctgccccctgagatcgtgacgctccaccccagaattgaagagggcttctttgacctgatgcatgtgcagaaagttctttctgcttccaccgtctgcaagctgcagagctgtacacacggggtgcctggagatctccaagtgtaccacatcggcaacctgctgaagggggacaaagtcaatggacatcttatccacaagattgaaccccatttcaacacctcttggatgagctgggatggctgcgacctcgactattactgtaatatgggggattggccgtcctgcacatataccggcgtgacgcagcacaaccatgccgcttttgttaatatgctgaacatcgagacagactacaccaaaaatttccactttcacagcaagcgcgtgacagcccatggagatacccctcagctggacctcaaagcccggcccacctacggcgctggggaaattacagtcctggtggaggttgcggatatggagcttcacacgaagaagatcgaaatttctggactgaaattcgcctccctcacctgtacaggctgctatgcttgcagctccgggatctcttgtaaggtgagaatccatgtcgacgagcctgatgaactgaccgtgcacgttaaaagcgaggaccccgatctggtggccgcctcctctagccttatggctcgcaagctcgaatttggaacagactccaccttcaaagccttttctgcgatgcctaagacgagcctgtgcttctacattgtcgagcgggagtattgtaaatcctgcagcaaggaagatacacagaagtgtgtgaacaccaaactggagcaaccccagtctatcctcattgaacacaagggcaccatcattgggaaacagaataacacatgcaccgctaaggcctcctgttggctggagagcgtgaaatctttcttctacggccttaagaatatgctgtccggaatctttggcaacgtcttcatcggggttttcctctttttcgccccgtttattctgctgatccttttctttatgttcggatggcgcattctcttttgcttcaagtgttgcagacggacaagaggcctgtttaaatatcggcatctgaaggacgatgaagagacggggtaccgcaaaatcattgagagactcaacaataagaaaggaaagaacaagctgcttgacggcgaacggctggctgacagaaaaatcgccgagctctttagcaccaagacacacatcggg

SEQ ID NO: 13849 - RNA, 2916 nt, synthetic construct
  misc_feature 1..2916: note = derived and/or modified CDS sequence (opt5) from CCHFV(BA88166, Artificial)__AF338470.1__Gn-4aa-Gc
  source 1..2916: mol_type = other RNA
agcgaggaatccggcgacgattgcatctctagaacccagctgctccggacagagacggccgaaattcacagcgacaactacgggggacccggcgataagatcaccatttgtaatgggtccacagtggtcgaccaacgcctgggatctgagcttggctgctataccatcaacagagttaagagcttcaaactgtgtgaaaattccgctacagggaaatcttgcgagattgatagcacccctgtgaagtgtcggcagggattttgcctcaaaatcacacaggagggccgcggccatgtgaagctgtccagagggagcgaagtcgtgcttgacgcctgtgattcttcctgcgagatcatgattccgaagggaaccggcgacatcctggttgattgtagcgggggacagcaacacttcctcaaagacaacctgattgatctgggctgccccaatatccctctcctggggaagatggcgatttacatctgtcggatgtctaaccatcccaaaacgaccatgggatttcttttctggttttccttcggctatgtggtcacatgcattctgtgcaagggcatcttttacctcctgatcgtggttgggacccttgggaaaaagttcaagcagtatcgcgaactgaaacctcagacatgtaccatttgcgagacgacacccgtgaatgctatcgacgccgagatgcacgatctcaactgtagctacaatatttgcccttattgtgcctctagactgacctccgacggcctggctcggcatgtcatgcagtgcccgaagcgcaaagaaaagatcgaggaaacagagctctacctgaaccttgaacggattccctgggtggtgagaaaactgctccaagtcagcgagtccaccggggttgccctgaagcgctctagctggcttgtggtgctgctcgtcctgctgaccgtgtccctcagccctgttcagtctgctcccatcggaagaaaacctctgtaccttgactccatcgtgaagggcatgaagaatctgctcaacagcacatctctggagacgagcctttccattgaagccccctggggagcgatcaatgtccagtctacctttaaaccgacaatgagcgccgctaacattgccctgtcctggagctctgtggagcaccggggaaataagatcctcgtttccggccgcagcgaatctattatgaaactggaggaaagaaccggcatctcctggaacctgggggtggaggatgctagcgagtccaagctcctgacagtctctgtgatggaccttagccagatgtattcccctgtcttcgaatacctgtctggagatcggcaagtggaggaatggcccaaagccacctgtacgggcgactgccctgagagatgtgggtgcacaagctccacctgtctccacaaggaatggccccatagccgcaactggcggtgcaatcccacctggtgctggggagttggcacagggtgtacctgctgtggcctggatgtgaaggacctgtttacagattatatgttcatcaaatggaaggtcgagtacattaaaacggaggcgatcgtgtgcgttgaacttacctctcaggagagacagtgtacactcattgaagccggaacccgctttaacctgggccctgtgatcattacactgtccgagccgcggaatatccaacagaagctccctcccgagattgtcaccctgcaccccagaatcgaagaggggttcttcgaccttatgcatgtgcagaaagtgctgagcgcttctacggtttgcaagctccagtcctgtacccacggagtccctggcgatctgcaagtgtatcacatcgggaacctgcttaagggagacaaagtgaatggccatctcattcacaagatcgaaccccattttaacacaagctggatgtcttgggatgggtgcgacctggactactattgtaatatgggcgattggccgagctgcacctacacaggagtcacccagcacaaccatgccgctttcgtgaatatgctgaacattgagacggactacaccaaaaattttcacttccactccaagcgcgttacagcccatggcgatacacctcagctcgacctgaaagcccggcccacctatggggctggagaaatcaccgtgcttgtcgaggtggcggatatggagctgcacacaaagaagattgaaatcagcggcctcaaatttgcctctctgacgtgtaccgggtgctacgcttgctccagcggaatctcctgtaaggttcgcattcatgtggacgagcctgatgaactgacagtccacgtgaaatctgaggaccccgatatcgttgccgccagctcctctcttatggctagaaagctcgagttcggcaccgacagcacatttaaagccttctccgcgatgcctaagacctctctgtgcttttatattgtggaacgggagtactgtaaaagctgctccaaggaagatacgcagaagtgtgtcaacacaaaactggagcaaccccagagcatcctcattgaacacaaggggaccatcatcggcaaacagaataatacctgcacagctaaggcctcttgttggctggagtccgtgaaatctttcttttatggacttaagaacatgctgagcggcattttcgggaacgtgtttatcggagtcttcctcttctttgccccgttcattctgctgatcctctttttcatgtttggctggcgcattcttttctgctttaagtgttgcagacggaccagagggctgttcaaataccggcatctgaaggacgatgaagagacaggatatcgcaaaatcatcgagagactcaacaataagaaaggcaagaacaagctgcttgacggggaacggctggctgacagaaaaattgccgagctcttttccacgaagacccacatcggc

SEQ ID NO: 13850 - RNA, 2916 nt, synthetic construct
  misc_feature 1..2916: note = derived and/or modified CDS sequence (opt5) from CCHFV(BA66019, Artificial)__AF350448.1__Gn-4aa-Gc
  source 1..2916: mol_type = other RNA
agcgaggaatccggcgacgattgcatctctagaacccagctgctccggacagagacggccgaagtgcacggggacaactacggaggccccggggataagattaccatctgtaatggaagcacaattgtcgaccaacgcctgggctccgagcttgggtgctataccatcaacagagttaaatctttcaagctgtgtgaaaatagcggaacaggcaaatcctgcaagattgataaacatcctgtgaagtgtcggcagggcttttgcctcaagatcacccaggaggggcgcggacacgtgaaactgtctagaggcagcgaggtcgtgcttgacgcttgtgattccagctgcgaaatcatgattccgaaggggacaggagacatcctggttgattgttctggcgggcagcaacatttcctcaaagacaacctggtggatctgggatgccccaatattcctctcctgggcaagatggccatctacatttgtcggatgtccaaccaccccaaaaccacgatggcgtttcttttctggtttagcttcggctatgtcattacctgcatcttttgcaagatcatcttctacctgctcattgtggttgggacactgggaaagaaatttaagcagtatcgcgagcttaaacctcagacctgtacaatctgcgaaaccacgcccacaaatgctattgacgccgagatgcatgatctgaagtgttcttacaacatctgcccttattgtgcctccagactcaccagcgacggcctggctcggcacgtgacacagtgcccgaaacgcaaggagaaagtcgaagagaccgaactgtacctcaatctggagcggattccctggatcgtgagaaagctcctgcaagtgtctgaatccaccggggtcgccctcaagcgcagctcctggctgatcgttcttctggtgctcctgacagtgtctctgagccctgtccagtccgctcccattggaagaaaacctctcttcagcgactctatcgtgaagggcatgaaaaacctgcttaattccacgagcctggagacctctctcagcattgaggccccctggggagcgatcaacgttcagtccacatttaagccgaccgtgtctacagccaatattgctctgagctggtccagcgtcgaacaccgggggaacaaaatccttgtgtctggccgctccgagagcatcatgaagctggaagagagaaccggcatttcttgggatctcggggttgaagacgcctccgagagcaagctgctgacggtgtccgtcatggatctctctcagatgtacagccctgtgttcgagtatctgtccggagaccggcaagtcgaagagtggcccaaagctacatgtaccggcgattgccctgacagatgtgggtgcacctctagcacatgtcttcataaggaatggccccactcccgcaattggcggtgcaaccccacctggtgctggggagtgggcacagggtgtacgtgctgtggcctggatgttaaagacctctttaccgattacatgttcgtgaagtggaaagtcgagtatatcaagacagaagccattgtgtgcgttgagctgaacagccaggagagacagtgttctctgatcgaagcgggaacccgcttcaatcttggccctgtgacaattaccctctccgagccgcggaacatccaacagaagctgccccctgaaattatcacgctgcatcccagaatcgaggaggggtttttcgacctcatgcacgtccagaaagtgctgagcgcctctaccgtgtgcaaacttcagtcctgtacacacggagttcctggcgatctgcaaatttaccatatcgggaatctcctgaagggagaccgcgtcaacggccacctgattcataagatcgaaccccactttaataccagctggatgtcttgggacgggtgcgatcttgactattactgtaacatgggcgattggccgagctgcacatataccggagtgacgcagcataatcacgctgccttcgtgaacctcctgaatattgagacagactacaccaaaaactttcacttccattccaagcgggtcacagctcacggcgatacccctcagctggacctcaaggccagacccacctacggggccggagaaatcacagtgctggttgaggtggctgatatggaacttcatacgaaaaagatcgcgattagcggcctgaaatttgcctctctcacctgtacagggtgctatgcttgctccagcggaatctcctgtaaggtccgcattcacgtggacgagcctgatgagctgaccgttcacgtgaaatctgaagaccccgatatcgtcgccgccagctcctctctgatggctcggaaacttgagttcggcacagacagcacctttaaggccttctccgcgatgcctaagacgtctctctgcttttacattgtggaaagagagtattgtgaaagctgctccaaggaggatacacagaaatgtgttaataccaagctggagcaaccccagagcatcctgatcgaacataaagggaccattatcggcaagcagaacgacacatgcaccgctaaagcctcttgttggctcgagtccgtcaagagcttcttttacggactgaagaatatgctttctggcattttcgggaacgtgttcatcggaatttttctgttcctcgccccgtttatcctgctgatccttttctttatgttcggctggcgcattctcttttgcttcaaatgttgccggagaacacgggggctgtttaagtatcgctacctgaaagacgatgaagagtccggatatagacggatcattgaaagactcaataacaagaaaggcaagaacaagctgcttgacggggagcgcctggctgatcggagaatcgccgagcttttcagcacgaaaacccacattggc

SEQ ID NO: 13851 - RNA, 2916 nt, synthetic construct
  misc_feature 1..2916: note = derived and/or modified CDS sequence (opt5) from CCHFV(BA8402, Artificial)__AF350449.1__Gn-4aa-Gc
  source 1..2916: mol_type = other RNA
agcgaggaatccggcgacgattgcatctctagaacccagctgctccggacagagacggccgaaattcacaacgacaattacgggggacccggcgataagatcaccatttgtaacgggagcacagtggtcgaccaacgcctgggatccgagcttggctgctataccatcaatagagttaactctttcaatctgtgtgaaaacacagctaccgggaaaagctgcgagattgattccacacctgtgaagtgtcggcagggattttgcctcaaaatcacccaggagggccgcggccatgtgaagctgtctagagggagcgaagtcgtgcttgacgcctgtgagtccagctgcgaaatcatgattccgaaaggaacgggcgatatcctggttgactgttctgggggacagcaacacttcctcaaggataatctgattgacctgggctgccccaacatccctctcctggggaagatggcgatttacatctgtcggatgtccaatcatcccaaaaccacaatggcttttcttttctggtttagcttcggatatgtggtgacctgcattctgtgcaaggtcatcttttacctcctgatcgttgtgggcacacttggcaaaaagttcaaacagtatcgcgagctgaagcctcagacctgtacgatttgcgagacaacccccgtcaacgccatcgatgccgaaatgcacgacctcaattgttcttacaacatttgcccttattgtgcttccagaccgacaagcgatgggctggcccggcatgtgatgcagtgccccaagcgcaaagagaagatcgaagagaccgctctgtacctcaatctggaacggattccttgggtggtcagaaaacttctgcaagtttctgagtccaccggagtggccctcaagcgcagctcctggctggtggtccttctggtgctcctgacagtttctctgagccccgtgcagtccgcgcctatcggcagaaaacccctctttagcgactctatcgtcaaggggatgaaaaacctgcttaattccacgagcctggagacctctctcagcattgaagccccgtggggagctatcaacgtgcagtccacattcaagcctaccgtttctgccgctaacattgccctgagctggtccagcgtggagcaccggggcaataagatccttgtctctgggcgctccgaaagcattatgaaactggaggaaagaacaggaatctcttgggacctcggcgtggaggatgcgtccgagagcaagctgctgaccgtctccgtgatggacctctctcagatgtacagccccgtttttgaatatctgtccggcgatcggcaagtggaggaatggcctaaagccacgtgtacaggggactgccccgagagatgtggatgcacctctagcacctgtcttcacaaggaatggccccattcccgcaactggcggtgcaatcctacatggtgctggggcgtcgggaccggatgtacatgctgtggcctggatgtgaaagacctcttcacggattacatgtttatcaagtggaaggttgagtatattaaaaccgaggctatcgtgtgcgtcgaactgacaagccaggagagacagtgtaccctgattgaagccgggacacgcttcaaccttggcccggtgaccatcacgctctctgagccccggaatattcaacagaagctgcctcccgagatcgtgaccctgcaccctagaattgaagagggattctttgacctcatgcatgttcagaaagtcctgtccgctagcacagtgtgcaaacttcagtcttgtacccacggcgtgcccggggatctgcaagtctaccacatcggaaacctcctgaaaggcgacaaggtgaatgggcatctgatccacaagattgaaccgcatttcaacacatcctggatgagctgggatggatgcgaccttcactattactgtaatatgggcgactggccttcttgcacctatacgggggttacacagcataaccacgccgcctttgtgaatatgctcaacatcgagaccgattacaccaaaaatttccactttcatagcaagcgcgtcaccgctcacggcgacacaccccagctggatctgaaagcgcggcctacatacggagccggcgaaattacggtgctcgttgaggtggctgacatggagctgcataccaagaaaatcgaaatttccgggcttaagttcgccagcctgacatgtaccggatgctatgcctgttcttccggcatcagctgcaaggtcagaatccacgtggatgagcccgacgaactcacagttcacgtgaaatccgaggatcctgacattgtcgctgcctctagctccctgatggcgcgcaagctggaatttgggaccgattctacgttcaaagcctttagcgctatgcccaagacatccctttgcttctacatcgtggagcgggagtattgtgaatcttgcagcaaagaggacacccagaagtgtgtgaacaccaaactcgaacaaccgcagtccattctgatcgagcataagggaacaattatcggcaagcagagcaatacctgcacagccaaggcttcttgttggctggaatccgtcaagagctttttctacgggctcaaaaacatgctgtctggcatctttggaaacgttttcattggcgtgttcctgtttttcgccccttttatccttctcattctgttctttatgttcgggtggagaatcctgttttgcttcaagtgttgccgccggacgagaggactttttaaatatcggcacctcaaggatgacgaggagaccggctaccgcaagattatcgaaagactgaataacaaaaaggggaaaaataagctgctcgatggagagcggctggctgacagaaaaatcgccgaacttttctccacaaagacccatattggc

SEQ ID NO: 13852 - RNA, 2916 nt, synthetic construct
  misc_feature 1..2916: note = derived and/or modified CDS sequence (opt5) from CCHFV(Matin, Artificial)__AF467769.2__Gn-4aa-Gc
  source 1..2916: mol_type = other RNA
agcgaggaatccggcgacgattgcatctctagaacccagctgctccggacagagacggccgaaattcacagcgactcctacgggggacccggcgataagatcaccatttgtaacgggtctacagtggtcgaccaacgcctgggaagcgagcttggctgctataccatcaatagagttaaatccttcaagctgtgtgaaaactctgctacagggaaaagctgcgagattgattccacccctgtgaagtgtcggcagggattttgcctcaaaatcacacaggagggccgcggccatgtgaagctgagcagagggtctgaagtcgtgcttgacgcctgtgattccagctgcgagatcatgattccgaagggaaccggcgacatcctggttgattgttctgggggacagcaacacttcctcaaagacaatctgattgatctgggctgccccaacatccctctcctggggaagatggcgatttacatctgtcggatgtccaatcatcccaaaacgaccatggtgtttcttttctggtttagcttcggatatgtcattacatgcatcctgtgcaaggtgatcttttacctcctgattgttgtgggcacccttggcaaaaagttcaagcagtatcgcgaactgaaacctcagacatgtaccatctgcgagacgacacccgtcaacgctattgacgccgagatgcacgatctcaattgttcttacaacatctgcccttattgtgcctccagactgaccagcgacgggctggctcggcatgtgatgcagtgcccgaagcgcaaagaaaagattgaggaaacagagctctacctgaatcttgaaagaatcccctgggtggtccggaaactgctccaagtttccgagtctaccggagtggccctgaagcgcagctcctggcttgtggtcctgctcgtgctgctgaccgttagcctctctcctgtgcagtccgctcccatcggcagaaaacctctgtttcttgacagcattatcaaggggatgaagaacctgctcaattctacaagcctggagacgtccctttctattgaagccccctggggagcgatcaacgtccagagcaccttcaaaccgacaatgtccgccgctaatattgccctgagctggtcttccgtggagcaccggggcaacaagatcctcgttagcgggcgctctgaatccatcatgaaactggaggaaagaaccggaattagctgggatctgggcgtggaggacgcttccgagtctaagctcctgacagtcagcgtgatggatctttcccagatgtactctcctgtctttgaatatctgagcggcgaccggcaagtggaggaatggcccaaagccacctgtacgggggattgccctgagagatgtggatgcacatccagcacctgtctccacaaggaatggccccattctcgcaattggcggtgcaaccccacctggtgctggggcgttgggacaggatgtacctgctgtggcctggacgtgaaggatctgttcacagactacatgtttgtcaaatggaaggtggagtatatcaaaacggaggttattgtgtgcgtcgaacttacctcccaggagagacagtgtagcctcatcgaagcggggacacgcttcaacctgggccctgtgaccattacactgtctgagccgcggaatatccaacagaagctgccccctgagattgtgaccctccaccccagaatcgaagagggattctttgatcttatgcatgttcagaaagtcctgtccgccagcacggtgtgcaagctccagtcttgtacccacggcgtgcctggggacctgcaagtctaccacatcggaaacctgcttaagggcgataaagtgaatgggcatctcattcacaagatcgaaccccatttcaacacaagctggatgtcctgggacggatgcgacctggattattactgtaatatgggcgactggccgagctgctcttataccggggttacacagcacaaccatgctgcctttgtgaatatgctgtccattgagaccgattacacgaaaaacttccactttcacagcaagcgcgtcacagctcatggcgacacccctcagctcgatctgaaagcccggcccacatacggagccggcgaaatcaccgtgcttgttgaggtggctgacatggagctgcacaccaagaagattgaaatctccgggctcaaattcgcgtctctgacatgtacgggatgctatgcctgcagctccggcatctcttgtaaggtccgcattcatgtggatgagcctgacgaactgaccgttcacgtgaaaagcgaggatcccgacatcgtcgctgcctcctctagccttatggccagaaagctcgaatttgggacagattccaccttcaaggcttttagcgccatgcctaagacatctctgtgcttctacattgtggagcgggagtattgtaaatcctgcagcaaggaagacacccagaagtgtgtgaatacgaaactggagcaaccccagtctatcctcattgaacacaagggaacaatcatcggcaaacagaacgatacctgcaccgcgaaggcttcctgttggctggagagcgtcaaatcctttttctacgggcttaagaatatgctgtctggcatttttggaaacgttttcatcggcattttcctctttctggccccgttcgccctgcttatcctctttttcatgtttgggtggcgcattctgttctgctttaagtgttgcagacggacaagaggactgttcaaatatcggcatctcaaggacgacgaagagaccggctaccgcaaaatcatcgagagactgaataacaagaaagggaagaataaacttctggatggagaacggctcgctgacagaaaaattgccgagctgtttagcacaaagacgcacgtgggc

SEQ ID NO: 13853 - RNA, 2916 nt, synthetic construct
  misc_feature 1..2916: note = derived and/or modified CDS sequence (opt5) from CCHFV(Baghdad 12, Artificial)__AJ538197.2__Gn-4aa-Gc
  source 1..2916: mol_type = other RNA
agcgaggaatccggcgacgattgcatctctagaacccggctgctccgcacagagacggccgaaattcacggggacagctacggaggccccggggataagatcaccatttgtaacggatccacaatcgtggaccagagactgggctctgagatggggtgctataccattaatcgggtcaagagcttcaagctctgtgaaaactccgctacaggaaaatcttgcaagatcgatagcatccctgttaaatgtcgccaaggctactgcctgaagattacccaggagggcagagggcatgtgaagctctcccggggaagcgaggtggtcctggacgcctgtgattcttcctgcgaagtgatgatcccgaaaggcacaggggacattcttgttgattgtagcggaggccagcagcactttctgaaggacaatctcatcgatctggggtgccccaacattcctctgctcggaaaaatggcgatctatatttgtcgcatgtctaatcatcccaagaccacgatggctttcctgttttggttctcctttggctacgtgattacctgcatcctttgcaaagccatcttctatctgctcatcattgtcggcacactggggaagagatttaagcaataccgggagcttaaacctcagacctgtacaatctgcgaaaccacgcccgtgaacgccattgacgctgagatgcacgatctgaattgtagctataacatctgcccttactgtgcctctcgcctcacatccgacggactggctagacatgttacccagtgcccgaagcggaaagagaaggtggaagagacagaactgtacctcaatctggagcgcatcccctgggtcgtgagaaaacttcttcaggtgagcgaatccaccggcgtcgccctcaagcggtctagctggctgattgttcttctggtgctcctggcggtgtccagctctcctgtccaatccgcccccatcgggcgcaaacctctgttcctcgacagcattgtgaagggaaccaagaacctgcttaattctacaagcctggagacgtccctctctatcgaggctccctggggcgccattaacgttcagagcacctataaaccgacagtgtccaccgctaatatcgccctgagctggtcttccgtcgaacacagagggaacaagatccttgtgagcggacggtctgagtccattatgaaactggaagagagaacaggcatcagctgggatctcggcgttgaagacgcgtccgagtctaagctgctgaccgtgagcgtcatggatctctcccagatgtactctcctgtgtttgagtatctgagcggggaccgccaggtcgaagagtggcccaaagccacgtgtacaggagattgccctgaacggtgtggctgcaccacctccacatgtcttcacaaggagtggccccatagcagaaattggcgctgcaaccccacctggtgctggggagtgggaacaggctgtacgtgctgtgggctggacgttaaggatctcttcaccgactacatgtttgtgaaatggaaggtcgaatatattaaaacagatgctatcgtgtgcgttgagctgacctctcaagagcggcagtgttccctgattgaagccggcacaagattcaaccttggaagcgtgaccatcacgctctctgagcctcgcaatattcagcaaaagctgccgcccgaaatcatcaccctgcaccctcggattgaggagggctttttcgacctcatgcatgtccagaaagtgctgtccgctagcacagtgtgcaagctgcagtcttgtacccacggggttcccggagatctgcaggtctaccacatcggcaacctcctgaagggggacaaagtgaatggacatctgattcacaagatcgaacctcatttcaacacaagctggatgtcctgggacggctgcgatcttgactattactgtaatatgggggattggcccagctgcacctacacgggcgtgacacaacacaaccatgcctcttttgtcaatctcctgaacattgagaccgactatacaaaatccttccactttcacagcaagagagtgaccgcccatggagataccccgcagctggacctcaaagttcgccctacatacggcgctggggaaatcacggtgctggtcgaggtggcggatatggaacttcacaccaagaagatcgagatttccggactgaaattcgcctctctcacatgtaccggctgctatgcttgcagctccgggatctcttgtaaggttcggattcatgtggacgagcccgatgaactgacagtccacgtgaaaagcgacgatcctgacgttgtggccgcctcctctagcctgatggctagaaaacttgagtttggaaccgattccacgttcaaagcctttagcgcgatgcccaagacatctctctgcttctacatcgtcgaacgcgagtattgtaaatcctgcagcaaggaagacacccagaagtgtgtgaataccaaactggagcagcctcaatctattctgatcgagcacaagggcacaatcattgggaaacagaacaatacctgcacagctaagacgtcctgttggctcgaaagcgtgaaatcctttttctacggcctgaagaacatgctttctggaatctttggcaatttctttatggggattttcctgttcctcgccccctttatcctgctgattcttttctttatgttcggatggcggatcctcttttgcttcaagtgttgcagacggacccgcggcctgtttaaatatagacatctgaaggacgatgaggaaacagggtaccggagaatcattgagcgcctcaacaataaaaaggggaaaaacaagctgcttgacggcgaacggctggccgatagacgcatcgctgagcttttcagcaccaagacacacattggg

SEQ ID NO: 13854 - RNA, 2916 nt, synthetic construct
  misc_feature 1..2916: note = derived and/or modified CDS sequence (opt5) from CCHFV(VLG/TI29414, Artificial)__AY179961.1__Gn-4aa-Gc
  source 1..2916: mol_type = other RNA
agcgaggaacccggcgacgattgcatctccagaacccagctgctccgggccgagcctgctgaaattcacgacgataactacgggggaccgggcgacaagatcacaatttgtaatgggtctacgatcgtggatcaacgcctgggaagcgagcttggctgctataccattaacagagtcaaatccttcaagctgtgtgaaaattctgccacagggaaaacctgcgagatcgacagcacacccgttaagtgtcggcagggattttgcctcaaaatcacccaggagggccgcggccatgtgaagctgtccagagggtctgaagtggtccttgatgcgtgtgacagctcctgcgaggtgatgattcctaagggaacaggcgatatcctggttgactgtagcgggggacagcaacacttcctcaaagataacctgattgacctgggctgcccccatatccctctcctggggaagatggctatttacatctgtcggatgtctaatcacccccgcaccacgatggcctttcttttctggttttccttcggatatgtgattacctgcatcttttgcaaagccctgttctacagcctcatcattatcggcacactgggcaagaaaattaagcagtatagagaacttaagcctcagacctgtacaatctgcgagaccgctccggtcaacgccattgatgctgagatgcatgacctgaattgttcttacaacatctgcccctattgtgcctcccggctcacgagcgacgggctggcgcgccacgtgcctcagtgccccaaaagaaaggaaaaagttgaggaaacagagctgtacctcaatctggaacggatcccttggaacgtgcgcaaacttctgcaagtctctgagtccaccggagtggccctcaagagaagctcctggctgattgtgcttctggtcctcctgacagtttctctgagccccgtgcagtccgctccggtgggccggaagcctctctttctggatagcatcgtcaaagggatgaagaatcttctgaactctaccaatctcgagacctccctgagcattgaagccccctggggagctatcaacgtgcagtctacattcaagcctacggttagcaccgccaatattgcgctttcctggtctagcgtggagcaccgcggcaacaaaatcctggtcacagggagatccgaaagcatcatgaagctcgaggaacggaccggagtgtcttgggacctgggcgttgaggatgcctccgagagcaaactgctcacagtgtctattatggacctgtcccagatgtacagccccgtctttgaatatctttccggcgatagacaagtggaggaatggcccaaggctacctgtacgggggactgccctgagcgctgtggatgcacatctagcacctgtctgcataaagaatggccgcactcccggaactggagatgcaatcccacctggtgctgggaggtcggcacagggtgtacctgctgtggatggaacgtgaaggatctcttcacagaccatatgtttgttaagtggaaagtggagtacatcaagacggaagccattgtctgcgtggagctgacctctcaggaacgccagtgtagcctgatcgaggctggcacacggttcaatcttgggcctgttaccattacactctccgagcccagaaacatccaacagaaactgcctcccgaaattatcaccctgcacccgaaggtggaggaaggcttctttgatctcatgcacgtccagaaagtgctgagcgcctctacggtgtgcaaacttcagtcctgtacccatggaatccctggcgacctgcaagtttatcacattgggaatctcctgaagggagatcgcgtcaacggccatctgatccacaagattgagccccatttcaatacaagctggatgtcttgggacgggtgcgaccttgattactattgtaacatgggagactggccttcctgcacctacacaggcatgacccagcacaatcacgccgcttttgtgaacctcctgaatatcgaaacggattatacaaagaccttccattttcacagcaaacgggtgacagcgcatggggacacaccccagctggatctcaaggccagacctacctacggcgctggagagattaccgtcctggtggaggttgccgacatggaacttcacacgaaaaaggtggagatctctggcctgaagttcgccagcctcgcttgtaccgggtgctacgcctgctccagcggaatctcttgtaaagtccgcattcacgtggatgaacccgacgagctgacagttcatgtgaagtccaacgatccggacgtcatcgcggctagcacctccctgatggcccggaaacttgaatttggcacagattctaccttcaaggcctttagcgctatgcctaaaacgtccctctgcttctatattgccgagagagagtactgtaagtcttgcagcgaagaggacacacagaaatgtgtggataccaagctggaacaaccccagtccatcctgattgagcacaaggggaccatcatcggaaaacagaatgacacatgcaccgctaaggcctcttgttggctcgaaagcgttaaatcctttttctatggcctgaagaacatgcttgggagcgtgtttggcaatttcttcattggaatcctgctctttctggcgcccttcgtcctgcttgtgctctttttcatgtttggctggaaaattctgttctgctttaagtgttgccgccggacaagagggctgctcaagtaccggctgcttaaagacgatgaggagacgggatatcgcagaatcattgaacggctgaacaacaagaaaggcaagaatagactcctggacggggagcgcctggccgatcggaaaatcgctgaacttttctctaccaagacacatatcgga

SEQ ID NO: 13855 - RNA, 2916 nt, synthetic construct
  misc_feature 1..2916: note = derived and/or modified CDS sequence (opt5) from CCHFV(TADJ/HU8966, Artificial)__AY179962.1__Gn-4aa-Gc
  source 1..2916: mol_type = other RNA
agcgaggaatccggcgacgattgcatctctagaacccagctgctccggacagagacggccgaaattcacggggacgattacggaggccccggggacaagatcaccatttgtaacggaagcacaatcgtggatcaacgcctgggctccgagcttgggtgctataccattaatagagtcaaatctttcaagctgtgtgaaaacagcgctacaggaaagaattgcgagatcgactccgttcctgtgaagtgtcggcagggctactgcctcaaaatcacccaggagggccgcgggcatgtgaagctgtctagaggaagcgaagtcgtgcttgatgcctgtgactccagctgcgaggttatgattccgaagggcacaggggatatctctgtggactgttccggaggccagcaacactttctgaaagataacctcattgacctggggtgccccaagatccctctgctcggaaaaatggcgatttatatctgtcggatgagcaatcatcccaagaccacgatggctttcctgttttggttctcttttggctacgtcattacccgcatcctttgcaaagccatcttctatctgctcattatcgtgggcacactggggaagagatttaagcagtaccgggaacttaaacctcagacctgcacaatttgtgagaccacgcccgccaacgctatcgatgccgagatgcacgacctgaattgctcctataacatttgtccttactgcgctagccgcctcacatctgacggactggccagacatgttacccagtgtccgaagcggaaagaacgcgtggaggaaacagagctgtacctcaatctggaaagaatcccctggatcgtccggaagctgctgcaagtgtccgagagcaccggcgtggcgctcaaacgctcctcttggctgattgtccttctggttctcttcaccgtgagcctgtcccctgtgcagagcgcccccatcgggagacggcctctgtttctcgattctattgtcaagggaatgaaaaacccccttaattccacaagccttgagacgtctctgagcatcgaagctccgtggggcgccattaacgtgcagtccacctataagcctacagtttctaccgctaatatcgccctcagctggtccagcatcgagcacagagggaacaatattctggtgtctggacgctccgaaagcatcatgaaacttgaggaacggacaggcatttctggcgacctgggggtcgaggatgcgtccgagagcaaactcctgaccgtgtccgttatggacctgtctcagatgtacagccccgtgttcgaatatctctccggagatagacaagtcgaggaatggcctaaggccacgtgcacaggcgactgtcccgagcgctgcgggtgtacctctagcacatgcctgcacaaagaatggccccattcccggaactggagatgtaaccctacatggtgctggggagtgggcaccgggtgcacatgttgcggccttgatgtcaaggacctgtttatcgattacatgttcgtgaaatggaaggttgactatattaagacggaggctatcgtgtgtgtcgagctcaccagccaggaacgccagtgctctctggtggaggccggaacacggtttaatctgggcccggttaccattacactttccgaacccagaaacatccaacagaaactccctcccgagatcattaccctgcaccctcgcatcgaggaagggttcttcgatctgatgcatgtgcagaaggtcctcagcgcttctacggtgtgtaaactgcagtcctgcacccacggagtgcccggcgaccttcaagtttaccacattgggaatctgctcaagggagacaaagagaacggccatctgatccacaagattgaaccgcattttaatacaagctggatgtcttgggatgggtgtgacctggattattactgcaacatgggcgactggcctagctgtacctacacaggagtcacccagcacaatcatgcctccttcgtgaaccttctcaatatcgagacggattatacaaagagctttcacttccactctaaacgggtgaccgcccatggcgacacaccccagctggatctgaaggctagacctacctacggggcgggagaaatcaccgtcctcgtggaggttgccgacatggagctgcacaccaaaaagattgaaatcacgggccttaaatttgcttccctgacctgcacagggtgttatgcctgcagctccggaatttcttgcaaggtgcgcatccatgtcgatgagcccgacgaactcaccgtgcacgttaagagcgatgaccctgatgtggtcgccgcttcctctagcctgatggcccggaaactggagttcggcacagactccacctttaaggcgttctctgctatgcccaaaacgagcctttgtttttacattgtggaaagagagtatcggaagtcctgcagcaaagaggacacacagaagtgtgttaacaccaaactcgaacaaccgcagtctatcctgatcgagcacaaggggaccattatcggcaagcagaataacacatgcaccgccaaagcctcctgttggctggaaagcgtgaagtctttcttttacggactcaaaaatatgctgtccggcattttcgggaacgtctttgtgggaatcttccttttcctggctccttttattctcctgatcctgttctttatgttcggctggcgcatccttagctgctttaagtgttgcagacggacaagagggctcctgaaacatcgccacctgaaggatgacgaggaaacgggatatcggagaattatcgagcgcctcaataacaagaaaggcaagaacaaactgcttgatggggagagactggccgaccggcgcattgctgaactcttctctaccaagacacatatcggc

SEQ ID NO: 13856 - RNA, 2916 nt, synthetic construct
  misc_feature 1..2916: note = derived and/or modified CDS sequence (opt5) from CCHFV(Hodzha, Artificial)__AY223476.1__Gn-4aa-Gc
  source 1..2916: mol_type = other RNA
agcgaggaatccggcgacgattgcatctctagaacccagctgctccggacagagacggccgaaattcacggggacgattacggaggccccggggacaagatcaccatttgtaacggaagcacaatcgtggatcaacgcctgggctccgagcttgggtgctataccattaatagagtcaaatctttcaagctgtgtaaaaacagcgctacaggaaagtcctgcgaaatcgactctacccctgttaaatgtcggcagggctactgcctcaagatcacacaggagggccgcgggcatgtgaagctgagcagaggatccgaggtggtccttgatgcctgtgacagctcttgcgaagtgatgattccgaaaggcaccggggatatcctggttgactgttccggaggccagcaacactttctcaaggataatctgattgacctggggtgcccccggatccctctcctgggaaaaatggcgatttatatctgtcgcatgagcaaccatcccaagacgaccatggctttcctgttttggttctcttttggctacgtgattacatgcatcctttgcaaagccatcttctatctcctgattatcgtcggcacccttgggaagagatttaagcagtaccgggagctgaaacctcagacatgtaccatttgcgaaacgacacccgccaatgctatcgatgccgagatgcacgacctcaactgttcctataatatttgcccttactgtgctagccgcctgacctctgacggactggccagacatgtgacacagtgcccgaagcggaaagagaaggttgaagagaccgaactctacctgaaccttgagcgcatcccctggatcgtgagaaaactgctccaagtctccgaaagcaccggcgtggcgctgaagcggtcctcttggcttattgtgctgctcgtcctgttcgccgttagcctgtcccctgtgcagagcgctcccatcgggcgcagacctctctttctggattctattgtgaaaggaacaaagaatcttctgaactccacgagcctcgagacctctctgagcatcgaggccccctggggcgctattaatgtccagtccacatataagccgaccgtgtctacagccaacatcgcgcttagctggtccagcgttgaacaccgggggaataaaatcctggtgtctggaagatccgagagcattatgaagctcgaggaacgcaccggcatctcttgggacctgggcgtcgaagatgcctccgagagcaaactgctcacggtgtccgttatggacctgtctcagatgtacagccctgtgttcgagtatctttccggggatcggcaagtcgaagagtggcccaaggctacatgtaccggagactgccctgaaagatgtggctgcacctctagcacatgtctgcacaaagagtggccccattcccgcaactggcggtgcaatcccacctggtgctggggagtgggaacaggctgtacgtgctgtgggctcgatgtcaaggacctgtttaccgattacatgttcgtgaagtggaaagttgactatattaagacagaagccatcgtgtgcgtcgagctgaccagccaggagagacagtgttctcttgtggaagctggcacacgctttaacctcggacctgttaccattacgctgtccgagccgcggaacatccaacagaaactgccccctgaaattatcaccctccaccccagaatcgaggagggcttcttcgatctgatgcatgtgcagaaggtccttagcgcctctacagtgtgcaaactgcagtcctgtacccacggggtgcctggagacctccaagtttaccacattggcaatctgctgaagggggacaaggtcaacggacatcttatccacaaaattgaaccccattttaatacaagctggatgtcttgggatggctgcgacctcgattattactgtaacatgggggactggccgagctgcacctacacgggcgtgacacagcacaatcatgcctccttcgtgaacctgctgaatatcgagaccgattatacaaagagctttcacttccactctaaacgcgtcaccgctcatggagacacccctcagctcgatctgaaggcgcggcccacatacggcgccggggaaattacggtgcttgttgaggtggctgacatggaactgcacaccaaaaagatcgagatcacaggactcaagtttgcctccctgacctgtacaggctgctatgcctgcagctccgggatttcttgtaaagtcagaatccatgtggatgagcctgacgaactgaccgttcacgtcaagagcgatgaccccgatgtggtggctgcctcctctagccttatggcgcgcaaactcgagttcggaacggactccacatttaaggctttctctgccatgcctaaaaccagcctgtgcttttacattgttgaacgggagtattgtaagtcctgcagcaaagaagacacccagaagtgtgtgaacacaaagctggagcaaccccagtctatcctcattgagagaaaaggcaccatcatcgggaagcagaataacacatgcacggccaaggcttcctgttggctggaaagcgtcaagtctttcttttacggccttaaaaatatgctgtccggaattttcggcaacgtgtttgtggggatcttcctcttcctggccccgtttattctgcttatcctcttctttatgttcggatggcggattctgttttgcttcaagtgttgccgcagaacccggggcctgtttaagtataaacacctcaaggatgacgaggaaacagggtacagacgcatcatcgagcggctgaataacaaaaaggggaaaaataaacttctggatggcgaaagactcgctgaccgcagaattgccgagctgttcagcaccaagacacatatcggg

SEQ ID NO: 13857 - RNA, 2916 nt, synthetic construct
  misc_feature 1..2916: note = derived and/or modified CDS sequence (opt5) from CCHFV(Kosovo/9553/2001, Artificial)__AY675511.1__Gn-4aa-Gc
  source 1..2916: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacagctcctgcgaggtgatgattcccaagggaacgggcgatatcctggttgactgtagcgggggacagcaacacttcctcaaagataacctgattgacctgggctgccctcatatccccctcctggggaagatggcgatttacatcgctcggatgtctaatcaccctaaaaccacaatggcctttcttttctggttttccctgggatatgtgattacctgtatcctctgcaaggccctgttctacagccttatcattatcggcacactgggcaaaaagattaagcagtatcgcgaactcaaaccccagacctgcacgatctgtgagacagctcctgtcaacgccattgatgctgagatgcatgacctgaattgctcttacaacatctgtccgtattgcgcctccagactgaccagcgacgggctcgcgcggcacgtgaagcagtgtcccaaacgcaaggaaaaagttgaggaaacagagctgtaccttaatctggaaagaatcccttgggtggtccggaagctcctgcaagtgtctgagtccaccggagtggcccttaaacgcagctcctggctgattgtcctcctggttctgctcaccgtgtctctgagccccgtgcagtccgctcctgtcggcagaaagcccctttttctggatagcatcgtgaaggggatgaaaaacctcctgaatagcacatcccttgagacgagcctgtctattgaagccccgtggggagctatcaacgttcagagcaccttcaagcctacagtgtccaccgccaatattgcgctctcttggagctccgtcgagcaccggggcaacaaaatcctggtgacagggcgcagcgaatctatcatgaagctggaggaaagaaccggagtttcctgggacctcggcgtggaggatgccagcgagtctaaactgcttacggtctccattatggacctgagccagatgtactcccccgtgtttgaatatctctctggcgatcggcaagtcgaggaatggcctaaggctacatgcaccggggactgtcccgagagatgcggatgtaccagctccacatgcctgcataaggaatggccccactctcgcaattggcggtgtaaccctacctggtgctggggcgtggggacaggatgcacgtgttgcggcgttgatgtgaaagacctgttcaccgatcatatgtttgtcaagtggaaagtggagtacatcaagacagaggccattgtttgtgtggaacttaccagccaggagagacagtgctccctcatcgaagctgggacacgcttcaacctgggcccggtcaccattacgctgagcgagccccggaatatccaacagaaactccctcccgagattatcaccctgcaccctaagatcgaagagggatttttcgaccttatgcacgtgcagaaggtgctgtctgcctccacagtttgtaaactccagagctgcacccatggcattcccggggatctgcaagtctatcacatcggaaacctgcttaagggcgacagagtgaatgggcatctcattcacaaaatcgaaccgcatttcaacacatcttggatgtcctgggacggatgtgatctggactactattgcaatatgggcgattggcctagctgtacctacacgggggtgacacagcacaaccacgccgcttttgtcaatctgctcaacattgagaccgactatacaaagaccttccattttcactctaaacgcgtgaccgcgcatggcgatacaccccagctggaccttaaggcccggcctacgtacggagctggcgaaatcaccgttctggtggaggtcgccgatatggagctccacacaaagaaagtggaaatcagcgggctgaagttcgcctccctggcttgcaccggatgttacgcctgcagctctggcatttcctgcaaagttagaatccacgtggacgagcccgatgaacttacagtccatgtgaagtcttccgaccctgatgttgtggcggcttctaccagcctcatggcccgcaaactggagtttgggacggactccacattcaaggccttttctgctatgcccaaaaccagcctgtgtttctatattgtcgaaaaggagtactgcaagtcctgttctgaggatgacaccaaaaagtgcgtggacacaaaactcgaacagccgcaaagcatcctgattgagcaccggggaaccatcatcggcaagcctaatgatacatgtcccgccaaaacgtcctgctggcttgaaagcgtgaagtcctttttctatgggctgaagaacatgctcggctctgtctttggaaatttctttattggcatcctgctgttccttgctcccttctttctctggatgctgagcttcatgtttgggtggaaaattctgttctgttttaagtgctgtagacgcacccggggactcttcaaatacagacatctgaaggacgatgaggaaacaggctatcggcgcatcattgagagacttaacaataaaaaggggaagaaccggctgctcgacggagagagactggccgatcgcaaaatcgcggaactgttttctaccaagacacacatcggc

SEQ ID NO: 13858 - RNA, 2916 nt, synthetic construct
  misc_feature 1..2916: note = derived and/or modified CDS sequence (opt5) from CCHFV(SPU41/84, Artificial)__AY900142.1__Gn-4aa-Gc
  source 1..2916: mol_type = other RNA
agcgaggaatcctctgacgattgcatcagcagaacccagctgctccggacagagacggccgaaattcacggcgacaactacgggggacccggcgataagatcaccatttgtaatgggtccacagtggtcgaccaacgcctgggatctgagcttggctgctataccatcaacagagttaaaacattcaagctgtgtgaaaatagcgctaccgggaaatcctgcgagattgattctgtgcctgtgaagtgtcggcagggatactgcctcaaaatcacacaggagggccgcggccatgtcaagctgagcagagggtccgaagtggttcttgacgcctgtgataccagctgcgaggtgatgatcccgaagggaacgggcgacattctggtcgattgttctgggggacagcaacactttctcaaagacaacctgatcgatctgggctgccccaagattcctctcctggggaaaatggcgatctatatttgtcggatgtccaatcatcccaagaccacaatggctttcctgttttggttcagctttggatacgtgattacctgcatcatctgcaaagttatcttctatctgctcattatcgtgggcacactgggcaagcgctttaagcagtacagagaacttaaacctcagacctgtacgatttgcgagacaacccccgtcaacgccatcgacgccgagatgcacgatctgaattgttcttataacatttgcccttactgtgcttcccggctcacaagcgacgggctggcccgccatgtgacccagtgcccgaagagaaaagaaaaggtggaggaaaccgagctgtacctcaatctggaacggatcccctgggtcgttcgcaaacttctgcaagtgtctgagtccacaggagtggctctcaagagaagctcctggctggtcgtgcttctggttctcctgacggtgtctctgagccctgtccagtccgcccccatcagccggcgccctctcttcctggactctattgtgaaaggcatgaagaaccttcttaattccaccagcctcgagacatctctgagcatcgaagcgccctggggagccattaacgttcagtccacctataagccgacagtgtctaccgctaatatcgcccttagctggtccagcgtcgagcacagagggaacaaaattctggtgtctggccggtccgaaagcatcatgaagctcgaggaaagaacggggatctcttgggatctgggagtcgaggacgcttccgagagcaaactgctcacagtgtccgttatggatctgtctcagatgtacagccctgtgtttgaatatctttccggcgaccgccaagtcgaggaatggcccaaggccacctgtaccggcgattgccctgagcggtgtgggtgcacatctagcacctgtctgcacaaagaatggccccattccagaaattggcgctgcaaccccacatggtgctggggagtgggcacggggtgtacctgctgtggactcgacgttaaggatctgttcacagactacatgtttgtgaagtggaaagtcgagtatattaagaccgaggcgatcgtgtgcgtggaactgacaagccaggagcggcagtgttctcttattgaagccggcaccagattcaacctcgggcctgttacgatcaccctgtccgagccgcgcaatattcaacagaaactgccccctgagatcattacactccacccccggatcgaagagggctttttcgatctgatgcatgtccagaaggtgcttagcgcttctaccgtgtgcaaactgcagtcctgtacacacggagtccctggcgacctccaagtgtaccacatcgggaacctgctgaagggagataaggttaatggccatcttgtgcacaaaattgaaccccatttcaacaccagctggatgtcttgggacgggtgcgacctcgattattactgtaatatgggagactggccgagctgcacgtacacaggcgtcacccagcacaaccatgcctcctttgtgaatatgctgaacatcgagacagattataccaagaatttccactttcacagcaaaagagttaccgctcatggggacacacctcagctggatctcaaggcccgccccacgtacggcgccggagaaattaccgtgctggtcgaggtggctgacatggagcttcacacaaagaagatcgaaatttctggcctgaagttcacctccctcacatgtaccgggtgctatgcgtgcagctccggaatctcttgtaaagttcggatccatgtggatgagcctgacgaactgacggtccacgtgaaaagcgaggatcccgacgtggtcgccgcttcctctagcctgatggccagaaaacttgaatttggcacagattccaccttcaaggccttttctgctatgcctaaaaccagcctctgcttctacattgttgagcgcgagtattgtaagtcctgcagcgaagaggacacacagaaatgtgtgaacaccaagctggaacaaccccagtctatcctgattgagcggaaggggacaatcattggaaaacagaataacacgtgcaaggccaaagcgggctgttggctcgaatccgtcaagagctttttctacgggctgaaaaatatgctttctggcatctttggaaacgtgttcatcggcatttttctgttcctcgctccgttcatcctgctgattctctttttcatgtttgggtggagaatccttttctgctttaagtgttgccggcgcaccagaggactgttcaagtatcggcacctgaaagatgacgaggagacaggctacagaaagattatcgaacgcctcaataacaaaaaggggaaaaacaagctgcttgacggagagcggctggccgatagacgcatcgccgaactcttttccaccaagacacatattggc

SEQ ID NO: 13859 - RNA, 2916 nt, synthetic construct
  misc_feature 1..2916: note = derived and/or modified CDS sequence (opt5) from CCHFV(UG3010, Artificial)__AY900143.1__Gn-4aa-Gc
  source 1..2916: mol_type = other RNA
gccgagggcgtgagcaacgactgcgtctccagaacccagctgatcaagacagaagttgctgagattcacgaagattcttacgggggacccggcgagaaaatcacgatttgtaatgggagcaccatcgtggaccaacggctcggatccgaactgggctgctatacaattaaccgcgtgaagacctacaaactttgtgagaatagcgccacagagaaggggtgcgaaatcgatagcgtccctgtgaaatgtaagcagggattctgcctgaaggttacccaggagggcagaggccatgtgaaactctcccgggggacagaaatcgtcctggacgtgtgtgatacctcttgcgagcttatgattccgaagggaacgggcgacatcctggttgattgtagcgggggacagcaacactttctccaggacaacctgattgatctgggctgccccaatgtgcctctcctggggaaaatggcgatctatatttgtcgcatgtccaaccatcccaagaccacaatggctttcctgttttggttcagctttggatacgtcattacctgcatcgtgtgcaaagtgctgttctatctcctgatcgtcatcggcacactttctaagaagctgaaacagtacagagagctcaagcctcagacctgtattgtttgcgaatccacgcccgtgaatgccatcgacgccgagatgcacgaactgaactgtaattataacatttgcccttactgtgctagccggctgacatctgatggcctcgtgcgccatgtcaatcaatgcccgaaaagaaaggagaaagtggaagagaccgagctgtaccttaacctggaacggatcccctggctcgttcgcagactgcttcaggtgtccgagagcacagggatggccctgaagcggtcttgttggatgaccaccctcctgattctgctcgtcgtgtccctgagccctgttcagtccgctcccgtgggacgcaaacctctttatctggactctatcgccaagggcatgaaaagcctccttaattccacaaaccttgaaacgagcctgtctatcgaggcgccctggggagccattaatgtccagtccacctttaagccgacagtgagcgctgccaacatcgctctctcttggagctccgtcgaacacagagggaacaagattctggtgtctggccggagcgagtccatcatgaaactggaggaacgcaccgggattagctggtctctcggagttgaggatgcctccgaaagcaagacactgaccgtgtctgtcatggacctttcccaaatgtacagccctgtgttcgagtatctgtccggcgacagacaggttgaagagtggcccaaagcgacgtgcacaggcgattgtcaggagcggtgcgggtgtacctcttctacctgcctccacaaggaatggcctcattccagaaattggcgctgcaaccccacatggtgttggggagtgggcaccgggtgcacatgttgcggactggacgtccgggatctgtttacggactacatgatggtgaagtggaaagtggagtatgttaagaccgaagccatcatgtgtgtcgagcttacatctcaagagagacagtgcagcctcatcgaagctggcacccgcttcaatctggggcccgtgacaattaccctgtccgagcctcggaacatccagcagagactcccgagcgaaattgtgacgctgcaccccaaaatcgaggaaggctttttcgatcttatgcatgtccaaaaggtgctgtctgcctccaccgtttgtaaactccagagctgcacacacggagtgcctggcgacctgcaggtctaccacgtggggaatctgcttaagggagataaggttaacggccattctattcacaaaatcgagtcccattttaataccagctggatgtcttgggacgggtgtgatctcgactatttctgcaacatgggagattggcccagctgtacatacaccggcgtgacgcagcacaatcgcgctgccttcattaacatgctgaatatcgagacagactacaccaagacatttcatttccactccaaacgggtcaccgcccacggggacacccctcaactggatctcaaggctagacccacatatggcgcgggagaagtgacggttctggtggaggtcgccgaccttgaactgcataccaaaaagatcgaggtgagcggcctcaagtttgcttctctgacatgctccgggtgctacgcctgtagctccggaatttcttgcaaagtgcgcatccacgtcaacgaaccggatgagttcaccgttcatgtcaagagctccgaccctgatgtggtggccgctggctctagcctgatggcccggaaaattgagtttggggcggactccacattcaaggctttttctagcatgcccaaaaattccctttgtttctatatcgtggaaagagattactgcagctcttgtaccaacgacgatacgcagaagtgcgttgacacaaaactcgagcaccctcagtccattctgatcgaacacaagggaaccatcattggcaagcagaatgatacctgtagcacaaaaacctcttgctggctggagtccgtcaagagctttttctatgggctcaaaaacatgctgggcggaatctttggcaacgtgttccttgggatttttctgttcctcgcccccttcgccctgctgatctttttctttttctttggatggcgccttctcttctgtctgaagtgctgtcggagaacacggggcctgctcaaatacaagcaactgaaggacgaagaggaggctgggtataaaaagattatcgaacgccttaatgataaaaagggaaaatctagactgtttgacggcgagcggctcgccgacagaaagatcgctgaactgttctccacgaagacccatattggg

SEQ ID NO: 13860 - RNA, 2916 nt, synthetic construct
  misc_feature 1..2916: note = derived and/or modified CDS sequence (opt5) from CCHFV(Hy13, Artificial)__AY900145.1__Gn-4aa-Gc
  source 1..2916: mol_type = other RNA
agcgaggaatccggcgacgattgcatctctagaacccagctgagccggacagagacggccgaaattcactccgacaactacgggggacccggcgataagatcaccatttgtaatgggtctacaatcgtggaccaacgcctcggaagcgagctgggctgctataccattaacagagtcaaatccttcaagctgtgtgaaaattctgctacagggaaaagctgcgagatcgattccacccctatcaagtgtcggcagggattttgcctgaaaattacacaggagggccgcggccatgttaagctcagcagagggtctgaagtggtgctggacgcctgtgattccagctgcgagatcatgattccgaagggaaccggcgacatccttgtcgattgttctgggggacagcaacacttcctgaaagacaacctcattgatctgggctgccccaatatccctctgctcgggaagatggcgatttacatctgtcggatgtccaaccatcccaaaacgaccatggcttttctgttctggtttagcttcggatatgtgatcacatgcattctttgcaaggttatcttttacctgctcattgtggtcggcaccctgggcaaaaagttcaagcagtatcgcgaacttaaacctcagacatgtaccatctgcgagacgacacccgtgaatgccattgacgccgagatgcacgatctgaactgttcttacaatatctgcccttattgtgcttccagactcaccagcgacgggctggcccggcatgttatgcagtgcccgaagcgcaaagaaaaggtggaggaaacagagctgtacctcaacctggaaagaatcccctgggtcgtgcggaaacttctgcaagtgtccgagtctaccggagtcgctctcaagcgcagctcctggctggttgtgcttctggtgctcctgaccgtcagcctgtctcctgtgcagtccgcccccattggcagaaaacctctctttagcgactctatcgttaaggggatgaagaatctgcttaacagcacatccctggagacgtctctcagcattgaagcgccctggggagccatcaatgtgcagtccaccttcaaaccgacagtcagcgctgccaacattgctctgtcttggtccagcgtggagcaccggggcaataagatccttgtttctgggcgctccgaaagcatcatgaaactggaggaaagaaccggaatttcctgggatctcggcgtggaggacgcctctgagagcaagctgctgacagtctccatcatggatctctctcagatgtacagccctgtgtttgaatatctgtccggcgaccggcaagtcgaggaatggcccaaagcgacctgtacgggggattgccctgagagatgtggatgcacaagctctacctgtcttcacaaggaatggccccattcccgcaactggcggtgcaaccccacctggtgctggggcgtggggacaggatgtacctgctgtggcctggacgttaaggatctcttcacagaccacatgtttgtgaaatggaaggtcgagtacattaaaacggaggccatcgtgtgcgttgaactgaccagccaggagagacagtgttctctgattgaagctgggacacgcttcaatcttggccctgtgaccatcacactctccgagccgcggaacattcaacagaagctgccccctgagatcgtcaccctgcatcccagaatcgaagagggattctttgatctcatgcacgtgaaaaaggtgctgagcgcctctacggtttgcaaacttcagagctgtacccacggcgtccctggggaccttcaggtgtatcatattggaaatctcctgaagggcgataaggtgaacgggcacctgatccataaaattgaaccccacttcaatacatcctggatgagctgggacggatgcgaccttgattactattgtaacatgggcgactggccgtcttgctcctacaccggggtcacacaacataatcacgctgcctttgtgaacatgctcaatatcgagaccgattatacgaagattttccactttcatagcaaacgcgttacagcccacggcgacacccctcagctggatctgaaggctcggcccacatacggagcgggcgaaatcaccgtgctcgtcgaggtggccgacatggagctgcataccaagaaaatcgaaatttccgggcttaagttcgcttctctgacatgtacgggatgctacgcctgcagctccggcatctcttgtaaagttcgcattcacgtggatgagcctgacgaactcaccgtccacgttaagagcgaggatcccgacatcgtggccgcttcctctagcctgatggccagaaaactggaatttgggacagattccaccttcaaggcgtttagcgctatgcctaaaacatctctttgcttctatattgtggagcgggagtactgtaagtcctgcagcaaggaagacacccagaaatgtgtcaacacgaagctcgagcagccccaatctatcctgatcgaacataaaggaacaattatcggcaagcagaatgatacctgcacctccaaagccgggtgttggctggagagcgtgaagtcctttttctatggcctcaagaacatgctgtctggaatttttggcaatgtgttcatcgggattttcctttttctggccccgttcatcctcctgatcctgtttttcatgtttggatggcgcattcttttctgctttaaatgttgcagacggacaagaggcctcttcaagtaccggcacctgaaagacgacgaagagaccgggtatcgcaagatcattgagagactgaacaataaaaagggaaagaacaaactcctggatggcgaacggcttgctgacagaaagatcgccgagctgtttagcacaaaaacgcatattggg

SEQ ID NO: 13861 - RNA, 2916 nt, synthetic construct
  misc_feature 1..2916: note = derived and/or modified CDS sequence (opt5) from CCHFV(Semunya, Artificial)__DQ094832.1__Gn-4aa-Gc
  source 1..2916: mol_type = other RNA
gccgagggcgtgagcaacgactgcgtctccagaacccagctgatcaagacagaagttgctgagattcacgaagattcttacgggggacccggcgagaaaatcacgatttgtaatgggagcaccatcgtggaccaacggctcggatccgaactgggctgctatacaattaaccgcgtgaagacctacaaactttgtgaaaattctgccacagagaaggggtgcgagatcgatagcgtccctgtgaaatgtaagcagggattctgcctgaaggttacccaggagggcagaggccatgtgaaactctcccgggggacagaaatcgtcctggacgtgtgtgatacctcttgcgagcttatgattccgaagggaacgggcgacatcctggttgattgtagcgggggacagcaacactttctccaggacaacctgattgatctgggctgccccaatgtgcctctcctggggaaaatggcgatctatatttgtcgcatgtccaaccatcccaagaccacaatggctttcctgttttggttcagctttggatacgtcattacctgcgtggtgtgcaaagtcctgttctatctcctgatcgttatcggcacacttggcaagaagctgaaacagtacagagagctcaagcctcagacctgtatcgtgtgcgaatctattcccgtgaatgccatcgacgccgagatgcacgaactgaactgtaattataacatttgcccttactgtgcttcccggctgacgagcgatgggctcgtccgccatgtgacacaatgcccgaaaagaaaggagaaagttgaagagaccgagctgtaccttaatctggaacggatcccctggctcgtgcgcagactgcttcaggtctctgagtccacaggaatggccctgaagcggagctgttggatgaccaccctcctgattctgctcgtggtttctctgtcccctgtgcagagcgctcccgtcggccgcaaacctctttttctggactccatcgccaaggggaagaaatctctcctgaacagcacaaatcttgaaacgtccctgagcatcgaggcgccctggggagccattaacgtgcagtctaccttcaagccgacagtctccgctgccaatatcgctctcagctggtctagcgtggaacacagaggcaacaaaattctggtttccgggcggtctgagagcatcatgaagctggaggaacgcaccggaatttcctggagcctcggcgtggaggatgcctctgaatccaaaacactgaccgtcagcgtgatggacctttctcaaatgtattcccctgtttttgagtacctgagcggcgacagacaggtggaagagtggcccaaggcgacgtgcacaggggattgtcctgagcggtgcggatgtacctcctctacctgcctccacaaggaatggccccatagcagaaactggcgctgcaatcccacatggtgttggggcgtcgggaccggatgcacatgttgcggcctggacgtgcgggatctgttcacggactatatgatggtgaaatggaaggttgagtacgtcaaaaccgaagccatcatgtgtgtggagcttacatcccaggagagacaatgctctctcatcgaagctgggacccgctttaacctgggccctgtgacaattaccctgagcgagccgcggaatgtccagcagagactcccctccgaaatcgtgacgctgcaccctaagattgaggaaggattctttgatcttatgcatgttcagaaagtgctgttctgtaagtatagcctccaagccacctcttgcacacacggcgtccccggggaccttcaggtgtaccacgttggaaacctgcttaagggcgataaagtgaatgggcattccatccacaagattgagagccatttcaacacctcttggatgtcctgggacggatgtgatctcgactatttttgcaatatgggcgattggcctagctgtacatacaccggggtcacgcagcacaaccgcgctgccttcgtgaatatgctgaacatcgagacagactacaccaaaacatttcatttccactctaagcgggttaccgcccacggcgacacaccccagctggatctcaaagctagaccgacctatggagcgggcgaagtgacggtcctggtggaggtggccgaccttgaactgcataccaagaagattgaggtcagcgggctcaaatttgcttccctgacatgcagcggatgctacgcctgttcttccggcatcagctgcaaggttcgcatccacgtgaatgaacctgatgagttcaccgtgcatgtcaaatccaacgaccccgatgtggttgccgctgggtctagcctgatggcccggaagattgagtttggagcggactccacattcaaggctttttctagcatgcctaaaaattccctttgtttctatatcgtggaaagagattactgctctagctgtaccgacgatgacacgcaaaaatgcgtcaacattaagctcgagcacccccagtccatcctgattgaacacaagggcacaatcatcgggaaacagaatgatacctgtcctaccaagacaagctgctggctggagtctgtgaaatcctttttctatggcctcaagaacatgctgggaggcatttttgggaacgttttccttggaatcttcctgtttctcgcccccttcgccctgctgattctctttttctttttcggctggcgccttctgttttgtctgaaatgctgtcggagaacccgggggctcctgaagtacaagcagcttaaagacgaagaggaggctggatataagaaaatcattgaacgcctgaatgataagaaaggcaagagcagactcttcgacggggagcggctggccgacagaaagatcgctaaactgttttctacaaagacgcatatcggc

SEQ ID NO: 13862 - RNA, 2916 nt, synthetic construct
  misc_feature 1..2916: note = derived and/or modified CDS sequence (opt5) from CCHFV(SPU128/81/7, Artificial)__DQ157174.1__Gn-4aa-Gc
  source 1..2916: mol_type = other RNA
agcgaggaaccctccgacgattgcatctctagaacccagctgctccggacagagacggccgaaattcacggcgacaactacgggggacctggcgataagatcaccatttgtaatgggagcacaatcgtggaccagcgcctgggatccgagcttggctgctataccattaacagagtcaaatctttcaagctgtgtgaaaatagcgctacagggaaatcctgcgagatcgagtctgttccggtgaagtgtcggcagggatactgcctccgcatcacccaggaaggcagaggccatgtgaaactgagccgggggtccgaggtcgtgcttgatgcctgtgacacaagctgcgaaattatgatccccaagggaaccggcgatattctggttgactgttctgggggacagcaacactttctcaaggataacctgatcgacctgggctgccctaaaattcccctcctggggaagatggcgatctatatttgtcgcatgtccaatcatcctaaaacgaccatggctttcctgttttggttcagctttggatacgtgatcacatgcatcctgtgcaaggccattttctatctcctgatcattatcggcacccttggcaaaagatttaagcagtaccgggagctgaagccccagacatgtaccatttgcgagacgacacctgtcaacgccatcgatgctgaaatgcacgacctcaattgttcttataacatctgcccgtactgtgcctcccgcctgaccagcgatgggctggctagacatgtgacacagtgccccaaacggaaggagaaagttgaagagaccgaactctacctgaatcttgagcgcattccttgggtggtcagaaagctgctccaagtgtctgagtccaccggagtggccctgaaacggagctcctggcttatcgtcctgctcgttctgttcacagtgtctctgagccccgtgcagtccgcgcctattggccgcaagcccctctttctggacagcatcgtcaaagggatgaagaaccttcttaattctacgtccctcgaaaccagcctgtctattgaggccccgtggggagctatcaacgtgcagagcacatataagcctaccgtttccacagccaatatcgctctttcttggagctccgtggaacacagaggcaacaaaattctggtcagcgggcggtctgagtccatcatgaagctcgaagagagaaccggaattagctgggacctgggcgtggaggatgcctctgaatccaaactgctcacggttagcgtgatggacctgtcccagatgtactctcccgtcttcgagtatcttagcggcgatcgccaagtggaagagtggcctaaggcgacatgtaccggggactgccccgaacggtgtggatgcacctcctctacatgtctgcacaaagagtggccccatagcagaaattggcgctgcaaccctacctggtgctggggcgtcgggacaggatgtacgtgctgtggcctcgatgtgaaggacctgtttaccgattacatgttcgttaagtggaaagtggagtatatcaagacagaagccattgtctgcgtggagctgacctcccaggaacggcagtgtagccttatcgaggctgggacaagatttaacctcggcccggttaccattacgctgtctgagccccgcaatatccaacagaaactgcctcccgaaatcattaccctccaccctcggatcgaggaaggattcttcgacctgatgcatgtgcagaaggtcctttccgccagcacagtgtgcaaactgcagtcttgtacccacggcgtgcccggggatctccaagtttaccacattggaaacctgctgaagggcgacaaggtcaatgggcatcttatccacaaaattgagccgcattttaacacatcctggatgagctgggatggatgcgacctcgactattactgtaatatgggcgattggccttcttgcacctacacgggggtgacacagcacaaccatgctagcttcgtgaatctgctgaacatcgaaaccgactatacaaagaattttcacttccactccaaaagagtcaccgcccatggcgatacaccccagctcgacctgaaggcccgccctacctacggagctggcgagatcacggtgcttgttgaggtggcggatatggaactgcacaccaaaaagattgagatcagcgggctcaagtttgcctctctgacatgtaccggatgctatgcttgctccagcggcatttcctgtaaagtccggatccatgtggacgaacccgatgagctgacagttcacgtgaagtctgacgatcctgacgtcgtggccgccagctcctctcttatggctagaaaactcgagttcgggaccgatagcacgtttaaggccttctccgcgatgcccaaaacatctctgtgcttttacattgttgaacgcgagcactgtaagagctgctccgaagaggacaccaaaaagtgtgtgaacaccaagctggaacagccgcaaagcatcctcatcgagcataaaggaacaattatcggcaagcaaaattctacctgcacagctaaagcctcctgttggctggaaagcgtcaagtctttcttttatgggcttaaaaacatgctgtccggcattttcggaaatgtgtttatcggcattttcctcttcctggggccttttatcctgcttatcctcttctttatgttcggatggcggattctgttttgcttcaagtgttgcagacggacgcgcggcctgctcaagtacagacacctgaaagaggatgaggaaaccgggtatcggagaatcattgagcgccttaacaataagaaaggaaagaacaaactgctcgacggcgaacggctggccgacagacgcatcgctgagctgtttagcacaaagacccatattggg

SEQ ID NO: 13863 - RNA, 2916 nt, synthetic construct
  misc_feature 1..2916: note = derived and/or modified CDS sequence (opt5) from CCHFV(ROS/HUVLV-100, Artificial)__DQ206448.1__Gn-4aa-Gc
  source 1..2916: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacagctcctgcgaggtgatgattcccaagggaacgggcgatatcctggttgactgtagcgggggacagcaacacttcctcaaagataacctgattgacctgggctgccctcatatccccctcctggggaagatggcgatttacatctgtcggatgtctaatcaccctcgcaccacaatggcttttcttttctggttttccttcggatatgtgattacctgcatcttttgcaaagccctgttctacagcctcatcattatcggcacactgggcaagaaaattaagcagtatagagaacttaagccccagacctgtacgatctgcgagacagcccctgtcaacgctattgatgccgagatgcatgacctgaattgttcttacaacatctgcccgtattgtgcttcccggctcaccagcgacgggctggcccgccacgtgccccagtgccctaaaagaaaggaaaaagttgaggaaacagagctgtacctcaatctggaacggatcccctggattgtgcgcaagctgctgcaagtctctgagtccaccggagtggcgctcaaaagaagctcctggctgatcgtgcttctggtcctcctgaccgtttctctgagccctgtgcagtccgcccccgtgggccggaagccgctctttctggatagcattgtcaaagggatgaagaaccttcttaattctacatccctcgagacgagcctgtctatcgaagctccttggggagccattaacgtgcagagcaccttcaagcccacagtttccaccgctaatatcgccctttcttggagctccgtggagcaccgcggcaacaaaatcctggtcacagggagaagcgaatctattatgaagctcgaggaacggaccggagtgtcctgggacctgggcgttgaggatgcgagcgagtctaaactgctcacggtgtccatcatggacctgagccagatgtactcccctgtctttgaatatctttctggcgatagacaagtggaggaatggcccaaggccacatgtaccggggactgccccgagcgctgtggatgcaccagctccacatgtctgcataaagaatggcctcactctcggaattggagatgcaacccgacctggtgctggggcgtcgggacaggatgtacgtgctgtggcgtggatgttaaggacctcttcaccgatcatatgtttgtgaagtggaaagtcgagtacattaagacagaggctatcgtgtgcgttgaactgaccagccaggagcgccagtgttccctgattgaagccgggacacggttcaaccttggccccgtgaccatcacgctcagcgagcctagaaatattcaacagaaactgccccctgagatcatcaccctgcaccccaaggtcgaagagggattctttgacctcatgcacgtgcagaaagtgctgtctgcttccacagtttgcaaacttcagagctgtacccatggcattccgggggatctgcaagtctatcacatcggaaacctcctgaagggcgaccgcgtgaatgggcatctgattcacaaaatcgaacctcatttcaacacatcttggatgtcctgggacggatgcgatcttgactactattgtaatatgggcgattggcccagctgcacctacacgggggtgacacagcacaaccacgccgcctttgtcaatctcctgaacattgagaccgactatacaaagaccttccattttcactctaaacgggtgaccgctcatggcgatacacctcagctggacctcaaggcgagacccacgtacggagccggcgaaatcaccgttctggtggaggtcgctgatatggagcttcacacaaagaaggtggaaatcagcgggctgaagttcgcctccctcgcctgtaccggatgctacgcttgcagctctggcatttcctgtaaagttcgcatccacgtggacgagcctgatgaactgacagtccatgttaagagctccgaccccgatgtggtggccgcgtctaccagcctgatggctcggaaacttgagtttgggacggactccacattcaaggccttttctgccatgccgaaaaccagcctctgcttctatattgtcgaaagagagtactgtaagtcctgctctgaggaagatacccagaaatgtgtggacacaaagctggagcaacctcagagcatcctgattgaacacaagggaaccatcatcggcaaacagaatgacacatgcacggctaaggcctcctgttggctcgagagcgtgaaatcctttttctatgggctgaagaacatgcttggctctgtctttggaaatttcttcattggcatcctgctctttctggctcccttcgttctgcttgtgctctttttcatgtttgggtggaaaattctgttctgctttaagtgttgccgccggaccagaggactgctcaagtaccggctgcttaaagatgacgaagagacaggctatcgcagaatcattgagcggctgaacaataagaaagggaagaacagactcctggatggagaacgcctggccgaccggaaaatcgcggagcttttcagcaccaagacacatatcggc

SEQ ID NO: 13864 - RNA, 2916 nt, synthetic construct
  misc_feature 1..2916: note = derived and/or modified CDS sequence (opt5) from CCHFV(AP92, Artificial)__DQ211625.1__Gn-4aa-Gc
  source 1..2916: mol_type = other RNA
agcgagggcggggacggaggctgcatctccagaacccagctgattaagacagaaacggccgaggtgcacggggatgactacggaggccccggggagaaaatcaccatttgtaacggatctacaatcgtcgatcaacggctcggcagcgagctgggctgctataccattaatcgcatcaagtccttcaaactttgtgaaaactctgctcaggggaagaattgcgagatcgacagcgcccctgttcagtgtagacagggatactgcctgaaaatttcccaagagggccgggggcatgtgaagctctctcgcggaagcgaaatcgtgctggatgtctgtgacacatcctgcgagattatgatcccgaagggcaccggggatattcttgtggactgtagcggaggccagcagcactttctgcagtctaacctcgttgatctgggctgccccaatatccctctgctcgggaaaatggcgatttatatctgtagaatgtccaaccatcccaagacaaccatggctttcctgttttggttcagctttggatacgtgatcacgtgcattctttgcaaaaccctgttctatatcctcattatcattggcacactggggaagaaacttaagcaataccgggaactgaagcctcagacctgtacaatctgcgagtctgtccccgtgaatgccatcgacgccgagatgcacgatctcaactgttcctataatatttgcccttactgtgctagccgcctgacctctgaaggactgacgagacatgttaaccagtgcccgaaacggaaggagaaagtggaagagacagaactctacctgaatcttgagcgcatcccctggattgtcagaaagctgctccaggtgtccgagagcaccggcgtggccctgaaacggtcctcttggatgatcgtccttctgattctcctgatcgttagcatgtcccctgtgcaaagcgctcccatctctcgcaagcctctgtttctcgactccattgccaaaggggtgaagaacctgcttaatagcacatctctggaaaccagcctctccatcgaggcgccctggggagccattaacgctcagtctacctataagccgacagccagctccgctaatatcgccctgacgtggagctctgtcgaacacagaggcaacaaaattcttgtgtccggccggagcgagtctatcatgaagctggaagaacgcaccgggatttcctggaacctcggagttgaggatgcgagcgaatccagaacactgaccatctctgtgatggacctgagccagatgtactcccctgtcttcgagtatctctctggcgaccggcaagtggaagagtggcccaaagccacatgtaccgggaattgccctgaaagatgtggatgcacgagctccacatgtctgtacaaggagtggccccacagccgcaactggcggtgcaatcccacctggtgctggggcgttgggaccggctgtacatgctgtggacttgatgtgaaagagctgtttaccgaccatatgctcgtcaagtggaaggtggaatatatcaaaacagaggctattgtctgcgtggaactgacgtctcaggagagacagtgttccctgatcgaggccggcacccgcttcagccttgggcctgttacaattaccctctctgaaccgcggaacatccagcaaaagctgccccctgagctgattacactccaccccaaaatcgaagatggatactttgacctgatgcatgtgcagaaggtcatgtccgctagcaccgtgtgcaaacttcagtcttgtacgcacggcgttcctggggatctgcagatctatcacgtgggaaatctcctgaagggcgacagagtcaacgggcatctgattcacaaggtggagccccatcttaataccagctggatgtcctgggatggctgcgacctcgattacttctgtaacatgggagactggccgagctgcacatacaccggcgtgacacaacacaatcatgccgcctttgctaacctgctgaatatcgaaaccgattatacgaaaacattccacttccactctaagcgcgttaccgcgcatggggacacacctcagctcgacctgaaagcccggcccagatacggagctggcgagattaccgtccttgtggaggtggccgatatggaactgcacaccaagaaagtcgaggtgacagggctcaagtttgcctccctgacgtgtagcggatgctatgcttgctcctctggcatcagctgtaaggttcgcattcatgtggacgaacctgatgagctgaccgtccacgtgaaatcctctgaccccgatatcgttgccgcgagctcctctcttatggctcggaagatcgaatttggggtggacagcacatttaaagccttctccagcatgcctaaggattctctctgcttttacattgtcgagagagactattgtaactcctgcaaaaatgaggaaacccagcgctgtgtgaacgccaagctggagcagccccaaagcatcctgattgaacacacaggcaccatcattggaaaacagaatgatacgtgcggctctcggacatcctgttggctcgacagcttcaagtctttcttctacgggctgaagtccatgcttagcggaatctttggcaacgttttcctggggatctttctcttcctggctccgtttgccctgcttctcttcttctttttctttggatggcggattctgttctgctttaaatgttgcagacgcaccagaggcctgttcaagtatcggcatatcaaagatgacgaggaagtggggtacaagaaaattatcgagagactcaacaataagaagggcaaacaccgcctgcttgatggagagcggctggctgacagaaagattgccgaactcttttccaccaaaacacatatcggc

SEQ ID NO: 13865 - RNA, 2916 nt, synthetic construct
  misc_feature 1..2916: note = derived and/or modified CDS sequence (opt5) from CCHFV(ArD8194, Artificial)__DQ211626.1__Gn-4aa-Gc
  source 1..2916: mol_type = other RNA
gccgagggcgggagcaacgactgcgtgtccagaacccagcttgtcaagacagaagttgctgagatccacgaagattcttacggaggccccggggagaaaattacgatctgtaatggaagcaccattgtggaccaacggctcggctccgaactggggtgctatacaatcaaccgcgtgagaacctacaagctctgtgaaaattctgccacagagaaaagctgcgaaattgattccgtccctgtgaagtgtaaacagggattctgcctgaagatcacccaggagggccggggccatgttaagctctctcgcgggacagaaatcgtgctggacgtctgtgataccagctgcgagcttatgattccgaaaggaacgggcgacatcctggtggattgttccgggggacagcaacactttctccaggacaacctgattgatctgggctgccccaatatccctctcctggggagaaccgcgatttatgtttgtcggatgagcaaccatcccaagacaaccatggctttcctgttttggttctcttttggatacgtgatcacatgcgtcgtgtgcaaagtgctgttctatctcctgattgtcatcggcacccttggcaagcgcctgaaacagtacagagagctcaagcctcagacgtgtatcgtttgcgaatccattcccgtgaatgccatcgacgccgagatgcacgatctgaactgtaattataacatttgcccttactgtgctagccggctgacatctgacgggctcgtgcgccatgtcacccaatgcccgaagagaaaagaaaaggtggaggaaacagagctgtaccttaatctggagcggatcccctggctcgttcgcaaactgcttcaggtgtccgaaagcaccggagtcgccctgaagagatcttgttggatgattaccctcctgatcctgctcacagtgtccatgagccctgttcagtccgctcccgtgggccggaaacctctgtttcttgatcgcatcgccaaggggatgaaatctctgctcaacagcacgtccctggagaccagcctttctattgaagcgccctggggagccatcaatgtccagtccacattcaagccgaccgtgagcgctgccaacattgctctgtcttggagctccgtcgagcacaagggcaataaaatcctcgtgtctgggagaagcgaatccattatgaagctggaggagcggacaggaatcagctggtgcctgggcgttgaagacgcctctgagtccaaaaccctcacggtgagcgtcatggacctgtctcaaatgtattcccctgtgtttgaataccttagcggcgatagacaggttgaggaatggcccaaggcgacatgtaccggggactgccctgagcgctgtggatgcacctcctctacatgcctgcacaaagagtggccccatagccggaactggagatgtaaccccacctggtgctggggcgtggggacaggatgtacgtgctgtggcctcgatgtcaaggacctgttcaccgattatatgctggtgaagtggaaagtggaatacatcaagacagaggccattatctgcgttgaacttacctcccaggagcgccaatgttctctcattgaggctgggacacggtttaatctgggccctgtcaccatcacgctgagcgaaccgagaaacgtgcagcagcgccttccccctgagattatcaccctgcaccccaaaattgaagagggattctttgaccttatgcatgtgcagaaggtcatgtccgccagcacagtgtgcaaactgcaatcttgtacccacggcgttcctggggatctccaggtgtatcacgtcggaaatctgctgaagggcgacaaggtgaacgggcattccatccacaaaatcgaaagccatcttaatacatcttggatgtcctgggatggatgcgacctcgattacttctgtaacatgggcgactggcccagctgcacctatacgggggttacacagcacaatcatgctgccttcattaacatgctgaatatcgagaccgactacacaaagacctttcacttccactctaaacgggtgaccgcccatggcgatacaccgcagctggacctcaaggctagacctgcgtacggagccggcgagattacggtcctggtggaagttgctgatcttgagctgcacaccaaaaagatcgaagtgagcgggctcaagtttgcctccctgagctgctctggatgttatgcctgctccagcggcatttcctgtaaagtccgcatccatgtgaacgagcccgacgagttcacagtgcacgtcaagtctaatgatcctgacgttgtggctgccgggagctccctgatggcgcggaaaatcgagtctggagctgatagcacctttaaggccttctcctctatgcccaaaaacagcctttgcttttacattgtggagagagactattgttccagctgcacagatgacgatacccaaaagtgtgtcgacatcaaactcgaacaccctcagtctattctgatcgagcataagggcacgattatcgggaagcagaatgatacatgccccaccaaaacctcctgttggctggaaagcatcaagtctttcttttacggcctcaaaaacatgctgtccggaattttcggcaatgtgtttcttgggatgcttctcttcctggccccgtttatcctgcttattctcttcttctttttcggatggcgcctgctgttttgcctcaagtgttgccggagaacacggaaactgcttaagtataagcatctgcgcgacgaggaagagagcggctacaaaaagatcattgagagactcaacgacaaaaaggggaaatctcggctgttcgatggagaaagactggctgaccgcaagatcgccgagctgttttccaccaagacacacatcggc

SEQ ID NO: 13866 - RNA, 2916 nt, synthetic construct
  misc_feature 1..2916: note = derived and/or modified CDS sequence (opt5) from CCHFV(ArD15786, Artificial)__DQ211627.1__Gn-4aa-Gc
  source 1..2916: mol_type = other RNA
gccgagggcgggagcaacgactgcgtgtccagaacccagctggtcaagacagaagttacggagatccacgaagattcttacggaggccccggggagaaaattaccatctgtaatggaagcacaattgtggaccaacggctcggctccgaactggggtgctataccatcaaccgcgtgagaacatacaagctctgtgagaatagcgctaccgagaaaagctgcgaaattgattccgtccctgtgaagtgtaaacagggattctgcctgaagatcacacaggagggccggggccatgttaagctctctcgcgggaccgaaatcgtgctggacgtctgtgatacgagctgcgagcttatgattccgaaaggaaccggcgacatcctggtggattgttccgggggacagcaacactttctccaggacaacctgattgatctgggctgccccaatatccctctcctggggcagacagccatttatgtttgtagaatgagcaaccatcccaagaccacaatggcgttcctgttttggttctcttttggatacgtgattacctgcgtcgtgtgcaaagtgcttttctatctcctgattgtcatcggcacgcttggcaagcggctgaaacagtaccgcgagctcaagcctcaaacatgtatcgtttgcgaatccattcccgtgaatgctatcgacgccgagatgcacgatctgaactgtaattataacatttgcccttactgtgccagcagactgacctctgacgggctcgtgcggcatgtcacacagtgcccgaagcgcaaagaaaaggtggaggaaaccgagctgtaccttaatctggagagaatcccctggctcgttcggaaactgcttcaggtgtccgaaagcaccggagtcgctctgaagcgctcttgttggattatcacactcctgatcctgctcacggtgtccatgagccctgttcagtccgcccccgtgggcagaaaacctctgtctcttgatagcattgctaaggggatgaaatccctgctcaacagcacctctctggagacatcccttagcatcgaagccccctggggagcgattaatgtccaatctacctttaagccgacaatcagcgccgctaacattgccctgtcctggtctagcgtggagcacaagggcaataaaatcctcgtctccgggcggagcgaatctatcatgaagctggaggagcgcaccggaatttcctggtgcctgggcgtggaagacgctagcgagtctaaaacgctcacagtttccgtgatggacctgagccagatgtattcccctgtcttcgaatacctttctggcgatagacaggtggaggaatggcccaaggccacctgtaccggggactgccctgagcggtgtggatgcacaagctctacctgcctgcacaaagagtggccccattccagaaactggcgctgtaaccccacatggtgctggggcgttgggacgggatgtacctgctgtggcctcgatgtgaaggacctgtttacagattatatgctggtcaagtggaaagtggaatacatcaagaccgaggcgattatctgcgtggaacttacaagccaagagcggcagtgttccctcattgaggccgggaccagattcaatctgggccctgttacgatcaccctgagcgaaccgcgcaacgtccagcagcggcttccccctgagattatcacactgcaccccaaaatcgaagagggatttttcgaccttatgcatgtgcaaaaggtgatgtctgcttccaccgtctgcaaactgcagagctgtacacacggcgtgcctggggatctccaggtttatcacgtgggaaatctgctgaagggcgacaaggtcaacgggcattctattcacaaaatcgaatcccatcttaataccagctggatgtcttgggatggatgcgacctcgattacttttgtaacatgggcgactggcccagctgcacgtatacaggggtgacccagcacaatagagccgctttcattaacatgctgaatatcgagacagactacaccaagaccttccattttcactccaaacgcgttacagcccacggcgatacgccgcaactggacctcaaggcccggcctacctacggagctggcgagattacagtgctggtcgaagtggcggatcttgagctgcataccaaaaagatcgaagttagcgggctcaagttcgcctctctgacatgctccggatgttatgcttgcagctccggcatctcttgtaaagtgagaatccacgtcaacgagcccgacgaatttaccgtgcatgtgaagtctaatgatcctgacgtcgttgccgccgggtcctctctgatggctcgcaaaatcgagagcggagccgattccacgttcaaggcgttttctagcatgcccaaaaactccctttgcttctacattgtggagcgggactattgtagctcttgcacagatgacgatacccagaagtgtgtggacatcaaactcgaacaccctcagtccattctgatcgagcacaagggcaccatcattgggaagcagaatgatacatgccccaccaaaacaagctgttggctggaatctatcaagtcctttttctacggcctcaaaaacatgctgagcggaatttttggcaatatcttccttgggatgctgctctttctggctccgttcgtcctgcttattctctttttcttctttggatggagactgctgttctgcctcaagtgttgccgccggacgagaaaactgcttaagtataagcatctgcgggacgaggaagagtctggctacaaaaagatcatcgagcgcctcaacgacaaaaaggggaaatccagactgtttgatggagaacggctggccgacagaaagattgccgagcttttcagcaccaagacacacgtgggc

SEQ ID NO: 13867 - RNA, 2916 nt, synthetic construct
  misc_feature 1..2916: note = derived and/or modified CDS sequence (opt5) from CCHFV(ArD39554, Artificial)__DQ211628.1__Gn-4aa-Gc
  source 1..2916: mol_type = other RNA
agcgagtccaacaataacgactgcgtgtctagaacccagctgatcaagacagaaaatgccgagattcacggcgatgactacgggggacccggcgaaaagatcacgatttgtaacgggagcaccatcgtcgagcaacggctcggatccgaactgggctgctatacaattaatcgcatcaagtctttcaaactttgtgagaacagcgcttccgggaagggatgcgagatcgattctacccctgttaaatgtaagcagggcttttgcctgaagattacacaggaaggcagagggcatgtgaaactcagccggggatccgagatcattctggacgtgtgtgatagctcttgcgaaatgatgatcccgaagggctccggggacattcttgtcgattgtagcggaggccagcaacacttcctgcaggacaatctcgtggatctggggtgccccaacgttcctctgctcggaaaaatggccatctacatttgtcgcatgtctaatcatcccaagaccacaatggcgtttctgttctggttttccttcggctatgtgattacctgcatcttttgcaaagtcatcttctacgtgcttatcattatcggcacgctggggaagagaattaagcagtatcgggagctcaaacctcagacctgtacaatctgcgaggctacccccgttaacgccatcgacgccgaaatgcacgatctgaattgtagctacaacatttgcccttattgtgcttctcgccttacatccgagggactggtgagacatgtcacccaatgcccgaagcggaaagaaaagatcgaggaaacggagctctacctgaatctggagcgcattccctggtttgtgagaaaactccttcaggtgagcgaatccacaggcgtcgccctgaagcggtctagctggctggttaccctcctggtgcttctgacagtgtccctcagccctgtccagtctgctcccatcgggcgcaaacctctgttcctggactccaccgccaagagcatgaagtctctcctgaacagcacctcccttgagacatctctgagcattgaagcgccctggggagccatcaatgtgcagtccacgtttaaaccgaccgctagcacagccaacatcgctctctcttggtccagcgttgagcacagaggcaacaagattctggtgaccgggcggtctgaatccatcatgaaacttgaggagcgcacaggaattagctggaatctgggcgtcgaagatgcctccgagtctaagaccctcacggtgagcgttatggacctgtcccaaatgtactctacagtgttcgaatatctgagcggcgacagacaggtcgaggaatggcctaaagcgacctgtaccggggattgccccgagcggtgtggatgcacatccagcacctgtctccacaaggcctggcctcattctagaaactggcgctgcaatcccacatggtgctggggcgtggggacgggatgtacctgctgtggcctggacgtcaagaacctttttacagattacatgctgatcaaatggaaggtggagttcattaaaaccgaagctatcgtttgcgtggagctcacatcccaggaacggcaatgtagcctgattgaggccgggaccagattcaatctgggccccgtcacgatcaccctttctgagcctcgcaacatccagcagaagctcccgcccgaactggtgacactgcaccctcgggttgaggaaggatttttcgacctcatgcatgtgcagaaagtcctgtccgctagcaccgtgtgcaaacttcaatcttgtacacacggcgtgcccggggatctgcaggtttatcacgtcggaaatctcctgaagggcgacaaaattaacgggaatagctttcataagatcgagcctaacctgaatacctcctggatgagctgggatggatgcgaccttgattactattgtaacatgggcgactggccctcttgcacgtacacaggggtgacccagcacaatcatgccgccttcgtgaacctcctgaatattgaaacagattataccaaaaactttcacttccattccaagagagtcaccgctcacggcgagacaccgcagctggacctcaaagcgcgccctaagtacggagccggcgaggtgacggttctggtggaagtcgctgacatggagcttcacaccaagaaaatcgaaattagcgggctgaagtttgcctccctcacatgtaccggatgctacgcctgctctagcggcatctcctgtaaagtgcggctgcatgttgatgagcccgacgaactgacagtgcacgtcaagtctgatgaccctgatgtggttgctgccagctcctctcttatggcgagaaaaatcgagttcgggaccgacagcacgtttaaggctttctccagcatgcccaaagataagctctgcttttatattgtggagcgcgactactgttcttcctgcagcaaggaagatacacaaaaatgtgtcaacgccaagctggagcagcctcagtctatcctgattgaacataaaggaaccatcattggcaagcagaatgatacctgcacagtgaaagcctcctgttggctcgagagcgtgaagtctttcttttatgggctgaagaacatgcttggcggaatcttcggcaatgtcatcctggggattatcatgttcctcgctccctttgccctgctgcttctcttctttctgttcggatggcggattctgttttgcctcagatgttgccgccggaccagaggcctgttcaaatacaagcacatcaaagacgacgaagagtccgggtataagcggattatcgagcgccttaacaataaaaagggaaagaacaaactgtttgatggcgaaagactcgctgacaagaaaatcgccgagctgttcagcacaaagacgcacattggg

SEQ ID NO: 13868 - RNA, 2916 nt, synthetic construct
  misc_feature 1..2916: note = derived and/or modified CDS sequence (opt5) from CCHFV(C-68031, Artificial)__DQ211629.1__Gn-4aa-Gc
  source 1..2916: mol_type = other RNA
agcgaggaatccggcgacgattgcatctctagaacccagctgagccggacagagacggccgaaattcactccgacaactacgggggacccggcgataagatcaccatttgtaatgggtctacaatcgtggaccaacgcctcggaagcgagctgggctgctataccattaacagagtcaaatccttcaagctgtgtgaaaattctgctacagggaaaagctgcgagatcgattccacccctatcaagtgtcggcagggattttgcctgaaaattacacaggagggccgcggccatgttaagctcagcagagggtctgaagtggtgctggacgcctgtgattccagctgcgagatcatgattccgaagggaaccggcgacatccttgtcgattgttctgggggacagcaacacttcctgaaagacaacctcattgatctgggctgccccaatatccctctgctcgggaagatggcgatttacatctgtcggatgtccaaccatcccaaaacgaccatggcttttctgttctggtttagcttcggatatgtgatcacatgcattctttgcaaggttatcttttacctgctcattgtggtcggcaccctgggcaaaaagttcaagcagtatcgcgaacttaaacctcagacatgtaccatctgcgagacgacacccgtgaatgccattgacgccgagatgcacgatctgaactgttcttacaatatctgcccttattgtgcttccagactcaccagcgacgggctggcccggcatgttatgcagtgcccgaagcgcaaagaaaaggtggaggaaacagagctgtacctcaacctggaaagaatcccctgggtcgtgcggaaacttctgcaagtgtccgagtctaccggagtcgctctcaagcgcagctcctggctggttgtgcttctggtgctcctgaccgtcagcctgtctcctgtgcagtccgcccccattggcagaaaacctctctttagcgactctatcgttaaggggatgaagaatctgcttaacagcacatccctggagacgtctctcagcattgaagcgccctggggagccatcaatgtgcagtccaccttcaaaccgacagtcagcgctgccaacattgctctgtcttggtccagcgtggagcaccggggcaataagatccttgtttctgggcgctccgaaagcatcatgaaactggaggaaagaaccggaatttcctgggatctcggcgtggaggacgcctctgagagcaagctgctgacagtctccatcatggatctctctcagatgtacagccctgtgtttgaatatctgtccggcgaccggcaagtcgaggaatggcccaaagcgacctgtacgggggattgccctgagagatgtggatgcacaagctctacctgtcttcacaaggaatggccccattcccgcaactggcggtgcaaccccacctggtgctggggcgtggggacaggatgtacctgctgtggcctggacgttaaggatctcttcacagactacatgtttgtgaaatggaaggtcgagtatattaaaacggaggccatcgtgtgcgttgaactgaccagccaggagagacagtgttctctgattgaagctgggacacgcttcaatcttggccctgtgaccatcacactctccgagccgcggaacattcaacagaagctgccccctgagatcgtcaccctgcaccccagaatcgaagagggattctttgatctcatgcatgtgaaaaaggtgctgagcgcctctacggtttgcaaacttcagagctgtacccacggcgtccctggggaccttcaggtgtaccacattggaaatctcctgaagggcgataaggtgaacgggcatctgatccacaaaattgaaccccatttcaatacatcctggatgagctgggacggatgcgaccttgattattactgtaacatgggcgactggccgtcttgctcctataccggggtcacacaacacaatcatgctgcctttgtgaacatgctcaatatcgagaccgattacacgaagattttccactttcacagcaaacgcgttacagcccatggcgacacccctcagctggatctgaaggctcggcccacatacggagcgggcgaaatcaccgtgctcgtcgaggtggccgacatggagctgcacaccaagaaaatcgaaatttccgggcttaagttcgcttctctgacatgtacgggatgctatgcctgcagctccggcatctcttgtaaagttcgcattcatgtggatgagcctgacgaactcaccgtccacgttaagagcgaggatcccgacatcgtggccgcttcctctagcctgatggccagaaaactggaatttgggacagattccaccttcaaggcgtttagcgctatgcctaaaacatctctttgcttctacattgtggagcgggagtattgtaagtcctgcagcaaggaagacacccagaaatgtgtcaacacgaagctcgagcagccccaatctatcctgatcgaacacaaaggaacaattatcggcaagcagaatgatacctgcacctccaaagccgggtgttggctggagagcgtgaagtcctttttctacggcctcaagaacatgctgtctggaatttttggcaatgtgttcatcgggattttcctttttctggccccgttcatcctcctgatcctgtttttcatgtttggatggcgcattcttttctgctttaaatgttgcagacggacaagaggcctcttcaagtatcggcatctgaaagacgacgaagagaccgggtaccgcaagatcattgagagactgaacaataaaaagggaaagaacaaactcctggatggcgaacggcttgctgacagaaagatcgccgagctgtttagcacaaaaacgcacattggg

SEQ ID NO: 13869 - RNA, 2916 nt, synthetic construct
  misc_feature 1..2916: note = derived and/or modified CDS sequence (opt5) from CCHFV(Drosdov, Artificial)__DQ211630.1__Gn-4aa-Gc
  source 1..2916: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgcctgtgacagctcctgcgaggtgatgattcccaaaggaacgggcgatatcctggttgactgtagcgggggacagcaacacttcctcaaggataacctgattgacctgggctgccctcatatccccctcctggggaaaatggcgatttacatctgtagaatgtctaatcaccctcggaccacaatggcttttcttttctggttttccttcggatatgtgattacctgcatcttttgcaaggccctgttctacagcctcatcattatcggcacactgggcaaaaagattaagcagtatcgcgaacttaaaccccagacctgtacgatctgcgagacagcccctgtcaacgctattgatgccgagatgcatgacctgaagtgttcttacaatatctgcccgtattgtgcttccagactcaccagcgacgggctggcccggcacgtgacacagtgccccaaacgcaaggaaaaagttgaggaaaccgagctgtacctcaacctggaaagaatcccttggattgtgcggaaacttctgcaagtctctgagtccaccggagtggcgctcaaacgcagctcctggctgatcgtgcttctggtcctcctgacagtttctctgagccccgtgcagtccgcccctgtgggcagaaagcccctctttctggatagcacggtcaaggggatgaaaaatcttctgaactctacctccctcgagacaagcctgtctattgaagctccgtggggagccatcaatgtgcagagcaccttcaagcctacagtttccaccgctaacattgccctttcttggagctccgtggagcaccggggcaataaaatcctggtcacggggcgcagcgaatctatcatgaagctcgaggaaagaacaggagtgtcctgggacctgggcgttgaggatgcgagcgagtctaaactgctcaccgtgtccattatggacctgagccagatgtactcccccgtctttgaatatctttctggcgatcggcaagtggaggaatggcctaaggccacctgtacaggggactgccccgagagatgtggatgcaccagctccacatgtctgcataaggaatggccccactctcgcaactggcggtgcaatcctacgtggtgctggggcgtcgggaccggatgtacatgctgtggcgtggatgttaaagacctcttcaccgatcatatgtttgtgaagtggaaagtcgagtacatgaagacagaggctatcgtgtgcgttgaactgaccagccaggagagacagtgttccctgattgaagccgggacgcgcttcaaccttggcccggtgaccatcacactcagcgagccccggaacattcaacagaaactgcctcccgagatcattaccctgcaccctaagatcgaagagggattctttgacctcatgcacgtccagaaggtgctgtctgcttccacagtgtgcaaacttcagagctgtacccatggcatccccggggatctgcaaatttatcacatcggaaatctcctgaagggcgacagagttaacgggcatctgattcacaaaatcgaaccgcatttcaatacgtcttggatgtcctgggacggatgcgatcttgactactattgtaacatgggcaattggcctagctgcacatacaccggggtcacacagcacaaccacgccgcctttgtgaatctcctgaacattgagaccgattataccaagacattccattttcactctaaacgcgtgacggctcatggcgacacaccccagctggatctcaaggcgcggcctacctacggagccggcgaaatcaccgtcctggtggaggttgctgacatggagcttcacacaaagaaagtggaaatcagcgggctgaagttcgcctccctcgtctgtaccggatgctacgcctgcagctctggcatttcctgtaaagtgagaatccacgttgatgagcccgacgaactgacggtgcatgtcaagagctccgatcctgacgtggttgctgcctctacaagcctgatggcgcgcaaacttgagtttgggaccgattccattttcaaggctttttctgccatgcccaaaaccagcctctgcttctatatcgtggaacgggagtactgtaagtcctgctctgaggacgatacaaagaaatgtgtcgacaccaagctggaacagccgcaaagcattctgatcgagcacaaaggaacaatcattggcaagcagaatgacacgtgcaccgccaaggcttcctgttggctcgaaagcgtgaagtcctttttctatgggctgaagaacatgcttggctctgtgtttggaaatttcttcgtcggcatcctgctctttctggcccctttcgttctgcttgtgctctttttcatgtttgggtggaaaattctgttctgctttaagtgttgcagacgcacacggggactgttcaaatacagacatctcaaggatgacgaggaaaccggctatcggcgcatcattgagagactgaacagcaaaaaggggaagaatcggcttctggatggagagagactcgctgaccgcaaaatcgccgaactgttttctacaaagacccacatcggc

SEQ ID NO: 13870 - RNA, 2916 nt, synthetic construct
  misc_feature 1..2916: note = derived and/or modified CDS sequence (opt5) from CCHFV(Kashmanov, Artificial)__DQ211631.1__Gn-4aa-Gc
  source 1..2916: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacagctcctgcgaggtgatgattcccaagggaacgggcgatatcctggttgactgtagcgggggacagcaacacttcctcaaagataacctgattgacctgggctgccctcatatccccctcctggggaagatggcgatttacatctgtcggatgtctaatcaccctcgcaccacaatggcttttcttttctggttttccttcggatatgtgattacctgcatcttttgcaaagccctgttctacagcctcatcattatcggcacactgggcaagaaaattaagcagtatagagaacttaagccccagacctgtacgatctgcgagacagcccctgtcaacgctattgatgccgagatgcatgacctgaattgttcttacaacatctgcccgtattgtgcttcccggctcaccagcgacgggctggcccgccacgtgccccagtgccctaaaagaaaggaaaaagttgaggaaacagagctgtacctcaatctggaacggatcccctggattgtgcgcaaacttctgcaagtctctgagtccaccggagtggcgctcaaaagaagctcctggctgatcgtgcttctggtcctcctgaccgtttctctgagccctgtgcagtccgcccccgtgggccggaagccgctctttctggatagcattgtcaaagggatgaagaactctcttaattccacaagcctggagacgtctctcagcatcgaagctccttggggagccattaacgtgcagtccaccttcaagcccacagtttctaccgctaatatcgccctgagctggtccagcgtggagcaccgcggcaacaaaatccttgtcacagggagatctgaatccattatgaagctggaggaacggaccggagtgagctgggacctcggcgttgaggatgcgtctgagtccaaactgctgacggtgagcatcatggacctctcccagatgtactctcctgtctttgaatatctgagcggcgatagacaagtggaggaatggcccaaggccacatgtaccggggactgccccgagcgctgtggatgcacctcctctacatgtcttcataaagaatggcctcacagccggaattggagatgcaacccgacctggtgctggggcgtcgggacaggatgtacgtgctgtggcgtggatgttaaggacctgttcaccgatcatatgtttgtgaagtggaaagtcgagtacattaagacagaggctatcgtgtgcgttgaactcacctcccaggagcgccagtgtagcctgattgaagccgggacacggttcaacctgggccccgtgaccatcacgctttctgagcctagaaatattcaacagaaacttccccctgagatcatcaccctgcaccccaaggtcgaagagggattctttgacctgatgcacgtgcagaaagtgctctccgctagcacagtttgcaagctgcagtcttgtacccatggcattccgggggatcttcaagtctatcacatcggaaacctgctcaagggcgaccgcattaatgggcatctgatccacaaaattgaacctcatttcaacacatcctggatgagctgggacggatgcgatctggactactattgtaatatgggcgattggccctcttgcacctacacgggggtgacacagcacaaccacgccgcctttgtgaatcttctcaacatcgagaccgactatacaaagaccttccattttcacagcaaacgggtcaccgctcatggcgatacacctcagctggacctgaaggcgagacccacgtacggagccggcgaaatcaccgtgctcgttgaggtggctgatatggagctgcacacaaagaaggtcgaaatttccgggcttaagttcgccagcctggcctgtaccggatgctacgcttgttcttccggcatcagctgcaaagtgcgcattcacgttgacgagcctgatgaactcacagtgcatgtcaagtcctctgaccccgatgtggttgccgcgagcacctccctgatggctcggaaactggagtttgggacggactctacattcaaggcctttagcgccatgccgaaaacctccctttgcttctatatcgtggaaagagagtactgtaagtcttgcagcgaggaagatacccagaaatgtgtcgacacaaagctcgagcaacctcagtccattctgatcgaacacaagggaaccatcattggcaaacagaatgacacatgcacggctaaggccagctgttggctggagtctgtgaaatcctttttctatgggctcaagaacatgctgggcagcgtgtttggaaatttcttcatcggcattcttctgtttctcgctcccttcgtcctgctggttctctttttcatgtttgggtggaaaatcctcttctgctttaagtgttgccgccggaccagaggactgctgaagtaccggcatctcaaagatgacgaagagacaggctatcgcagaattatcgagcggctgaacaataagaaagggaagaacagacttctggatggagaacgcctcgccgaccggaaaatcgcggagctgttctctaccaagacacacattggc

SEQ ID NO: 13871 - RNA, 2916 nt, synthetic construct
  misc_feature 1..2916: note = derived and/or modified CDS sequence (opt5) from CCHFV(Oman, Artificial)__DQ211632.1__Gn-4aa-Gc
  source 1..2916: mol_type = other RNA
agcgaggaatccggcgaggactgcatctctagaacccagctgctccggacagaaacggccgagattcacggggataactacggaggccccggggacaagatcaccatttgtaatggaagcacaatcgtggatcaacgcctgggctccgaacttgggtgctataccattaacagagtcaaatctttcaagctgtgtgagaatagcgctacaggaaaatcctgcgagatcgacaacacccctgttaagtgtaaacagggcttttgcctcaagatcacacaggaaggccgggggcatgtgaagctgtctcgcgatagcgaggtggtccttgacgcctgtgattccagctgcgaaattatgatcccgaaaggaaccggcgacattctggtggattgttctgggggacagcaacacttcctcaaggacaatctgatcgatctgggctgccccaacattcctctcctggggaaaatggcgatctacatttgtagaatgtccaatcatcccaagacgaccatggcttttcttttctggtttagcttcggatatgttatcacatgcatcctgtgcaaagtgatcttttacctcctgattgtcgtgggcacccttggcaagaagttcaaacagtatcgggagctgaagcctcagacatgtaccatttgcgagacgacacccgttaacgccatcgacgccgaaatgcacgatctcaattgttcttacaacatttgcccttattgtgcttcccgcctgaccagcgacgggctggccagacatgtgatgcagtgcccgaaacggaaggagaaaatcgaagagacagaactctacctgaatcttgagcgcatcccctgggtcgtgagaaagctgctccaagtgtctgagtccaccggagtcgctctgaaacggagctcctggcttattgttctgctcgtgctgctgaccgtgtctctcagccctgtccagtccgcccccatcggccgcaagcctctgtttcttgacagcattgcgaaggggatgaaaaacctgctcaattctacatccctggaaacgagcctttctatcgaggccccctggggagctattaacgtgcagagcaccttcaagccgacagtttccaccgccaatatcgctctgtcttggagctccgtggaacacagaggcaacaaaatcctcgtcagcgggcggtctgagtccattatgaagctggaagagagaacaggaatcagctgggatctgggcgtggaggacgcctctgaatccaaactcctgaccgttagcgtgatggatctttcccagatgtactctcctgtctttgagtatctgagcggcgacagacaagtggaagagtggcccaaggcgacgtgtacaggggattgccctgaacggtgtggatgcacctcctctacctgtctccacaaggagtggccccatagcagaaactggcgctgcaatcccacatggtgctggggcgtcgggaccggatgtacatgctgtggcctggacgtgaaagatctgttcacggactacatgtttgttaagtggaaagtggagtatattaagaccgaagccatcgtctgcgtggagcttacatcccaggaacggcagtgtagcctcattgaggctgggaccagattcaacctgggccctgttacaatcaccctgtctgagccgcgcaatattcaacagaaactgccccctgaaatcgtgacgctccacccccggatcgaggaaggattctttgatcttatgcatgtccagaaggtgctgtccgccagcaccgtgtgcaagctccagtcttgtacacacggcgttcctggggacctgcaagtctaccacattggaaacctgcttaaaggcgataaggtgaatgggcatctcatccacaaagtggagccccatttcaacacctcctggatgagctgggacggatgcgacctggattattactgtaatatgggcgactggccgtcttgcacatataccggggtcacgcagcacaaccatgctgcctttgtgaatctgctcaacattgaaacagattacaccaagaatttccactttcacagcaaaagagttacagcccatggcgacacccctcagctggatcttaaggctcgccccaactacggagcgggcgaggtgaccgtcctggtggaggttgccgacatggaactccacacaaagaaaatcgagatttccgggctgaagttcgctagcctgacgtgtaccggatgctatgcctgttcttccggcatcagctgcaaagtgcggatccatgtcgatgaacctgacgagcttacagtgcacgttaagtccgaagatcccgacattgtggccgcttctagctccctcatggccagaaaactggagtttgggaccgattctacattcaaggcgtttagcgctatgcctaaaacctccctgtgcttctacatcgtcgagcgcgaatattgtaagtcttgcagcaaggaggacacgcagaaatgtgtgaatgccaagctcgaacggccccaatccattctgatcgagcacaaaggaacaattatcggcaagcagaacgatacctgcaccgccaaagctagctgttggcttgaatctgtgaagtcctttttctacgggctgaagaatatgctcagcggcatctttggaaacgtcttcattggcatcttcctgtttctggccccgttcattcttctcatcctgtttttcatgtttgggtggcgcattctgttctgctttaaatgttgccgccggacaagaggactcttcaagtatcggcatctgaaagacgacgaggagaccggctaccgcaagatcatcgaaagacttaacaataaaaaggggaagaacaaactgctcgatggagagcggctggctgacagaaagattgccgaactgttttctacaaaaacgcacatcggc

SEQ ID NO: 13872 - RNA, 2916 nt, synthetic construct
  misc_feature 1..2916: note = derived and/or modified CDS sequence (opt5) from CCHFV(SPU97/85, Artificial)__DQ211633.1__Gn-4aa-Gc
  source 1..2916: mol_type = other RNA
agcgaggaatccgacggcgattgcatctctagaacccagctgctccggacagagacggccgaaattcacagcgacaactacgggggacccggcgataagatcaccatttgtaatgggtccacaatcgtggaccaacgcctgggatctgagcttggctgctataccattaacagagtcaagagcttcaaactgtgtgaaaattccgctacagggaaatcttgcgagatcgatagcacccctgttaagtgtcggcagggattttgcctcaaaatcacacaggagggccgcggccatgtgaagctgtccagagggagcgaaattgtgcttgacgcctgtgattcttcctgcgagatcatgattccgaagggaaccggcgacatcctggtcgattgtagcgggggacagcaacacttcctcaaagacaacctgattgatctgggctgccccaatatccctctcctggggcggatggcgatttacatctgtcgcatgtctaaccatcccaagacgaccatggcttttcttttctggttttccttcggatatgtgatcacatgcattctgtgcaaagttatcttttacctcctgattgtggccggcaccgtcggcaagaaattcaagcagtatagagaacttcggcctcagacatgtaccatctgcgagacgacacccgtgaatgccattgacgctgagatgcacgatctgaactgtagctacaatatctgcccttattgtgcctctcgcctcacctccgacgggctggctagacatgttatgcagtgcccgaagcggaaagaaaagatcgaggaaacagagctgtacctcaacctggaacgcattccctgggtggtcagaaaacttctgcaagtgagcgagtccaccggagtggccctcaagcggtctagctggctgaccgtccttctggttctcctgatcgtgtccctgagccctgtgcagtctgcgcccattggccgcaaacctctctttctggactccatcgtcaaggggaaaaagaatcttctgaacagcacatctctcgagacgagcctgtccattgaagccccctggggagctatcaatgtgcagtctaccttcaagccgacagttagcgccgctaacatcgccctttcctggagctctgtggagcacagaggcaataaaattctggtctccgggcggagcgaatctatcatgaagctcgaggaaagaaccggaatttcctgggatctgggcgtggaggacgcgagcgagtccaaactgctcacagtttctgtgatggatctgagccagatgtactcccctgtctttgaatatctttctggcgaccgccaagtggaggaatggcccaaggccacctgtacgggggattgccctgagcggtgtggatgcacaagctccacctgtctgcacaaagaatggccccatagcagaaactggcgctgcaaccccacctggtgctggggcgtcgggacaggatgtacctgctgtggcctcgacgtgaaggatctgttcacagactacatgtttgttaagtggaaagtggagtatatcaagacggaggctattgtctgcgtggaactgacctctcaggagcggcagtgttcccttatcgaagccgggacaagattcaatctcggccctgttaccattacactgagcgagccgcgcaacatccaacagaaactgccccctgagatcattaccctccacccccggatcgaagagggattctttgatctgatgcatgtgcagaaggtcctttctgcttccacggtgtgcaaactgcagagctgtacccacggcgtgcctggggacctccaagtttaccacattggaaatctgctgaagggcgataaggtcaacgggcatcttatccacaaaattgaaccccatttcaatacatcttggatgagctgggacggatgcgacctcgattattactgtaacatgggcgactggccgtcctgcacctatacaggggtgacccagcacaatcatgccgcctttgtgaacctgctgaatatcgagacggattacacaaagaacttccactttcacagcaaaagagtcaccgctcatggcgacacacctcagctcgatctgaaggcgcgccccacctacggagccggcgaagtgaccgttcttgtggaggtcgctgacatggagctgcacacgaaaaagatcgaaatttctgggctcaagttcgcctccctgagctgtacaggatgctatgcctgctcctctggcatcagctgtaaagtgcggattcatgttgatgagcctgacgaactgaccgtgcacgtcaagtccgaggatcccgacatcgtggctgccgggtctagccttatggcgagaaaactcgaatttggagctgattccacattcaaggccttttctgccatgcctaaaaccagcctgtgcttctacattgttgagcgcgagtattgtaagtcctgcagccgggaagacacacagaaatgtgtgaataccaagctggagagaccccaatctatcctcatcgaacacaagggcacgattatcgggaaacagaacgatacatgcaccgctaaggcctcctgttggctggagagcgtcaaatcctttttctacggccttaagtctatgctgagcggaatttttggcaatgtgttcatcgggattttcctctttatcgctccgttcgtgctgctgatcctctttttcatgtttggatggcggattcttttctgctttaaatgttgccgcagaacccggggcctgttcaagtatagacatctgaaggacgacgaagagacagggtaccgcaaaatcattgagcggctcaacaataagaaaggaaagaacaaactgcttgatggcgaaagactggccgaccgcaagatcgcggagctcttttctaccaagtcccacattggg

SEQ ID NO: 13873 - RNA, 2916 nt, synthetic construct
  misc_feature 1..2916: note = derived and/or modified CDS sequence (opt5) from CCHFV(SPU103/87, Artificial)__DQ211634.1__Gn-4aa-Gc
  source 1..2916: mol_type = other RNA
agcgaggaatcctctgacgattgcatcagcagaacccagctgctccggacagagacggccgaaattcacggcgacaactacgggggacccggcgataagatcaccatttgtaatgggtccacaatcgtggaccaacgcctgggatctgagcttggctgctataccattaacagagtcaaaacattcaagctgtgtgaaaatagcgctaccgggaaatcctgcgagatcgattctgttcctgtgaagtgtcggcagggatactgcctcaaaatcacacaggagggccgcggccatgtgaagctgagcagagggtccgaagtcgtgcttgacgcctgtgataccagctgcgaggttatgattccgaagggaacgggcgacatcctggtggattgttctgggggacagcaacactttctcaaagacaacctgattgatctgggctgccccaagatccctctcctggggaaaatggcgatttatatctgtcggatgtccaatcatcccaagaccacaatggctttcctgttttggttcagctttggatacgtcattacctgcgtgctttgcaaagccatcttctatctcctgatcattgttggcacacttggcaagcgcctgaagcagtacagagaactcaaacctcagacctgtacgatctgcgagacaacccccgtgaacgccattgacgctgagatgcacgatctgaattgttcttataacatctgcccttactgtgcctcccggctgacaagcgacgggctcgctcgccatgtcacccagtgcccgaagagaaaagaaaaggtggaggaaaccgagctgtaccttaatctggaacggattccctgggtggtccgcagactcctgcaagtttctgagtccacaggagtggcccttaaacggagctcctggctgatcgtgctcctggtcctgtttacggtgtctctcagccctgttcagtccgcgcccatcagccgcagacctctgttccttgacaacattgtgaagggcatgaaaaatctgctcaactctacctccctggagacaagcctttctatcgaagccccctggggagctattaatgtccagagcacctataagccgacagtgtccaccgccaacatcgctctgtcttggagctccgttgagcaccgggggaataagattctcgtgagcggcagatctgaatccatcatgaaactggaggaacgcacggggatcagctgggatctgggagtcgaggacgcctctgagtccaagctcctgacagtgagcgtcatggatctttcccagatgtactctcctgtgtttgaatatctgagcggcgaccggcaagttgaggaatggcccaaagcgacctgtaccggcgattgccctgagagatgtgggtgcacatcctctacctgtctccacaaggaatggccccatagccgcaactggcggtgcaaccccacatggtgctggggagtgggcacggggtgtacctgctgtggactggacgtcaaagatctgttcacagactacatgtttgtgaagtggaagattgagtatatcaaaaccgaggccattgtttgcgtggaacttacatcccaggagagacagtgtagcctcatcgaagctggcacccgcttcaatctggggcctgtcacgattaccctgtctgagccgcggaacatccaacagaagctcccctccgagattatcacactgcaccctagaatcgaagagggctttttcgatcttatgcatgtgcagaaagtgctgagcgcctctaccgtttgcaagctccagtcctgtacacacggagtccccggcgacctgcaagtgtaccacattgggaatctgcttaaaggagataaggtgaacggccatctcgtccacaagatcgaacctcatttcaataccagctggatgtcttgggacgggtgcgacctggattattactgtaacatgggagactggcccagctgcacgtacacaggcgtgacccagcacaatcatgcttcctttgttaacctgctcaatattgagacagattataccaaaaacttccactttcacagcaagcgcgtgaccgcccatggggacacaccgcagctggatcttaaagcccggcctacgtacggcgctggagaaatcaccgtcctggtggaggttgcggacatggagctccacacaaagaaaattgaaatctctggcctgaagttcacctccctgacatgtaccgggtgctatgcctgcagctccggaatctcttgtaaggtgcgcattcatgtcgatgagcccgacgaacttacggtgcacgttaaaagcgatgaccctgatgtggtcgctgcctcctctagcctcatggccagaaagctggagtttggcacagactccaccttcaaggctttttctgccatgcccaaaaccagcctgtgcttctacatcgtggaacgggagtattgtaaatcctgcagcgaggaagatacacagaagtgtgtgaataccaaactcgagcaacctcagtctattctgatcgaacacaaggggacaattatcggaaagcagaacaatacgtgcaaagcgagagctggctgttggcttgagtccgtcaagagctttttctacgggctgaaaaacatgctctctggcatctttggaaatgttttcattggcatctttctgttcctggcccccttcattcttctcatcctgtttttcatgtttgggtggcggattctgttctgctttaagtgttgccgcagaacccggggactcttcaaatatagacatctgaaggacgacgaagagacaggctaccgcaagatcatcgagcggcttaacaacaaaaaggggaaaaataagctgctcgatggagaaagactggccgaccgcagaattgctgagctgttttccaccaaaacacacatcggc

SEQ ID NO: 13874 - RNA, 2916 nt, synthetic construct
  misc_feature 1..2916: note = derived and/or modified CDS sequence (opt5) from CCHFV(SPU415/85, Artificial)__DQ211635.1__Gn-4aa-Gc
  source 1..2916: mol_type = other RNA
agcgaggaatccgacggcgattgcatctctagaacccagctgctccggacagagacgaccgaaattcacagcgacaactacgggggacccggcgataagatcacaatttgtaatgggtccaccatcgtggaccaacgcctgggatctgagcttggctgctatacaattaacagagtcaagagcttcaagctgtgtgaaaattccgccaccgggaaatcttgcgagatcgatagcacacctgttaagtgtcggcagggattttgcctcaaaatcacccaggagggccgcggccatgtgaagctgtccagagggagcgaaattgtgcttgacgcttgtgattctaactgcgagatcatgattccgaagggaacgggcgacatcctggtcgattgttccgggggacagcaacacttcctcaaagacaatctgattgatctgggctgccccaacatccctctcctggggaagatggccatttacatctgtcggatgagcaatcatcccaaaaccacaatggcgtttcttttctggttttctttcggatatgtgatcacatgcattctgtgcaaggttatcttttacctcctgattgtggctggcacagtcggcaaaaagttcaagcagtatcgcgaacttagacctcagacctgtacgatctgcgagacaattcccgtgaacgccatcgacgccgagatgcacgatctgaattgttcctacaacatctgcccttattgtgctagccggctcacctctgacgggctggcccgccatgttatgcagtgcccgaaaagaaaggaaaaagtggaggaaacagagctgtacctcaatctggaacggattccctgggtcgtgcgcaaacttctgcaagtgtccgagagcaccggagtcgctctcaaaagatcctcttggctgaccgttcttctggtgctcctgatcgtgagcctgtcccctgtccagagcgcccccattggccggaagcctctctttctggactctatcgtgaaagggatgaagaaccttcttaattccacaagcctcgagacgtctctgagcattgaagcgccctggggagccatcaacgttcagtccaccttcaagccgacagtgtctgctgccaatatcgctcttagctggtccagcgtcgagcaccgcggcaacaaaattctggtgtctgggagatccgaaagcatcatgaagctcgaggaacggaccggaatttcttgggatctgggcgttgaggacgcctccgagagcaaactgctcacagtgtccgtcatggatctgtctcagatgtacagccctgtgtttgaatatctttccggcgacagacaagtcgaggaatggcccaaggcgacctgtacgggggattgccctgagcgctgtggatgcacatctagcacctgtctgcacaaagaatggccccattcccggaactggagatgcaatcccacctggtgctggggcgtggggacaggatgtacctgctgtggcctcgacgttaaggatctgttcacagactacatgtttgtgaagtggaaagtcgagtatatcaagacggaggccattgtgtgcgttgaactgaccagccaggagcgccagtgttctcttatcgaagctgggacacggttcaacctcggccctgtgaccattacactgtccgagccgagaaatatccaacagaaactgccccctgagatcattaccctccacccccgcatcgaagagggattctttgatctgatgcatgtccagcgggtgcttagcgcctctacggtgtgcaagctgcagtcctgtacccacggcgttcctggggacctccaagtctaccacattggaaacctgctgaaaggcgataaggtgaatgggcatcttatccacaagattgaaccccatttcaacacaagctggatgtcttgggacggatgcgacctcgattattactgtaatatgggcgactggccgagctgcacctatacaggggtgacccagcacaaccatgctgcctttgtcaatctgctgaacatcgagacggattacaccaaaaatttccactttcactccaagagagtgaccgcccatggcgacacacctcagctcgatctgaaagctcgccccacctacggagcgggcgaagttaccgtgcttgtcgaggtggccgacatggagctgcacacaaagaaaatcgaaattagcgggctcaagttcgcttctctgacgtgtaccggatgctatgcctgctccagcggcatctcctgtaaggttaaaattcatgtggatgagcctgacgaactgacagtccacgtgaagtctgaggatcccgacatcgttgccgctgggagctcccttatggcccggaaactcgaatttggagcggattctaccttcaaggcttttagcgccatgcctaaaacatccctgtgcttctacattgtggagagagagtattgtaagtcttgcagccgcgaagacacccggaaatgtgtcaacacgaagctggatagaccccagtccatcctcatcgagcacaagggcacaattatcgggaaacaaaataatacctgcaccgccaaggctagctgttggctggaatctgtgaaatcctttttctacggccttaagaacatgctgagcggaatttttggcaacgtgttcatcgggattttcctctttatcgccccgttcgtcctgctgatcctgtttttcatgtttggatggcggattctcttctgctttaaatgttgccgcagaacacggggcctgttcaagtatagacatctgaaggacgacgaggaaaccgggtaccgcaaaatcattgagcggctcaacaataagaaaggaaagaacaaactgcttgatggcgagagactggctgaccgcaagatcgccgaactcttttctacaaagtcccacattggg

SEQ ID NO: 13875 - RNA, 2916 nt, synthetic construct
  misc_feature 1..2916: note = derived and/or modified CDS sequence (opt5) from CCHFV(Turkey200310849, Artificial)__DQ211636.1__Gn-4aa-Gc
  source 1..2916: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgaggttgacagcacaccggtgaagtgtcggcagggattttgcctcaaaatcacccaggagggccgcggccatgtgaagctgtccagagggtctgaagtcgtgcttgatgcctgtgacagctcctgcgaggttatgatccccaagggaacgggcgatattctggtggactgtagcgggggacagcaacacttcctcaaagataacctgatcgacctgggctgccctcatattcccctcctggggaagatggcgatctacatttgtcggatgtctaatcaccctcgcaccacaatggcttttcttttctggttttccttcggatatgtcattacctgcatcagctgcaaagccctgttttactctctcatcatcattggcacactgggcaagaaaatcaagcagtatagagaacttaagccccagacctgtacgatttgcgagacagcccctgtgaacgctatcgatgccgagatgcatgacctgaattgttcctacaacatttgcccgtattgtgctagccggctcacctctgacgggctggcccgccacgttacacagtgccccaaaagaaaggaaaaagtggaggaaaccgagctgtacctcaatctggaacggatcccttggatcgtccgcaagctgctgcaagtgtccgagagcaccggagtggcgctcaaaagatcctcttggctgattgtccttctggttctcctgacagtgagcctgtcccccgtgcagagcgcccctgtcggccggaagcccctcttcctggattctatcgtgaaagggatgaagaaccttcttaattccacgagcctcgagacctctctgagcattgaagctccgtggggagccatcaacgttcagtccacatttaagcctgctgtgtctaccgccaatattgcgcttagctggtccagcgtcgagcaccgcggcaacaaaatcctggtgacagggagatctgaatccatcatgaagctcgaggaacggaccggagttagctgggacctgggcgtggaggatgcctctgagtccaaactgctcacggtcagcattatggacctgtcccagatgtactctcccgtgttcgaatatcttagcggcgatagacaagtcgaggaatggcctaaggctacatgtaccggggactgccccgagcgctgtggatgcacctcctctacatgtctgcataaagaatggccccacagccggaattggagatgcaaccctacctggtgctggggcgtggggacaggatgtacgtgctgtggcgttgatgtgaaggacctctttaccgatcatatgttcgtcaagtggaaagtggagtacatcaagacagaggccattgtttgcgtggaactgacctcccaggagcgccagtgtagcctgatcgaagctgggacacggtttaaccttggcccggtcaccattacgctctctgagcccagaaatatccaacagaaactgcctcccgagattatcaccctgcaccctaagatcgaagagggattcttcgacctcatgcacgtgcagaaagtgctgtccgccagcacagtttgcaaacttcagtcttgtacccatggcattcccggggatctgcaagtctatcacatcggaaacctcctgaagggcgaccgcgtgaatgggcatctgattcacaaaatcgaatcccattttaacacaagctggatgtcttgggacggatgcgatcttgactactattgtaatatgggcgattggccgagctgcacctacacgggggtgacacagcacaaccacgccgctttcgtcaatctcctgaacattgagaccgactatacaaagacctttcatttccactccaaacgggtgaccgcgcatggcgatacacctcagctggacctcaaggccagacccacgtacggagctggcgaaatcaccgttctggtggaggtcgccgatatggagcttcacacaaagaaggtggaaatcagcgggctgaagtttgcctctctcgcttgtaccggatgctacgcctgctccagcggcatttcctgtaaagttcgcatccacgtggacgagcctgatgaactgacagtccatgtgaagtctagcgaccccgatgttgtggcggcttccacctctctgatggcccggaaacttgagttcgggacggacagcacatttaaggccttctccgctatgcctaaaacctctctctgcttttatattgtcgaaagagagtactgtaagagctgctccgaggatgacacccagaaatgtgtggacacacgcctggaacaaccccagagcatcctgattgagcacaagggaaccatcatcggcaagcagaatgatacatgcacggccaaagctagctgttggctcgaatccgtgaagtctttcttttatgggctgaaaaacatgcttggctctgtcttcggaaatctgtttattggcatcctcctgttcctggccccgttcgttcttctcgtgctgtttttcatgtttgggtggaagattctgttctgctttaaatgttgccggagaacccggggactcttcaagtaccgccatctgaaggacgatgaggaaacaggctatagacggatcattgagagacttaactccaaaaaggggaaaaatcgcctgctcgacggagatcggctggcggacagaaagatcgccgagctgtttagcaccaaaacacacatcggc

SEQ ID NO: 13876 - RNA, 2916 nt, synthetic construct
  misc_feature 1..2916: note = derived and/or modified CDS sequence (opt5) from CCHFV(Iran-52, Artificial)__DQ446215.1__Gn-4aa-Gc
  source 1..2916: mol_type = other RNA
agcgaggaatccggcgacgattgcatctctagaacccagctgctccggacagagacggccgaagtgcacggggacaactacggaggccccggggataagattaccatctgtaatggaagcacagtcgttgaccaacgcctgggctccgagcttgggtgctataccattaacagagtgcggtctttcaaactgtgtgaaaatagcgctacaggaaagtcctgcgagatcgattctattcctgtgaaatgtaagcagggctactgcctcaaaatcacccaggagggccgcgggcatgtcaagctgagcagaggatccgaagtggttcttgacgtgtgtgatagctcttgcgaggtcatgatcccgaagggcacaggggacattctggtggattgttccggaggccagcaacactttctcaaagacaacctggttgatctggggtgccccaagatccctctcctgggaaaaatggccatttatatctgtcggatgagcaatcatcccaagaccacgatggcgttcctgttttggttctcttttggctacgtgattacctgcatcctgtgcaaagctattttctttctcctgatcatcttcggcacacttgggaagcgctttaagcagtatagagaactgaaacctcagacctgtacaatttgcgagaccacgcccgtcaacgccatcgacgccgagatgcacgatctcaattgttcctacaacatttgcccttattgtgctagccggctgacatctgacggactggcccgccatgtgacccagtgcccgagacggaaggaaaaagtggaggaaacagagctctacctgaatcttgaacgcatcccctgggtcgttagaaagctgctccaagtgtccgagagcaccggcaccgtgctgaaacggtcctcttggcttattgtcctgctcgtgctgttcacagttagcctgtcccctgtgcagagcgctcccatcgggcgcagacctctctttctggactctatcgtcaagggaatgaaaaaccttcttaattccacgagcctcgagacctctctgagcattgaagccccctggggcgcgatcaacgtgcagtccacatacaagccgaccgtttctacagccaatattgctcttagctggtccagcgtggagcaccgggggaacaaggtcctggtgtctggaagatccgaaagcatcatgaaactcgaggaacgcaccggcatttcttgggatctgggcgtcgaggacgcctccgagagcaagctgctcacggtgtccgttatggatctgtctcagatgtatagccctgtgttcgaatacctttccggggaccggcaagtcgaggaatggcccaaagctacatgtaccggagattgccctgagagatgtggctgcacctctagcacatgtctgcacaaggaatggccccattcccgcaattggcggtgcaaccccacctggtgctggggagtggggacaggctgtacgtgctgtgggctcgacgttaaagatctgtttaccgactatatgttcgtgaagtggaaggtcgagtacatcaaaacagaggccatcgtgtgcgtggaactgaccagccaggagagacagtgttctcttattgaagcgggcacacgcttcaacctcggatccgttaccatcacgctgagcgagcctcggaatattcaacagaagctgccgcccgagatcattaccctccaccctaaaatcgaagagggctttttcgatctgatgcatgtccagaaggtgctttctgcctccacagtgtgcaaactgcagagctgtacccacggggtccccggagacctccaagtgtatcacattggcaacctgctgaagggggatagagttaatggacatcttatccacaagatcgaacagcattttaacacatcttggatgagctgggacggctgcgacctcgattactattgtaatatgggggactggccttcctgcacctacacgggcgtgacacagcacaaccatgctagcttcgtcaatctgctgaacattgagaccgattacacaaaaacctttcacttccactctaagcgcgtgaccgcccatggagacacaccccagctcgatctgaaagctcggccgacgtatggcgccggggaaatcaccgttcttgtggaggtcgccgacatggagctgcacacaaagaaaattgaaatctccggactcaagtttgctggcctgacctgtacagggtgctacgcgtgcagctccggaatttcttgtaaggtgagaatccatgttgaggaacctgatgagctgaccgtgcacgtcaaaagcgacgatcccgacgtggtggccgcttcctctagccttatggcccgcaagctcgagttcggcacggattccacatttaaagccttctctgctatgcctaagaccagcctgtgcttttatatcgtcgagcgggagtactgtaaatcctgcagcaaggaagacacccaaaaatgtgttaatacaaagctggagcagccccagtctattctcatcgaacacaaggggaccattatcggcaaacagaacaatacatgcacggccaaggcgtcctgttggctggagagcgtgaaatctttcttttatggacttaagaacatgctgggcgggattttcggaaatgtgttcatcggcatctttaccttcctcacaccttttattctgctgatccttttctttatgttcgggtggcggattctcttttgcttcaaatgttgcagacgcaccagaggactgtttaagtaccggcatctgaaggatgacgaagagacaggctatagaaaaatcattgagcgcctcaacaataagaaagggaagaaccggctgcttgacggcgaaagactggctgatcgcaaaatcgccgaactcttctccaccaagacgcacatcgga

SEQ ID NO: 13877 - RNA, 2916 nt, synthetic construct
  misc_feature 1..2916: note = derived and/or modified CDS sequence (opt5) from CCHFV(Iran-53, Artificial)__DQ446216.1__Gn-4aa-Gc
  source 1..2916: mol_type = other RNA
agcgaggaatccggcgacgattgcatctctagaacccagctgctccggacagagacggccgaagtgcacggggacaactacggaggccccggggataagattaccatctgtaatggaagcacagtcgttgaccaacgcctgggctccgagcttgggtgctataccattaacagagtgcggtctttcaaactgtgtgaaaatagcgctacaggaaagtcctgcgagatcgattctattcctgtgaaatgtaagcagggctactgcctcaaaatcacccaggagggccgcgggcatgtcaagctgagcagaggatccgaagtggttcttgacgtgtgtgatagctcttgcgaggtcatgatcccgaagggcacaggggacattctggtggattgttccggaggccagcaacactttctcaaagacaacctggttgatctggggtgccccaagatccctctcctgggaaaaatggccatttatatctgtcggatgagcaatcatcccaagaccacgatggcgttcctgttttggttctcttttggctacgtgattacctgcatcctgtgcaaagctattttctttctcctgatcatcttcggcacacttgggaagcgctttaagcagtatagagaactgaaacctcagacctgtacaatttgcgagaccacgcccgtcaacgccatcgacgccgagatgcacgatctcaattgttcctacaacatttgcccttattgtgctagccggctgacatctgacggactggcccgccatgtgacccagtgcccgagacggaaggaaaaagtggaggaaacagagctctacctgaatcttgaacgcatcccctgggtcgttagaaagctgctccaagtgtccgagagcaccggcaccgtgctgaaacggtcctcttggcttattgtcctgctcgtgctgttcacagttagcctgtcccctgtgcagagcgctcccatcgggcgcagacctctctttctggactctatcgtcaagggaatgaaaaaccttcttaattccacgagcctcgagacctctctgagcattgaagccccctggggcgcgatcaacgtgcagtccacatacaagccgaccgtttctacagccaatattgctcttagctggtccagcgtggagcaccgggggaacaaggtcctggtgtctggaagatccgaaagcatcatgaaactcgaggaacgcaccggcatttcttgggatctgggcgtcgaggacgcctccgagagcaagctgctcacggtgtccgttatggatctgtctcagatgtatagccctgtgttcgaatacctttccggggaccggcaagtcgaggaatggcccaaagctacatgtaccggagattgccctgagagatgtggctgcacctctagcacatgtctgcacaaggaatggccccattcccgcaattggcggtgcaaccccacctggtgctggggagtggggacaggctgtacgtgctgtgggctcgacgttaaagatctgtttaccgactatatgttcgtgaagtggaaggtcgagtacatcaaaacagaggccatcgtgtgcgtggaactgaccagccaggagagacagtgttctcttattgaagcgggcacacgcttcaacctcggatccgttaccatcacgctgagcgagcctcggaatattcaacagaagctgccgcccgagatcattaccctccaccctaaaatcgaagagggctttttcgatctgatgcatgtccagaaggtgctttctgcctccacagtgtgcaaactgcagagctgtacccacggggtccccggagacctccaagtgtatcacattggcaacctgctgaagggggatagagttaatggacatcttatccacaagatcgaacagcattttaacacatcttggatgagctgggacggctgcgacctcgattactattgtaatatgggggactggccttcctgcacctacacgggcgtgacacagcacaaccatgctagcttcgtcaatctgctgaacattgagaccgattacacaaaaacctttcacttccactctaagcgcgtgaccgcccatggagacacaccccagctcgatctgaaagctcggccgacgtatggcgccggggaagttaccgtgcttgtcgaggtggccgacatggagctgcacacaaagaaaatcgaaatttccggactcaagtttgctggcctgacctgtacagggtgctacgcgtgcagctccggaatctcttgtaaggttcgcattcatgtggatgagcctgacgaactgaccgtccacgtgaaaagcgatgaccccgatgtggtcgccgcttcctctagccttatggccagaaagctcgagttcggcacggactccacatttaaagccttctctgctatgcctaagaccagcctgtgcttttatatcgttgaacgggagtactgtaaatcctgcagcaaggaggatacccaaaaatgtgtgaatacaaagctggaacagccccagtctatcctcattgagcacaaggggaccatcattggcaaacagaacaatacatgcacggccaaggcgtcctgttggctggaaagcgtgaaatctttcttttatggacttaagaacatgctgggcgggatcttcggaaatgtcttcattggcatctttaccttcctcacaccttttatcctgctgattcttttctttatgttcgggtggagaatcctcttttgcttcaaatgttgccggcgcaccagaggactgtttaagtaccggcatctgaaggacgacgaggaaacaggctatagaaaaattatcgagcgcctcaacaataagaaagggaagaaccggctgcttgatggcgagagactggctgaccgcaaaattgccgaactcttctccaccaagacgcacatcgga

SEQ ID NO: 13878 - RNA, 2916 nt, synthetic construct
  misc_feature 1..2916: note = derived and/or modified CDS sequence (opt5) from CCHFV(Kosova Hoti, Artificial)__EU037902.1__Gn-4aa-Gc
  source 1..2916: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccagaagggccgcggccatgtgaagctgtccagagggtctgaggtggtccttgatgcctgtgacagcaactgcgaagtgatgattcccaaaggaacgggcgatatcctggttgactgttccgggggacagcaacacttcctcaaggataatctgattgacctgggctgccctcatatccccctcctggggaaaatggcgatttacatctgtcggatgagcaaccaccctaagaccacaatggcttttcttttctggttttctttcggatatgtgattacctgcatcttttgcaaagccctgttctactccctcatcattatcggcacactgggcaagaagattaaacagtatcgcgagcttaagccccagacctgtacgatctgcgaaacagcccctgtcaatgctattgatgccgagatgcatgacctgaactgtagctacaatatctgcccgtattgtgcttctagactcacctccgacgggctggcccggcacgtgaaacagtgccccaagcgcaaagagaaggttgaagagacagaactgtacctcaacctggagagaatcccttgggtggtccggaaacttctgcaagtgagcgaatctaccggagtggcgctcaagcgctccagctggctgattgtccttctggttctcctgaccgtgtccctgtctcccgtgcagagcgcccctgtcggcagaaagcccctctttctggattccatcgtgaaagggatgaagaatcttctgaacagcacatctctcgagacgtccctgagcattgaggctccgtggggagccatcaatgttcagtctaccttcaaacctacagtgagcaccgctaacattgccctttcctggtctagcgtcgaacaccggggcaataagatcctggtgacagggcgctccgagagcatcatgaaactcgaagagagaaccggaatttcttgggacctgggcgttgaagatgcgtccgagagcaagctgctcacggtgtctatcatggacctgtcccagatgtacagccccgtctttgagtatctttccggcgatcggcaagtggaagagtggcctaaggccacatgtaccggggactgcccccagagatgtggatgcacctctagcacatgtctgcataaagaatggccccactcccgcaactggcggtgcaaccctacctggtgctggggcgtcgggacaggatgtacgtgctgtggcgtggatgttaaggacctcttcaccgatcatatgtttgtgaaatggaaggtcgagtacattaaaacagaagctatcgtgtgcgttgagctgacctctcaggagagacaatgtagcctgattgaagccgggacacgcttcaatcttggcccggtgaccatcacgctctccgagccccggaacattcagcagaagctgcctcccgaaatcatcaccctgcaccctaagattgaggagggattctttgacctcatgcacgtccagaaagtgctgagcgcttctacagtgtgcaaacttcaatcctgtacccatggcatccccggggatctgcaggtttatcacattggaaatctcctgaaaggcgacagagtcaacgggcatctgatccacaagattgaaccgcatttcaatacaagctggatgtcttgggacggatgcgatcttgactactattgtaacatgggcgattggccttcctgcacctacacgggggtgacacagcacaatcacgccgcctttgtgaacctcctgaatatcgagaccgactatacaaaaaccttccattttcacagcaagcgcgtcaccgctcatggcgatacaccccagctggacctcaaggcgcggcctacgtacggagccggcgaaatcaccgtgctggttgaggtggctgatatggaacttcacacaaagaaggtcgagatttctgggctgaaattcgccagcctcgcctgtaccggatgctacgcttgctccagcggcatctcttgtaaggtgcgcattcacgttgacgagcccgatgaactgacagtgcatgtcaaatccagcgaccctgatgtggttgccgcggggacctccctgatggctagaaaacttgagtttggaacggactctacattcaaagcctttagcgccatgcccaagacctccctctgcttctatatcgtggaaaaggagtactgtaaatcttgcagcgaagatgacaccaagaaatgtgtcgacacaaagctggagcaaccgcagtccattctgatcgagcaccggggcaccatcattgggaaacagaacgatacatgcacggctaaggcctcttgttggctcgaaagcgtgaagtcctttttctatggcctgaaaaatatgcttggaagcgtgtttggcaacttcttcatcgggattctgctctttctggctcctttcgtcctgcttgttctctttttcatgtttggatggaagatcctgttctgctttaaatgttgcagacgcacccggggcctgttcaagtacagacatctcaaagacgatgaggaaacagggtatcggcgcattatcgagagactgaataacaagaagggaaagaatcggcttctggacggcgaaagactcgccgatcgcaagatcgcggagctgttttctaccaaaacacacattggg

SEQ ID NO: 13879 - RNA, 2916 nt, synthetic construct
  misc_feature 1..2916: note = derived and/or modified CDS sequence (opt5) from CCHFV(YL04057, Artificial)__FJ562094.1__Gn-4aa-Gc
  source 1..2916: mol_type = other RNA
gccgagggcgggagctccgactgcatctctagaacccagctggtgaagacagaagtcgctgagattcacgaagatagctacggaggccccggggagaaaatcacgatttgtaacggatccaccatcgttgaccaacggctcggccgcgaactggggtgctatacaattaatagagtgcggtcttacaaactttgtgagaacagcgcctccggaaagtcttgcgagatcgatagcatccctgtgaagtgtaaacagggcttctgcctgaagattacccaggaaggccgcgggcatgtcaagctctccagaggaacagagatcgtgctggacgtttgtgatagctcttgcgaacttatgattccgaaaggcaccggggacatcctggtggattgttccggaggccagcaacactttctccagaataacctgattgacctggggtgccccaatgtccctctcctgggaaagatggcgatctatgtgtgtcggatgagcaaccatcccaaaacaaccatggctttcctcttttggttctcttttggctacgttattacgtgcatcgcctgccgcgtgctgttctatctcctgatcgccattggcaccgtcgggaagaaacttaagcagtacagagagctgaagcctcagacatgtatcgtgtgcgagtccgtgcccgtcaatgctattgatgccgaaatgcacgagctcaactgtagctataatatctgcccttactgtgcttctcggctgtccaccgacggactgattcgccatgttacacaatgcccgaaaagacgggaaaaggtggaggaaaccgagctctttctgaaccttgagcgcatcccctggctggtgagaaaactcctgcaggtcagcgaatccacgggcatggcccttaagcggtcttgttggatgatcacactgctcattctgctgctcgtgagcatctcccctgttcagagcgcgcccgtggggcgcaaacctctgttccttgattctattgccaaggggaaaaagtccctgctcaatagcacctctctggagacaagcctttccatcgaagctccctggggcgccattaacgtccagtctacctttaagccgaccgtgagcgctgccaatatcgcgctgtcctggagctctgttgagcacagagggaacaaaatcctcgtgtccggacggagcgaatctattatgaagctggaggagagaacaggcgtctcctggaatctgggcgtggaagacgccagcgagtccaaaacgctcaccgtctctgtgatggatctgagccaaatgtactcccctgttttcgaatatctttctggggaccgccaggtggaggaatggcccaaggctacatgcaccggagactgtcctgagcggtgcggctgtacaagctccacgtgcctgcacaaagagtggccccatagcagaaactggcgctgctctcccacctggtgttggggagtcggaacaggctgcacctgttgcgggctcgatgtgaaggactttttcaccgattacatgctggttaagtggaaagtggaatatatcaagacagaggccattgtctgtgtggaactgacctcccaggagcggcaatgcagccttatcgaggctggcacaagatttaacctcggacctgtgacgattaccctgtctgaaccgcgcaatgttcagcagcggctgccccctgagatcgtcacactccaccccaaaattgaagagggcttcttcgacctgatgcatgtgcagaagatcctttccgccagcaccgtgtgtaaactgcaatcttgcacacacggggtccctggagattttcaggtgtaccacgttggcaacctcctgagaggggacaaggtgaatggacatagcatccacaagattgaaccccatttcaacacctcctggatgagctgggatggctgtgacctggattatttttgcaatatgggggactggccgtcttgtacgtacaccggcgtcacacagcacaaccgcgccgctttcatcaatatgcttaacattgagaccgattatacaaaaacctttcatttccactccaagcgggtgacggcgcacggagacacacctcagctcgacctgaaagccagacccgcttacggcgccggggaggttaccgtgctggtcgaagtggccgatctcgagctgcatacaaagaaacttgaagttagcggactgaagatcgcttcccttacctgctctggctgctacgcctgtagctccgggatttcttgcaaggtgcgcatccacgtcaatgagcctgacgaatttaccgtgcatgtgcggagctccgatcccgacgtcgttgcggctggatctagcctgatggccagaaaaatcgagttcggcgccgattccacatttaaggctttcagctctatgcctaaagactccctgtgtttttatattgtggagaaggattactgcagctcttgtacggacgatgacacccaaaaatgcgtgaacacaaaacttgatcacccccagtccatcctcattgaacacaaggggaccatcattggcaagcagaatgacacatgtagcaccaagacgtcttgctggctggagtccgtcaaaggattcttttatggcctgaagaacatgctcagcgggatcttcggaaatgtgttcctgggcatccttctgtttctcgccccgttcgttctgctgatctttttctttttctttgggtggcggcttctcttctgtctgaaatgctgtcgcagaacacggggactgctcaagtacaaacatctgaaggatgaagaggaagctggctataagaaaattattgagagacttaacgggaagaaaggcaagtcccagctgtttgacggagagcgcctcgccgaccggaaaatcgcggaactgttcagcaccaagattcacatcggc

SEQ ID NO: 13880 - RNA, 2916 nt, synthetic construct
  misc_feature 1..2916: note = derived and/or modified CDS sequence (opt5) from CCHFV(V42/81, Artificial)__GU477490.1__Gn-4aa-Gc
  source 1..2916: mol_type = other RNA
agcaaggagcccggcgacgattgcatctccagaacccagctgatgcggacagaaacggccgagattcacgacgataactacgggggacctggcgacaaaatcaccatttgtaatgggtctacaatcgtggatcaacgcctcggaagcgaactgggctgctataccattaacagagtcaagtccttcaaactttgtgagaatagcgctacagggaaggcctgcgaagttgacagcaccccggtgaaatgtcggcagggattttgcctgaagatcacacaggagggccgcggccatgtgaagctctccagagggtctgaggtcgtgctggatgcgtgtgacagctcctgcgaagttatgatccccaaaggaaccggcgatattcttgtggactgtagcgggggacagcaacacttcctgaaggataacctcatcgacctggagtgccctcatattcccctgctcggcaaactggctatctacatttgtcggatgtctaatcaccctcgcacgaccatggcctttcttttctggtttgggttcggatatgtcatcacatgcattctgtgcaaggccctcttttactccctgatcatcattggcacccttggcaaaaagatcaagcagtatagagaactgaaaccccagacatgtaccatttgcgagacggctcctgtgaacgccatcgatgctgagatgcatgacctcaattgtagctacaacatttgcccgtattgtgcctctcggctgacatccgacgggctggcgcgccacgttacccagtgccccaagagaaaagaaaaggtggaggaaacagagctctacctgaatcttgaacggatcccttggatcgtccgcaaactgctccaagtgagcgagtctaccggagtggtcctgaagagatccagctggcttattgttctgctcgtgctgctgaccgtgtccctctctcccgtccagagcgcccctgtgggccggaaacccctgttccttgattccatcgttaaggggaagaaaaacctgctcaatagcacatctctggagacgtcccttagcattgaagctccgtggggagccatcaacattcagtctacctttaagcctacagtgagcgctgccaatatcgcgctgtcctggtctagcgtcgagcaccgcggcaacaaaatcctcgtgtccgggagaagcgaatctattatgaagctggaggaacggaccggagtttcctggaatctgggcgtggaggacgccagcgagtctaaactcctgacagtctccatcatggatcttagccagatgtactcccccgtgttcgaatatctgtctggcgacagacaagtcgaggaatggcctaaggctacctgtacgggggattgccccgagcgctgtggatgcacaagctccacctgtctccataaggaatggccccactctcggaactggagatgcaaccctacctggtgctggggcgtggggacaggatgtacctgctgtggcgttgacgtgaaagatctgtttattgaccatatgttcgtcaagtggaaagtggagtacatcaagacagaggccattgtttgcgtggaactgacgagccaggagcgccagtgttcccttatcgaagctgggacccggtttaatctcggcccggtcacaattaccctgagcgagcccagaaacatccaacagaaactgcctcccgagatcattacactccaccctaagatcgaagagggattcttcgatctgatgcacgtgcagaaggtgctttctgcctccaccgtttgcaaactgcagagctgtacgcatggcattcccggggacctccaagtctatcacatcggaaatctgctgaagggcgatcgcgtgaacgggcatcttattcacaaaatcgaaccgcattttaatacctcttggatgtcctgggacggatgcgacctcgattactattgtaacatgggcgactggcctagctgcacatacaccggggtgacacagcacaatcacgccgctttcgtcaacctgctgaatatcgagaccgattatacgaagacatttcatttccactctaaacgggtgaccgcgcatggcgaaacaccccagctcgacctgaaggccagacctgcttacggagccggcgagattaccgttcttgtggaggtcgccgatatggaactgcacaccaagaaagtggagatcagcgggctcaagtttgcttccctggcctgtacaggatgctacgcgtgcagctctggcatttcctgtaaagttcgcatccacgtggacgaacccgatgagctgacggtccatgtgaagtctaacgaccctgatgttgtggctgcctccacctctcttatggcccggaaactcgaaagcgggacagactccaccttcaaggctttttctgccatgcccaaaacaagcctgtgcttctatattgtcgagagagagtactgtaagtcctgctctgaagatgacacccagaagtgtgtggagacgaaactggaacaaccgcagagcatcctcatcgagcacaagggaacaattatcggcaaacagaatgatacctgcaccgctaaggcctcctgttggctggaaagcgtgaaatcctttttctatgggcttaagaacatgctgggctctgtctttggaaatttctttattggcatcctcctgttcctggcgcctttcgttcttctcgtgctgtttttcatgtttgggtggaagattctgttctgctttaaatgttgccgccggacaagaggactcttcaagtaccggcatctgaaagaggacgaggaaaccggctatcgcagaatcatcgagcggcttaacagcaagaaagggaagaatagactgctcgacggagaacgcctggccgatcggaagattgctgagctgttttctacaaaaacgcacatcggc

SEQ ID NO: 13881 - RNA, 2916 nt, synthetic construct
  misc_feature 1..2916: note = derived and/or modified CDS sequence (opt5) from CCHFV(79121M18, Artificial)__GU477493.1__Gn-4aa-Gc
  source 1..2916: mol_type = other RNA
gccgagggcgggagctccgactgcatctctagaacccagctggtgaagacagaagtcgctgagattcacgaagatagctacggaggccccggggagaaaatcacgatttgtaacggatccaccatcgttgaccaaggcctcgggtctgaactgggatgctatacaattaatcgggtgcgcagctacaaactttgtgagaactccgcctctggcaaaagctgcgagatcgattccatccctgtgaagtgtaaacagggcttctgcctgaagattacccaggaagggagaggacatgtcaagctcagccggggcacagagatcgtgctggacgtttgtgattcttcctgcgaacttatgattccgaaagggaccggagacatcctggtggattgtagcggcgggcagcaacactttctccagaataacctgattgacctgggatgccccaatgtccctctcctgggcaagatggcgatctatgtgtgtcgcatgtctaaccatcccaaaacaaccatggctttcctcttttggttctcctttggctacgttattacgtgcatcgcctgcagagtgctgttctatctcctgatcgccattgggaccgtcggaaagaaacttaagcagtaccgggagctgaagcctcagacatgtatcgtgtgcgagagcgtgcccgtcaatgctattgatgccgaaatgcacgagctcaactgttcttataatatctgcccttactgtgcttcccgcctgagcaccgacggcctgattagacatgttacacaatgcccgaaacggcgcgaaaaggtggaggaaaccgagctctttctgaaccttgagagaatcccctggctggtgcggaaactcctgcaggtctccgaatctacggggatggcccttaagcgcagctgttggatgatcacactgctcattctgctgctcgtgtccatcagccctgttcagtctgcgcccgtgggaagaaaacctctgttccttgattccaccgccaagggcatgaaaagcctgctcaattctacaagcctggagacctccctttctattgaagctccctggggagccatcaacgtccagagcacctttaagccgacagtgtccgctgccaatattgcgctgagctggtcttccgttgagcaccgggggaacaagatcctcgtgagcggccgctctgaatccatcatgaaactggaggagagaacgggcgtcagctggaatctgggggtggaagacgcctccgagtctaagaccctcacagtcagcgtgatggatctgtcccaaatgtactctcctgttttcgaatatcttagcggagacagacaggtggaggaatggcccaaagctacctgcacaggcgactgtcctgagcggtgcgggtgtacctccagcacgtgcctgcacaaggagtggccccattctcgcaactggcggtgcaaccccacatggtgttggggagtcggcaccgggtgcacctgttgcggcctcgatgtgaaagactttttcacagattacatgctggttaagtggaaggtggaatatattaaaaccgaggccatcgtctgtgtggaactgacatcccaggagagacaatgcagccttattgaggctggaacgcgctttaatctcggccctgtgaccatcacactgtctgaaccgcggaacgttcagcagagactgccccctgagattgtcaccctccaccccaagatcgaagaggggttcttcgacctgatgcatgtgcagaaaattctttccgccagcacagtgtgtaagctgcaatcttgcacccacggagtccctggcgattttcagatctaccacgtggggaatctcctgcgcggagacaaagttaacggccatagcatccacaagattgaaccccatttcaatacgtcctggatgagctgggatgggtgtgacctggattatttttgcaacatgggcgactggccgtcttgtacctacacaggagtgacccagcacaatcgggccgctttcatcaacatgcttaatattgagacagattataccaagacgtttcatttccactccaaaagagtcacagcgcacggcgacacccctcagctcgacctgaaggcccgccccgcttacggggccggagaggtgacagttctggtggaagtcgccgatctcgagctgcataccaaaaagctggaagtgagcggccttaaaatcgcttcccttacctgctctgggtgctacgcctgtagctccggaatttcttgcaaggttcggatccacgtgaacgagcctgacgaatttacagtccatgtgagaagctccgatcccgacgtggtcgcggctggctctagcctgatggcccgcaagatcgagttcggggccgattccacgtttaaggctttcagctctatgcctaaggactccctgtgtttttatattgttgagaaagattactgcagctcttgtaccgacgatgacacacaaaagtgcgtgaataccaaacttgatcacccccagtccatcctcattgaacacaagggcacaatcattggaaaacagaacgacacctgtagcacgaagacatcttgctggctggagtccgtgaagggcttcttttatgggctgaaaaatatgctcagcggaatcttcggcaacgtcttcctggggatctttcttttcctggccccgtttgtgctcctgattttctttttctttttcggatggcggctgctcttttgtcttaagtgctgtagacggacccgcggcctgctgaaatacaagcatctcaaagatgaagaggaagctgggtataagaagatcattgagagactgaatggcaaaaagggaaaatcccagcttttcgacggcgagcggctggccgacagaaagatcgcggaactctttagcaccaaaattcacatcggg

SEQ ID NO: 13882 - RNA, 2916 nt, synthetic construct
  misc_feature 1..2916: note = derived and/or modified CDS sequence (opt5) from CCHFV(Afg09-2990, Artificial)__HM452306.1__Gn-4aa-Gc
  source 1..2916: mol_type = other RNA
agcgaggaatccggcgacgattgcatctctagaacccagctgctccggacagagacggccgaagtgcacggggacaactacggaggccccggggataagattaccatctgtaatggaagcacagtcgttgaccaacgcctgggctccgagcttgggtgctataccattaacagagtgcggtctttcaaactgtgtgaaaatagcgctacaggaaagtcctgcgagatcgattctattcctgtgaaatgtaagcagggctactgcctcaaaatcacccaggagggccgcgggcatgtcaagctgagcagaggatccgaagtggttcttgacgtgtgtgatagctcttgcgaggtcatgatcccgaagggcacaggggacattctggtggattgttccggaggccagcaacactatctcaaagacaacctggttgatctggggtgccccaagatccctctcctgggaaaaatggccatttacatctgtcggatgagcaatcatcccaagaccacgatggcgtttcttttctggttttctttcggctatgtgattacctgcatcctgtgcaaagctatctttttcctcctgattatctttggcacacttgggaagcgcttcaagcagtacagagaactgaaacctcagacctgtacaatttgcgagaccacgcccgtcaacgccatcgacgccgagatgcacgatctcaattgttcctataacatttgcccttactgtgctagccggctgacatctgacggactggcccgccatgtgacccagtgcccgagacggaaggaaaaagtggaggaaacagagctctacctgaatcttgaacgcatcccctgggtcgttagaaagctgctccaagtgtccgagagcaccggcaccgtgctgaaacggtcctcttggcttattgtcctgctcgtgctgtttacagttagcctgtcccctgtgcagagcgctcccatcgggcgcagacctctcttcctggactctatcgtcaagggaatgaaaaaccttcttaattccacgagcctcgagacctctctgagcattgaagccccctggggcgcgatcaacgtgcagtccacatataagccgaccgtttctacagccaatattgctcttagctggtccagcgtggagcaccgggggaacaaggtcctggtgtctggaagatccgaaagcatcatgaaactcgaggaacgcaccggcatttcttgggatctgggcgtcgaggacgcctccgagagcaagctgctcacggtgtccgttatggatctgtctcagatgtacagccctgtgtttgaatatctttccggggaccggcaagtcgaggaatggcccaaagctacatgtaccggagattgccctgagagatgtggctgcacctctagcacatgtctgcacaaggaatggccccattcccgcaattggcggtgcaaccccacctggtgctggggagtggggacaggctgtacgtgctgtgggctcgacgttaaagatctgttcaccgactacatgtttgtgaagtggaaggtcgagtatatcaaaacagaggccatcgtgtgcgtggaactgaccagccaggagagacagtgttctcttattgaagcgggcacacgcttcaacctcggatccgttaccatcacgctgagcgagcctcggaatattcaacagaagctgccgcccgagatcattaccctccaccctaaaatcgaagagggcttctttgatctgatgcatgtccagaaggtgctttctgcctccacagtgtgcaaactgcagagctgtacccacggggtccccggagacctccaagtgtaccacattggcaacctgctgaagggggatagagttaatggacatcttatccacaagatcgaacagcatttcaacacatcttggatgagctgggacggctgcgacctcgattattactgtaatatgggggactggccttcctgcacctacacgggcgtgacacagcacaaccatgctagctttgtcaatctgctgaacattgagaccgattatacaaaaaccttccactttcactctaagcgcgtgaccgcccatggagacacaccccagctcgatctgaaagctcggccgacgtacggcgccggggaaatcaccgttcttgtggaggtcgccgacatggagctgcacacaaagaaaattgaaatctccggactcaagttcgctggcctgacctgtacagggtgctatgcgtgcagctccggaatttcttgtaaggtgagaatccatgttgatgagcctgacgaactgaccgtgcacgtcaaaagcgatgaccccgatgtggtggccgcttcctctagccttatggcccgcaagctcgagtttggcacggactccacattcaaagccttttctgctatgcctaagaccagcctgtgcttctacatcgtcgaacgggagtattgtaaatcctgcagcaaggaggatacccaaaaatgtgttaatacaaagctggaacagccccagtctattctcatcgagcacaaggggaccattatcggcaaacagaacaatacatgcacggccaaggcgtcctgttggctggaaagcgtgaaatcctttttctacggacttaagaacatgctgggcgggatttttggaaatgtgttcatcggcatcttcacctttctcacacctttcattctgctgatcctgtttttcatgtttgggtggcggattctcttctgctttaaatgttgcagacgcaccagaggactgttcaagtatcggcatctgaaggacgacgaggaaacaggctacagaaaaatcattgagcgcctcaacaataagaaagggaagaaccggctgcttgatggcgagagactggctgaccgcaaaatcgccgaactcttttctaccaagacgcacatcgga

SEQ ID NO: 13883 - RNA, 2916 nt, synthetic construct
  misc_feature 1..2916: note = derived and/or modified CDS sequence (opt5) from CCHFV(Sudan Al-Fulah 3-2008, Artificial)__HQ378184.1__Gn-4aa-Gc
  source 1..2916: mol_type = other RNA
agcgaggaaccctccgacgattgcatctctagaacccagctgctccggacagagacggccgaaattcacggcgacaactacgggggacctggcgataagatcaccatttgtaatgggagcacaatcgtggaccagcgcctgggatccgagcttggctgctataccattaacagagtcaaatctttcaagctgtgtgaaaatagcgctacagggaaatcctgcgttatcgattctgtgccggtgaagtgtcggcagggatactgcctccgcatcacccaggagggcagaggccatgtcaaactgagccgggggtccgaggtggttcttgacgcctgtgatacaagctgcgaaattatgatccccaagggaaccggcgacattctggtggattgttctgggggacagcaacactttctcaaggacaacctggtcgatctgggctgccctaaaatccccctcctggggaagatggcgatttatatctgtcgcatgtccaatcatcctaaaacgaccatggctttccttttctggttcagctttggatacgtgattacatgcatcctgtgcaaggccatcttctatctcctgattatcattggcacccttggcaaaagatttcggcagtaccgcgagctgaagccccagacatgtaccatctgcgaaacgacacctgttaacgccattgacgctgagatgcacgatctcaattgttcttataacatctgcccgtactgtgcctccagactgaccagcgacgggctggctcggcatgtgacacagtgccccaagcgcaaagagaaggtcgaagagaccgaactctacctgaatcttgagagaatcccttgggtggtgcggaaactgctccaagtctctgaatccaccggagttgccctgaagcgcagctcctggcttattgtgctgctcgtgctgttcacagtctctctgagccccgtgcagtccgcgcctatcggcagacggcccctctttctggacagcattgttaaagggatgaagaaccttctcaattctacgtccctcgagaccagcctgtctatcgaggccccgtggggagctattaacgtgcagagcacatataaacctaccgtctccacagccaatatcgctctttcttggagctccgtggaacacagaggcaacaagatcctggttagcgggcgctctgagtccattatgaagctcgaggaacggaccggaatcagctgggatctgggcgtggaagacgcctctgagtccaaactgctcacggtcagcgtgatggatctgtcccagatgtactctcccgtcttcgagtatcttagcggcgacagacaagtggaagagtggcctaaggcgacatgtaccggggattgccccgaacgctgtggatgcacctcctctacatgtctgcacaaagagtggccccatagccggaattggagatgcaaccctacctggtgctggggcgttgggacaggatgtacgtgctgtggcctcgacgtgaaggatctgtttaccgactacatgttcgtcaaatggaaggtggaatatattaagacagaggccatcgtttgcgtggagctgacctcccaggaacgccagtgtagccttattgaggctgggacacggtttaacctcggcccggtcaccatcacgctgtctgaacccagaaatattcaacagaaactgcctcccgagatcatcaccctccaccctcgcattgaggaaggattcttcgatctgatgcatgtgcagaaggtgctttccgccagcacagtttgcaaactgcagtcttgtacccacggcgtccccggggacctccaagtgtaccacatcggaaacctgctgaagggcgataaagtgaatgggcatcttattcacaagatcgagccgcattttaacacatcctggatgagctgggacggatgcgacctcgattattactgtaatatgggcgactggccttcttgcacctacacgggggtcacacagcacaaccatgctagcttcgtgaatctgctgaacattgaaaccgattatacaaagaattttcacttccactccaaacgggttaccgcccatggcgacacaccccagctcgatctgaaggccagacctacctacggagctggcgagatcacggtgcttgtcgaagtggcggacatggagctgcacaccaaaaagatcgagattagcgggctcaaatttgcctctctgacatgtaccggatgctatgcttgctccagcggcatctcctgtaaggttcgcattcatgtggatgaacccgacgagctgacagtccacgtgaagtctgatgaccctgatgttgtggccgccagctcctctcttatggctcggaaactcgaatttgggaccgacagcacgtttaaggccttctccgcgatgcccaaaacatctctgtgcttttacatcgtcgagaaggaatattgtaaaagctgctccgaggaggataccaagaaatgtgtgaacaccaagctggaacagccgcaaagcattctcatcgagcacaagggaacaatcattggcaaacaaaattctacctgcacagctaaggtgtcctgttggctggaaagcgccaaatctttcttttacgggcttaaggacatgctgtccggcatcttcggaaacgtctttattggcatcttcctcttcctggccccttttgttctgcttgtgctgttctttatgttcgggtggcggattctgctgtgctttagatgttgccgcagaacgcggggactcttcaaatatagacatctgaaggacgatgaggaaaccggctaccgccggatcatcgagagacttaataacaagaaagggaagaataaactgctcgacggagagcgcctggctgatagaaagattgccgaactgtttagcacaaaaacccacatcggc

SEQ ID NO: 13884 - RNA, 2916 nt, synthetic construct
  misc_feature 1..2916: note = derived and/or modified CDS sequence (opt5) from CCHFV(Sudan AB1-2009, Artificial)__HQ378187.1__Gn-4aa-Gc
  source 1..2916: mol_type = other RNA
agcgaggaaccctccgacgattgcatctctagaacccagcttctccggacagagacggccgaaattcacggcgacaactacgggggacctggcgataagatcaccatttgtaatgggagcacaatcgtggaccagcgcctgggatccgagcttggctgctataccattaacagagtcaaatctttcaagctgtgtgaaaatagcgctacagggaaaaactgcgagatcgattccgttccggtgaagtgtcggcagggatactgcctccgcatcacccaggagggcagaggccatgtgaaactgtctcgggggagcgaagtcgtgcttgacgcctgtgatacatcctgcgagattatgatccccaagggaaccggcgacattctggttgattgtagcgggggacagcaacactttctcaaggacaatctgatcgatctgggctgccctaaaattcccctcctggggaagatggcgatctatatttgtcgcatgtctaaccatcctaaaacgaccatggctttcctgttttggttctcctttggataccttatcacatgcatcctctgcaaggccattttctatctgcttatcattatcggcaccctgggcaaaagactcaagcagtaccgggaactgaagccccagacatgtaccatttgcgagacgacacctgtgaatgccatcgacgctgagatgcacgatctgaactgtagctataatatctgcccgtactgtgcctctcgcctcacctccgacgggctggctagacatgtcattcagtgccccaaacggaaggaaaaagtggaggaaacagagctttacctgaacctcgaacgcatcccttgggttgtgagaaagctgcttcaagtcagcgagtctaccggagtggccctgaaacggtccagctggctcattgtgctgctggtcctctttaccgtttccctgtctcccgtgcagagcgcgcctatcggccgcaagccccttttcctggactccattgccaaagggatgaagaatctcctgaacagcacatctcttgagacgtccctgagcatcgaagctccgtggggagccatcaatgtgcagtctacctataagcctacagtcagcaccgctaacattgccctctcctggtctagcgtggagcacagaggcaataaaatcctggtttccgggcggagcgaatctattatgaagctggaggaaagaacaggaatctcctgggatctcggcgtggaggacgcgagcgagtctaaactgcttaccgtctccgtgatggatctgagccagatgtactcccccgtttttgaatatctctctggcgaccgccaagtggaggaatggcctaaggccacgtgtacaggggattgccccgagcggtgtggatgcaccagctccacctgtctgcacaaagaatggccccattctagaaactggcgctgcaaccctacatggtgctggggcgtcgggaccggatgtacatgctgtggcctggacgtgaaggatcttttcacggactacatgtttgtcaagtggaaagtggagtatattaagaccgaggctatcgtttgcgtggaactcacaagccaggagcggcagtgttccctgattgaagccgggaccagattcaatctgggcccggtcacaatcaccctcagcgagccccgcaacatccaacagaaactgcctcccgagattatcacgcttcaccctcggattgaagagggatttttcgatctgatgcatgtgcagaaggttctctctgcttccaccgtgtgcaaactgcagagctgtacacacggcgtccccggggacctgcaagtgtaccacatcggaaatcttctcaagggcgataaggtgaacgggcatctgattcacaaaatcgaaccgcatttcaatacctcttggatgtcctgggacggatgcgacctggattattactgtaacatgggcgactggcctagctgcacatacaccggggttacgcagcacaatcatgcctcttttgtcaacctcctgaatatcgagacagattataccaagaacttccactttcacagcaaaagagtgacagcccatggcgacacaccccagcttgatctgaaggctcgccctacctacggagcgggcgaaattacagtgctcgtcgaggtggccgacatggagctgcacacgaaaaagatcgaaatttccgggctgaagttcgctagccttacctgtacaggatgctatgcctgttcttccggcatcagctgcaaagttcggattcatgtggatgagcccgacgaactcaccgtccacgtgaagtccgatgaccctgatgttgtggccgcttctagctccctgatggccagaaaactggagtttgggacagactctaccttcaaggcgtttagcgctatgcccaaaacgtccctctgcttctacatcgtcgaacgcgagcactgtaagtcttgcaatgaggaagataccaaaaagtgtgtgaacaccaagctggagcagccgcaaagcatccttattgaacataaaggaaccatcattggcaagcaaaattccacatgcaccgcccgggccagctgttggctggagtctgttaaatcctttttctatgggctcaagaacatgctgagcggcatctttggaaatgtgttcatgggcatttttctgttccttgctcctttcatcctcctgatcctgtttttcatgtttgggtggcggattctcttctgctttaaatgttgcagacgcacaagaggactgttcaagtaccggcaccttaaggacgacgaagagacgggctatagacgcatcattgagcggctgaacaacaaaaaggggaaaaataagctcctggatggagaaagactggccgaccgcagaatcgctgagctgttttctaccaaaacacatattggc

SEQ ID NO: 13885 - RNA, 2916 nt, synthetic construct
  misc_feature 1..2916: note = derived and/or modified CDS sequence (opt5) from CCHFV(NIVA 118595, Artificial)__JN572083.1__Gn-4aa-Gc
  source 1..2916: mol_type = other RNA
agcgaggaatccggcgacgattgcatctctagaacccagctgctccggacagagacggccgaagtgcacggggacaactacggaggccccggggataagattaccatctgtaatggaagcacagtcgttgaccaacgcctgggctccgagcttgggtgctataccattaacagagtgaaatctttcaagctgtgtgaaaatagcgctacaggaaaatcctgcgagatcgattctattcctgtgaagtgtcggcagggctactgcctcaaaatcacccaggagggccgcgggcatgtcaagctgagcagaggatccgaagtggttcttgacgcctgtgatagctcttgcgaggtgatgatcccgaagggcacaggggacattctggtcgattgttccggaggccagcaacactttctcaaagacaacctgatcgatctggggtgccccaagattcctctcctgggaaaaatggcgatctatatttgtcggatgagcaatcatcccaagaccacgatggctttcctgttttggttctcttttggctacgtgattacctgcattctttgcaaagttatcttctatctcctgatcatttttggcacacttgggaagcgcttcaagcagtacagagaactgaaacctcagacctgtacaatctgcgagaccacgcccgtgaacgccattgacgccgagatgcacgatctcaattgttcctataacatctgcccttactgtgctagccggctgacatctgacggactggcccgccatgtcacccagtgcccgaagagaaaagaaaaggtggaggaaacagagctctacctgaatcttgaacggattccctgggtggtccgcaaactgctccaagtttccgagagcaccggcatcgctctgaagagatcctcttggcttatcgtgctgctcgtgctgtttaccgtcagcattacacctgtgcagtccgcccccatcgggcggcgccctctgttcctcgacagcattgttaaaggaatgaagaacctgcttaattctacgtccctggagaccagcctctctatcgaagcgccctggggcgccattaacgtgcagagcacatataagccgaccgtctccgctgccaatatcgctctgtcttggagctccgtggagcacagagggaacaaaatccttgttagcggacggtctgaatccattatgaagctggaggaaagaacaggcatcagctgggatctcggcgtggaggacgcctctgagtccaaactgctgaccgtcagcgtgatggatctctcccagatgtactctcctgtctttgaatatctgagcggggaccgccaagtggaggaatggcccaaggcgacgtgtacaggagattgccctgagcggtgtggctgcacctcctctacctgtcttcacaaagaatggccccatagcagaaattggcgctgcaaccccacatggtgctggggagttgggaccggctgtacatgctgtgggctggacgtgaaggatctcttcacggactacatgtttgtcaagtggaaagtggagtatattaagaccgaggccatcgtttgcgtggaactgacatcccaggagcggcagtgtagcctgattgaagctggcaccagattcaaccttggatctgtcacaatcaccctctccgagcctcgcaatattcaacagaaactgccgcccgagatcatcacgctgcaccctcggattgaagagggcttctttgatctcatgcatgtgcagaaggtgctgagcgcctctaccgtttgcaaacttcagtcctgtacacacggggtccccggagacctgcaagtgtaccacatcggcaacctcctgaagggggatagagtgaatggacatctgattcacaagatcgaacagcatcttaacaccagctggatgtcttgggacggctgcgacctcgattattactgtaatatgggggactggcctagctgcacatacaccggcgtcacgcagcacaaccatgcttccttcgtgaatctgctgaacattgagacagattataccaaaacatttcacttccacagcaagcgcgttaccgcccatggagacacaccccagctcgatctgaaagcccggccgacctacggcgctggggaaatcacggtgcttgtcgaggtggcggacatggagctgcacaccaagaaaatcgaaatttctggactcaagtttgcctccctgagctgtacaggctgctatgcttgctcctctgggatcagctgtaaggttcgcattcatgtggatgagcctgacgaactgaccgtccacgtgaaatccgatgaccccgatgttgtggccgcctctagctcccttatggctagaaagctcgagtctggaacagacagcaccttcaaagccttttccgcgatgcctaagacgagcctgtgcttctacatcgtcgaacgggagtattgtaaaggctgctctaaggaggatacacaaaaatgtgtgaataccaagctggaacagccccagtccattctcatcgagcacaaggggaccatcattggcaaacagaacaatacatgcaccgctaaggccagctgttggctggaatctgtgaaatcctttttctacggacttaagaacatgctgagcggcatctttgggaatgtcttcctcggaatcttttctttcctggcccctttcgttctgcttatcctctttttcatgtttggctggcggattctgttctgctttaaatgttgcagacgcacaagagggctgttcaagtatcggcatctcaaggacgacgaggaaacgggatacagaaaaatcatcgagcgcctgaacaataagaaaggcaagaacaaacttctggatggggagcggctcgctgacagaaagattgccgaactgttttccaccaagacacacatcggc

SEQ ID NO: 13886 - RNA, 2916 nt, synthetic construct
  misc_feature 1..2916: note = derived and/or modified CDS sequence (opt5) from CCHFV(NIV 112143, Artificial)__JN572085.1__Gn-4aa-Gc
  source 1..2916: mol_type = other RNA
agcgaggaatccggcgacgattgcatctctagaacccagctgctccggacagagacggccgaagtgcacggggacaactacggaggccccggggataagattaccatctgtaatggaagcacagtcgttgaccaacgcctgggctccgagcttgggtgctataccattaacagagtgaaatctttcaagctgtgtgaaaatagcgctacaggaaaatcctgcgagatcgattctattcctgtgaagtgtcggcagggctactgcctcaaaatcacccaggagggccgcgggcatgtcaagctgagcagaggatccgaagtggttcttgacgcctgtgatagctcttgcgaggtgatgatcccgaagggcacaggggacattctggtcgattgttccggaggccagcaacactttctcaaagacaacctgatcgatctggggtgccccaagattcctctcctgggaaaaatggcgatctatatttgtcggatgagcaatcatcccaagaccacgatggctttcctgttttggttctcttttggctacgtgattacctgcattctttgcaaagttatcttctatctcctgatcatttttggcacacttgggaagcgcttcaagcagtacagagaactgaaacctcagacctgtacaatctgcgagaccacgcccgtgaacgccattgacgccgagatgcacgatctcaattgttcctataacatctgcccttactgtgctagccggctgacatctgacggactggcccgccatgtcacccagtgcccgaagagaaaagaaaaggtggaggaaacagagctctacctgaatcttgaacggattccctgggtggtccgcaaactgctccaagtttccgagagcaccggcatcgctctgaagagatcctcttggcttatcgtgctgctcgtgctgtttaccgtcagcattacacctgtgcagtccgcccccatcgggcggcgccctctgttcctcgacagcattgttaaaggaatgaagaacctgcttaattctacgtccctggagaccagcctctctatcgaagcgccctggggcgccattaacgtgcagagcacatataagccgaccgtctccgctgccaatatcgctctgtcttggagctccgtggagcacagagggaacaaaatccttgttagcggacggtctgaatccattatgaagctggaggaaagaacaggcatcagctgggatctcggcgtggaggacgcctctgagtccaaactgctgaccgtcagcgtgatggatctctcccagatgtactctcctgtctttgaatatctgagcggggaccgccaagtggaggaatggcccaaggcgacgtgtacaggagattgccctgagcggtgtggctgcacctcctctacctgtcttcacaaagaatggccccatagcagaaattggcgctgcaaccccacatggtgctggggagttgggaccggctgtacatgctgtgggctggacgtgaaggatctcttcacggactacatgtttgtcaagtggaaagtggagtatattaagaccgaggccatcgtttgcgtggaactgacatcccaggagcggcagtgtagcctgattgaagctggcaccagattcaaccttggatctgtcacaatcaccctctccgagcctcgcaatattcaacagaaactgccgcccgagatcatcacgctgcaccctcggattgaagagggcttctttgatctcatgcatgtgcagaaggtgctgagcgcctctaccgtttgcaaacttcagtcctgtacacacggggtccccggagacctgcaagtgtaccacatcggcaacctcctgaagggggatagagtgaatggacatctgattcacaagatcgaacagcatcttaacaccagctggatgtcttgggacggctgcgacctcgattattactgtaatatgggggactggcctagctgcacatacaccggcgtcacgcagcacaaccatgcttccttcgtgaatctgctgaacattgagacagattataccaaaacatttcacttccacagcaagcgcgttaccgcccatggagacacaccccagctcgatctgaaagcccggccgacctacggcgctggggaaatcacggtgcttgtcgaggtggcggacatggagctgcacaccaagaaaatcgaaatttctggactcaagtttgcctccctgagctgtacaggctgctatgcttgctcctctgggatcagctgtaaggttagaatccatgtggatgagcctgacgaactgaccgtccacgtgaaatccgatgaccccgatgttgtggccgcctctagctcccttatggctcgcaagctcgagttcggaacagactctacctttaaagccttcagcgcgatgcctaagacgtccctgtgcttttacatcgtcgaacgggagtattgtaaaggctgcagcaaggaggatacacaaaaatgtgtgaataccaagctggaacagccccagtctattctcatcgagcacaaggggaccatcattggcaaacagaacaatacatgcaccgctaaggcctcctgttggctggaaagcgtgaaatctttcttttacggacttaagaacatgctgtccggcatcttcgggaatgtctttctcggaattttcagcttcctggccccttttgttctgcttatcctcttctttatgttcggctggcggattctgttttgcttcaaatgttgcagacgcacaagagggctgtttaagtatcggcatctcaaggacgacgaggaaacgggatacagaaaaatcatcgagcgcctgaacaataagaaaggcaagaacaaacttctggatggggagcggctcgctgacagaaagattgccgaactgttctctaccaagacacacatcggc

SEQ ID NO: 13887 - RNA, 2916 nt, synthetic construct
  misc_feature 1..2916: note = derived and/or modified CDS sequence (opt5) from CCHFV(SCT ex Afghanistan, Artificial)__KC344856.1__Gn-4aa-Gc
  source 1..2916: mol_type = other RNA
agcgaggaatccggcgacgattgcatctctagaacccagctgctccggacagagacggccgaagtgcacaacgacaattacgggggacccggcgataagattaccatctgtaacgggagcacaattgtcgaccaacgcctgggatccgagcttggctgctataccatcaatagagttaaatctttcaagctgtgtgaaaacagcgctacagggaaatcctgcaagattgattctacccctgtgaaatgtcggcagggattttgcctcaagatcacacaggagggccgcggccatgtgaagctgagcagagggtccgaggtcgtgcttgacgcctgtgatagctcttgcgaaatcatgattccgaaaggaaccggcgacatcctggttgattgttccgggggacagcaacacttcctcaaggacaatctgattgatctgggctgccccaacatccctctcctggggaaaatggcgatttacatctgtcggatgagcaatcatcccaagacgaccatggcttttcttttctggttttctttcggatatgtgattacatgcatcttttgcaaagtcatcttctacctgctcattgtggttggcaccctgggcaagaagtttaaacagtatcgcgagcttaagcctcagacatgtaccatctgcgaaacgacacccaccaacgccattgacgccgagatgcacgatctgaattgttcctacaacatctgcccttattgtgctagcagactcacatctgacgggctggcccggcatgtgacccagtgcccgaaacgcaaggagaaagtcgaagagaccgaactgtacctcaatctggagcggattccctggatcgtgagaaagctcctgcaagtgtccgaaagcacaggagtcgctctcaaacgctcctcttggctgatcgttcttctggtgctcctgacggtgagcctgtcccctgtccagagcgcccccattggcagaaagcctctcttcctgaactctatcgtgaaggggatgaaaaatcttctgaactccaccaatctcgagacaagcctgtctattgaggcgccctggggagccatcaacgttcagagcacctttaagccgacagtgtccaccgctaacattgccctttcttggagctccgtcgaacaccggggcaataaaatcctggtgagcgggcgctctgagtccatcatgaagctcgaagagagaacgggaattagctgggacctgggcgttgaagatgcttctgagtccaaaagcctgacagtgtccgtcatggacctctctcagatgtacagccctgtgttcgagtatctgtccggcgatcggcaagtcgaagagtggcccaaggccacctgtaccggggactgccctgaaagatgtggatgcacatctagcacctgtcttcacaaggagtggccccattcccgcaactggcggtgcaatcccacatggtgctggggcgtggggacgggatgtacctgctgtggcctggatgttaaagacctctttacagattacatgttcgtgaagtggaaagtcgaatatatcaagaccgaggcgattgtgtgcgttgagctgacaagccaggaaagacagtgttctctgatcgaggccgggacccgcttcaaccttggccctgtgacgattaccctctccgaaccgcggaatatccaacagaaactgccccctgagattatcacactgcaccccagaatcgaggaaggatttttcgacctcatgcatgtccagaaggtgctgagcgcttctaccgtgtgcaaacttcagtcctgtacacacggcgttcctggggatctgcaagtctaccacattggaaacctcctgaagggcgacaagctgaatgggcatatgatccacaaaattgagccccattttaacaccagctggatgtcttgggatggatgcgaccttgactattactgtaatatgggcgattggccgagctgcacgtatacaggggtgacccagcacaaccatgccgctttcgtgaatctcctgaacatcgaaacagactacaccaagaattttcacttccactccaaacgcgtcaccgcccatggcgatacacctcagctggacctcaaggcccggcccacgtacggagctggcgagattaccgtgctggttgaagtggcggatatggagcttcacacaaagaaaatcgacatcagcgggctgaagtttgcctctctcacctgtgctggatgctatgcctgctccagcggcatttcctgtaaagtcagaatccatgtggatgagcctgacgaactgacagttcacgtgaagtctgaggatcccgacattgtcgccgctagcacctccctgatcgcccgcaaacttgaactcgggacggattctacattcaaggcgtttagcgctatgcctaaaacctccctgtgcttctacattgtggagcgggaatattgtaagtcttgcagcaaggaggacacccagaaatgtgttaacacaaagctggagcacccccaaggaatcctcatcgaacataaaggcaccattatcgggaagcagaatgatacatgcacggccaaagccggctgttggctggagtccgtcaagagctttttctacggacttaagaacatgctgtctggcatttttgggaacgtgttcatcggaattttcctctttctggctccgttcgtgctgcttatcctctttttcatgtttggctggagactgctgttctgctttaaatgttgccgccggaccagagggcttttcaagtatcggcacctgaaagaagacgaggaatccggataccgcagaatcattgagcggcttaataacaagaaaggcaagaataagctgctcgacggggagagactggccgatcgccggatcgctgaactgtttagcacaaaaacccatattggc

SEQ ID NO: 13888 - RNA, 2916 nt, synthetic construct
  misc_feature 1..2916: note = derived and/or modified CDS sequence (opt5) from CCHFV(Zahedan 2007, Artificial)__KC867273.1__Gn-4aa-Gc
  source 1..2916: mol_type = other RNA
agcgaggaatccggcgacgattgcatctctagaacccagctgctccggacagagacggccgaagtgcacggggacaactacggaggccccggggataagattaccatctgtaatggaagcacagtcgttgaccaacgcctgggctccgagcttgggtgctataccattaacagagtgcggtctttcaaactgtgtgaaaatagcgctacaggaaagtcctgcgagatcgattctattcctgtgaaatgtaagcagggcttttgcctcaaaatcacccaggagggccgcgggcatgtcaagctgagcagaggatccgaagtggttcttgacgtgtgtgatagctcttgcgaggtcatgatcccgaagggcacaggggacattctggtggattgttccggaggccagcaacacttcctcaaagacaacctggttgatctggggtgccccaagatccctctcctgggaaaaatggccatttacatctgtcggatgagcaatcatcccaagaccacgatggcgtttcttttctggttttctttcggctatgtgattacctgcatcctgtgcaaagctatctttttcctcctgattatctttggcacacttgggaagcgcttcaagcagtacagagaactgaaacctcagacctgtacaatttgcgagaccacgcccgtcaacgccatcgacgccgagatgcacgatctcaattgttcctataacatttgcccttactgtgctagccggctgacatctgacggactggcccgccatgtgacccagtgcccgagacggaaggaaaaagtggaggaaacagagctctatctgaatcttgaacgcatcccctgggtcgttagaaagctgctccaagtgtccgagagcaccggcaccgtgctgaaacggtcctcttggcttattgtcctgctcgtgctgtttacagttagcctgtcccctgtgcagagcgctcccatcgggcgcagacctctcttcctggactctatcgtcaaggatatgaaaaaccttcttaattccacgagcctcgagacctctctgagcattgaagccccctggggagcgatcaacgtgcagtccacatacaagccgaccgtttctacagccaatattgctcttagctggtccagcgtggagcaccggggcaacaaggtcctggtgtctgggagatccgaaagcatcatgaaactcgaggaacgcaccggaatttcttgggacctgggcgtcgaggatgcctccgagagcaagctgctcacggtgtccgttatggacctgtctcagatgtacagccctgtgtttgaatatctttccggcgatcggcaagtcgaggaatggcccaaagctacatgtaccggggactgccctgagagatgtggatgcacctctagcacatgtctgcacaaggaatggccccattcccgcaattggcggtgcaaccccacctggtgctggggcgtggggacaggatgtacgtgctgtggcctcgatgttaaagacctgttcaccgattacatgttcgtgaagtggaaggtcgagtatatcaaaacagaggccatcgtgtgcgtggaactgaccagccaggagagacagtgttctcttattgaagcggggacacgctttaacctcggctccgttaccatcacgctgagcgagcctcggaatattcaacagaagctgccgcccgagatcattaccctccaccctaaaatcgaagagggattctttgacctgatgcatgtccagaaggtgctttctgcctccacagtgtgcaaactgcagagctgtacccacggcgtccccggggatctccaagtgtaccacattggaaacctgctgaagggcgacagagttaatgggcatcttatccacaagatcgaacagcatttcaacacatcttggatgagctgggacggatgcgatctcgactattactgtaatatgggcgattggccttcctgcacctatacgggggtgacacagcacaaccatgctagctttgtcaatctgctgaacattgagaccgactacacaaaaaccttccactttcactctaagcgcgtgaccgcccatggcgatacaccccagctcgacctgaaagctcggccgacgtacggagccggcgaaatcaccgttcttgtggaggtcgccgatatggagctgcacacaaagaaaattgaaatctccgggctcaagttcgctggactgacctgtacaggctgctatgcgtgcagctccgggatttcttgtaaggtgagaatccatgttgacgagcctgatgaactgaccgtgcacgtcaaaagcgacgatcccgacgtggtggccgcttcctctagccttatggcccgcaagctcgagtttggaacggattccacattcaaagccttttctgctatgcctaagaccagcctgtgcttctacatcgtcgaacgggagtattgtaaatcctgcagcaaggaggacacccaaaaatgtgttaatacaaagctggaacagccccagtctattctcatcgagcacaagggcaccattatcgggaaacagaacaatacatgcacggccaaggcgtcctgttggctggaaagcgtgaaatcctttttctacggccttaagaacatgctgggaggcattttcgggaatgtgtttatcggaatcttcacctttctcacacctttcattctgctgatctttttctttatgttcggctggcggattctgttttgcttcaaatgttgcagacgcaccagagggctctttaagtatcggcatctgaaggacgatgaggaaacaggatacagaaaaatcattgagcgcctgaacaataagaaaggcaagaaccggctcctggacggggagagacttgctgatcgcaaaatcgccgaactgttctctaccaagacgcacatcggc

SEQ ID NO: 13889 - RNA, 2916 nt, synthetic construct
  misc_feature 1..2916: note = derived and/or modified CDS sequence (opt5) from CCHFV(SPU 44/08, Artificial)__KJ682805.1__Gn-4aa-Gc
  source 1..2916: mol_type = other RNA
agcgaggaatccaacgacgattgcctgtctagaacccagctcctgcggacagagaatgccgaaatccacagcgacaactacggcgggcccggagataagattacgatctgtaatggctccaccattgtggaccaacgccttgggtctgagctgggatgctatacaatcaacagagtcaaatctttcaagctctgtgaaaattccgctaccggcaaatcttgcgagattgatagcacacctgttcggtgtcgccaggggttttgcctgaagatcacccaggagggaagaggccatgtgaaactttcccggggcagcgaagtggtcctggacgcctgtgattcttcctgcgagatcatgattccgaaggggacaggagacatcctcgtggattgtagcggcgggcagcaacacttcctgaaggacaacctggttgatctcggatgccccaatattcctctgcttggcaaaatggcgatctacatttgtcgcatgtctaaccatcccaagaccacgatggcttttctgttctggttttccttcgggtatgtgatcacatgcattctctgcaaagccatcttttacctgcttatcgtcgtgggaacactgggcaagaaattcaagcagtatagagaactcaagcctcagacctgtacaatttgcgagaccaatcccgttaacgccatcgacgctgagatgcacgatctgaattgtagctacaacatttgcccttattgtgcctctcggctgacgtccgacggcctcgctcgccatgtgatgcagtgcccgaaaagaaaggaaaagatcgaggaaacagagctgtaccttaatctggaacggattccctgggtcgtgcgcaagctcctgcaagtgagcgagtccaccggggtcgcccttaaaagatctagctggctggttatcctcctggtgctgctcacagtgtccctgagccctgtccagtctgcgcccatctcccggaagcctctttttctggacagcattgtgaaaggaatgaagaacctccttaattctaccagcctggagacctccctgtctatcgaagccccctggggcgctattaacgttcagagcacattcaagccgacggtgtccgccgctaacatcgccctcagctggtcttccgtcgagcaccgcgggaataaaattctggtgagcggaagatctgaatccatcatgaagctggaggaacggaccggcatcagctgggatctcggggttgaggacgcgtccgagtctaaactgcttacagtgagcgtcatggatctgtcccagatgtactctcctgtgtttgaatatctcagcggagacagacaagtcgaggaatggcccaaggccacctgtacaggcgattgccctgagcgctgtggctgcacctccagcacgtgtctgcacaaagaatggccccattctcggaactggagatgcaatcccacatggtgctggggagtgggaaccggctgtacctgctgtgggctggacgttaaggatcttttcacagactacatgtttgtgaagtggaaagtcgattatattaagaccgaggctatcgtgtgcgttgagctcacatcccaggaacgccagtgtagcctgattgaggccggaacgcggttcaacctgggccctgtgaccatcacactctctgaaccgagaaatattcaacagaaactgccccctgagatcgtcacccttcacccccgcattgaggaagggttctttgacctgatgcatatccagaaggtgctctccgctagcacagtgtgcaaactgcagtcttgtacccacggcgttcctggagatctgcaaatctaccacattggcaaccttctcaagggggacaaggtcaatggacatctgatccacaaaattgagccccatttcaacacgagctggatgtcctgggacggctgcgatctggactattactgtaatatgggggattggccgagctgctcttataccggagtgacacagcacaaccatgccgcctttgtgaatatgctcaacatcgaaaccgactacacaaagaatttccactttcactccaaacgggtcaccgctcatggcgatacgcctcagctggaccttaaggcgagacccacatacggggccggcgagattaccgtgctggttgaagtggctgatatggagctccacaccaaaaagatcgagatcagcggactgaagttcgcctccctgacctgtaccggctgctatgcctgctctagcgggatttcctgtaaagtccgcatccatgtggacgaacctgatgagcttacagttcacgtgaagtctgaagaccccgatattgtcgctgccagctcctctctcatggcgcggaaactggagtttggaacggacagcaccttcaaggctttttccgccatgcctaaaacaagcctgtgcttctacatcgtggaaagagagtattgtaagtcttgctccaaagaggatacccagaagtgtgttaacacaaagctcgaacaaccccagagcattctgatcgagcacaaaggcaccatcattgggaagcagaatgacacgtgcacagccaaagctagctgttggcttgaatccatcaagagctttttctacggactgaaaaacatgctctctggcatttttgggaacgtgttcatcggcattttcctgtttctggccccgttcatcatgcttatcctctttttcatgtttggatggcgcattctgttctgctttaagtgttgccggagaacccggggcctgttcaagtatcgccatctcaaagacgatgaggaaatcgggtacagaaagattatcgagcggctgaataacaaaaaggggaaaaataaacttctggacggcgagagactcgctgatcgcaagattgccgaactgttttccaccaaaacacacatcggg

SEQ ID NO: 13890 - RNA, 2916 nt, synthetic construct
  misc_feature 1..2916: note = derived and/or modified CDS sequence (opt5) from CCHFV(SPU 383/87, Artificial)__KJ682806.1__Gn-4aa-Gc
  source 1..2916: mol_type = other RNA
agcgaggaatccaacgacgattgcctgtctagaacccagctcctgcggacagagaatgccgaaatccacagcgacaactacggcgggcccggagataagattacgatctgtaatggctccaccattgtggaccaacgccttgggtctgagctgggatgctatacaatcaacagagtcaaatctttcaagctctgtgaaaattccgctaccggcaaatcttgcgagattgatagcacacctgttcggtgtcgccaggggttttgcctgaagatcacccaggagggaagaggccatgtgaaactttcccggggcagcgaagtggtcctggacgcctgtgattcttcctgcgagatcatgattccgaaggggacaggagacatcctcgtggattgtagcggcgggcagcaacacttcctgaaggacaacctggttgatctcggatgccccaatattcctctgcttggcaaaatggcgatctacatttgtcgcatgtctaaccatcccaagaccacgatggcttttctgttctggttttccttcgggtatgtgattacctgcatcctctgcaaagtcatcttttacctgcttgtggttgtgggaacactgggcaagaaattcaagcagtatagagaactcaagcctcagacctgtacaatctgcgagaccaatcccgtcaacgccattgacgccgagatgcacgatctgaattgtagctacaacatctgcccttattgtgcttctcggctgacgtccgacggcctcgcccgccatgtgattcagtgcccgaaaagaaaggaaaagatcgaggaaacagagctgtaccttaatctggaacggattccctgggtggtccgcaagctcctgcaagttagcgagtccaccggggtggctcttaaaagatctagctggctggtgatcctcctggtcctgctcacagtgtccctgagccctgttcagtctgcccccatctcccggaagcctctttttctggacagcattgtgaaaggaatgaagaacctcctgaatagcaccagccttgagacctccctgtctatcgaagcgccctggggcgccattaacgtccagagcacattcaagccgacggtgtccgctgccaacatcgctctcagctggtcttccgttgagcaccgcgggaataaaattctggtgagcggaagatctgaatccatcatgaagctggaggaacggaccggcatcagctgggatctcggggtcgaggacgcctccgagtctaaactgcttacagtgagcgtcatggatctgtcccagatgtactctcctgtgtttgaatatctcagcggagacagacaagttgaggaatggcccaaggcgacctgtacaggcgattgccctgagcgctgtggctgcacctccagcacgtgtctgcacaaagaatggccccattctcggaactggagatgcaatcccacatggtgctggggagtgggaaccggctgtacctgctgtgggctggacgtcaaggatcttttcacagactacatgtttgtgaagtggaaagttgattatattaagaccgaggccatcgtgtgcgtcgagctcacatcccaggaacgccagtgtagcctgattgaggctggaacgcggttcaacctgggccctgtgaccatcacactctctgaaccgagaaatattcaacagaaactgccccctgagatcgtgacccttcacccccgcattgaggaagggttctttgacctgatgcatatccagaaggttctctccgccagcacagtctgcaaactgcagtcttgtacccacggcgtgcctggagatctgcaaatctaccacattggcaaccttctcaagggggacaaggtgaatggacatctgatccacaaaattgagccccatttcaacacgagctggatgtcctgggacggctgcgatctggactattactgtaatatgggggattggccgagctgctcttataccggagtcacacagcacaaccatgctgcctttgtgaatatgctcaacatcgaaaccgactacacaaagaatttccactttcactccaaacgggttaccgcccatggcgatacgcctcagctggaccttaaggctagacccacatacggggcgggcgagattaccgtgctggtcgaagtggccgatatggagctccacaccaaaaagatcgagatcagcggactgaagttcgcttccctgacatgtaccggctgctatgcctgctctagcgggatttcctgtaaagttcgcatccatgtggacgaacctgatgagcttacagtccacgtgaagtctgaagaccccgatattgttgccgctagctcctctctcatggcccggaaactggagtttggaacggacagcaccttcaaggcgttttccgctatgcctaaaacaagcctgtgcttctacatcgtggaaagagagtattgtaagtcttgctccaaagaggatacccagaagtgtgtcaacacaaagctcgaacaaccccagagcattctgatcgagcacaaaggcaccatctttgggaagcagaatgacacgtgcacagccaaagcctcttgttggcttgaatccgtcaagagcttcttttacggactgaaaaacatgctctctggcattttcgggaacgtgttcatcggcgtgtttctgttcctggctccgtttattatgcttatcctcttctttatgttcggatggcgcattctgttttgcttcaagtgttgccggagaacccggggcctgtttaagtatcgccatctcaaagacgatgaggaaatcgggtacagaaagatcattgagcggctgaataacaaaaaggggaaaaataaacttctggacggcgagagactcgccgatcgcaagatcgctgaactgttctccaccaaaacacacattggg

SEQ ID NO: 13891 - RNA, 2916 nt, synthetic construct
  misc_feature 1..2916: note = derived and/or modified CDS sequence (opt5) from CCHFV(SPU 130/89, Artificial)__KJ682807.1__Gn-4aa-Gc
  source 1..2916: mol_type = other RNA
agcgaggaacccaactacgactgcctgtccagaacccagctcctgcggacagagaatgccgaaatccactctgataactatggcgggcctggagacaagattacgatctgtaatggcagcaccattgtggatcaacgccttgggtccgagctgggatgctacacaatcaacagagtcaaatctttcaagctctgtgaaaatagcgctaccggcaaatcctgcgagattgactctacaccggttcggtgtcgccaggggttttgcctgaagatcacccaggagggaagaggccatgtgaaacttagccggggctccgaagtggtcctggatgcctgtgacagctcttgcgagatcatgattcccaaggggacaggagatatcctcgtggactgttccggcgggcagcaacacttcctgaaggataacctggttgacctcggatgccctaatattcccctgcttggcaaaatggcgatctatatttgtcgcatgagcaaccatcctaagaccacgatggcttttctgttctggttttctttcgggtacgtgatcacatgcattctctgcaaagtcatcttttatctgcttatcgtggttggaacactgggcaagaaattcaagcagtacagagaactcaagccccagacctgtacaatttgcgagaccaatcctgtgaacgccatcgatgccgagatgcacgacctgaattgttcctataacatttgcccgtactgtgctagccggctgacgtctgatggcctcgcccgccatgtcatgcagtgccccaaaagaaaggagaaaatcgaagaaacagagctgtaccttaatctggaacggattccttgggtggtgcgcaagctcctgcaagtctccgagagcaccggggttgctcttaaaagatcctcttggctggtggtgctcctggtcctgctcacagtgagcctgtcccccgttcagagcgcccctatctctcggaagcccctttccctggacagcatcgtgaaaggaatgaagaacctcctgaatagcaccagccttgagacctccctgtctattgaagcgccgtggggcgccatcaacgtccagagcacatttaagcctacggtgtccgctgccaacattgctctcagctggtcttccgttgagcaccgcgggaataaaatcctggtgagcggaagatctgaatccattatgaagctggaggaacggaccggcatcagctgggacctcggggtcgaggatgcctccgagtctaaactgcttacagtgagcgtcatggacctgtcccagatgtattctcccgtgttcgaatacctcagcggagatagacaagttgaggaatggcctaaggcgacctgtacaggcgactgccccgagcgctgtggctgcacctccagcacgtgtctgcacaaagaatggccccattctcggaactggagatgcaatcctacatggtgctggggagtggggaccggctgtacctgctgtgggctggatgtcaaggacctttttacagattatatgttcgtgaagtggaaagttgactacatcaagaccgaggccattgtgtgcgtcgagctcacatcccaggaacgccagtgtagcctgatcgaggctggaacgcggtttaacctgggcccggtgaccattacactctctgaacccagaaatatccaacagaaactgcctcccgagattgtgacccttcaccctcgcatcgaggaagggttcttcgatctgatgcatattcagaaggttctctccgccagcacagtctgcaaactgcagtcttgtacccacggcgtgcccggagacctgcaaatctatcacatcggcaaccttctcaagggggataaggtgaatggacatctgattcacaaaatcgagccgcattttaacacgagctggatgtcctgggacggctgcgacctggattactattgtaatatgggggactggcctagctgctcttacaccggagtcacacagcacaaccatgctgccttcgtgaatatgctcaacattgaaaccgattacacaaagaattttcacttccactccaaacgggttaccgcccatggcgacacgccccagctggatcttaaggctagacctacatatggggcgggcgagatcaccgtgctggtcgaagtggccgacatggagctccacaccaaaaaggttgagattagcggactgaagtttgcttccctgacctgtaccggctgctacgcctgctctagcgggatctcctgtaaagtgcgcatccatgtcgatgaacccgacgagcttacagtgcacgttaagtctgaagatcctgacattgtggccgctagctcctctctcatggcccggaaactggagttcggaacggatagcacctttaaggcgttctccgctatgcccaaaacaagcctgtgcttttatatcgtcgaaagagagcactgtaagtcttgctccaaagaggacacccagcgctgtgtgaacacaaagctcgaacaaccgcagagcattctgatcgagcataagggcaccattatcgggaaacagaatgatacgtgcacagccaaggcctcttgttggcttgaatccatcaaatctttcttttacggactgaagaacatgctctctggcattttcgggaacgtgtttatcggcgtcttcctgttcctggctccttttattatccttattctcttctttatgttcggatggcggatcctgttttgcttcaaatgttgcagacggacccgcggcctgctcaagtatagacacctgaaggacgacgaggaaatcgggtaccggaaaattatcgagagacttaataacaagaaaggaaagaataaactgctcgatggcgagcgcctggccgaccggaagattgctgaactgttttccaccaagacacatatcggg

SEQ ID NO: 13892 - RNA, 2916 nt, synthetic construct
  misc_feature 1..2916: note = derived and/or modified CDS sequence (opt5) from CCHFV(SPU 497/88, Artificial)__KJ682808.1__Gn-4aa-Gc
  source 1..2916: mol_type = other RNA
agcgaggaatccaacgacgattgcctgtctagaacccagctcctgcggacagagaatgccgaaatccacagcgacaactacggcgggcccggagataagattacgatctgtaatggctccaccattgtggaccaacgccttgggtctgagctgggatgctatacaatcaacagagtcaaatctttcaagctctgtgaaaattccgctaccggcaaatcttgcgagattgatagcacacctgttcggtgtcgccaggggttttgcctgaagatcacccaggagggaaaaggccatgtgaaactttccagaggcagcgaagtggtcctggacgcctgtgattcttcctgcgagatcatgattccgaaggggacaggagacatcctcgtggattgtagcggcgggcagcaacacttcctgaaagacaacctggttgatctcggatgccccaatattcctctgcttggcaagatggcgatctacatttgtcggatgtctaaccatcccaaaaccacgatggtgtttctgttctggttttccttcgggtatgtcattacctgcattctctgcaaggtgatcttttacctgcttatcgttgtgggaacactgggcaaaaagttcaagcagtatcgcgaactcaaacctcagacctgtacaatttgcgagaccaatcccgtcaacgctatcgacgccgagatgcacgatctgaattgtagctacaacatttgcccttattgtgcctctagactgacgtccgacggcctcgctcggcatgtgatgcagtgcccgaagcgcaaagaaaagatcgaggaaacagagctgtaccttaatctggaaagaatcccctgggtggtccggaaactcctgcaagttagcgagtccaccggggtggcccttaagcgctctagctggctggtgatcctcctggtcctgctcacagtgtccctgagccctgttcagtctgctcccatctccagaaaacctctttttctggacagcattgtgaagggaatgcggaacctcctgaatagcaccagccttgagacctccctgtctatcgaagccccctggggcgcgattaacgtccagagcacattcaagccgacggtgtccgccgctaacatcgccctcagctggtcttccgttgagcaccgcgggaataaaattctggtgagcggaagatctgaatccatcatgaagctggaggaacggaccggcatcagctgggatctcggggtcgaggacgcttccgagtctaaactgcttacagtgagcgtcatggatctgtcccagatgtactctcctgtgtttgaatatctcagcggagacagacaagttgaggaatggcccaaggccacctgtacaggcgattgccctgagcgctgtggctgcacctccagcacgtgtctgcacaaagaatggccccattctcggaactggagatgcaatcccacatggtgctggggagtggggaccggctgtacctgctgtgggctggacgtcaaggatcttttcacagactacatgtttgtgaagtggaaagttgattatattaagaccgaggcgatcgtgtgcgtcgagctcacatcccaggaacgccagtgtagcctgattgaggccggaacgcggttcaacctgggccctgtgaccatcacactctctgaaccgagaaatattcaacagaaactgccccctgagatcgtgacccttcacccccgcattgaggaagggttctttgacctgatgcatatccagaaggttctctccgctagcacagtctgcaaactgcagtcttgtacccacggcgtgcctggagatctgcaaatctaccacattggcaaccttctcaagggggacaaggtgaatggacatctgatccacaaaattgagccccatttcaacacgagctggatgtcctgggacggctgcgatctggactattactgtaatatgggggattggccgagctgctcttataccggagtcacacagcacaaccatgccgcttttgtgaatatgctcaacatcgaaaccgactacacaaagaatttccactttcactccaaacgggttaccgcccatggcgatacgcctcagctggaccttaaggccagacccacatacggggctggcgagattaccgtgctggtcgaagtggcggatatggagctccacaccaaaaagatcgagatcagcggactgaagttcgcctccctgacatgtaccggctgctatgcttgctctagcgggatttcctgtaaagttcgcatccatgtggacgaacctgatgagcttacagtccacgtgaagtctgaagaccccgatattgttgccgccagctcctctctcatggctcggaaactggagtttggaacggacagcaccttcaaggccttttccgcgatgcctaaaacaagcctgtgcttctacatcgtggaaagagagtattgtaagtcttgctccaaagaggatacccagaagtgtgtcaacacaaagctcgaacaaccccagagcattctgatcgagcacaaaggcaccatcattgggaagcagaatgacacgtgcacagctcgcgcctcttgttggcttgaatccatcaagagctttttctacggactgaagaacatgctctctggcatttttgggaacgtgttcatcggcattttcctgtttttcgccccgtttatcatgctgatccttttctttatgttcggatggcggattctcttttgcttcaaatgttgcagacggacccgcggcctgtttaagtatagacatctgaaggacgatgaggaagtggggtaccggaaaatcattgagagactcaataacaagaaaggaaagaataaactgcttgacggcgagcgcctggctgatcggaagatcgccgaactcttctccaccaagacacacattggg

SEQ ID NO: 13893 - RNA, 2916 nt, synthetic construct
  misc_feature 1..2916: note = derived and/or modified CDS sequence (opt5) from CCHFV(SPU 18/88, Artificial)__KJ682810.1__Gn-4aa-Gc
  source 1..2916: mol_type = other RNA
agcgaggaatccaacgacgattgcctgtctagaacccagctcctgcggacagagaatgccgaaatccacagcgacaactacggcgggcccggagataagattacgatctgtaatggctccaccattgtggaccaacgccttgggtctgagctgggatgctatacaatcaacagagtcaaatctttcaagctctgtgaaaattccgctaccggcaaatcttgcgagattgatagcacacctgttcggtgtcgccaggggttttgcctgaagatcacccaggagggaagaggccatgtgaaactttcccggggcagcgaagtggtcctggacgcctgtgattcttcctgcgagatcatgattccgaaggggacaggagacatcctcgtggattgtagcggcgggcagcaacacttcctgaaggacaacctggttgatctcggatgccccaatattcctctgcttggcaaaatggcgatctacatttgtcgcatgtctaaccatcccaagaccacgatggggtttctgttctggttttccttcggatatgtgatcacatgcattctctgcaaagtcatcttttacctgcttatcgtggttggcacactgggcaagaaattcaagcagtatagagaactcaagcctcagacctgtacaatttgcgagaccaatcccgtgaacgctatcgacgccgagatgcacgatctgaattgtagctacaacatttgcccttattgtgcctctcggctgacgtccgacgggctcgctcgccatgtcatgcagtgcccgaaaagaaaggagaaaatcgaagaaacagagctgtaccttaatctggaacggattccctgggtggtgcgcaagctcctgcaagtcagcgagtccaccggagttgcccttaaaagatctagctggctggtgatcctcctggtgctgctcacagtctccctgagccctgtgcagtctgctcccatctcccggaagcctctttttctggacagcattgttaaaggcaagaagaacctcctgaatagcaccagccttgagacctccctgtctatcgaagccccctggggagcgattaacgtgcagagcacattcaaaccgacggtctccgccgctaacatcgccctcagctggtcttccgtggagcaccgcgggaataagattctggttagcggcagatctgaatccatcatgaaactggaggaacggaccgggatcagctgggatctcggagtggaggacgcttccgagtctaagctgcttacagtcagcgtgatggatctgtcccagatgtactctcctgtctttgaatatctcagcggcgacagacaagtggaggaatggcccaaagccacctgtacaggcgattgccctgagcgctgtgggtgcacctccagcacgtgtctgcacaaggaatggccccattctcggaactggagatgcaatcccacatggtgctggggagttggcaccgggtgtacctgctgtggactggacgtgaaggatcttttcacagactacatgtttgtcaaatggaaggtggattatattaaaaccgaggcgatcgtttgcgtggagctcacatcccaggaacgccagtgtagcctgattgaggccggcacgcggttcaacctggggcctgtcaccatcacactctctgaaccgagaaatattcaacagaagctgccccctgagatcgtgacccttcacccccgcattgaggaaggcttctttgacctgatgcatatccagaaagtgctctccgctagcacagtttgcaagctgcagtcttgtacccacggagtccctggcgatctgcaaatctaccacattgggaaccttctcaagggagacaaagtgaatggccatctgatccacaagattgagccccatttcaacacgagctggatgtcctgggacgggtgcgatctggactattactgtaatatgggagattggccgagctgctcttataccggcgtgacacagcacaaccatgccgcttttgtcaatatgctcaacatcgaaaccgactacaccaaaaatttccactttcactccaagcgggtgaccgcccatggggatacgcctcagctggaccttaaagccagacccacatacggcgctggagagattaccgttctggtggaagtcgcggatatggagctccacacaaagaagatcgagatcagcggcctgaaattcgcctccctgacctgtaccgggtgctatgcttgctctagcggaatttcctgtaaggtgcgcatccatgttgacgaacctgatgagcttacagtgcacgtcaaatctgaagaccccgatattgtggccgccagctcctctctcatggctcggaagctggagtttggcacggacagcaccttcaaagccttttccgcgatgcctaagacaagcctgtgcttctacatcgttgaaagagagtattgtaaatcttgctccaaggaggatacccagaagtgtgtgaacacaaaactcgaacaaccccagagcattctgatcgagcacaaggggaccatcattggaaaacagaatgacacgtgcacaggcaaggctgggtgttggcttgaatctatcaaatcctttttctacggcctgaagaacatgctcagcggaatttttggcaacgtcttcatcgggattttcctgtttctggccccgttcatcatgcttatcctctttttcatgtttggatggcgcattctgttctgctttaagtgttgccggagaacccggggcctgttcaaatatcgccatctcaaggacgatgaggaaatcgggtacagaaaaattatcgagcggctgaagaataaaaagggaaagaacaaacttctggacggcgagagactcgccgatcgcaagattgctgaactgttttctaccaaaacacacatcggg

SEQ ID NO: 13894 - RNA, 2916 nt, synthetic construct
  misc_feature 1..2916: note = derived and/or modified CDS sequence (opt5) from CCHFV(SPU 431/85, Artificial)__KJ682812.1__Gn-4aa-Gc
  source 1..2916: mol_type = other RNA
agcgaggaatccgacggcgattgcatctctagaacccagctgctccggacagagacgaccgaaattcacagcgacaactacgggggacccggcgataagatcacaatttgtaatgggtccaccatcgtggaccaacgcctgggatctgagcttggctgctatacaattaacagagtcaagagcttcaagctgtgtgaaaattccgccaccgggaaatcttgcgagatcgatagcacacctgttaagtgtcggcagggattttgcctcaaaatcacccaggagggccgcggccatgtgaagctgtccagagggagcgaaattgtgcttgacgcttgtgattctaactgcgagatcatgattccgaagggaacgggcgacatcctggtcgattgttccgggggacagcaacacttcctcaaagacaatctgattgatctgggctgccccaacatccctctcctggggaagatggccatttacatctgtcggatgagcaatcatcccaaaaccacaatggcgtttcttttctggttttctttcggatatgtgatcacatgcattctgtgcaaggttatcttttacctcctgattgtggctggcacagtcggcaaaaagttcaagcagtatcgcgaacttagacctcagacctgtacgatctgcgagacaattcccgtgaacgccatcgacgccgagatgcacgatctgaattgttcctacaacatctgcccttattgtgctagccggctcacctctgacgggctggcccgccatgttatgcagtgcccgaaaagaaaggaaaaagtggaggaaacagagctgtacctcaatctggaacggattccctgggtcgtgcgcaaacttctgcaagtgtccgagagcaccggagtcgctctcaaaagatcctcttggctgaccgttcttctggtgctcctgatcgtgagcctgtcccctgtccagagcgcccccattggccggaagcctctctttctggactctatcgtgaaagggcgcaagaaccttcttaattccacaagcctcgagacgtctctgagcattgaagcgccctggggagccatcaacgttcagtccaccttcaagccgacagtgtctgctgccaatatcgctcttagctggtccagcgtcgagcacagaggcaacaaaattctggtgtctgggcggtccgaaagcatcatgaagctcgaggaaagaaccggaatttcttgggatctgggcgttgaggacgcctccgagagcaaactgctcacagtgtccgtcatggatctgtctcagatgtacagccctgtgtttgaatatctttccggcgaccgccaagtcgaggaatggcccaaggcgacctgtacgggggattgccctgagcggtgtggatgcacatctagcacctgtctgcacaaagaatggccccattccagaaactggcgctgcaatcccacctggtgctggggcgtggggacaggatgtacctgctgtggcctcgacgttaaggatctgttcacagactacatgtttgtgaagtggaaagtcgagtatatcaagacggaggccattgtgtgcgttgaactgaccagccaggagcggcagtgttctcttatcgaagctgggacaagattcaacctcggccctgtgaccattacactgtccgagccgcgcaatatccaacagaaactgccccctgagatcattaccctccacccccggatcgaagagggattctttgatctgatgcatgtccagagagtgcttagcgcctctacggtgtgcaagctgcagtcctgtacccacggcgttcctggggacctccaagtctaccacattggaaacctgctgaaaggcgataaggtgaatgggcatcttatccacaagattgaaccccatttcaacacaagctggatgtcttgggacggatgcgacctcgattattactgtaatatgggcgactggccgagctgcacctatacaggggtgacccagcacaaccatgctgcctttgtcaatctgctgaacatcgagacggattacaccaaaaatttccactttcactccaagcgcgtgaccgcccatggcgacacacctcagctcgatctgaaagctcggcccacctacggagcgggcgaagttaccgtgcttgtcgaggtggccgacatggagctgcacacaaagaaaatcgaaattagcgggctcaagttcgcttctctgacgtgtaccggatgctatgcctgctccagcggcatctcctgtaaggttaaaattcatgtggatgagcctgacgaactgacagtccacgtgaagtctgaggatcccgacatcgttgccgctgggagctcccttatggccagaaaactcgaatttggagcggattctaccttcaaggcttttagcgccatgcctaaaacatccctgtgcttctacattgtggagcgcgagtattgtaagtcttgcagccgggaagacaccagaaaatgtgtcaacacgaagctggatcggccccagtccatcctcatcgagcacaagggcacaattatcgggaaacaaaataatacctgcaccgccaaggctagctgttggctggaatctgtgaaatcctttttctacggccttaagaacatgctgagcggaatttttggcaacgtgttcatcgggattttcctctttatcgccccgttcgtcctgctgatcctgtttttcatgtttggatggcgcattctcttctgctttaaatgttgcagacggacaagaggcctgttcaagtatcgccatctgaaggacgacgaggaaaccgggtaccggaaaatcattgagagactcaacaataagaaaggaaagaacaaactgcttgatggcgagcgcctggctgacagaaagatcgccgaactcttttctacaaagtcccacattggg

SEQ ID NO: 13895 - RNA, 2916 nt, synthetic construct
  misc_feature 1..2916: note = derived and/or modified CDS sequence (opt5) from CCHFV(SPU 48/90, Artificial)__KJ682813.1__Gn-4aa-Gc
  source 1..2916: mol_type = other RNA
agcgaggaaccctccgacgattgcatctctagaacccagctgctccggacagagacggccgaaattcacggcgacaactacgggggacctggcgataagatcaccatttgtaatgggagcacaatcgtggaccagcgcctgggatccgagcttggctgctataccattaacagagtcaaatctttcaagctgtgtgaaaatagcgctacagggaaatcctgcgttatcgattctgtgccggtgaagtgtcggcagggatactgcctccgcatcacccaggagggcagaggccatgtcaaactgagccgggggtccgaggtggttcttgacgcctgtgatacaagctgcgaaattatgatccccaagggaaccggcgacattctggtggattgttctgggggacagcaacactttctcaaggacaacctgatcgatctgggctgccctaaaattcccctcctggggaagatggcgatctatatttgtcgcatgtccaatcatcctacgaccacaatggctttccttttctggttcagctttggatacgtcattacctgcatcctgtgcaaagccattttctatctcctgatcattatcggcacacttggcaagagatttcggcagtaccgcgagctgaaaccccagacctgtacgatttgcgaaacaacccctgtgaacgccatcgacgctgagatgcacgatctcaattgttcttataacatctgcccgtactgtgcctccagactgacaagcgacgggctggctcggcatgttacccagtgccccaagcgcaaggagaaagtggaagagaccgaactctacctgaatcttgagagaatcccttgggtcgtgcggaagctgctccaagtgtctgaatccacaggagtcgccctgaaacgcagctcctggcttatcgttctgctcgtgctgttcacggtgtctctgagccccgtccagtccgcgcctattggcagaaagcccctctttcgggacagcatcgtgaaagggatgaagaacctgcttaattctacctccctggagacaagcctctctattgaggccccgtggggagctatcaacgttcagagcacctataaacctacagtgtccaccgccaatatcgctctgtcttggagctccgtcgaacacagaggcaacaagattcttgtgagcgggcgctctgagtccatcatgaagctggaggaacggacgggaattagctgggatctcggcgttgaagacgcctctgagtccaaactgctgacagtgagcgtcatggatctctcccagatgtactctcccgtgttcgagtatctgagcggcgacagacaagtcgaagagtggcctaaggcgacctgtaccggggattgccccgaacgctgtggatgcacatcctctacctgtcttcacaaagagtggccccatagccggaattggagatgcaaccctacatggtgctggggcgtggggacgggatgtacctgctgtggcctggacgttaaggatctctttacagactacatgttcgtgaaatggaaggtcgaatatatcaagaccgaggccattgtgtgcgttgagctgacatcccaggaacgccagtgtagcctgatcgaggctgggacccggtttaaccttggcccggtgacgattaccctctctgaacccagaaatatccaacagaaactgcctcccgagatcattacactgcaccctcgcatcgaggaaggattcttcgatctcatgcatgtccagaaggtgctgtccgccagcaccgtgtgcaaacttcagtcttgtacacacggcgttcccggggacctgcaagtctaccacattggaaacctcctgaagggcgataaagtgaatgggcatctgatccacaagattgagccgcattttaacacctcctggatgagctgggacggatgcgaccttgattattactgtaatatgggcgactggccttcttgcacgtacacaggggtgacccagcacaaccgggctagcttcgtcaatctcctgaacatcgaaacagattataccaagaattttcatttccactccaaaagagtgaccgcccacggcgacacaccccagctggatctcaaggcccgccctacgtacggagctggcgagatcaccgttctggtggaagtcgcggacatggagcttcatacaaagaagattgagatcagcgggctgaaatttgcctctctcacctgtacaggatgctatgcttgctccagcggcatttcctgtaaggtgcggatccacgttgatgaacccgacgagctgaccgtgcatgtcaagtctgatgaccctgatgtggttgccgccagctcctctctgatggctagaaaacttgaatttgggacggacagcacatttaaggccttctccgcgatgcccaaaacctctctctgcttttacattgtggagaaggaatattgtaaaagctgctccgaggaggataccaagaaatgtgtcaacacaaagctggaacagccgcaaagcatcctgatcgagcacaagggaaccattatcggcaaacaaaattctacatgcacggctaaggtgtcctgttggctcgaaagcgccaaatctttcttttacgggctgaaggacatgctttccggcattttcggaaacgtgtttatcggcattttcctgttcctcgccccttttatcctgctgatccttttctttatgttcgggtggcggattctcctgtgctttaaatgttgccgcagaacccggggactgttcaagtatagacacctcaaggacgatgaggaaacaggctaccgccggatcattgagagactgaataacaaaaaggggaaaaataaacttctggacggagagcgcctcgctgatagacggatcgccgaactgtttagcaccaaaacacatattggc

SEQ ID NO: 13896 - RNA, 2916 nt, synthetic construct
  misc_feature 1..2916: note = derived and/or modified CDS sequence (opt5) from CCHFV(SPU 187/90, Artificial)__KJ682814.1__Gn-4aa-Gc
  source 1..2916: mol_type = other RNA
agcgaggaaccctccgacgattgcatctctagaacccagctgctccggacagagacggccgaaattcacggcgacaactacgggggacctggcgataagatcaccatttgtaatgggagcacaatcgtggaccagcgcctgggatccgagcttggctgctataccattaacagagtcaaatctttcaagctgtgtgaaaatagcgctacagggaaatcctgcgagatcgattctgttccggtgaagtgtcggcagggatactgcctccgcatcacccaggagggcagaggccatgtgaaactgagccgggggtccgaagtcgtgcttgacgcctgtgatacaagctgcgagattatgatccccaagggaaccggcgacattctggttgattgttctgggggacagcaacactttctcaaggacaacctgatcgatctgggctgccctaaaattcccctcctggggaagatggcgatctatatttgtcgcatgtccaatcatcctaaaacgaccatggctttcctgttttggttcagctttggatacgtgatcacatgcatcctgtgcaaggccattttctatctcctgatcattatcggcacccttggcaaaagatttaagcagtaccgggaactgaagccccagacatgtaccatttgcgagacgacacctgtcaacgccatcgacgctgagatgcacgatctcaattgttcttataacatctgcccgtactgtgcctcccgcctgaccagcgacgggctggctagacatgtgacacagtgccccaaacggaaggaaaaagttgaggaaaccgagctctacctgaatcttgaacgcattccttgggtggtcagaaagctgctccaagtgtctgagtccaccggagtggccctgaaacggagctcctggcttatcgtcctgctcgttctgttcacagtgtctctgagccccgtgcagtccgcgcctattggccgcagacccctctttctggacagcatcgtcaaggggatgaaaaaccttcttaattctacgtccctcgagaccagcctgtctattgaagccccgtggggagctatcaacgtgcagagcacatataagcctaccgtttccacagccaatatcgctctttcttggagctccgtggagcaccggggcaacaagattctggtcagcgggagatctgaatccatcatgaaactcgaggaacgcaccggaattagctgggatctgggcgtggaggacgcctctgagtccaagctgctcacggttagcgtgatggatctgtcccagatgtactctcccgtcttcgaatatcttagcggcgaccggcaagtggaggaatggcctaaagcgacatgtaccggggattgccccgagagatgtggatgcacctcctctacatgtctgcacaaggaatggccccatagccgcaattggcggtgcaaccctacctggtgctggggcgtcgggacaggatgtacgtgctgtggcctcgacgtgaaagatctgtttaccgactacatgttcgttaagtggaaggtggagtatatcaaaacagaggccattgtctgcgtggaactgacctcccaggagagacagtgtagccttatcgaagctgggacacgctttaacctcggcccggttaccattacgctgtctgagccccggaatatccaacagaagctgcctcccgagatcattaccctccaccctagaatcgaagagggattcttcgatctgatgcatgtgcagaaagtcctttccgccagcacagtgtgcaagctgcagtcttgtacccacggcgtgcccggggacctccaagtttaccacattggaaacctgctgaaaggcgataaggtcaatgggcatcttatccacaagattgaaccgcattttaacacatcctggatgagctgggacggatgcgacctcgattattactgtaatatgggcgactggccttcttgcacctacacgggggtgacacagcacaaccatgctagcttcgtgaatctgctgaacatcgagaccgattataccaaaaattttcacttccactccaagcgcgtcaccgcccatggcgacacaccccagctcgatctgaaagcccggcctacatacggagctggcgaaatcacggtgcttgttgaggtggcggacatggagctgcacaccaagaaaattgaaatcagcgggctcaagtttgcctctctgacatgtaccggatgctatgcttgctccagcggcatttcctgtaaggtcagaatccatgtggatgagcccgacgaactgacagttcacgtgaaatctgatgaccctgatgtcgtggccgccagctcctctcttatggctcgcaagctcgagttcgggaccgacagcatttttaaagccttctccgcgatgcccaagacgtctctgtgcttttacatcgttgaacgggagcactgtaaaagctgctccgaggaagatacaaagaaatgtgtgaacaccaagctggagcagccgcaaagcatcctcattgaacataagggaaccatcattggcaaacaaaattctacatgcaccgctaagacatcctgttggctggagagcgtcaaatctttcttttatgggcttaagaacatgctgtccggcatcttcggaaatgtgtttattggcatcttcctcttcctggccccttttatcctgcttattctcttctttatgttcgggtggagaatcctgttttgcttcaaatgttgccggcgcacgagaggactgtttaagtaccggcacctcaaggacgacgaagagaccggctatagacgcattatcgagcggctgaacaataaaaaggggaaaaacaaacttctggatggagaaagactcgccgaccgcagaattgctgagctgttcagcacaaagacccatatcggc

SEQ ID NO: 13897 - RNA, 2916 nt, synthetic construct
  misc_feature 1..2916: note = derived and/or modified CDS sequence (opt5) from CCHFV(Haskovo-V46/13, Artificial)__KR092379.1__Gn-4aa-Gc
  source 1..2916: mol_type = other RNA
agcgaggaactgggcgacgattgcatctccagaacccagctcctgcggacagagacggccgaaattcacgacgataactacgggggacccggcgacaagatcaccatttgtaatgggtctacaatcgtggatcaacgccttggaagcgagctgggctgctataccattaacagagggaaatccttcaagctctgtgaaaattctgctacaggaaaaacctgcgagatcgacagcacacctgtcaagtgtcggcagggcttttgcctgaaaatcacccaggagggccgcgggcatgttaaactttccagaggatctgaagtggtgctggatgcctgtgacagctcctgcgaggtcatgattccgaagggcacgggggatatcctcgtggactgtagcggaggccagcaacacttcctgaaggataacctgattgacctcgggtgcccccatatccctctgcttggaaagatggcgatttacatctgtcggatgtctaatcacccccgcaccacaatggcttttctgttctggttttccttcggctatgttattacctgcatcttttgcaaagccctcttctacagcctgatcattatcggcacacttgggaagaaaattaagcagtatagagaactgaagcctcagacctgtacgatctgcgagacaacccccgtgaacgccattgatgctgagatgcatgacctcaattgttcttacaacatctgcccttattgtgcctcccggctgacaagcgacggactggctcgccacgtcacccagtgcccgaaaagaaaggaaaaagtggaggaaaccgagctctacctgaatcttgaacggatcccctggattgttcgcaagctgctccaagtgtctgagtccacaggcgtcgccctgaaaagaagctcctggcttatcgtgctgctcgtgctgctgcctgtctctctcagccccgttcagtccgcgcctgtggggcggaagcccctgtttcttgatagcattgtgaaaggaatgaagaacctgctcaattctacgtccctggagaccagcctttctatcgaagccccgtggggcgctattaacgtccagagcacattcaagcctaccgtgtccacagccaatatcgctctgtcttggagctccgttgagcaccgcgggaacaaaatcctcgtgaccggaagaagcgaatctattatgaagctggaggaacggacgggcgtctcctgggacctgggcgtggaggatgccagcgagtctaaactcctgacagtttccatcatggaccttagccagatgtactcccccgtgtttgaatatctgtctggggatagacaagtcgaggaatggcctaaggcgacctgtaccggagactgccccgagcgctgtggctgcacaagctccacctgtctccataaagaatggccccactctcggaattggagatgcaaccctacatggtgctggggagtgggaacgggctgtacctgctgtggggtcgatgtgaaggacctgttcacagatcatatgtttgttaagtggaaagtggagtacattaagaccgaggccatcgtctgcgtggaactgacaagccaggagcgccagtgttcccttattgaagctggcacccggttcaacctcggaccggttacgatcaccctgagcgagcccagaaatattcaacagaaactgcctcccgagatcatcacactccaccctaagattgaagagggcttctttgacctgatgcacgtgcagaaagtcctttctgcctccaccgtgtgcaagctgcagagctgtacacatgggatccccggagatctccaagtgtatcacattggcaacctgctgaagggggaccgcgttaatggacatcttatccacaaaattgaaccgcatttcaacacctcttggatgtcctgggacggctgcgatctcgactactattgtaatatgggggattggcctagctgcacgtacacaggcgtcacccagcacaaccacgctgcctttgtgaatctgctgaacatcgagacagactataccaagaccttccattttcactctaaacgggtgacagcccatggagatacgccccagctcgacctgaaggctagacctacctacggcgcgggggaaatcacagtccttgtggaggttgccgatatggagctgcacaccaaaaaggtggaaattagcggactcaagttcgcttccctgacatgtaccggctgctacgcctgcagctctgggatctcctgtaaagtccgcattcacgtggacgagcccgatgaactgacggttcatgtcaagagctccgaccctgatgtggtggccgctggaacatctcttatggcccggaaactcgagtttggcaccgacagcaccttcaaggcgttttccgctatgcccaaaacatctctgtgcttctatatcgttgaaagagagtactgtaagagctgctccgaggatgacacccagaaatgtgtggacacaaagctggaacaaccgcagtctattctcatcgagcacaaggggacgatcattggcaaacagaatgatacctgcacagcccgcgccagctgttggctggaatccgtcaagagctttttctatggacttaaaaacatgctgggctctgtgtttgggaatttcctcatcgggattctgctgttccttgctccttttgtgctcctggtcctgttctttatgttcggctggaagatcctcttttgcttcaaatgttgccggagaacccgggggctgtttaagtaccgccatcttaaggacgatgaggaaacaggatatagacggattatcgagagactgaactccaaaaagggcaaaaatcgcctcctggacggggagcggctggccgatagaaagatcgctgaacttttcagcaccaaaacgcacattggc

SEQ ID NO: 13898 - RNA, 2916 nt, synthetic construct
  misc_feature 1..2916: note = derived and/or modified CDS sequence (opt5) from CCHFV(24-R-2012, Artificial)__KR814856.1__Gn-4aa-Gc
  source 1..2916: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacacgagctgcgaggtgatgattcccaagggaaccggcgatatcctggttgactgttccgggggacagcaacacttcctcaaagataacctgattgacctgggctgccctcatatccccctcctggggaagatggcgatttacatctgtcggatgagcaatcaccctcgcacaaccatggcttttcttttctggttttctttcggatatgtgattacatgcatcttttgcaaagccctgttctactccctcatcattatcggcaccctgggcaagaaaattaagcagtatagagaacttaagccccagacgtgtacaatctgcgagaccgcccctgtcaacgctattgatgccgagatgcatgacctgaattgtagctacaacatctgcccgtattgtgcttctcggctcacatccgacgggctggcccgccacgtgccccagtgccctaaaagaaaggaaaaagttgaggaaaccgagctgtacctcaatctggaacggatcccctggattgtgcgcaaacttctgcaagtcagcgagtctaccggagtggcgctcaagagatccagctggctgatcgtgcttctggtcctcctgacagtttccctgtctcctgtgcagagcgcccccgtgggccggaagccgctctttctggattccattgtcaaagggatgaagaaccttctgaatagcacgtctctcgagacctccctgagcatcgaagctccttggggagccattaacgtgcagtctacattcaagcccaccgttagcacagctaatatcgccctttcctggtctagcgtggagcaccgcggcaacaaaatcctggtcaccgggagatccgaaagcattatgaagctcgaggaacggacgggagtgtcttgggacctgggcgttgaggatgcgtccgagagcaaactgctcacagtgtctatcatggacctgtcccagatgtacagccctgtctttgaatatctttccggcgatagacaagtggaggaatggcccaaggccacctgtaccggggactgccccgagcgctgtggatgcacatctagcacctgtctgcataaagaatggcctcactcccggaattggagatgcaacccgacatggtgctggggcgtcgggacgggatgtacctgctgtggcgtggatgttaaggacctcttcacagatcatatgtttgtgaagtggaaagtcgagtacattaagaccgaggctatcgtgtgcgttgaactgacatctcaggagcgccagtgtagcctgattgaagccgggacccggttcaaccttggccccgtgacgatcaccctctccgagcctagaaatattcaacagaaactgccccctgagatcatcacactgcaccccaaggtcgaagagggattctttgacctcatgcacgtgcagaaagtgctgagcgcttctaccgtttgcaaacttcagtcctgtacacatggcattccgggggatctgcaagtctatcacatcggaaacctcctgaagggcgaccgcgtgaatgggcatctgattcacaagatcgaacctcatttcaacaccagctggatgtcttgggacggatgcgatcttgactactattgtaatatgggcgattggccctcctgcacgtacacaggggtgacccagcacaaccacgccgcctttgtcaatctcctgaacattgagacagactataccaagaccttccattttcacagcaaacgggtgacagctcatggcgatacgcctcagctggacctcaaggcgagacccacctacggagccggcgaaatcacagttctggtggaggtcgctgatatggagcttcacaccaaaaaggtggaaatctctgggctgaagttcgccagcctcgcctgtacaggatgctacgcttgctccagcggcatttcttgtaaagttcgcatccacgtggacgagcctgatgaactgaccgtccatgtgaagtccaatgaccccgatgttgtggccgcgagcacgtccctgatggctcggaaacttgagtttgggacagactctaccttcaaggcctttagcgccatgccgaaaacctccctctgcttctatattgtcgaaagagagtactgtaagtcttgcagcgaggaagatacacagaaatgtgtggacaccaagctggagcaacctcagtccatcctgattgaacacaagggaacaatcatcggcaaacagaacgacacgtgcaccgctaaggcctcttgttggctcgagagcgtgaaatcctttttctatgggctgaagaatatgcttggcagcgtctttggaaacttcttcattggcatcctgctctttctggctcccttcgttctgcttgtgctctttttcatgtttgggtggaaaattctgttctgctttaagtgttgccgccggacaagaggactgctcaagtaccggctgcttaaagatgacgaagagaccggctatcgcagaatcattgagcggctgaataacaagaaagggaagaatagactcctggatggagaacgcctggccgaccggaaaatcgcggagcttttctctacaaagacccatatcggc

SEQ ID NO: 13899 - RNA, 2916 nt, synthetic construct
  misc_feature 1..2916: note = derived and/or modified CDS sequence (opt5) from CCHFV(36-ST-2014, Artificial)__KR814857.1__Gn-4aa-Gc
  source 1..2916: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgcctgtgacagctcctgcgagattatgatccccaaaggaacgggcgatattctggtggactgtagcgggggacagcaacacttcctcaaggataacctgatcgacctgggctgccctcatattcccctcctggggaaaatggcgatctacatttgtagaatgtctaatcaccctcggaccacaatggcttttcttttctggttttccttcggatatgttattacctgcatcttttgcaaggccctgttctacagcctcattatcattggcacactgggcaaaaagatcaagcagtatcgcgaacttaaaccccagacctgtacgatttgcgagacagcccctgtgaacgctatcgatgccgagatgcatgacctgaattgttcttacaacatctgcccgtattgtgcttccagactcaccagcgacgggctggcccggcacgtcacacagtgccccaagcgcaaagaaaaggtggaggaaaccgagctgtacctcaatctggaaagaatcccttggatcgttcggaaacttctgcaagtgtctgagtccaccggagtcgcgctcaagcgcagctcctggctgattgtgcttctggtgctcctgacagtctctctgagccccgttcagtccgcccctgtgggcagaaaacccctctttctggatagcatcgtgaaggggatgaagaaccttcttaattctacgtccctcgagaccagcctgtctattgaagctccgtggggagccatcaacgtccagagcacattcaaacctaccgtgtccacagctaatatcgccctttcttggagctccgttgagcaccggggcaacaagattctggtgaccgggcgcagcgaatctatcatgaaactcgaggaaagaacgggagtctcctgggacctgggcgtggaggatgcgagcgagtctaagctgctcacagtttccattatggacctgagccagatgtactcccccgtgtttgaatatctttctggcgatcggcaagtcgaggaatggcctaaagccacctgtaccggggactgccccgagagatgtggatgcacaagctccacctgtctgcataaggaatggccccactctcgcaattggcggtgcaaccctacatggtgctggggcgtggggacgggatgtacctgctgtggcgtcgatgtgaaggacctcttcacagatcatatgtttatcaaatggaaggttgagtacattaaaaccgaggctatcgtgtgcgtcgaactgacaagccaggagagacagtgttccctgattgaagccgggacccgcttcaaccttggcccggtgacgatcaccctcagcgagccccggaatatccaacagaagctgcctcccgagattatcacactgcaccctaaaattgaagagggattctttgacctcatgcacgttcagaaggtgctgtctgcttccaccgtctgcaagctgcagagctgtacacatggcatccccggggatctgcaaatttatcacatcggaaacctcctgaaaggcgacagactgaatgggcatcttatccacaagattgaaccgcatttcaacacctcttggatgtcctgggacggatgcgatctcgactactattgtaatatgggcgattggcctagctgcacgtacacaggggtgacccagcacaaccacgccgcctttgtgaatctgctgaacatcgagacagactataccaaaaccttccattttcactctaagcgcgttacagctcatggcgatacgccccagctcgacctgaaagcgcggcctacctacggagccggcgaaattacagtccttgtggaggtggctgatatggagctgcacaccaagaaggtcgaaatcagcgggctcaaattcgcctccctggcctgtacaggatgctacgcttgcagctctggcatttcctgtaaggtgagaatccacgttgacgagcccgatgaactgaccgtgcatgtcaaaagctccgaccctgatgtggttgccgcgtctacgagccttatggctcgcaagctcgagtttgggacagactccaccttcaaagccttttctgccatgcccaagaccagcctgtgcttctatatcgtggaacgggagtactgtaaatcctgctctgaggatgacacaaagaagtgtgtcgacaccaaactggatcagccgcaaagcattctcatcgaacacaagggaacaattatcggcaaacagaatgacacgtgcaccgctaaggcctcctgttggctggagagcgtgaaatcctttttctatgggcttaagaacatgctgggctctgtttttggaaatttcttcgtgggcattctcctgtttctggctcctttcgtccttctcgtgctgtttttcatgtgcgggtggaagtttctgttctgttttaaatgctgtagacgcacacggggactcttcaagtacagacatctgaaagatgacgaagagaccggctatcggcgcatcatcgaaagacttaacagcaagaaagggaagaatcggctgctcgatggagagagactggccgaccgcaagattgcggagctgttttctacaaaatcccacatcggc

SEQ ID NO: 13900 - RNA, 2916 nt, synthetic construct
  misc_feature 1..2916: note = derived and/or modified CDS sequence (opt5) from CCHFV(37-R-2013, Artificial)__KR814858.1__Gn-4aa-Gc
  source 1..2916: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacacgagctgcgaggtgatgattcccaagggaaccggcgatatcctggttgactgttccgggggacagcaacacttcctcaaagataacctgattgacctgggctgccctcatatccccctcctggggaagatggcgatttacatctgtcggatgagcaatcaccctcgcacaaccatggcttttcttttctggttttctttcggatatgtgattacatgcatcttttgcaaagccctgttctactccctcatcattatcggcaccctgggcaagaaaattaagcagtatagagaacttaagccccagacgtgtacaatctgcgagaccgcccctgtcaacgctattgatgccgagatgcatgacctgaattgtagctacaacatctgcccgtattgtgcttctcggctcacatccgacgggctggcccgccacgtgccccagtgccctaaaagaaaggaaaaagttgaggaaaccgagctgtacctcaatctggaacggatcccctggattgtgcgcaaacttctgcaagtcagcgagtctaccggagtggcgctcaagagatccagctggctgatcgtgcttctggtcctcctgacagtttccctgtctcctgtgcagagcgcccccgtgggccggaagccgctctttctggattccattgtcaaagggatgaagaaccttctgaatagcacgtctctcgagacctccctgagcatcgaagctccttggggagccattaacgtgcagtctacattcaagcccaccgttagcacagctaatatcgccctttcctggtctagcgtggagcaccgcggcaacaaaatcctggtcaccgggagatccgaaagcattatgaagctcgaggaacggacgggagtgtcttgggacctgggcgttgatgacgcgtccgagagcaaactgctcacagtgtctatcatggatctgtcccagatgtacagccctgtctttgagtatctttccggcgacagacaagtggaagagtggcccaaggccacctgtaccggggattgccccgaacgctgtggatgcacatctagcacctgtctgcataaagagtggcctcactcccggaattggagatgcaacccgacatggtgctggggcgtcgggacgggatgtacctgctgtggcgtggacgttaaggatctcttcacagaccatatgtttgtgaagtggaaagtcgaatacattaagaccgaggctatcgtgtgcgttgagctgacatctcaggaacgccagtgtagcctgattgaggccgggacccggttcaaccttggccccgtgacgatcaccctctccgaacctagaaatattcaacagaaactgccccctgagatcatcacactgcaccccaaggtcgaggaaggattctttgatctcatgcacgtgcagaaagtgctgagcgcttctaccgtttgcaaacttcagtcctgtacacatggcattccgggggacctgcaagtctatcacatcggaaacctcctgaagggcgaccgcgtgaatgggcatctgattcacaagatcgagcctcatttcaacaccagctggatgtcttgggatggatgcgaccttgattactattgtaatatgggcgactggccctcctgcacgtacacaggggtgacccagcacaaccacgccgcctttgtcaatctcctgaacattgaaacagattataccaagaccttccattttcacagcaaacgggtgacagctcatggcgacacgcctcagctggatctcaaggcgagacccacctacggagccggcgagatcacagttctggtggaagtcgctgacatggagcttcacaccaaaaaggtggagatctctgggctgaagttcgccagcctcgcctgtacaggatgctacgcttgctccagcggcatttcttgtaaagttcgcatccacgtggatgaacctgacgagctgaccgtccatgtgaagtccaatgatcccgacgttgtggccgcgagcacgtccctgatggctcggaaacttgaatttgggacagattctaccttcaaggcctttagcgccatgccgaaaacctccctctgcttctatattgtcgagagagaatactgtaagtcttgcagcgaggaggacacacagaaatgtgtggacaccaagctggaacaacctcagtccatcctgattgagcacaagggaacaatcatcggcaaacagaacgtgacgtgcaccgctaaggcctcttgttggctcgaaagcgtcaaatcctttttctatgggctgaagaatatgcttggcagcgtttttggaaacttcttcattggcatcctgctctttctggctcccttcgtgctgcttgtgctctttttcatgtttgggtggaaaattctgttctgctttaagtgttgccgccggacaagaggactgctcaagtaccggctgcttaaagatgacgaggaaaccggctatcgcagaatcattgagcggctgaataacaagaaagggaagaatagactcctggatggagagcgcctggccgaccggaaaatcgcggaacttttctctacaaagacccatatcggc

SEQ ID NO: 13901 - RNA, 2916 nt, synthetic construct
  misc_feature 1..2916: note = derived and/or modified CDS sequence (opt5) from CCHFV(44-ST-2010, Artificial)__KR814859.1__Gn-4aa-Gc
  source 1..2916: mol_type = other RNA
agcgaggaacccggcgacgattgcatctccagaacccagcttctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgcctgtgacagctcctgcgagattatgatccccaaaggaacgggcgatattctggtggactgtagcgggggacagcaacacttcctcaaggataacctgatcgacctgggctgccctcatattcccctcctggggaaaatggcgatctacatttgtagaatgtctaatcaccctcggaccacaatggcttttcttctgtggttctcctttggatatgttattacctgcatcttctgcaaggccctcttttacagcctgattatcattggcacacttggcaaaaagatcaagcagtatcgcgaactgaaaccccagacctgtacgatttgcgagacagcccctgtgaacgctatcgatgccgagatgcatgacctcaattgttcttacaacatctgcccgtattgtgcttccagactgaccagcgacgggctggcccggcacgtcacacagtgccccaagcgcaaagaaaaggtggaggaaaccgagctctacctgaatcttgaaagaatcccttggatcgttcggaaactgctccaagtgtctgagtccaccggagtcgcgctgaagcgcagctcctggcttattgtgctgctcgtgctgctgacagtctctctcagccccgttcagtccgcccctgtgggcagaaaacccctgttccttgatagcatcgtgaaggggatgaagaacctgctcaattctacgtccctggagaccagcctttctattgaagctccgtggggagccatcaacgtccagagcacatttaaacctaccgtgtccacagctaatatcgccctgtcttggagctccgttgagcaccggggcaacaagattctcgtgaccgggcgcagcgaatctatcatgaaactggaggaaagaacgggagtctcctgggacctgggcgtggaggatgcgagcgagtctaagctcctgacagtttccattatggaccttagccagatgtactcccccgtgttcgaatatctgtctggcgatcggcaagtcgaggaatggcctaaagccacctgtaccggggactgccccgagagatgtggatgcacaagctccacctgtctccataaggaatggccccactctcgcaattggcggtgcaaccctacatggtgctggggcgtggggacgggatgtacctgctgtggcgtcgatgtgaaggacctgtttacagatcatatgttcatcaaatggaaggttgagtacattaaaaccgaggctatcgtgtgcgtcgaactgacaagccaggagagacagtgttcccttattgaagccgggacccgctttaacctcggcccggtgacgatcaccctgagcgagccccggaatatccaacagaagctgcctcccgagattatcacactccaccctaaaattgaagagggattcttcgacctgatgcacgttcagaaggtgctttctgcttccaccgtctgcaagctgcagagctgtacacatggcatccccggggatctccaaatttatcacatcggaaacctgctgaaaggcgacagacttaatgggcatctcatccacaagattgaaccgcattttaacacctcttggatgtcctgggacggatgcgatctggactactattgtaatatgggcgattggcctagctgcacgtacacaggggtgacccagcacaaccacgccgccttcgtgaatctgctcaacatcgagacagactataccaaaacctttcatttccactctaagcgcgttacagctcatggcgatacgccccagctggaccttaaagcgcggcctacctacggagccggcgaaattacagtcctggtggaggtggctgatatggagctccacaccaagaaggtcgaaatcagcgggctgaaatttgcctccctggcctgtacaggatgctacgcttgcagctctggcatttcctgtaaggtgagaatccacgttgacgagcccgatgaacttaccgtgcatgtcaaaagctccgaccctgatgtggttgccgcgtctacgagcctcatggctcgcaagctggagttcgggacagactccacctttaaagccttctctgccatgcccaagaccagcctgtgcttttatatcgtggaacgggagtactgtaaatcctgctctgaggatgacacaaagaagtgtgtcgacaccaaactcgatcagccgcaaagcattctgatcgaacacaagggaacaattatcggcaaacagaatgacacgtgcaccgctaaggcctcctgttggcttgagagcgtgaaatctttcttttatgggctgaagaacatgctcggctccgttttcggaaactttttcgtgggcattctgctgttccttgctccttttgtcctcctggtgctgttctttatgtgcgggtggaagatcctcttctgttttaaatgctgtagacgcacacggggactgttcaagtacagacatcttaaagatgacgaagagaccggctatcggcgcatcattgaaagactgaatagcaagaaagggaagaatcggctcctggatggagagagactggccgaccgcaagatcgcggagctgttttctacaaaatcccacattggc

SEQ ID NO: 13902 - RNA, 2916 nt, synthetic construct
  misc_feature 1..2916: note = derived and/or modified CDS sequence (opt5) from CCHFV(46-ST-2012, Artificial)__KR814860.1__Gn-4aa-Gc
  source 1..2916: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacagctcctgcgaggtgatgattcccaagggaacgggcgatatcctggttgactgtagcgggggacagcaacacttcctcaaagataacctgattgacctgggctgccctcatatccccctcctggggaagatggcgatttacatctgtcggatgtctaatcaccctcgcaccacaatggcttttcttttctggttttccttcggatatgtgattacctgcatcttttgcaaagccctgttctacagcctcatcattatcggcacactgggcaagaaaattaagcagtatagagaacttaagccccagacctgtacgatctgcgagacagcccctgtcaacgctattgatgccgagatgcatgacctgaattgttcttacaacatctgcccgtattgtgcttcccggctcaccagcgacgggctggcccgccacgtgccccagtgccctaaaagaaaggaaaaagttgaggaaacagagctgtacctcaatctggaacggatcccctggattgtgcgcaagctgctgcaagtctctgagtccaccggagtggcgctcaaaagaagctcctggctgatcgtgcttctggtcctcctgaccgtttctctgagccctgtgcagtccgcccccgtgggccggaagccgctctttctggatagcattgtcaaagggatgaagaaccttcttaattctacatccctcgagacgagcctgtctatcgaagctccttggggagccattaacgtgcagagcaccttcaagcccacagtttccaccgctaatatcgccctttcttggagctccgtggagcaccgcggcaacaaaatcctggtcacagggagaagcgaatctattatgaagctcgaggaacggaccggagtgtcctgggacctgggcgttgaggatgcgagcgagtctaaactgctcacggtgtccatcatggacctgagccagatgtactcccctgtctttgaatatctttctggcgatagacaagtggaggaatggcccaaggccacatgtaccggggactgccccgagcgctgtggatgcaccagctccacatgtctgcataaagaatggcctcactctcggaattggagatgcaacccgacctggtgctggggcgtcgggacaggatgtacgtgctgtggcgtggatgttaaggacctcttcaccgatcatatgtttgtgaagtggaaagtcgagtacattaagacagaggctatcgtgtgcgttgaactgaccagccaggagcgccagtgttccctgattgaagccgggacacggttcaaccttggccccgtgaccatcacgctcagcgagcctagaaatattcaacagaaactgccccctgagatcatcaccctgcaccccaaggtcgaagagggattctttgacctcatgcacgtgcagaaagtgctgtctgcttccacagtttgcaaacttcagagctgtacccatggcattccgggggatctgcaagtctatcacatcggaaacctcctgaagggcgaccgcattaatgggcatctgatccacaaaattgaacctcatttcaacacatcttggatgtcctgggacggatgcgatcttgactactattgtaatatgggcgattggcccagctgcacctacacgggggtgacacagcacaaccacgccgcctttgtgaatctcctgaacatcgagaccgactatacaaagaccttccattttcactctaaacgggtcaccgctcatggcgatacacctcagctggacctcaaggcgagacccacgtacggagccggcgaaatcaccgtgctggttgaggtggctgatatggagcttcacacaaagaaggtcgaaattagcgggctgaagttcgcctccctcgcctgtaccggatgctacgcttgcagctctggcatctcctgtaaagtgcgcattcacgttgacgagcctgatgaactgacagtgcatgtcaagagctccgaccccgatgtggttgccgcgtctaccagcctgatggctcggaaacttgagtttgggacggactccacattcaaggccttttctgccatgccgaaaaccagcctctgcttctatatcgtggaaagagagtactgtaagtcctgctctgaggaagatacccagaaatgtgtcgacacacgcctggagcaacctcagagcattctgatcgaacacaagggaaccatcattggcaagcagaatgacacatgcacggctaaagcctcctgttggctcgagagcgtgaagtcctttttctatgggctgaaaaacatgcttggctctgtgtttggaaatttcttcatcggcattctgctctttctggctcccttcgtcctgcttgttctctttttcatgtttgggtggaagatcctgttctgctttaaatgttgccggagaacccggggactgctcaagtaccgccatctgaaggatgacgaagagacaggctatagacggattatcgagagacttaacaataaaaaggggaaaaaccgcctgctcgatggagaacggctggccgacagaaagatcgcggagctgttcagcaccaaaacacacattggc

SEQ ID NO: 13903 - RNA, 2916 nt, synthetic construct
  misc_feature 1..2916: note = derived and/or modified CDS sequence (opt5) from CCHFV(47-ST-2013, Artificial)__KR814861.1__Gn-4aa-Gc
  source 1..2916: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtaaaaattctgctacagggaagacctgcgaaatcgacagcacaccggttaagtgtagacagggattttgcctcaagatcacccaggagggccggggccatgtgaaactgtcccgcgggtctgaggtggtccttgatgcctgtgacagctcctgcgaaattatgatccccaagggaacgggcgatattctggtggactgtagcgggggacagcaacacttcctcaaagataacctgatcgacctgggctgccctcatattcccctcctggggaagatggcgatctacatttgtagaatgtctaatcaccctcggaccacaatggcttttcttttctggttttccttcggatatgttattacctgcatcttttgcaaagccctgttctacagcctcattatcattggcacactgggcaagaagatcaaacagtatcgcgagcttaagccccagacctgtacgatttgcgaaacagcccctgtgaacgctatcgatgccgagatgcatgacctgaattgttcttacaacatctgcccgtattgtgcttccagactcaccagcgacgggctggcccggcacgtcacacagtgccccaaacgcaaggagaaagtggaagagaccgaactgtacctcaatctggagagaatcccttggatcgttcggaagctgctgcaagtgtctgaatccaccggagtcgcgctcaaacgcagctcctggctgattgtgcttctggtgctcctgacagtctctctgagccccgttcagtccgcccctgtgggcagaaagcccctctttctggatagcatcgtgaaggggatgaaaaaccttcttaattctacgtccctcgagaccagcctgtctattgaggctccgtggggagccatcaacgtccagagcacattcaagcctaccgtgtccacagctaatatcgccctttcttggagctccgttgaacaccggggcaacaaaattctggtgaccgggcgcagcgagtctatcatgaagctcgaagagagaacgggagtctcctgggacctgggcgtggaagatgcgagcgagtctaaactgctcacagtttccattatggacctgagccagatgtactcccccgtgtttgagtatctttctggcgatcggcaagtcgaagagtggcctaaggccacctgtaccggggaatgccccgagagatgtggatgcacaagctccacctgtctgcataaggaatggccccactctcgcaattggcggtgcaaccctacatggtgctggggcgtggggacgggatgtacctgctgtggcgtcgacgtgaaagatctcttcacagaccatatgtttatcaagtggaaagttgagtacattaagaccgaggctatcgtgtgcgtcgaactgacaagccaggagagacagtgttccctgattgaagccgggacccgcttcaaccttggcccggtgacgatcaccctcagcgagccccggaatatccaacagaaactgcctcccgagattatcacactgcaccctaagattgaagagggattctttgatctcatgcacgttcagaaggtgctgtctgcttccaccgtctgcaaacttcagagctgtacacatggcatccccggggacctgcaaatttatcacatcggaaacctcctgaagggcgatagagtgaatgggcatctgatccacaaaattgaaccgcatttcaacacctcttggatgtcctgggacggatgcgaccttgattactattgtaatatgggcgactggcctagctgcacgtacacaggggtgacccagcacaaccacgccgcctttgttaatctcctgaacatcgagacagattataccaagaccttccattttcactctaaacgcgtcacagctcatggcgacacgccccagctggatctcaaggcgcggcctacctacggagccggcgaaattacagtgctggtggaggtcgctgacatggagcttcacaccaagaaagtggaagttagcgggctgaagttcgcctccctcgcctgtacaggatgctacgcttgcagctctggcatctcctgtaaagtgcgcattcacgtcgatgagcccgacgaactgaccgtgcatgttaagagctccgatcctgacgtggtcgccgcgtctacgagcctgatggctagaaaacttgagtttgggacagattccaccttcaaggccttttctgccatgcccaaaaccagcctctgcttctatatcgtggaacgggagtactgtaagtcctgctctgaggacgatacaaagaaatgtgttgacaccaagctggaacagccgcaaagcatcctgattgagcacaaaggaacaatcattggcaagcagaatgacacgtgcaccgctaaagcctcctgttggctcgaaagcgtgaagtcctttttctatgggctgaagaacatgcttggctctgtctttggaaatttcttcgtgggcatcctgctctttctggctcctttcgtgctgcttgtcctctttttcatgtttgggtggaaaattctgttctgctttaagtgttgcagacgcacacggggactgttcaaatacagacatctcaaggatgacgaggaaaccggctatcggcgcatcatcgagagactgaacagcaaaaaggggaagaatcggcttctggatggagagagactcgccgaccgcaaaattgcggaactgttttctacaaagacccacatcggc

SEQ ID NO: 13904 - RNA, 2916 nt, synthetic construct
  misc_feature 1..2916: note = derived and/or modified CDS sequence (opt5) from CCHFV(52-R-2014, Artificial)__KR814862.1__Gn-4aa-Gc
  source 1..2916: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacacgagctgcgaggtgatgattcccaagggaaccggcgatatcctggttgactgttccgggggacagcaacacttcctcaaagataacctgattgacctgggctgccctcatgtgcccctcctggggaagatggcgatctacatttgtcggatgagcaatcaccctcgcacaaccatggcttttcttttctggttttctttcggatatgtcatcacatgcatcttttgcaaagccctgttctactccctcattatcattggcaccctgggcaagaaaatcaagcagtatagagaacttaagccccagacgtgtacaatttgcgagaccgcccctgtgaacgctatcgatgccgagatgcatgacctgaattgtagctacaacatttgcccgtattgtgcttctcggctcacatccgacgggctggcccgccacgttccccagtgccctaaaagaaaggaaaaagtggaggaaaccgagctgtacctcaatctggaacggatcccctggatcgtccgcaaacttctgcaagtgagcgagtctaccggagtggcgctcaaaagatccagctggctgattgtccttctggttctcctgacagtgtccctgtctcctgtgcagagcgcccccgtcggccggaagccgctctttctggattccatcgtgaaagggatgaagaaccttctgaatagcacgtctctcgagacctccctgagcattgaagctccttggggagccatcaacgttcagtctacattcaagcccaccgtgagcacagctaatattgccctttcctggtctagcgtcgagcaccgcggcaacaaaatcctggtgaccgggagatccgaaagcatcatgaagctcgaggaacggacgggagtttcttgggacctgggcgtggatgacgcgtccgagagcaaactgctcacagtctctattatggatctgtcccagatgtacagccctgtgtttgagtatctttccggcgacagacaagtcgaagagtggcccaaggccacctgtaccggggattgccccgaacgctgtggatgcacatctagcacctgtctgcataaagagtggcctcactcccggaattggagatgcaacccgacatggtgctggggcgtggggacgggatgtacctgctgtggcgttgacgtgaaggatctcttcacagaccatatgtttgtcaagtggaaagtggaatacatcaagaccgaggctattgtttgcgtggagctgacatctcaggaacgccagtgtagcctgatcgaggccgggacccggttcaaccttggccccgtcacgattaccctctccgaacctagaaatatccaacagaaactgccccctgagattatcacactgcaccccaaggtggaggaaggattctttgatctcatgcacgtgcagaaagttctgagcgcttctaccgtctgcaaacttcagtcctgtacacatggcatcccgggggacctgcaagtgtatcacattggaaacctcctgaagggcgaccgcgtgaatgggcatctgatccacaagattgagcctcatttcaacaccagctggatgtcttgggatggatgcgaccttgattactattgtaatatgggcgactggccctcctgcacgtacacaggggtcacccagcacaaccacgccgcctttgtgaatctcctgaacatcgaaacagattataccaagaccttccattttcacagcaaacgggttacagctcatggcgacacgcctcagctggatctcaaggcgagacccacctacggagccggcgagattacagtgctggtcgaagtggctgacatggagcttcacaccaaaaaggttgagatctctgggctgaagttcgccagcctcgcctgtacaggatgctacgcttgctccagcggcatctcttgtaaagtgcgcattcacgtcgatgaacctgacgagctgaccgtgcatgttaagtccaatgatcccgacgtggtcgccgcgagcacgtccctgatggctcggaaacttgaatttgggacagattctaccttcaaggcctttagcgccatgccgaaaacctccctctgcttctatatcgtggagagagaatactgtaagtcttgcagcgaggaggacacacagaaatgtgtggacaccaagctggaacaacctcagtccattctgatcgagcacaagggaacaattatcggcaaacagaacgatacgtgcaccgctaaggccgggtgttggctcgaatctgtcaagagctttttctatggcctgaagaatatgcttggatccgtttttggcaacttcttcatcgggattctgctctttctggctcccttcgtgctgcttgtgctctttttcatgtttggatggaaaatcctgttctgctttaagtgttgccgccggacaagaggcctgctcaagtaccggctgcttaaagacgatgaggaaaccgggtatcgcagaattatcgagcggctgaataacaagaaaggaaagaatagactcctggacggcgagcgcctggccgatcggaaaattgcggaacttttcagcacaaagacccatatcggg

SEQ ID NO: 13905 - RNA, 2916 nt, synthetic construct
  misc_feature 1..2916: note = derived and/or modified CDS sequence (opt5) from CCHFV(75-R-2012, Artificial)__KR814863.1__Gn-4aa-Gc
  source 1..2916: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcgccccggttaagtgtcggcagggattttgcctcaaaatcacacaggagggccgcggccatgtgaagctgtccagagggtctgaagtggtccttgatgcgtgtgacagctcctgcgaggtgatgattcccaagggaaccggcgatatcctggttgactgtagcgggggacagcaacacttcctcaaagataacctgattgacctgggctgccctcatatccccctcctggggaagatggctatttacatctgtcggatgtctaatcaccctcgcacgaccatggcctttcttttctggttttccttcggatatgtgattacatgcatcttttgcaaagccctgttctacagcctcatcattatcggcaccctgggcaagaaaattaagcagtatagagaacttaagccccagacatgtaccatctgcgagacggctcctgtcaacgccattgatgctgagatgcatgacctgaattgttcttacaacatctgcccgtattgtgcctcccggctcacaagcgacgggctggcgcgccacgtgccccagtgccctaaaagaaaggaaaaagttgaggaaaccgagctgtacctcaatctggaacggatcccctggattgtgcgcaagctgctgcaagtctctgagtccacaggagtggccctcaaaagaagctcctggctgatcgtgcttctggtcctcctgaccgtttctctgagccctgtgcagtccgctcccgtgggccggaagccgctctttctggatagcattgtcaaagggatgaagaaccttcttaattctacctccctcgagacaagcctgtctatcgaagccccttggggagctattaacgtgcagagcacgttcaagcccaccgtttccacagccaatatcgcgctttcttggagctccgtggagcaccgcggcaacaaaatcctggtcaccgggagaagcgaatctattatgaagctcgaggaacggacaggagtgtcctgggacctgggcgttgaggatgccagcgagtctaaactgctcaccgtgtccatcatggacctgagccagatgtactcccctgtctttgaatatctttctggcgatagacaagtggaggaatggcccaaggctacgtgtacaggggactgccccgagcgctgtggatgcaccagctccacctgtctgcataaagaatggcctcactctcggaattggagatgcaacccgacatggtgctggggcgtcgggaccggatgtacatgctgtggcgtggatgttaaggacctcttcacggatcatatgtttgtgaagtggaaagtcgagtacattaagaccgaggccatcgtgtgcgttgaactgacaagccaggagcgccagtgttccctgattgaagctgggacccggttcaaccttggccccgtgacaatcaccctcagcgagcctagaaatattcaacagaaactgccccctgagatcatcacgctgcaccccaaggtcgaagagggattctttgacctcatgcacgtgcagaaagtgctgtctgcctccaccgtttgcaaacttcagagctgtacacatggcattccgggggatctgcaagtctatcacatcggaaacctcctgaagggcgaccgcgtgaatgggcatctgattcacaagatcgaacctcatttcaacacctcttggatgtcctgggacggatgcgatcttgactactattgtaatatgggcgattggcccagctgcacatacaccggggtgacgcagcacaaccacgccgcttttgtcaatctcctgaacattgagacagactataccaagacattccattttcactctaaacgggtgaccgcgcatggcgatacccctcagctggacctcaaggccagacccacatacggagctggcgaaatcacggttctggtggaggtcgccgatatggagcttcacaccaaaaaggtggaaatcagcgggctgaagttcgcctccctcgcttgtacaggatgctacgcctgcagctctggcatttcctgtaaagttcgcatccacgtggacgagcctgatgaactgaccgtccatgttaagagctccgaccccgatgtggtggcggcttctacaagcctgatggcccggaaacttgagtttgggaccgactccacgttcaaggccttttctgctatgccgaaaacaagcctctgcttctatattgtcgaaagagagtactgtaagtcctgctctgaggaagatacccagaaatgtgtggacaccaagctggagcaacctcagagcatcctgattgaacacaagggaacaatcatcggcaaacagaatgatacctgcacagccaaggcttcctgttggctcgagagcgtgaaatcttttctgtatgggcttaagaacatgctgggctccgtcttcggaaactttttcattggcatcctcctgttcctggccccctttgttcttctcgtgctgttctttatgttcgggtggaaaattctgttttgcttcaagtgttgccgccggacgagaggactcctgaagtaccggcttctgaaagacgacgaagagaccggctatcgcagaatcattgagcggctcaataataagaaagggaagaacagactgctggatggagaacgccttgcggaccggaaaatcgccgagctgtttagcacaaagacccatatcggc

SEQ ID NO: 13906 - RNA, 2916 nt, synthetic construct
  misc_feature 1..2916: note = derived and/or modified CDS sequence (opt5) from CCHFV(75-ST-2010, Artificial)__KR814864.1__Gn-4aa-Gc
  source 1..2916: mol_type = other RNA
agcgaggaatccggcgacgattgcatctctagaacccagctgctccggacagagacggccgaaattcacgacgataactacgggggacccggcgacaagatcaccatttgtaatgggagcacaatcgtggatcaacgcctgggatccgagcttggctgctataccattaacagagtcaaatctttcaagctgtgtgaaaatagcgctacagggaaaacctgcgagatcgactccacacctgttaagtgtcggcagggattttgcctcaaaatcacccaggagggccgcggccatgtgaagctgtctagagggagcgaagtggtccttgatgcctgtgactccagctgcgaggtgatgattccgaagggaacgggcgatatcctggttgactgttctgggggacagcaacacttcctcaaagataacctgattgacctgggctgcccccatatccctctcctggggaagatggcgatttacatctgtcggatgtccaatcacccccgcaccacaatggcttttcttttctggtttagcttcggatatgtgattacctgcctgttttgcaaagccctcttctactctctgatcatcattggcacacttggcaagaaaatcaagcagtatagagaactgcggcctcagacctgtacgatttgcgagacagcccccgtcaacgctatcgatgccgagatgcatgacctcaattgttcctacaacatttgcccttattgtgctagccgcctgacctctgacgggctggccagacacgtgccgcagtgccccaagcggaaagaaaaggttgaggaaacagagctctacctgaatcttgaacgcatcccttggatcgtgagaaaactgctccaagtctccgagagcaccggagtggcgctgaagcggtcctcttggcttattgtgctgctcgtcctgctgaccgttagcctctcccccgtgcagagcgcccctgtgggccgcaaacccctgtttcttgattctatcgtcaaggggatgaaaaacctgctcaattccacaagcctggagacgtctcttagcattgaagctccgtggggagccatcaacgtgcagtccaccttcaagcctacagtttctaccgctaatattgccctgagctggtccagcgtggagcacagaggcaacaagatcctcgtcacagggcggtctgaatccatcatgaaactggaggaaagaaccggagtgagctgggacctgggcgttgaggatgcgtctgagtccaagctcctgacggtgagcattatggacctttcccagatgtactctcccgtctttgaatatctgagcggcgatcgccaagtggaggaatggcctaaagccacatgtaccggggactgccccgagcggtgtggatgcacctcctctacatgtctccataaggaatggccccacagcagaaattggcgctgcaaccctacctggtgctggggcgtcgggacaggatgtacgtgctgtggcgtggatgttaaagacctgttcaccgatcatatgtttgtgaagtggaaggtcgagtacatcaaaacagaggctattgtgtgcgttgaactgacctcccaggagcggcagtgtagccttatcgaagccgggacaagattcaacctcggcccggtgaccattacgctgtctgagccccgcaatatccaacagaagctgcctcccgagattatcaccctccaccctaaagtcgaagagggattctttgacctgatgcacgtgcagaaggtgctttccgctagcacagtttgcaaactgcagtcttgtacccatggcatccccggggatctccaagtctatcacattggaaacctgctgaagggcgaccgggtgaatgggcatcttatccacaagattgaaccgcatttcaacacatcctggatgagctgggacggatgcgatctcgactactattgtaatatgggcgattggccttcttgcacctacacgggggtgacacagcacaaccacgccgcctttgtcaatctgctgaacatcgagaccgactatacaaaaaccttccattttcacagcaagagagtgaccgctcatggcgatacaccccagctcgacctgaaagcgcgccctacgtacggagccggcgaaattaccgttcttgtggaggtcgctgatatggagctgcacacaaagaaagtggaaatctccgggctcaagttcgccagcctggcctgtaccggatgctacgcttgttcttccggcatcagctgcaaggttcggattcacgtggacgagcccgatgaactgacagtccatgtgaaatcctctgaccctgatgttgtggccgcgagcacctcccttatggctagaaagctcgagtttgggacggactctacattcaaagcctttagcgccatgcccaagacctccctgtgcttctatatcgtcgaacgcgagtactgtaaatcttgcagcgaggaagatacccagaagtgtgtggacacaaaactggagcaaccgcagtccattctcatcgaacacaagggaaccattatcggcaagcagaatgacacatgcacggctaaagccagctgttggctggagtctgtgaagtcctttttctatgggcttaaaaacatgctgggcagcgtctttggaaatttcttcatcggcattctcctgtttctggctcctttcgttcttctcgtgctgtttttcatgtttgggtggaagatcctgttctgctttaaatgttgccggagagcccggggactcctgaagtaccgccatcttaaggatgacgaagagaccggctatagaaaaattatcgagcggctgaacaataagaaagggaagaacagactcctggatggagaacgcctggcggaccggaaaattgccgagcttttctctacaaagacccacatcggc

SEQ ID NO: 13907 - RNA, 2916 nt, synthetic construct
  misc_feature 1..2916: note = derived and/or modified CDS sequence (opt5) from CCHFV(3756-ST-2007, Artificial)__KR814866.1__Gn-4aa-Gc
  source 1..2916: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgcctgtgacagctcctgcgagattatgatccccaaaggaacgggcgatattctggtggactgtagcgggggacagcaacacttcctcaaggataacctgatcgacctgggctgccctcatattcccctcctggggaaaatggcgatctacatttgtagaatgtctaatcaccctcggaccacaatggcttttcttttctggttttccttcggatatgttattacctgcatcttttgcaaggccctgttctacagcctcattatcattggcacactgggcaaaaagatcaagcagtatcgcgaacttaaaccccagacctgtacgatttgcgagacagcccctgtgaacgctatcgatgccgagatgcatgacctgaattgttcttacaacatctgcccgtattgtgcttccagactcaccagcgacgggctggcccggcacgtcacacagtgccccaagcgcaaagaaaaggtggaggaaaccgagctgtacctcaatctggaaagaatcccttggatcgttcggaaacttctgcaagtgtctgagtccaccggagtcgcgctcaagcgcagctcctggctgattgtgcttctggtgctcctgacagtctctctgagccccgttcagtccgcccctgtgggcagaaaacccctctttctggatagcatcgtgaaggggatgaagaaccttctgaatagcacgtccctcgagaccagcctgtctattgaagctccgtggggagccatcaacgtccagagcacattcaaacctaccgtgtccacagctaatatcgccctttcttggagctccgttgagcaccggggcaacaagattctggtgaccgggcgcagcgaatctatcatgaaactcgaggaaagaacgggagtctcctgggacctgggcgtggaggatgcgagcgagtctaagctgctcacagtttccattatggacctgagccagatgtactcccccgtgtttgaatatctttctggcgatcggcaagtcgaggaatggcctaaagccacctgtaccggggactgccccgagagatgtggatgcacaagctccacctgtctgcataaggaatggccccactctcgcaattggcggtgcaaccctacatggtgctggggcgtggggacgggatgtacctgctgtggcgtcgatgtgaaggacctcttcacagatcatatgtttatcaaatggaaggttgagtacattaaaaccgaggctatcgtgtgcgtcgaactgacaagccaggagagacagtgttccctgattgaagccgggacccgcttcaaccttggcccggtgacgatcaccctcagcgagccccggaatatccaacagaagctgcctcccgagattatcacactgcaccctaaaattgaagagggattctttgacctcatgcacgttcagaaggtgctgtctgcttccaccgtctgcaagctgcagagctgtacacatggcatccccggggatctgcaaatttatcacatcggaaacctcctgaaaggcgacagagtgaatgggcatctgatccacaagattgaaccgcatttcaacacctcttggatgtcctgggacggatgcgatcttgactactattgtaatatgggcgattggcctagctgcacgtacacaggggtgacccagcacaaccacgccgcctttgttaatctcctgaacatcgagacagactataccaaaaccttccattttcactctaagcgcgtcacagctcatggcgatacgccccagctggacctcaaagcgcggcctacctacggagccggcgaaattacagtgctggtggaggtcgctgatatggagcttcacaccaagaaggtggaaatcagcgggctgaaattcgcctccctcacatgtaccggatgctacgcctgcagctctggcatttcctgtaaggttagaatccacgtggacgagcccgatgaactgacggtccatgtgaaaagctccgaccctgatgttgtggctgcctctacaagcctgatggcgcgcaaacttgagtttgggaccgactccaccttcaaggctttttctgccatgcccaagacaagcctctgcttctatatcgtcgaacgggagtactgtaaatcctgctctgaggatgacaccaagaagtgtgtggacacaaaactggaacagccgcaaagcattctgatcgagcacaagggaacgattatcggcaaacagaatgatacctgcacagccaaggcttcctgttggctcgaaagcgttaaatcctttttctatgggctgaagaacatgcttggctctgtgtttggatctttcttcgtcggcattctgctctttctgacccctttcgtgctgcttgtgctctttttcatgtttgggtggaagatcctgttctgctttaaatgttgcagacgcacacggggactgttcaagtacagacatctcaaagacgatgaggaaaccggctatcggcgcatcattgagagacttaattctaagaaagggaagaaccggcttctggacggagagagactcgccgatcgcaagatcgctgaactgttttccacgaaaacccacattggc

SEQ ID NO: 13908 - RNA, 2916 nt, synthetic construct
  misc_feature 1..2916: note = derived and/or modified CDS sequence (opt5) from CCHFV(3809-ST-2007, Artificial)__KR814867.1__Gn-4aa-Gc
  source 1..2916: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacagctcctgcgaggtgatgattcccaagggaacgggcgatatcctggttgactgtagcgggggacagcaacacttcctcaaagataacctgattgacctgggctgccctcatatccccctcctggggaagatggcgatttacatctgtcggatgtctaatcaccctcgcaccacaatggcttttcttttctggttttccttcggatatgtgattacctgcatcttttgcaaagccctgttctacagcctcatcattatcggcacactgggcaagaaaattaagcagtatagagaacttaagccccagacctgtacgatctgcgagacagcccctgtcaacgctattgatgccgagatgcatgacctgaattgttcttacaacatctgcccgtattgtgcttcccggctcaccagcgacgggctggcccgccacgtgccccagtgccctaaaagaaaggaaaaagttgaggaaacagagctgtacctcaatctggaacggatcccctggattgtgcgcaagctgctgcaagtctctgagtccaccggagtggcgctcaaaagaagctcctggctgatcgtgcttctggtcctcctgaccgtttctctgagccctgtgcagtccgcccccgtgggccggaagccgctctttctggatagcattgtcaaagggatgaagaaccttcttaattctacatccctcgagacgagcctgtctatcgaagctccttggggagccattaacgtgcagagcaccttcaagcccacagtttccaccgctaatatcgccctttcttggagctccgtggagcaccgcggcaacaaaatcctggtcacagggagaagcgaatctattatgaagctcgaggaacggaccggagtgtcctgggacctgggcgttgaggatgcgagcgagtctaaactgctcacggtgtccatcatggacctgagccagatgtactcccctgtctttgaatatctttctggcgatagacaagtggaggaatggcccaaggccacatgtaccggggactgccccgagcgctgtggatgcaccagctccacatgtctgcataaagaatggcctcactctcggaattggagatgcaacccgacctggtgctggggcgtcgggacaggatgtacgtgctgtggcgtggatgttaaggacctcttcaccgatcatatgtttgtgaagtggaaagtcgagtacattaagacagaggctatcgtgtgcgttgaactgaccagccaggagcgccagtgttccctgattgaagccgggacacggttcaaccttggccccgtgaccatcacgctcagcgagcctagaaatattcaacagaaactgccccctgagatcatcaccctgcaccccaaggtcgaagagggattctttgacctcatgcacgtgcagaaagtgctgtctgcttccacagtttgcaaacttcagagctgtacccatggcattccgggggatctgcaagtctatcacatcggaaacctcctgaagggcgaccgcgtgaatgggcatctgattcacaaaatcgaacctcatttcaacacatcttggatgtcctgggacggatgcgatcttgactactattgtaatatgggcgattggcccagctgcacctacacgggggtgacacagcacaaccacgccgcctttgtcaatctcctgaacattgagaccgactatacaaagaccttccattttcactctaaacgggtgaccgctcatggcgatacacctcagctggacctcaaggcgagacccacgtacggagccggcgaaatcaccgttctggtggaggtcgctgatatggagcttcacacaaagaaggtggaaatcagcgggctgaagttcgcctccctcgcctgtaccggatgctacgcttgcagctctggcatttcctgtaaagttcgcatccacgtggacgagcctgatgaactgacagtccatgttaagagctccgaccccgatgtggtggccgcgtctaccagcctgatggctcggaaacttgagtttgggacggactccacattcaaggccttttctgccatgccgaaaaccagcctctgcttctatattgtcgaaaaggagtactgtagatcctgctctgaggaagatacccagaaatgtgtggacacaaagctggagcaacctcagagcatcctgattgaacacaagggaaccatcatcggcaaacagaatgacacatgcacggctaaggcctcctgttggctcgagagcgtgaaatcctttttctatgggctgaagaacatgcttggctctgtctttggaaatttcttcattggcatcctgctctttctgacccccttcgttctgcttgtgctctttttcatgtttgggtggaaaattctgttctgctttaagtgttgccgccggacaagaggactgctcaagtaccggcatctgaaagatgacgaagagaccggctatcgcagaatcattgagcggcttaacaataagaaagggaagaacagactgctcgatggagaacgcctggctgaccggaaaatcgccgagctgttcagcacaaagacccacatcggc

SEQ ID NO: 13909 - RNA, 2916 nt, synthetic construct
  misc_feature 1..2916: note = derived and/or modified CDS sequence (opt5) from CCHFV(3820-ST-2007, Artificial)__KR814868.1__Gn-4aa-Gc
  source 1..2916: mol_type = other RNA
agcgaggaacccggcgacgattgcatctccagaacccagctgctcaagacagagacggccgaaattcacgacgataactacgggtctcctggagacaaaatcaccatttgtaatggcagcacaatcgtggatcaacggctggggtccgagcttggatgctataccattaaccgcgtcaagtctttcaaactgtgtgaaaatagcgctacaggcaagacctgcgagatcgactccacaccggttaaatgtagacaggggttttgcctcaagatcacccaggagggacggggccatgtgaagctgtctcgcggcagcgaagtggtccttgatgcctgtgactccagctgcgagattatgatccccaaagggacgggagatattctggtggactgttctggcgggcagcaacacttcctcaaggataacctgatcgacctgggatgccctcatattcccctcctgggcaaaatggcgatctacatttgtagaatgtccaatcaccctcggaccacaatggcttttcttttctggtttagcttcgggtatgttattacctgcatcttttgcaaggccctgttctactctctcattatcattggaacactgggcaaaaagatcaagcagtatcgcgaacttaaaccccagacctgtacgatttgcgagacagcccctgtgaacgctatcgatgccgagatgcatgacctgaattgttcctacaacatctgcccgtattgtgctagcagactcacctctgacggcctggcccggcacgtcacacagtgccccaagcgcaaagaaaaggtggaggaaaccgagctgtacctcaatctggaaagaatcccttggatcgttcggaaacttctgcaagtgtccgagagcaccggggtcgcgctcaagcgctcctcttggctgattgtgcttctggtgctcctggccgtcagcctgtcccccgttcagagcgctcctgtgggaagaaaacccctctttctggattctatcgtgaagggcatgaagaaccttcttaattccacaagcctcgagacgtctctgagcattgaagccccgtggggagctatcaacgtccagtccaccttcaaacctacagtgtctaccgccaatatcgcgcttagctggtccagcgttgagcaccggggaaacaagattctggtgacaggccgctctgaatccatcatgaaactcgaggaaagaaccggggtcagctgggacctgggagtggaggatgcctctgagtccaagctgctcacggttagcattatggacctgtcccagatgtactctcccgtgtttgaatatcttagcggcgatcggcaagtcgaggaatggcctaaagctacatgtaccggcgactgccccgagagatgtgggtgcacctcctctacatgtctgcataaggaatggccccacagccgcaattggcggtgcaaccctacctggtgctggggagtgggcacagggtgtacgtgctgtggagtcgatgtgaaggacctcttcaccgatcatatgtttatcaaatggaaggttgagtacattaaaacagaggccatcgtgtgcgtcgaactgacctcccaggagagacagtgtagcctgattgaagctggcacacgcttcaaccttgggccggtgaccatcacgctctctgagccccggaatatccaacagaagctgcctcccgagattatcaccctgcaccctaaaattgaagagggcttctttgacctcatgcacgttcagaaggtgctgtccgccagcacagtctgcaagctgcagtcttgtacccatggaatccccggcgatctgcaaatttatcacatcgggaacctcctgaaaggagacagagtgaatggccatctgatccacaagattgaaccgcatttcaacacatcctggatgagctgggacgggtgcgatcttgactactattgtaatatgggagattggccttcttgcacctacacgggcgtgacacagcacaaccacgccgcttttgttaatctcctgaacatcgagaccgactatacaaaaaccttccattttcacagcaagcgcgtcaccgcgcatggggatacaccccagctggacctcaaagcccggcctacgtacggcgctggagaaattaccgtgctggtggaggtcgccgatatggagcttcacacaaagaaggtggaaatctccggcctgaaattcgccagcctcacctgtacagggtgctacgcttgttcttccggaattagctgcaaggttagaatccacgtggacgagcccgatgaactgaccgtccatgtgaaatcctctgaccctgatgttgtggccgcgagcacgtccctgatggctcgcaagctggagtttggcacagactctaccttcaaagcctttagcgccatgcccaagacctccctctgcttctatatcgtcgaacgggagtactgtaaatcttgcagcgaggatgacacaaagaagtgtgtggacaccaaactggaacagccgcaatccattctgatcgagcacaaggggacaattatcggaaaacagaatgatacgtgcaccgctaaggccagctgttggctcgaatctgttaaatcctttttctatggcctgaagaacatgcttgggagcgtgtttggctctttcttcgtcgggattctgctctttctggctcctttcgtgctgcttgtgctctttttcatgtttggctggaagatcctgttctgctttaaatgttgcagacgcacacgggggctgttcaagtacagacatctcaaagacgatgaggaaaccggatatcggcgcatcattgagagacttaattccaagaaaggcaagaaccggcttctggacggggagagactcgccgatcgcaagatcgcggaactgtttagcacaaaaacccacattgga

SEQ ID NO: 13910 - RNA, 2916 nt, synthetic construct
  misc_feature 1..2916: note = derived and/or modified CDS sequence (opt5) from CCHFV(4495-ST-2008, Artificial)__KR814869.1__Gn-4aa-Gc
  source 1..2916: mol_type = other RNA
agcgaggaatccggcgacgattgcatctctagaacccagctgctccggacagagacggccgaaattcacgacgataactacgggggacccggcgacaagatcaccatttgtaatgggagcacaatcgtggatcaacgcctgggatccgagcttggctgctataccattaacagagtcaaatctttcaagctgtgtgaaaatagcgctacagggaaaacctgcgagatcgactccacacctgttaagtgtcggcagggattttgcctcaaaatcacccaggagggccgcggccatgtgaagctgtctagagggagcgaagtggtccttgatgcctgtgactccagctgcgaggtgatgattccgaagggaacgggcgatatcctggttgactgttctgggggacagcaacacttcctcaaagataacctgattgacctgggctgcccccatatccctctcctggggaagatggcgatttacatctgtcggatgtccaatcacccccgcaccacaatggcttttcttttctggtttagcttcggatatgtgattacctgcctgttttgcaaagccctcttctactctctgatcatcattggcacacttggcaagaaaatcaagcagtatagagaactgcggcctcagacctgtacgatttgcgagacagcccccgtcaacgctatcgatgccgagatgcatgacctcaattgttcctacaacatttgcccttattgtgctagccgcctgacctctgacgggctggccagacacgtgccgcagtgccccaagcggaaagaaaaggttgaggaaacagagctctacctgaatcttgaacgcatcccttggatcgtgagaaaactgctccaagtctccgagagcaccggagtggcgctgaagcggtcctcttggcttattgtgctgctcgtcctgctgaccgttagcctctcccccgtgcagagcgcccctgtgggccgcaaacccctgtttcttgattctatcgtcaaggggatgaaaaacctgctcaattccacaagcctggagacgtctcttagcattgaagctccgtggggagccatcaacgtgcagtccaccttcaagcctacagtttctaccgctaatattgccctgagctggtccagcgtggagcacagaggcaacaagatcctcgtcacagggcggtctgaatccatcatgaaactggaggaaagaaccggaattagctgggacctgggcgtggaggatgcgtctgagtccaagctcctgacggttagcatcatggacctttcccagatgtactctcccgtgtttgaatatctgagcggcgatcgccaagtcgaggaatggcctaaagccacatgtaccggggactgccccgagcggtgtggatgcacctcctctacatgtctccataaggaatggccccacagcagaaattggcgctgcaaccctacctggtgctggggcgtggggacaggatgtacgtgctgtggcgtcgatgtgaaagacctgttcaccgatcatatgtttgttaagtggaaggtggagtacattaaaacagaggctatcgtctgcgtggaactgacctcccaggagcggcagtgtagccttattgaagccgggacaagattcaacctcggcccggttaccatcacgctgtctgagccccgcaatattcaacagaagctgcctcccgagatcatcaccctccaccctaaagtggaagagggattctttgacctgatgcacgtccagaaggtgctttccgctagcacagtgtgcaaactgcagtcttgtacccatggcattcccggggatctccaagtttatcacatcggaaacctgctgaagggcgaccgggtcaatgggcatcttattcacaagatcgaaccgcatttcaacacatcctggatgagctgggacggatgcgatctcgactactattgtaatatgggcgattggccttcttgcacctacacgggggtgacacagcacaaccacgccgcctttgtgaatctgctgaacattgagaccgactatacaaaaaccttccattttcacagcaagagagtcaccgctcatggcgatacaccccagctcgacctgaaagcgcgccctacgtacggagccggcgaaatcaccgtgcttgttgaggtggctgatatggagctgcacacaaagaaagtcgaaatctccgggctcaagttcgccagcctggcctgtaccggatgctacgcttgttcttccggcattagctgcaaggtgcggatccacgttgacgagcccgatgaactgacagtgcatgtcaaatcctctgaccctgatgtggttgccgcgagcacctcccttatggctagaaagctcgagtttgggacggactctacattcaaagcctttagcgccatgcccaagacctccctgtgcttctatattgtggaacgcgagtactgtaaatcttgcagcgaggaagatacccagcggtgtgtcgacacaaagctggagcaaccgcagtccatcctcattgaacacaaaggaaccatcatcggcaagcagaatgacacatgcacggctaaggccagctgttggctggagtctgtgaaatcctttttctatgggcttaagaacatgctgggcagcgtgtttggaaatttcttcattggcatcctcctgtttctggctcctttcgtccttctcgttctgtttttcatgtttgggtggaaaattctgttctgctttaagtgttgcagacgggcccgcggactcctgaaatacagacatcttaaggatgacgaagagaccggctatcggaagatcattgagagactgaacaataaaaaggggaaaaaccgcctcctggatggagaacggctggcggacagaaagatcgccgagcttttctctacaaaaacccacatcggc

SEQ ID NO: 13911 - RNA, 2916 nt, synthetic construct
  misc_feature 1..2916: note = derived and/or modified CDS sequence (opt5) from CCHFV(4691-ST-2009, Artificial)__KR814871.1__Gn-4aa-Gc
  source 1..2916: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgcctgtgacagctcctgcgagattatgatccccaaaggaacgggcgatattctggtggactgtagcgggggacagcaacacttcctcaaggataacctgatcgacctgggctgccctcatattcccctcctggggaaaatggcgatctacatttgtagaatgtctaatcaccctcggaccacaatggcttttcttttctggttttccttcggatatgttattacctgcatcttttgcaaggccctgttctacagcctcattatcattggcacactgggcaaaaagatcaagcagtatcgcgaacttaaaccccagacctgtacgatttgcgagacagcccctgtgaacgctatcgatgccgagatgcatgacctgaattgttcttacaacatctgcccgtattgtgcttccagactcaccagcgacgggctggcccggcacgtcacacagtgccccaagcgcaaagaaaaggtggaggaaaccgagctgtacctcaatctggaaagaatcccttggatcgttcggaaacttctgcaagtgtctgagtccaccggagtcgcgctcaagcgcagctcctggctgattgtgcttctggtgctcctgacagtctctctgagccccgttcagtccgcccctgtgggcagaaaacccctctttctggatagcatcgtgaaggggatgaagaaccttcttaattctacgtccctcgagaccagcctgtctattgaagctccgtggggagccatcaacgtccagagcacattcaaacctgctgtgtccaccgccaatatcgcgctttcttggagctccgttgagcaccggggcaacaagattctggtgacagggcgcagcgaatctatcatgaaactcgaggaaagaaccggagtctcctgggacctgggcgtggaggatgccagcgagtctaagctgctcacggtttccattatggacctgagccagatgtactcccccgtgtttgaatatctttctggcgatcggcaagtcgaggaatggcctaaagctacatgtaccggggactgccccgagagatgtggatgcaccagctccacatgtctgcataaggaatggccccactctcgcaattggcggtgcaaccctacctggtgctggggcgtggggacaggatgtacgtgctgtggcgtcgatgtgaaggacctcttcaccgatcatatgtttatcaaatggaaggttgagtacattaaaacagaggccatcgtgtgcgtcgaactgaccagccaggagagacagtgttccctgattgaagctgggacacgcttcaaccttggcccggtgaccatcacgctcagcgagccccggaatatccaacagaagctgcctcccgagattatcaccctgcaccctaaaattgaagagggattctttgacctcatgcacgttcagaaggtgctgtctgcctccacagtctgcaagctgcagagctgtacccatggcatccccggggatctgcaaatttatcacatcggaaacctcctgaaaggcgacagagtgaatgggcatctgatccacaagattgaaccgcatttcaacacatcttggatgtcctgggacggatgcgatcttgactactattgtaatatgggcgattggcctagctgcacctacacgggggtgacacagcacaaccacgccgcttttgttaatctcctgaacatcgagaccgactatacaaaaaccttccattttcactctaagcgcgtcaccgcgcatggcgatacaccccagctggacctcaaagcccggcctacgtacggagctggcgaaattaccgtgctggtggaggtcgccgatatggagcttcacacaaagaaggtggaaatcagcgggctgaaattcgcctccctcgcttgtaccggatgctacgcctgcagctctggcatttcctgtaaggttagaatccacgtggacgagcccgatgaactgacagtccatgtgaaaagctccgaccctgatgttgtggcggcttctaccagcctgatggcccgcaaacttgagtttgggacggactccacattcaaggccttttctgctatgcccaagaccagcctctgcttctatatcgtcgaacgggagtactgtaaatcctgctctgaggatgacaccaagaagtgtgtggacacaaaactggaacagccgcaaagcattctgatcgagcacaagggaaccattatcggcaaacagaatgatacatgcacggccaaggcttcctgttggctcgaaagcgttaaatcctttttctatgggctgaagaacatgcttggctctgtgtttggaaatttcttcgtcggcattctgctctttctggcccctttcgtgctgcttgtgctctttttcatgtttgggtggaagatcctgttctgctttaaatgttgcagacgcacccggggactgttcaagtacagacatctcaaagacgatgaggaaacaggctatcggcgcatcattgagagactgaacagcaagaaagggaagaatcggcttctggacggagagagactcgcggatcgcaagatcgccgaactgttttctaccaaaacacacattggc

SEQ ID NO: 13912 - RNA, 2916 nt, synthetic construct
  misc_feature 1..2916: note = derived and/or modified CDS sequence (opt5) from CCHFV(4701-ST-2009, Artificial)__KR814872.1__Gn-4aa-Gc
  source 1..2916: mol_type = other RNA
agcgaggaacccggcgacgattgcatctccagaacccagctgctcaagacagagacggccgaaattcacgacgataactacgggggacctggcgacaaaatcaccatttgtaatgggtctacagtggtcgatcaacggctgggaagcgagcttggctgctataccatcaaccgcgttaagtccttcaaactgtgtgaaaattctgctacagggaagacctgcgagattgacagcacaccggtgaaatgtagacagggattttgcctcaagatcacccaggagggccggggccatgtgaagctgtcccgcgggtctgaagtcgtgcttgatgcctgtgacagctcctgcgagatcatgattcccaaaggaacgggcgatatcctggttgactgtagcgggggacagcaacacttcctcaaggataacctgattgacctgggctgccctcatatccccctcctggggaaaatggcgatttacatctgtagaatgtctaatcaccctcggaccacaatggcttttcttttctggttttccttcggatatgtgattacctgcatcttttgcaaggccctgttctacagcctcatcattatcggcacactgggcaaaaagattaagcagtatcgcgaacttaaaccccagacctgtacgatctgcgagacagcccctgtcaacgctattgatgccgagatgcatgacctgaattgttcttacaacatctgcccgtattgtgcttccagactcaccagcgacgggctggcccggcacgtgacacagtgccccaagcgcaaagaaaaggttgaggaaaccgagctgtacctcaatctggaaagaatcccttggattgtgcggaaacttctgcaagtctctgagtccaccggagtggcgctcaagcgcagctcctggctgatcgtgcttctggtcctcctgacagtttctctgagccccgtgcagtccgcccctgtgggcagaaaacccctctttctggatagcattgtcaaggggatgaagaaccttcttaattctacgtccctcgagaccagcctgtctatcgaagctccgtggggagccattaacgtgcagagcacattcaaacctaccgtttccacagctaatatcgccctttcttggagctccgtggagcaccggggcaacaagatcctggtcaccgggcgcagcgaatctattatgaaactcgaggaaagaacgggagtgtcctgggacctgggcgttgaggatgcgagcgagtctaagctgctcacagtgtccatcatggacctgagccagatgtactcccccgtctttgaatatctttctggcgatcggcaagtggaggaatggcctaaagccacctgtaccggggactgccccgagagatgtggatgcacaagctccacctgtctgcataaggaatggccccactctcgcaattggcggtgcaaccctacatggtgctggggcgtcgggacgggatgtacctgctgtggcgtggatgttaaggacctcttcacagatcatatgtttattaaatggaaggtggagtacatcaaaaccgaggctattgtctgcgtggaactgacaagccaggagagacagtgttccctgatcgaagccgggacccgcttcaaccttggcccggttacgattaccctcagcgagccccggaatatccaacagaagctgcctcccgagatcattacactgcaccctaaaatcgaagagggattctttgacctcatgcacgtgcagaaggtcctgtctgcttccaccgtgtgcaagctgcagagctgtacacatggcattcccggggatctgcaaatctatcacattggaaacctcctgaaaggcgacagagtgaatgggcatctgatccacaagatcgaaccgcatttcaacacctcttggatgtcctgggacggatgcgatcttgactactattgtaatatgggcgattggcctagctgcacgtacacaggggttacccagcacaaccacgccgcctttgtcaatctcctgaacattgagacagactataccaaaaccttccattttcactctaagcgcgtgacagctcatggcgatacgccccagctggacctcaaagcgcggcctacctacggagccggcgaaatcacagtgctggtcgaggtggctgatatggagcttcacaccaagaaggttgaaattagcgggctgaaattcgcctccctcacatgtaccggatgctacgcctgcagctctggcatctcctgtaaggtgcgcattcacgtcgacgagcccgatgaactgacggtgcatgttaaaagctccgaccctgatgtggtcgctgcctctacaagcctgatggcgagaaaacttgagtttgggaccgactccaccttcaaggctttttctgccatgcccaagacaagcctctgcttctatatcgtggaacgggagtactgtaaatcctgctctgaggatgacaccaagaagtgtgttgacacaaaactggaacagccgcaaagcatcctgattgagcacaagggaacgatcattggcaaacagaatgatacctgcacagccaaggcttcctgttggctcgaaagcgtgaaatcctttttctatgggctgaagaacatgcttggctctgtctttggaggcttcttcgtggggatcctgctctttctggcccctttcgtgctgcttgtcctctttttcatgtttggatggaagattctgttctgctttaaatgttgcagacgcacccggggcctgttcaagtacagacatctcaaagacgatgaggaaacagggtatcggcgcatcatcgagagactgaatagcaagaaaggaaagaaccggcttctggacggcgagagactcgctgatcgcaagattgccgaactgttttctaccaaaacgcacatcggg

SEQ ID NO: 13913 - RNA, 2916 nt, synthetic construct
  misc_feature 1..2916: note = derived and/or modified CDS sequence (opt5) from CCHFV(5170-R-2011, Artificial)__KR814873.1__Gn-4aa-Gc
  source 1..2916: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgtgtgtgacagctcctgcgagattatgatccccaaaggaacgggcgatattctggttgactgtagcgggggacagcaacacttcctcaaggataacctgatcgacctgggctgccctcatattcccctcctggggaaaatggccatctacatttgtagaatgtctaatcaccctcggaccacaatggcgtttcttttctggttttccttcggatatgtgattacctgcatcttttgcaaggctctgttctacagcctcattatcattggcacactgggcaaaaagatcaagcagtatcgcgaacttaaaccccagacctgtacgatttgcgagacagcccctgtcaacgccatcgatgctgagatgcatgacctgaattgttcttacaacatctgcccgtattgtgcctccagactcaccagcgaagggctggctcggcacgtgacacagtgccccaagcgcaaagagaaggttgaagagaccgaactgtacctcaatctggagagaatcccttggatcgtgcggaaacttctgcaagtctctgagtccaccggagtggccctcaagcgcagctcctggctgattgtgcttctggtcctcctgacagtttctctgagccccgtgcagtccgcgcctgtgggcagaaaacccctctttctggacagcatcgtcaaggggatgaagaaccttcttaattctacgtccctcgaaaccagcctgtctattgaggccccgtggggagctatcaacgtgcagagcacattcaaacctaccgtttccacagccaatatcgctctttcttggagctccgtggaacaccggggcaacaagattctggtcaccgggcgcagcgagtctatcatgaaactcgaagagagaacgggagtgtcctgggatctgggcgttgaggacgccagcgaatctaagctgctcacagtgtccattatggatctgagccagatgtactcccccgtctttgagtatctttctggcgaccggcaagtggaagagtggcctaaagcgacctgtaccggggattgccccgaaagatgtggatgcacaagctccacctgtctgcataaggagtggccccactctcgcaattggcggtgcaaccctacatggtgctggggcgtcgggacgggatgtacctgctgtggcgtggacgttaaggatctcttcacagaccatatgtttatcaaatggaaggtggagtacattaaaaccgaagccatcgtctgcgtggagctgacaagccaggaaagacagtgttccctgattgaggctgggacccgcttcaaccttggcccggttacgatcaccctcagcgagccccggaatatccaacagaagctgcctcccgaaattatcacactgcaccctaaaattgaggaaggattctttgatctcatgcacgtgcagaaggtcctgtctgcctccaccgtgtgcaagctgcagagctgtacacatggcatccccggggacctgcaaatttatcacatcggaaacctcctgaaaggcgatagagtgaatgggcatctgatccacaagattgagccgcatttcaacacctcttggatgtcctgggacggatgcgaccttgattactattgtaatatgggcgactggcctagctgcacgtacacaggggttacccagcacaaccacgctgcctttgtcaatctcctgaacatcgaaacagattataccaaaaccttccattttcactctaagcgcgtgacagcccatggcgacacgccccagctggatctcaaagctcggcctacctacggagcgggcgagattacagtgctggtcgaggtggccgacatggaacttcacaccaagaaggttgagatcagcgggctgaaattcgcttccctcacatgtaccggatgctacgcctgcagctctggcatttcctgtaaggtgagaatccacgtcgatgaacccgacgagctgacggtgcatgttaaaagctccgatcctgacgtggtcgccgcttctacaagcctgatggcccgcaagctggaatttgggaccgattccaccttcaaagcgttttctgctatgcccaagacaagcctctgcttctatatcgtggagcgggagtactgtaaatcctgctctgaagacgataccaagaagtgtgttgacacaaaactggagcagccgcaaagcattctgatcgaacacaagggaacgattatcggcaaacagaatgatacctgcacagccaaggcctcctgttggctcgagagcgtgaaatctttcttttatgggctgaagaacatgcttggctccgtctttggatctttcttcgtgggcattctgctctttctggctcctttcgtgctgcttgtcctctttttcatgtttgggtggaagatcctgttctgctttaaatgttgcagacgcacccggggactgttcaagtacagacatctcaaagacgacgaagagacaggctatcggcgcatcattgagagacttaatagcaagaaagggaagaaccggcttctggatggagaaagactcgccgaccgcaagatcgctgagctgttttccaccaaaacgcacattggc

SEQ ID NO: 13914 - RNA, 2916 nt, synthetic construct
  misc_feature 1..2916: note = derived and/or modified CDS sequence (opt5) from CCHFV(Oman-199809166, Artificial)__KR864901.1__Gn-4aa-Gc
  source 1..2916: mol_type = other RNA
agcgaggaatccggcgaggactgcatctctagaacccagctgctccggacagaaacggccgagattcacggggataactacggaggccccggggacaagatcaccatttgtaatggaagcacaatcgtggatcaacgcctgggctccgaacttgggtgctataccattaacagagtcaaatctttcaagctgtgtgagaatagcgctacaggaaaatcctgcgagatcgacaacacccctgttaagtgtaaacagggcttttgcctcaagatcacacaggaaggccgggggcatgtgaagctgtctcgcgatagcgaggtggtccttgacgcctgtgattccagctgcgaaattatgatcccgaaaggaaccggcgacattctggtggattgttctgggggacagcaacacttcctcaaggacaatctgatcgatctgggctgccccaacattcctctcctggggaaaatggcgatctacatttgtagaatgtccaatcatcccaagacgaccatggcttttcttttctggtttagcttcggatatgttatcacatgcatcctgtgcaaagtgatcttttacctcctgattgtcgtgggcacccttggcaagaagttcaaacagtatcgggagctgaagcctcagacatgtaccatttgcgagacgacacccgttaacgccatcgacgccgaaatgcacgatctcaattgttcttacaacatttgcccttattgtgcttcccgcctgaccagcgacgggctggccagacatgtgatgcagtgcccgaaacggaaggagaaaatcgaagagacagaactctacctgaatcttgagcgcatcccctgggtcgtgagaaagctgctccaagtgtctgagtccaccggagtcgctctgaaacggagctcctggcttattgttctgctcgtgctgctgaccgtgtctctcagccctgtccagtccgcccccatcggccgcaagcctctgtttcttgacagcattgcgaaggggatgaaaaacctgctcaattctacatccctggaaacgagcctttctatcgaggccccctggggagctattaacgtgcagagcaccttcaagccgacagtttccaccgccaatatcgctctgtcttggagctccgtggaacacagaggcaacaaaatcctcgtcagcgggcggtctgagtccattatgaagctggaggaacgcacaggaatcagctgggatctgggcgtggaggacgcctctgaatccaaactcctgaccgttagcgtgatggatctttcccagatgtactctcctgtctttgagtatctgagcggcgacagacaagtggaagagtggcccaaggcgacgtgtacaggggattgccctgaacggtgtggatgcacctcctctacctgtctccacaaggagtggccccatagcagaaactggcgctgcaatcccacatggtgctggggcgtcgggaccggatgtacatgctgtggcctggacgtgaaagatctgttcacggactacatgtttgttaagtggaaagtggagtatattaagaccgaagccatcgtctgcgtggagcttacatcccaggaacggcagtgtagcctcattgaggctgggaccagattcaacctgggccctgttacaatcaccctgtctgagccgcgcaatattcaacagaaactgccccctgaaatcgtgacgctccacccccggatcgaggaaggattctttgatcttatgcatgtccagaaggtgctgtccgccagcaccgtgtgcaagctccagtcttgtacacacggcgttcctggggacctgcaagtctaccacattggaaacctgcttaaaggcgataaggtgaatgggcatctcatccacaaagtggagccccatttcaacacctcctggatgagctgggacggatgcgacctggattattactgtaatatgggcgactggccgtcttgcacatataccggggtcacgcagcacaaccatgctgcctttgtgaatctgctcaacattgaaacagattacaccaagaatttccactttcacagcaaaagagttacagcccatggcgacacccctcagctggatcttaaggctcgccccaactacggagcgggcgagatcaccgtgctggtcgaggtggccgacatggaactccacacaaagaaaattgagatctccgggctgaagttcgctagcctgacgtgtaccggatgctatgcctgttcttccggcatcagctgcaaagttcggattcatgtggatgaacctgacgagcttacagtccacgtgaagtccgaagatcccgacatcgttgccgcttctagctccctcatggccagaaaactggagtttgggaccgattctacattcaaggcgtttagcgctatgcctaaaacctccctgtgcttctacattgtggagcgcgaatattgtaagtcttgcagcaaggaggacacgcagaaatgtgtcaatgccaagctcgaacggccccaatccatcctgattgagcacaaaggaacaatcatcggcaagcagaacgatacctgcaccgccaaagctagctgttggcttgaatctgtgaagtcctttttctacgggctgaagaatatgctcagcggcatttttggaaacgtgttcatcggcattttcctgtttctggccccgttcatccttctcattctgtttttcatgtttgggtggagaatcctgttctgctttaaatgttgccgccggacaagaggactcttcaagtatcggcatctgaaagacgacgaggagaccggctaccgcaagatcattgaaagacttaacaataaaaaggggaagaacaaactgctcgatggagagcggctggctgacagaaagatcgccgaactgttttctacaaaaacgcacattggc

SEQ ID NO: 13915 - RNA, 2916 nt, synthetic construct
  misc_feature 1..2916: note = derived and/or modified CDS sequence (opt5) from CCHFV(200406546-Turkey, Artificial)__KR864902.1__Gn-4aa-Gc
  source 1..2916: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtgaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgtgtgtgacagctcctgcgaggttatgattcccaagggaacgggcgatatcctggtggactgtagcgggggacagcaacacttcctcaaagataacctgattgacctgggctgccctcatgtccccctcctggggcggatggccatctacatttgtcgcatgtctaatcaccctagaaccacaatggcgtttcttttctggttttccttcggatatgtgattacctgcatcttttgcaaggctctgttctacagcctcatcatcattggcacactgggcaaaaagtttaaacagtatcgggaacttaagccccagacctgtacgatctgcgagacagcccctgttaacgccattgatgctgagatgcatgacctgaattgttcttacaacatctgcccgtattgtgcctcccgcctcaccagcgacgggctggctagacacgtgccccagtgccctaagcggaaagaaaaggtcgaggaaacagagctgtacctcaatctggaacgcattccctggatcgtgagaaaacttctgcaagtgtctgagtccaccggagtcgccctcaagcggagctcctggctgatcgttcttctggtgctcctgaccgtgtctctgagccctgtccagtccgcgcccgtgggccgcaaaccgctgttcctggatagcattgttaaggggatgaaaaaccttctgaatagcacatccctcgagacgagcctgtctatcgaagccccttggggagctattaacgtgcagagcacctttaagcccacagtctccaccgccaatatcgctctttcttggagctccattgagcacagaggcaacaagatcctggtgacagggcggagcgaatctatcatgaaactcgaggaaagaaccggagtttcctgggacctgggcgtggaggatgccagcgagtctaagctgctcacggtctccattatggacctgagccagatgtactcccctgtgttcgaatatctttctggcgatcgccaagtcgaggaatggcccaaagcgacatgtaccggggactgccccgagcggtgtggatgcaccagctccacatgtctgcataaggaatggcctcactctagaaattggcgctgcaacccgacctggtgctggggcgtggggacaggatgtacgtgctgtggcgttgatgtgaaagacctctttaccgatcatatgttcgtcaagtggaaggtggagtacatcaaaacagaggccattgtttgcgtggaactgaccagccaggagcggcagtgttccctgatcgaagctgggacaagattcaaccttggccccgtcaccattacgctcagcgagcctcgcaatatccaacagaagctgccccctgagattatcaccctgcaccccaaagtggaagagggatttttcgacctcatgcacgtgcagaaggttctgtctgcctccacagtctgcaaacttcagagctgtacccatggcatcccgggggatctgcaagtgtatcacattggaaacctcctgaagggcgaccgggtgaatgggcatctgatccacaagattgaacctcattttaacacatcttggatgtcctgggacggatgcgatcttgactactattgtaatatgggcgattggcccagctgcacctacacgggggtcacacagcacaaccacgctgccttcgtgaatctcctgaacatcgagaccgactatacaaaaacctttcatttccactctaagagagttaccgcccatggcgatacacctcagctggacctcaaagctcgccccacgtacggagcgggcgaaattaccgtgctggtcgaggtggccgatatggagcttcacacaaagaaagttgaaatcagcgggctgaagtttgcttccctcgcctgtaccggatgctacgcctgcagctctggcatctcctgtaaggtgcggattcacgtcgacgagcctgatgaactgacagtgcatgttaaaagctccgaccccgatgtggtcgctgcctctaccagcctgacggcgagaaaacttgagttcgggacagactccacctttaaggctttctctgccatgccgaagaccagcctctgcttttatatcgtggaaaaagagtactgtaagtcctgcaatgaggatgacacacagaaatgtgtggacaccaagctggaacaacctcagtctattctgatcgagcacaagggaacaattatcggcaaacagaacgatacgtgcaccgccaaggctagctgttggctcgaatccgtcaaatctttcttttatgggctgaagaatatgcttggctctgttttcggaaacttctttatcggcattctcctcttcctggccccctttgtgctgcttgtcctcttctttatgttcgggtggaaaatcctgttttgcttcaagtgttgccgccggacaagaggactgtttaagtaccggcatctcaaagacgatgaggaaaccggctataagcgcattatcgagagactgaataacaaaaaggggaaaaatcggcttctggacggagagagactcgctgatcgcaagattgccgaactgttctccacaaagacccacatcggc

SEQ ID NO: 13916 - RNA, 2916 nt, synthetic construct
  misc_feature 1..2916: note = derived and/or modified CDS sequence (opt5) from CCHFV(1-CR/HU-2015, Artificial)__KU161584.1__Gn-4aa-Gc
  source 1..2916: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacagctcctgcgaggtgatgattcccaagggaacgggcgatatcctggttgactgtagcgggggacagcaacacttcctcaaagataacctgattgacctgggctgccctcatatccccctcctggggaagatggcgatttacatctgtcggatgtctaatcaccctcgcaccacaatggcttttcttttctggttttccttcggatatgtgattacctgcatcttttgcaaagccctgttctacagcctcatcattatcggcacactgggcaagaaaattaagcagtatagagaacttaagccccagacctgtacgatctgcgagacagcccctgtcaacgctattgatgccgagatgcatgacctgaattgttcttacaacatctgcccgtattgtgcttcccggctcaccagcgacgggctggcccgccacgtgacacagtgccccaaaagaaaggaaaaagttgaggaaaccgagctgtacctcaatctggaacggatcccttggattgtgcgcaagctgctgcaagtctctgagtccaccggagtggcgctcaaaagaagctcctggctgatcgtgcttctggtcctcctgacagtttctctgagccccgtgcagtccgcccctgtgggccggaagcccctctttctggatagcattgtcaaagggatgaagaaccttcttaattctacgtccctcgagaccagcctgtctatcgaagctccgtggggagccattaacgtgcagagcacattcaagcctaccgtttccacagctaatatcgccctttcttggagctccgtggagcaccgcggcaacaaaatcctggtcaccgggagaagcgaatctattatgaagctcgaggaacggacgggagtgtcctgggacctgggcgttgaggatgcgagcgagtctaaactgctcacagtgtccatcatggacctgagccagatgtactcccccgtctttgaatatctttctggcgatagacaagtggaggaatggcctaaggccacctgtaccggggactgccccgagcgctgtggatgcacaagctccacctgtctgcataaagaatggccccactctcggaattggagatgcaaccctacatggtgctggggcgtcgggacgggatgtacctgctgtggcgtggatgttaaggacctcttcacagatcatatgtttgtgaagtggaaagtcgagtacattaagaccgaggctatcgtgtgcgttgaactgacaagccaggagcgccagtgttccctgattgaagccgggacccggttcaaccttggcccggtgacgatcaccctcagcgagcccagaaatattcaacagaaactgcctcccgagatcatcacactgcaccctaagattgaagagggattctttgacctcatgcacgtccagaaagtgctgtctgcttccaccgtgtgcaaacttcagagctgtacacatggcatccccggggatctgcaagtttatcacattggaaacctcctgaagggcgaccgcgtcaatgggcatctgatccacaaaattgaaccgcatttcaacacctcttggatgtcctgggacggatgcgatcttgactactattgtaatatgggcgattggcctagctgcacgtacacaggggtgacccagcacaaccacgccgcctttgtgaatctcctgaacatcgagacagactataccaagaccttccattttcactctaaacgggtcacagctcatggcgatacgccccagctggacctcaaggcgagacctacctacggagccggcgaaatcacagtgctggttgaggtggctgatatggagcttcacaccaaaaaggtcgaaattagcgggctgaagttcgcctccctcgcctgtacaggatgctacgcttgcagctctggcatctcctgtaaagtgcgcattcacgttgacgagcccgatgaactgaccgtgcatgtcaagagctccgaccctgatgtggttgccgcgtctacgagcctgatggctcggaaacttgagtttgggacagactccaccttcaaggccttttctgccatgcccaaaaccagcctctgcttctatatcgtggaaagagagtactgtaagtcctgctctgaggatgacacaaagaagtgtgtcgacaccaagctggaacagccgcaaagcattctgatcgagcacaaaggaacaatcattggcaagcagaatgatacgtgcaccgctaaagcctcctgttggctcgaaagcgtgaagtcctttttctatgggctgaaaaacatgcttggctctgtgtttggaaatttcttcatcggcattctgctctttctggctcctttcgtcctgcttgttctctttttcatgtttgggtggaagatcctgttctgctttaagtgttgccgccggacaagaggactgttcaaataccggcatctcaaggacgatgaggaaaccggctatcgcagaattatcgagcggctgaacaataaaaaggggaaaaacagacttctggacggagagcgcctcgccgatcggaagatcgcggaactgtttagcacaaagacccacattggc

SEQ ID NO: 13917 - RNA, 2916 nt, synthetic construct
  misc_feature 1..2916: note = derived and/or modified CDS sequence (opt5) from CCHFV(Gaib, Artificial)__KX013445.1__Gn-4aa-Gc
  source 1..2916: mol_type = other RNA
agcgaggaatcctctgacgattgcatcagcagaacccagctgctccggacagagacggccgaaattcacaacgacaattacggcgggcccggagataagatcaccatttgtaacggctccacaatcgtggaccaacgcctggggtctgagcttggatgctataccattaatagagtcaagagcttcaaactgtgtgaaaactccgctacaggcaaatcttgcgagatcgatagcatccctgttaagtgtcggcaggggttttgcctcaaaattacccaggagggacgcggccatgtgaagctgtccagaggcagcgaagtggtccttgacgcctgtgattcttcctgcgagatcatgattccgaaggggacaggagacatcctggtggattgtagcggcgggcagcaacacttcctcaaagacaatctgattgatctgggatgccccaacatccctctcctgggcaagatggcgatttacatctgtcggatgtctaatcatcccaaaaccacgatggcttttcttttctggttttccttcgggtatgttatcacatgcattttctgcaaggccatcttctacctgctcattatcgtgggaacactgggcaaaaagtttaagcagtatcgcgaacttaaacctcagacctgtacaatttgcgagaccacgcccgtcaacgccatcgacgctgagatgcacgatctgaattgtagctacaacatctgcccttattgtgcctctagactcacatccgacggcctggctcggcatgtggttcactgcccgaagcgcaaagaaaagattgaggaaaccgagctgtacctcaatctggaaagagtgccctgggtcgtgcggaaacttcttcaggtgagcgagtccacaggggtcgccctcaagcgctctagctggctgatcgttcttctggtgctcctgaccgtgtccctgagccctgtccaatctgcgcccattggaagaaaacctctcttctccgacagcatcgtgaagggcatgaagaacctgcttaattctaccagcctggagacatccctctctattgaagccccctggggagctatcaacgttcagagcacgtttaaaccgaccgtgtccacagccaatatcgctctgagctggtcttccattgagcaccgggggaacaagatccttgtcagcggccgctctgaatccattatgaaactggaggaaagaaccgggatcagctgggatctcggagtggaggacgcctccgagtctcggctgctgacagttagcgtgatggatctctcccagatgtactctcctgtcttcgaatatctgagcggcgacagacaggtggaggaatggcccaaggcgacctgtacgggcgattgccctgagcgctgtgggtgcacatccagcacctgtcttcataaagaatggccccactctcggaactggagatgcaatcccacctggtgctggggagtcggcacagggtgtacctgctgtggactggacgtgaaggatctctttacagactacatgttcgttaagtggaaagtggagtatattaagacggaggccatcgtctgcgtggaactgacctcccaagagcgccagtgtagcctgattgaagctggcacacggttcaaccttgggcctgttaccatcacactctctgagccgagaaatatccagcaaaaactgccccctgagattatcaccctgcatccccgcattgaagagggctttttcgatctcatgcacgtgcagaaggtcctgtccgccagcacggtgtgcaaacttcagtcttgtacccacggagtgcctggcgacctgcaggtttaccatatcgggaacctcctgaagggagataaggtcaatggccacctgattcataaaatcgaaccccactttaacacaagctggatgtcctgggacgggtgcgaccttgattattactgtaatatgggagactggccgagctgcacctatacaggcgtgacccaacataaccacgctgccttcgtgaatctcctgaacatcgagacggattacacaaagaattttcacttccattctaaacgggtcaccgcccacggggacacacctcagctggatctcaaggctagacccacctacggcgcgggagaaattaccgtgctggttgaggtggccgacatggagcttcataccaaaaagatcgaaatttccggcctgaagtttgctagcctcacgtgtaccgggtgctatgcctgctcctctggaatcagctgtaaagtccgcattcacgtggatgagcctgacgaactgacagttcacgtgaagtccgaggatcccgacatcgtcgccgcttctagctccctgatggcccggaaacttgaatttggcaccgattctacatttaaggcgttcagcgctatgcctaaaacctccctctgcttttacatcgtggagagagagtattgtaagagctgctctcgcgaagacacgcagaaatgtgtttccacaaagctggagcagccccaaagcattctgatcgaacataaggggaccattatcggaaaacagaacaatacctgcacaaccaagacaacgtgttggctcgagtctgtgaaatccttcttttacggcctgaagaacatgcttagctctattttcgggaatgtcttcgtgggcatcttttccttcctggccccgtttatcctcctgattctgttctttatgttcggatggcggatcctgttttgcttcaaatgttgcagacggacccgcggcctctttaagtatagacacctgaaggatgacgaagagacagggtaccggagaattatcgagcgcctgaacaacaaaaagggaaaaagcaagctcctggacggcgaacggcttgccgatagaaaaattgctgagctgttctccaccaagacacatatcggg

SEQ ID NO: 13918 - RNA, 2916 nt, synthetic construct
  misc_feature 1..2916: note = derived and/or modified CDS sequence (opt5) from CCHFV(Hodzha, Artificial)__KX013448.1__Gn-4aa-Gc
  source 1..2916: mol_type = other RNA
agcgaggaatccggcgacgattgcatctctagaacccagctgctccggacagagacggccgaaattcacggggacgattacggaggccccggggacaagatcaccatttgtaacggaagcacaatcgtggatcaacgcctgggctccgagcttgggtgctataccattaatagagtcaaatctttcaagctgtgtgaaaacagcgctacaggaaaatcctgcgagatcgactctacccctgttaagtgtcggcagggctactgcctcaaaatcacacaggagggccgcgggcatgtgaagctgagcagaggatccgaagtggtccttgatgcctgtgacagctcttgcgaggtgatgattccgaagggcaccggggatatcctggttgactgttccggaggccagcaacactttctcaaagataatctgattgacctggggtgcccccggatccctctcctgggaaagatggcgatttatatctgtcgcatgagcaaccatcccgaaacgaccatggctttcctgttttggttctcttttggctacgtgattacatgcatcctttgcaaagccatcttctatctcctgattatcgtcggcacccttgggaagagatttaaacagtaccgggagctgaagcctcagacatgtaccatttgcgagacgacacccgccaatgctatcgatgccgaaatgcacgacctcaactgttcctataatatttgcccttactgtgctagccgcctgacctctgacggactggccagacatgtgacacagtgcccgaagcggaaagagaaggttgaagagaccgaactctacctgaaccttgagcgcatcccctggatcgtgagaaaactgctccaagtctccgagagcaccggcgtggcgctgaagcggtcctcttggcttattgtgctgctcgtcctgttcgccgttagcctgtcccctgtgcagagcgctcccatcgggcgcagacctctctttctggattctattgtgaaaggaaagaaaaatcttctgaactccacaagcctcgaaacgtctctgagcatcgaggccccctggggcgctattaatgtccagtccacctataagccgacagtgtctaccgccaacatcgcgcttagctggtccagcgttgaacaccgggggaataagatcctggtgtctggaagatccgagagcattatgaaactcgaagagagaacaggcatctcttgggacctgggcgtcgaggatgcctccgaaagcaagctgctcaccgtgtccgttatggacctgtctcagatgtacagccctgtgttcgagtatctttccggggatcggcaagtcgaagagtggcccaaagctacgtgtacaggagactgctctgaaagatgtggctgcaccagctccacctgtctgcacaaggagtggcctcatagccgcaactggcggtgcaatcccacatggtgctggggagtggggaccggctgtacatgctgtgggctcgatgtcaaagacctgtttacggattacatgttcgtgaagtggaaggttgactatattaaaaccgaggccatcgtgtgcgtcgaactgacatctcaggagagacagtgttcccttgtggaagctggcacccgctttaacctcggacccgttacaattaccctgagcgagcctcggaacatccaacagaagctgccgcccgagattatcacgctccaccctagaatcgaagagggcttcttcgatctgatgcatgtgcagaaagtcctttctgcctccaccgtgtgcaagctgcagagctgtacacacggggtgcccggagacctccaagtttaccacattggcaatctgctgaaaggggacaaggtcaacggacatcttatccacaagattgaacctcattttaatacctcttggatgagctgggatggctgcgacctcgattattactgtaacatgggggactggccctcctgcacatacaccggcgtgacgcagcacaatcatgccagcttcgtgaacctgctgaatatcgagacagattataccaaatcttttcacttccactccaagcgcgtcacagctcatggagacaccccgcagctcgatctgaaagcgcggcctacctacggcgccggggaaattacagtgcttgttgaggtggctgacatggagctgcacacgaagaaaatcgaaatcaccggactcaagtttgccagcctgacatgtaccggctgctatgcctgctcctctgggattagctgtaaggtcagaatccatgtggatgagcccgacgaactgacagttcacgtgaaatccgatgaccctgatgtcgtggctgcctctagctcccttatggcgcgcaagctcgagttcggaaccgactctacgtttaaggctttcagcgccatgcccaaaacatccctgtgcttttacattgttgaacgggagtattgtaaaagctgctctaaggaggacacccagaaatgtgtgaacaccaagctggaacaacctcagtccatcctcattgagcagaagggcacaatcatcgggaaacagaataatacctgcacagccaaggctagctgttggctggaatctgtcaaatccttcttttacggccttaagaacatgctgagcggaattttcggcaacgtgtttgtggggatcttcctcttcctggccccctttattctgcttatcctcttctttatgttcggatggcgcattctgttttgcttcaaatgttgccggcgcacgagaggcctgtttaagtataagcacctcaaagatgacgaggaaaccgggtaccggagaatcatcgagcgcctgaataacaagaaaggaaagaataaacttctggatggcgagcggctcgctgacagacgcattgccgaactgttctctacaaagacccatatcggg

SEQ ID NO: 13919 - RNA, 2916 nt, synthetic construct
  misc_feature 1..2916: note = derived and/or modified CDS sequence (opt5) from CCHFV(IbAn7620, Artificial)__KX013451.1__Gn-4aa-Gc
  source 1..2916: mol_type = other RNA
agcgaggaaccctccgacgattgcatctctagaacccagctgctccggacagagacggccgaaattcacggcgacaactacgggggacctggcgataagatcaccatttgtaatgggagcacaatcgtggaccaacgcctgggatccgagcttggctgctataccattaacagagtcaaatctttcaagctgtgtgaaaatagcgctacagggaaaaactgcgagatcgattccgttccggtgaagtgtcggcagggatactgcctccgcatcacccaggagggcagaggccatgtgaaactgtctcgggggagcgaaattgtccttgacgcctgtgatacatcctgcgagatcatgattcccaagggaaccggcgacatcctggtggattgtagcgggggacagcaacactttctcaaggacaatctgattgatctgggctgccctaaaatccccctcctggggaagatggcgatttatatctgtcgcatgtctaaccatcctaaaacgaccatggctttcctgttttggttctcctttggatacgttatcacatgcattctttgcaaggccatcttctatctcctgattatcattggcacccttggcaaaagactgaagcagtaccgggaactcaagccccagacatgtaccatctgcgagacgacacctgtgaatgccatcgacgctgagatgcacgatctgaactgtagctataatatttgcccgtactgtgcctctcgcctgacctccgacgggctcgctagacatgtcatccagtgccccaaacggaaggaaaaagtggaggaaacagagctgtaccttaacctggaacgcattccttgggttgtgagaaagctcctgcaagtcagcgagtctaccggagtggcccttaaacggtccagctggctgatcgtgctcctggtcctgtttaccgtttccctctctcccgtgcagagcgcgcctattggccgcaagcccctgttccttgactccatcgccaaagggatgaagaatccgctgaacagcacatctctcgagacgtccctgagcatcgaagctccttggggagccattgatgtgcagtctacctataagcccacagtcagcaccgctaatatcgccctttcctggtctagcgtggagcacagaggcaacaaaattctggtttccgggcggagcgaatctatcatgaagctcgaggaaagaacaggaatttcctgggacctgggcgtggaggatgcgagcgagtctaaactgctcaccgtctccgtgatggacctgagccagatgtactcccctgtttttgaatatctttctggcgatcgccaagtggaggaatggcccaaggccacgtgtacaggggactgccccgagcggtgtggatgcaccagctccacctgtctgcacaaagaatggcctcattctagaaattggcgctgcaacccgacatggtgctggggcgtcgggaccggatgtacatgctgtggcctcgatgtgaaggacctgttcacggattacatgtttgtcaagtggaaagtggagtatatcaagaccgaggctattgtttgcgtggaactgacaagccaggagcggcagtgttcccttatcgaagccgggaccagattcaacctcggccccgtcacaatcaccctgagcgagcctcgcaatattcaacagaaactgccccctgagatcattacgctccacccccggatcgaagagggatttttcgacctgatgcatgtgcagaaggttctttctgcttccaccgtgtgcaaactgcagagctgtacacacggcgtcccgggggatctccaagtgtaccacattggaaacctgctgaagggcgacaaggtgaatgggcatcttatccacaaaatcgaacctcatttcaacacctcttggatgtcctgggacggatgcgatctcgactattactgtaatatgggcgattggcccagctgcacatacaccggggttacgcagcacaaccatgcctcttttgtcaatctgctgaacattgagacagactataccaagaatttccactttcacagcaaaagagtgacagcccatggcgatacccctcagctcgacctgaaggctcgccccacctacggagcgggcgaaatcacagtgcttgtcgaggtggccaacatggagctgcacacgaaaaagattgaaatctccgggctcaagttcgctagcctgacctgtacaggatgctatgcctgttcttccggcattagctgcaaagttcggatccatgtggatgagcctgacgaactgaccgtccacgtgaagtccgatgaccccgatgttgtggccgcttctagctcccttatggccagaaaactcgagtttgggacagactctaccttcaaggcgtttagcgctatgccgaaaacgtccctgtgcttctacatcgtcgaacgcgagcactgtaagtcttgcagcgaggaagataccaaaaagtgtgtgaatacaaagctggagcagcctcaatccattctcatcgaacataaaggaaccattatcggcaagcagaacagcacatgcaccgccaaagcctcttgttggctggagtccgttaagagctttttctatgggcttaaaaatatgctgtctggcatttttggaaacgtgttcatgggcatctttctcttcctggctcccttcatcctgcttattctctttttcatgtttgggtggcggatcctgttctgctttaagtgttgcagacggacacgcggactgttcaagtacagacacctcaaagacgacgaagagacgggctatcggagaattatcgagcgcctgaataacaagaaagggaagaacaaacttctggatggagaacggctcgccgacagacgcattgctgagctgttttccaccaagacacatatcggc

SEQ ID NO: 13920 - RNA, 2916 nt, synthetic construct
  misc_feature 1..2916: note = derived and/or modified CDS sequence (opt5) from CCHFV(K128_76, Artificial)__KX013454.1__Gn-4aa-Gc
  source 1..2916: mol_type = other RNA
agcgacgagtccggcgatgactgcatctctagaacccagctgctccggacagaaacggccgagattcacggggataactacggaggccccggggacaagatcaccatttgtaatggaagcacaatcgtggatcaacgcctgggctccgaacttgggtgctataccattaacagagtcaaatctttcaagctgtgtgagaatagcgctacaggaaaatcctgcgaaatcgactctatccctgttaagtgtcggcagggctactgcctcaaaattacccaggagggccgcgggcatgtgaagctgagcagaggatccgaggtggtccttgatgcctgtgacagctcttgcgaagtgatgatcccgaagggcacaggggatattctggttgactgttccggaggccagcaacactttctcaaagataacctgatcgacctggggtgccccaagattcctctcctgggaaaaatggcgatctatatttgtcggatgagcaatcatcccaagaccacgatggctttcctcttttggttctcttttggctacgtgattacctgcatcgtctgcaaagccattttctatctgctcatcattgtgggcacactggggaagcgctttaagcagtacagagagcttaaacctcagacctgtacaatctgcgaaaccacgcccacaaacgccattgatgctgagatgcacgacctgaattgttcctataacatctgcccttactgtgccagccggctcacctctgacggactggctcgccatgttacacactgcccgaagagaaaagagaaggtggaagagaccgaactgtacctcaatctggagcggatcccctgggtcgtgcgcaaacttcttcaggtgtccgaaagcaccggcgtcgccctcaagagatcctcttggctgattgttcttctggtcctcttcgcggtgagcctgtcccctgtgcaaagcgcccccatctctcggcgccctctgtttcaggattccattgtgaaagggatgaagaacctcctgaatagcacatctcttgagacgagcctgtccatcgaggctccctggggagccattaacgttcagtctacctataagccggctgtgagcgccgcgaatatcgccctctcctggagctctgtcgaacacagaggctccaaaatcctggtgagcgggcggtctgagtccattatgaagctggaagagagaacaggaatcagctgggacctgggcgttgaagatgcttccgagtctaaactcctgaccgtgagcgtcatggacctgtcccagatgtactctcctgtgttcgagtatctcagcggcgatcgccaagtcgaagagtggcccaaggccacatgtaccggggactgccctgaacggtgtggatgcacgtccagcacatgtctgcataaagagtggccccactctagaaactggcgctgcaatcccacctggtgctggggcgtggggaccggatgtacatgctgtggccttgatgttaaggacctgtttaccgattacatgttcgtgaagtggaaagtcgaatatattaagacagaggctatcgtgtgcgttgagctcacgtcccaggaacggcagtgtagcctgattgaggccgggaccagatttaacctgggccctgtgacaatcaccctttctgaaccgcgcaacattcaacagaaacttccccctgagatcatcacactgcatccccggattgaggaaggattcttcgacctgatgcacgtccagaaggtgctctccgccagcaccgtgtgcaaactgcagtcttgtacgcacggcgttcctggggatcttcaagtctaccatatcggaaatctgctcaagggcgacagagtgaacgggcacctgattcataagatcgagccccactttaataccagctggatgtcctgggacggatgcgatctggactattactgtaacatgggcgattggccgagctgcacatacaccggggtgacacagcataatcacgcttctttcgtcaaccttctcaatattgaaaccgactatacgaaatcctttcacttccatagcaagcgcgtgacagcgcacggcgatacccctcagctggacctgaaagcccggcccaactacggagctggcgagatcacagttctcgtggaagtcgccgatatggagctgcataccaagaaaatcgagatttccgggcttaagtttgcctctctgacctgtacaggatgctatgcttgcagctccggcatctcttgtaaggtgagaatccacgttgacgaacctgatgagctcacggtgcacgtcaaaagcgacgatcccgacgtggttgccgcgtcctctagcctgatggctcgcaagctggaatttgggaccgattccacatttaaagccttcagcgccatgcctaagacctctctttgcttttacatcgtggagcgggaatattgtaaatcctgcagcaaggaggacacacagaaatgtgtcaataccaagctcgagcaaccccagtctattctgatcgaacataagggaacgatcattggcaaacagaacaatacatgcaccgctaagacctcctgttggctggagagcgtgaaatctttcttttacgggctcaagaacatgctgtccggcatcttcggaaatgtgtttgtcggcattttccttttcctggccccgtttatcctcctgattctgttctttatgttcgggtggagaatccttttctgcttcaaatgttgccggcgcacaagaggactctttcggtataagcacctggaaaacgacgaggaaaccggctacagacgcatcattgagcggctgaataacaagaaagggaagaacaaactcctggatggagagagacttgctgaccgcagaatcgccgaactgttcagcacaaagacgcatattggc

SEQ ID NO: 13921 - RNA, 2916 nt, synthetic construct
  misc_feature 1..2916: note = derived and/or modified CDS sequence (opt5) from CCHFV(K168_40, Artificial)__KX013457.1__Gn-4aa-Gc
  source 1..2916: mol_type = other RNA
agcgacgagtccggcgatgactgcatctctagaacccagctgctccggacagaaacggccgagattcacggggataactacggaggccccggggacaagatcaccatttgtaatggaagcacaatcgtggatcaacgcctgggctccgaacttgggtgctataccattaacagagtcaaatctttcaagctgtgtgagaatagcgctacaggaaaatcctgcgaagttgactctatccctgtgaagtgtcggcagggctactgcctcaaaatcacccaggagggccgcgggcatgtgaagctgagcagaggatccgaggtcgtgcttgatgcctgtgacagctcttgcgaagttatgattccgaagggcacaggggatatcctggtggactgttccggaggccagcaacactttctcaaagataacctgattgacctggggtgccccaagatccctctcctgggaaaaatggcgatttatatctgtcggatgagcaatcatcccaagaccacgatggctttccttttctggttctcttttggctacgtcattacctgcatcgtgtgcaaagccatcttctatctgctcattatcgttggcacactggggaagcgctttaagcagtacagagagcttaaacctcagacctgtacaatttgcgaaaccacgcccacaaacgccatcgatgctgagatgcacgacctgaattgttcctataacatttgcccttactgtgccagccggctcacctctgacggactggctcgccatgtgacacactgcccgaagagaaaagagaaggtcgaagagaccgaactgtacctcaatctggagcggatcccctgggtggtgcgcaaacttctgcaggtctccgaaagcaccggcgttgccctcaagagatcctcttggctgatcgtgcttctggtgctgttcgcggtcagcctgtcccctgtgcaaagcgcccccattgggcggcgccctctgtttctcgatggaatcgttaaaggcatgaagaacctgcttaattctacatccctggagacgagcctctctattgaggctccctggggagccatcaacgtgcagagcacctataagccgacagtctccgctgccaatattgcgctgtcttggagctccgtggaacacagagggaacaaaatccttgttagcggccggtctgagtccatcatgaagctggaagagagaaccggcattagctgggacctcggggtggaagatgcctctgagtccaaactgctgacagtcagcgtgatggacctctcccagatgtactctcctgtcttcgagtatctgagcggagatcgccaggtggaagagtggcccaaggctacctgtacgggcgactgccctgaacggtgtgggtgcacatcctctacctgtcttcataaagagtggccccacagcagaaattggcgctgcaaccccacctggtgctggggagttggcacagggtgtacctgctgtggcctggatgtgaaggacctctttacagattacatgttcgtcaagtggaaagtggaatatatcaagacggaggccattgtttgcgtggagctgacctcccaagaacggcagtgtagcctgatcgaggctggaacaagatttaaccttggccctgtcaccattacactctctgaaccgcgcaatatccagcaaaaactgccccctgagattatcaccctgcatccccggatcgaggaagggttcttcgacctcatgcacgtgcagaaggtgctgtccgccagcacggtttgcaaacttcagtcttgtacccacggagtccctggcgatctccaggtgtaccatattgggaacctcctgaagggagacaaggtgaatggccacctgatccataaaattgagccccactttaacacatcctggatgagctgggacgggtgcgatcttgactattactgtaatatgggcgattggccgtcttgcacctacacaggagtcacccaacataaccacgccagcttcatcaatctcctgaacattgaaacggactatacaaagtcctttcacttccatagcaaaagagtgaccgctcacggcgatacacctcagctggacctcaaggcgcgccccaattacggggccggagagatcaccgttctggtggaagtcgctgatatggagcttcataccaaaaagatcgagatttctggcctgaagtttgcctccctcacatgtacggggtgctatgcctgcagctccggaatctcttgtaaagtgcggattcacgttgacgaacctgatgagctgaccgtgcacgtcaagagcgacgatcccgacgtggttgctgcctcctctagcctgatggcgagaaaacttgaatttggcacagattccacctttaaggctttctctgccatgcctaaaacaagcctctgcttttacatcgtggagcgcgaatattgtaagtcctgcagcaaagaggacacccagaagtgtgtcaacacgaagctggagcatccccagtctattctgatcgaacacaaagggacaatcattggcaagcaaaataatacctgcaccgccaaaacatcctgttggctcgagagcgtgaagtctttcttttacggactgaaaaacatgctttccggcatcttcgggaacgtgtttgtcggaattttcctgttcctcgctccgtttatcctgctgattcttttctttatgttcggctggcggatcctcttttgcttcaagtgttgcagacggacccgcgggctgtttagatataagcatctggaagacgatgaggaaacaggataccggagaatcattgagcgcctcaataacaaaaagggcaaaaacaagctgcttgacggggagcggctggccgatagacgcatcgctgaactcttcagcacgaaaacccacattggc

SEQ ID NO: 13922 - RNA, 2916 nt, synthetic construct
  misc_feature 1..2916: note = derived and/or modified CDS sequence (opt5) from CCHFV(K168_125, Artificial)__KX013460.1__Gn-4aa-Gc
  source 1..2916: mol_type = other RNA
agcgacgagtccggcgatgactgcatctctagaacccagctgctccggacagaaacggccgagattcacggggataactacggaggccccggggacaagatcaccatttgtaatggaagcacaatcgtggatcaacgcctgggctccgaacttgggtgctataccattaacagagtcaaatctttcaagctgtgtgagaatagcgctacaggaaaatcctgcgaagttgactctatccctgtgaagtgtcggcagggctactgcctcaaaatcacccaggagggccgcgggcatgtgaagctgagcagaggatccgaggtcgtgcttgatgcctgtgacagctcttgcgaagttatgattccgaagggcacaggggatatcctggtggactgttccggaggccagcaacactttctcaaagataacctgattgacctggggtgccccaaggtccctctcctgggaaaaatggcgatctatatttgtcggatgagcaatcatcccaagaccacgatggctttcctgttttggttctcttttggctacgtgattacctgcatcgtttgcaaagccatcttctatctgctcatcattgtgggcacactggggaagcgctttaagcagtacagagagcttaaacctcagacctgtacaatctgcgaaaccacgcccacaaacgccattgatgctgagatgcacgacctgaattgttcctataacatctgcccttactgtgccagccggctcacctctgacggactggctcgccatgtcacacactgcccgaagagaaaagagaaggtggaagagaccgaactgtacctcaatctggagcggattccctgggtggtccgcaaacttctgcaggtttccgaaagcaccggcgtggccctcaagagatcctcttggctgatcgtgcttctggtcctcttcgcggtgagcctgtcccctgttcaaagcgcccccatcgggcggcgccctctgtttctcgattctattgtgaaaggaaagaagaacctgcttaattccacaagcctggagacgtctctcagcatcgaggctccctggggcgccattaacgtccagtccacctataaaccgacagtgtctgctgccaatatcgcgctgagctggtccagcgttgaacacagagggaacaagattcttgtgtctggacggtccgagagcatcatgaaactggaagagagaaccggcatctcttgggacctcggcgtcgaagatgcctccgagagcaagctgctgacagtgtccgtcatggacctctctcagatgtacagccctgtgttcgagtatctgtccggggatcgccaggttgaagagtggcccaaagctacctgtacgggagactgccctgaacggtgtggctgcacatctagcacctgtcttcataaggagtggccccactccagaaattggcgctgcaaccccacctggtgctggggagtggggacaggctgtacctgctgtgggctggatgtcaaggacctctttacagattacatgttcgtgaaatggaaggttgaatatattaaaacggaggccatcgtgtgcgtcgagctgaccagccaagaacggcagtgttctctgattgaggctggcacaagatttaaccttggacctgtgaccatcacactctccgaaccgcgcaatattcagcaaaagctgccccctgagatcattaccctgcatccccggatcgaggaaggcttcttcgacctcatgcacgtgcagaaagttctgagcgcctctacggtctgcaaacttcagtcctgtacccacggggtgcctggagatcttcaggtgtaccatatcggcaacctcctgaagggggacaaagtcaatggacacctgattcataagatcgagccccactttaacacaagctggatgtcttgggacggctgcgatcttgactattactgtaatatgggggattggccgagctgcacctacacaggcgtgacccaacataaccacgcctccttcattaatctcctgaacatcgaaacggactatacaaagagctttcacttccattctaagagagttaccgctcacggagatacacctcagctggacctcaaagcgcgccccaattacggcgccggggagattaccgtgctggtcgaagtggctgatatggagcttcataccaagaagatcgagatctccggactgaaatttgccagcctcacatgtacgggctgctatgcctgctcctctgggattagctgtaaggttcggatccacgtggacgaacctgatgagctgaccgtccacgtgaaatccgacgatcccgacgttgtggctgcctctagctccctgatggcgagaaaacttgagttcggaacagattctacctttaaggctttcagcgccatgcctaagacatccctctgcttttacattgtcgaacgcgaatattgtaaaagctgctctaaggaggacacccagaagtgtgtgaacacgaaactggagcatccccagtccatcctgattgaacacaagggcacaatcatcgggaaacaaaataatacctgcaccgccaagacaagctgttggctcgagtctgtgaaatccttcttttacggcctgaagaacatgcttagcggaattttcggcaacgtctttgttgggatcttcctgttcctcgctccgtttattctgctgatccttttctttatgttcggatggcggattctcttttgcttcaagtgttgcagacggacccgcggcctgtttagatataaacatctggaagacgatgaggaaacagggtaccggagaatcatcgagcgcctcaataacaagaaaggaaagaacaaactgcttgacggcgagcggctggccgatagacgcattgctgaactcttctctacgaagacccacatcggg

SEQ ID NO: 13923 - RNA, 2916 nt, synthetic construct
  misc_feature 1..2916: note = derived and/or modified CDS sequence (opt5) from CCHFV(K229_194, Artificial)__KX013463.1__Gn-4aa-Gc
  source 1..2916: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgcctgtgacagctcctgcgagattatgatccccaaaggaacgggcgatattctggtggactgtagcgggggacagcaacacttcctcaagggcaacctgatcgatctggggtgccctcatattcccctcctgggaaaaatggcgatctacatttgtagaatgtctaatcaccctcggaccacaatggcttttcttttctggttttccttcggctatgttattacctgcatcttttgcaaggccctgttctacagcctcattatcattggcacactggggaaaaagatcaagcagtatcgcgaacttaaaccccagacctgtacgatttgcgagacagcccctgtgaacgctatcgacgccgagatgcatgatctgaattgttcttacaacatctgcccgtattgtgcttccagactcaccagcgacggactggcccggcacgtcacacagtgccccaagcgcaaagaaaaggtggaggaaaccgagctgtacctcaatctggaaagaatcccttggatcgttcggaaacttctgcaagtgtctgagtccaccggcgtcgcgctcaagcgcagctcctggctgattgtgcttctggtgctcctgacagtctctctgagccccgttcagtccgcccctgtggggagaaaacccctctttctggacagcatcgtgaagggaaagaaaaaccttctcaattctacgtccctggagaccagcctgtctattgaagctccgtggggcgccatcaacgtccagagcacattcaagcctaccgtgtccacagctaatatcgccctttcttggagctccgttgagcaccgggggaacaaaattctggtgaccggacgcagcgaatctatcatgaagctcgaggaaagaacgggcgtctcctgggatctgggcgtggaggacgcgagcgagtctaaactgctcacagtttccattatggatctgagccagatgtactcccccgtgtttgaatatctttctggggaccggcaagtcgaggaatggcctaaggccacctgtaccggagattgccccgagagatgtggctgcacaagctccacctgtctgcataaggaatggccccactctcgcaattggcggtgcaaccctacatggtgctggggagtgggaacgggctgtacctgctgtggggtcgacgtgaaagatctcttcacagaccatatgtttatcaagtggaaagttgagtacattaagaccgaggctatcgtgtgcgtcgaactgacaagccaggagagacagtgttccctgattgaagccggcacccgcttcaaccttggaccggtgacgatcaccctcagcgagccccggaatatccaacagaaactgcctcccgagattatcacactgcaccctaagattgaagagggcttctttgatctcatgcacgttcagaaggtgctgtctgcttccaccgtctgcaaacttcagagctgtacacatgggatccccggagacctgcaaatttatcacatcggcaacctcctgaagggggatagactgaatggacatcttatccacaaaattgaaccgcatttcaacacctcttggatgtcctgggacggctgcgacctcgattactattgtaatatgggggactggcctagctgcacgtacacaggcgtgacccagcacaaccacgccgcctttgtgaatctgctgaacatcgagacagattataccaagaccttccattttcactctaaacgcgttacagctcatggagacacgccccagctcgatctgaaggcgcggcctacctacggcgccggggaaattacagtccttgtggaggtggctgacatggagctgcacaccaagaaagtcgaaatcagcggactcaagttcgcctccctggcctgtacaggctgctacagctgttcttccgggattagctgcaaagtgagaatccacgttgatgagcccgacgaactgaccgtgcatgtcaagtcctctgatcctgacgtggttgctgccagcacgtcccttatggcgcgcaaactcgagtttggaacagattctaccttcaaggcttttagcgccatgcccaaaacctccctgtgcttctatatcgtggaacgggagtactgtaagtcttgcagcgaggacgatacaaagaaatgtgtcgacaccaagctggaacagccgcaatccattctcatcgagcacaaaggcacaattatcgggaagcagaatgacacgtgcaccgccaaagctagctgttggctggaatctgtgaagtcctttttctatggccttaagaacatgctgggaagcgtttttggcaatttcttcgtggggattctcctgtttctggcccctttcgtccttctcgtgctgtttttcatgtttggatggaaaatcctgttctgctttaagtgttgcagacgcacacggggcctcttcaaatacagacatctgaaggatgacgaggaaaccgggtatcggaaaatcattgagcgccttaactctaagaaggggaaaaatagactgctcgatggcgagcggctggctgacagaaagatcgccgaactgttttccacaaaaacccacattggg

SEQ ID NO: 13924 - RNA, 2916 nt, synthetic construct
  misc_feature 1..2916: note = derived and/or modified CDS sequence (opt5) from CCHFV(K229_243, Artificial)__KX013466.1__Gn-4aa-Gc
  source 1..2916: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacagctcctgcgaggtgatgattcccaagggaacgggcgatatcctggttgactgtagcgggggacagcaacacttcctcaaagataacctgattgacctgggctgccctcatatccccctcctggggaagatggcgatttacatctgtcggatgtctaatcaccctcgcaccacaatggcttttcttttctggttttccttcggatatgtgattacctgcatcttttgcaaagccctgttctacagcctcatcattatcggcacactgggcaagaaaattaagcagtatagagaacttaagccccagacctgtacgatctgcgagacagcccctgtcaacgctattgatgccgagatgcatgacctgaattgttcttacaacatctgcccgtattgtgcttcccggctcaccagcgacgggctggcccgccacgtgccccagtgccctaaaagaaaggaaaaagttgaggaaacagagctgtacctcaatctggaacggatcccctggattgtgcgcaagctgctgcaagtctctgagtccaccggagtggcgctcaaaagaagctcctggctgatcgtgcttctggtcctcctgaccgtttctctgagccctgtgcagtccgcccccgtgggccggaagccgctctttctggatagcattgtcaaagggatgaagaaccttcttaattctacatccctcgagacgagcctgtctatcgaagctccttggggagccattaacgtgcagagcaccttcaagcccacagtttccaccgctaatatcgccctttcttggagctccgtggagcaccgcggcaacaaaatcctggtcacagggagaagcgaatctattatgaagctcgaggaacggaccggagtgtcctgggacctgggcgttgaggatgcgagcgagtctaaactgctcacggtgtccatcatggacctgagccagatgtactcccctgtctttgaatatctttctggcgatagacaagtggaggaatggcccaaggccacatgtaccggggactgccccgagcgctgtggatgcaccagctccacatgtctgcataaagaatggcctcactctcggaattggagatgcaacccgacctggtgctggggcgtcgggacaggatgtacgtgctgtggcgtggatgttaaggacctcttcaccgatcatatgtttgtgaagtggaaagtcgagtacattaagacagaggctatcgtgtgcgttgaactgaccagccaggagcgccagtgttccctgattgaagccgggacacggttcaaccttggccccgtgaccatcacgctcagcgagcctagaaatattcaacagaaactgccccctgagatcatcaccctgcaccccaaggtcgaagagggattctttgacctcatgcacgtgcagaaagtgctgtctgcttccacagtttgcaaacttcagagctgtacccatggcattccgggggatctgcaagtctatcacatcggaaacctcctgaagggcgaccgcgtgaatgggcatctgattcacaaaatcgaacctcatttcaacacatcttggatgtcctgggacggatgcgatcttgactactattgtaatatgggcgattggcccagctgcacctacacgggggtgacacagcacaaccacgccgcctttgtcaatctcctgaacattgagaccgactatacaaagaccttccattttcactctaaacgggtgaccgctcatggcgatacacctcagctggacctcaaggcgagacccacgtacggagccggcgaaatcaccgttctggtggaggtcgctgatatggagcttcacacaaagaaggtggaaatcagcgggctgaagttcgcctccctcgcctgtaccggatgctacgcttgcagctctggcatttcctgtaaagttcgcatccacgtggacgagcctgatgaactgacagtccatgttaagagctccgaccccgatgtggtggccgcgtctaccagcctgatggctcggaaacttgagtttgggacggactccacattcaaggccttttctgccatgccgaaaaccagcctctgcttctatattgtcgaaaaggagtactgtaaatcctgctctgaggaagatacccagaagtgtgtggacacaaagctggagcaacctcagagcatcctgattgaacacaaaggaaccatcatcggcaagcagaatgacacatgcacggctaaagcctcctgttggctcgagagcgtgaagtcctttttctatgggctgaaaaacatgcttggctctgtctttggaaatttcttcattggcatcctgctctttctgacccccttcgttctgcttgtgctctttttcatgtttgggtggaagattctgttctgctttaagtgttgcagacgcacacggggactgctcaaatacagacatctgaaggatgacgaagagaccggctatcggcgcatcattgagagacttaacaataaaaaggggaaaaaccggctgctcgatggagaaagactggctgaccgcaagatcgccgagctgttcagcacaaagacccacatcggc

SEQ ID NO: 13925 - RNA, 2916 nt, synthetic construct
  misc_feature 1..2916: note = derived and/or modified CDS sequence (opt5) from CCHFV(K315_14, Artificial)__KX013469.1__Gn-4aa-Gc
  source 1..2916: mol_type = other RNA
agcgaggaacccggcgacgattgcatctccagaacccagctgctcaagacagagacggccgaaattcacgacgataactacgggggacctggcgacaaaatcaccatttgtaatgggtctacagtggtcgatcaacggctgggaagcgagcttggctgctataccatcaaccgcgttaagtccttcaaactgtgtaaaaattctgctacagggaagacctgcgaaattgacagcacaccggtgaagtgtagacagggattttgcctcaagatcacccaggagggccggggccatgtgaaactgtcccgcgggtctgaggtcgtgcttgatgtttgtgacagctcctgcgaaatcatgattcccaagggaacgggcgatatcctggtggactgtagcgggggacagcaacacttcctcaaagataacctgattgacctgggctgccctcatatccccctcctggggaagatggccatttacatctgtagaatgtctaatcaccctcggaccacaatggcgtttcttttctggttttccttcggatatgtcattacctgcatcttttgcaaagctctgttctacagcctcatcattatcggcacactgggcaagaagattaaacagtatcgcgagcttaagccccagacctgtacgatctgcgaaacagcccctgtgaacgccattgatgctgagatgcatgacctgaattgttcttacaacatctgcccgtattgtgcctccagactcaccagcgaggggctggctcggcacgttacacagtgccccaaacgcaaggaaaaagtggaggaaaccgagctgtacctcaatctggaaagaatcccttggattgtccggaaacttctgcaagtgtctgagtccaccggagtggccctcaagcgcagctcctggctgatcgtccttctggttctcctgacagtgtctctgagccccgtgcagtccgcgcctgtcggcagaaagcccctctttctggacagcattgtgaaggggatgaaaaagctgcttaactctacgtccctcgagaccagcctgtctatcgaagccccgtggggagctattaatgttcagagcacattcaaacctaccgtgtccacagccaacatcgctctttcttggagctccgtcgagcaccggggcaataagatcctggtgaccgggcgcagcgaatctattatgaaactcgaggaaagaacgggagtttcctgggatctgggcgtggaggacgccagcgagtctaagctgctcacagtctccatcatggatctgagccagatgtactcccccgtgtttgaatatctttctggcgaccggcaagtcgaggaatggcctaaggcgacctgtaccggggattgccccgagagatgtggatgcacaagctccacctgtctgcataaagaatggccccactctcgcaactggcggtgcaatcctacatggtgctggggcgtggggacgggatgtacctgctgtggcgttgacgtgaaggatctcttcacagaccatatgtttattaaatggaaggtcgagtacatcaaaaccgaggccattgtgtgcgttgaactgacaagccaggagagacagtgttccctgatcgaagctgggacccgcttcaaccttggcccggtgacgattaccctcagcgagccccggaacatccaacagaagctgcctcccgagatcattacactgcaccctaagatcgaagagggattctttgatctcatgcacgtccagaaagtgctgtctgcctccaccgtgtgcaaacttcagagctgtacacatggcattcccggggacctgcaaatctatcacattggaaatctcctgaagggcgatagagttaacgggcatctgatccacaagatcgaaccgcatttcaatacctcttggatgtcctgggacggatgcgaccttgattactattgtaacatgggcgactggcctagctgcacgtacacaggggtcacccagcacaatcacgctgcctttgtgaacctcctgaatattgagacagattataccaaaaccttccattttcactctaagcgcgtgacagcccatggcgacacgccccagctggatctcaaggctcggcctacctacggagcgggcgaaatcacagtcctggtggaggttgccgacatggagcttcacaccaaaaaggtggaaattagcgggctgaaattcgcttccctcacatgtaccggatgctacgcctgcagctctggcatctcctgtaaggtccgcattcacgtggatgagcccgacgaactgacggttcatgtgaaaagctccgatcctgacgtcgtggccgcttctacaagcctgatggccagaaaacttgagtttgggaccgattccaccttcaaggcgttttctgctatgcccaagacaagcctctgcttctatatcgttgaacgggagtactgtaagtcctgctctgaggacgataccaaaaagtgtgtggacacaaaactggaacagccgcaaagcatcctgattgagcacaagggaacgatcattggcaaacagaacgatacctgcacagccaaggcctcctgttggctcgaaagcgtcaagagctttttctatgggctgaaaaatatgcttggctccgtgtttggatctttcttcgtgggcatcctgctctttctggctcctttcgtcctgcttgttctctttttcatgtttgggtggaagattctgttctgctttaaatgttgcagacgcacccggggactgttcaagtacagacatctcaaagacgacgaggaaacaggctatcggcgcatcatcgagagactgaactctaagaaggggaaaaatcggcttctggatggagagagactcgccgaccgcaagattgctgaactgttttccaccaaaacgcacatcggc

SEQ ID NO: 13926 - RNA, 2916 nt, synthetic construct
  misc_feature 1..2916: note = derived and/or modified CDS sequence (opt5) from CCHFV(K323_27, Artificial)__KX013472.1__Gn-4aa-Gc
  source 1..2916: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgcctgtgacagctcctgcgagattatgatccccaaaggaacgggcgatattctggtggactgtagcgggggacagcaacacttcctcaaggataacctgatcgacctgggctgccctcatattcccctcctggggaaaatggcgatctacatttgtagaatgtctaatcaccctcggaccacaatggcttttcttttctggttttccttcggatatgttattacctgcatcttttgcaaggccctgttctacctcctgattatcattggcacacttggcaaaaagatcaagcagtatcgcgaactgaaaccccagacctgtacgatttgcgagacagcccctgtgaacgctatcgatgccgagatgcatgacctcaattgtagctacaacatctgcccgtattgtgcttctagactgacctccgacgggctggcccggcacgtcacacagtgccccaagcgcaaagaaaaggtggaggaaaccgagctctacctgaatcttgaaagaatcccttggatcgttcggaaactgctccaagtgagcgagtctaccggagtcgcgctgaagcgctccagctggcttacagtgctgctcgtgctgctgacggtctccctctctcccgttcagagcgcccctgtgggcagaaaacccctgtttcttgattccattgctaaggggatgaagaacctgctcaatagcacctctctggagacatcccttagcatcgaagccccgtggggagctattaacgtgcagtctaccttcaaacctacagtcagcaccgccaatatcgcgctgtcctggtctagcgtggagcaccggggcaacaagatcctcgttacggggcgctccgaaagcattatgaaactggaggaaagaacaggagtgtcttgggacctgggcgtcgaggatgcctccgagagcaagctcctgaccgtgtctatcatggacctttcccagatgtacagccccgtttttgaatatctgtccggcgatcggcaagtggaggaatggcctaaagctacctgtacaggggactgccccgagagatgtggatgcacctctagcacatgtctccataaggaatggccccactcccgcaattggcggtgcaaccctacgtggtgctggggcgtcgggaccggatgtacatgctgtggcgtggatgtcaaggacctgttcaccgatcatatgtttattaaatggaaggtggagtacatcaaaacagaggccattgtttgcgtggaactgaccgggcaggagagacagtgttctcttatcgaagctggcacgcgcttcaacctcggaccggtcaccattacactgagcgagccccggaatatccaacagaagctgcctcccgagatcattaccctccaccctaaaatcgaagagggcttctttgacctgatgcacgtgcagaaggttctttccgccagcacagtgtgcaagctgcagtcttgtacccatgggattcccggagatctccaaatctatcacattggcaacctgctgaaaggggacagagtcaatggacatcttatccacaagatcgaaccgcatttcaacacgtcctggatgagctgggacggctgcgatctcgactactattgtaatatgggggattggccttcttgcacatacaccggcgtgacacagcacaaccacgccgcttttgtgaatctgctgaacattgagaccgactataccaaaacattccattttcactccaagcgcgttacggcgcatggagatacaccccagctcgacctgaaagcccggcctacctacggcgctggggaaatcaccgtccttgtggaggtggccgatatggagctgcacacaaagaaggtcgaaattagcggactcaaattcgcctctctgacctgtacgggctgctacgcttgcagctccgggatcagctgtaaggtgcgcattcacgttgacgagcccgatgaactgacagtgcatgtcaaatcttccgaccctgatgtggttgccgcgagcacctcccttatggctagaaagctcgagtttggaaccgactctacattcaaagcctttagcgccatgcccaagacctccctgtgcttctatatcgtggaacgggagtactgtaaatcttgcagcgaggatgacacaaagaagtgtgtcgacacgaaactggaacagccgcaatccatcctcattgagcacaagggcaccatcattgggaaacagaatgatacatgcaccgctaaggcctcttgttggctggaaagcgtgaaatcctttttctatggccttaagaacatgctgggaagcgtttttggctctttcttcgtggggatcctcctgtttctggctcctttcgtccttctcgtgctgtttttcatgtttggatggaagattctgttctgctttaaatgttgcagacgcacacggggcctcttcaagtacagacatctgaatgacgatgaggaaaccgggtatcggcgcatcatcgagagacttaactccaaaaagggcaaaaatcggctgctcgacggagagagactggccgatcgcaagattgcggaactgtttagcacgaagacccacatcggg

SEQ ID NO: 13927 - RNA, 2916 nt, synthetic construct
  misc_feature 1..2916: note = derived and/or modified CDS sequence (opt5) from CCHFV(K340_6, Artificial)__KX013475.1__Gn-4aa-Gc
  source 1..2916: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctacaaccgggaagacatgcgagatcgacagcaccccggttaaatgtagacagggattttgcctcaagatcacgcaggagggccggggccatgtgaagctgtcccgcgggtctgaagtggtccttgatgcttgtgacagctcctgcgagattatgatccccaaaggaaccggcgatattctggtggactgtagcgggggacagcaacacttcctcaaggataacctgatcgacctgggctgccctcatattccccctctcgggaaaatggccatctacatttgtagaatgtctaatcacccccggacaaccatggcgtttctgttctggttttccttcggatatgttatcacatgcatcttttgcaaggctcttttctacagcctgattatcattggcaccctcggcaaaaagatcaagcagtatcgcgaactgaaacctcagacgtgtacaatttgcgagaccgccccggtgaacgccatcgatgctgagatgcatgaccttaattgttcttacaacatctgcccctattgtgcctccagactgacaagcgacgggctcgctcggcacgtcacccagtgccctaagcgcaaagaaaaggtggaggaaaccgagctgtacctgaatctcgaacggattccctggatcgttagaaaactgcttcaagtgtctgagtccacaggagtcgccctgaagcgcagctcctggctcattgtgctgcttgtgctgctcacggtctctctgagccctgttcagtccgcgcccgtgggcagaaaaccgctgagcctcgattctatcgtgaaggggatgaagaacctgcttaattccaccagcctggagacatctctcagcattgaagccccttggggagctatcaacgtccagtccacctttaaacccacagtgtctaccgccaatatcgctctgagctggtccagcgttgagcaccggggcaacaagattcttgtgacggggcgctctgaatccatcatgaaactggaggaaagaacaggagtcagctgggacctcggcgtggaggatgcctctgagtccaagctgctgaccgttagcattatggacctctcccagatgtactctcctgtgttcgaatatctgagcggcgatcggcaagtcgaggaatggcccaaagcgacctgtacaggggactgccccgagagatgtggatgcacctcctctacatgtcttcataaggaatggcctcacagccgcaattggcggtgcaacccgacgtggtgctggggcgtggggaccggatgtacatgctgtggcgtcgatgtgaaggacctgtttaccgatcatatgttcatcaaatggaaggttgagtacattaaaacagaggccatcgtgtgcgtcgaactcacctcccaggagagacagtgtagcctgattgaagctgggacgcgctttaacctgggccccgtgaccatcacactttctgagcctcggaatatccaacagaagctgccccctgagattatcaccctgcaccccaaaattgaagagggattcttcgacctgatgcacgttcagaaggtgctctccgccagcacagtctgcaagctgcagtcttgtacccatggcatcccgggggatcttcaaatttatcacatcggaaacctgctcaaaggcgacagagtgaatgggcatctgatccacaagattgaacctcattttaacacgtcctggatgagctgggacggatgcgatctggactactattgtaatatgggcgattggccctcttgcacatacaccggggtgacacagcacaaccacgctgccttcgttaatcttctcaacatcgagaccgactataccaaaacatttcatttccacagcaagcgcgtcacggcccatggcgatacccctcagctggacctgaaagctcggcccacatacggagcgggcgaaattaccgtgctcgtggaggtcacagatatggagctgcacaccaagaaggtggaaatctccgggcttaaatttgccagcctgacgtgtacaggatgctacgcttgttcttccggcattagctgcaaggttagaatccacgtggacgagcctgatgaactcaccgtccatgtgaaatcctctgaccccgatgttgtggccgccagcacctccctgatggctcgcaagctggagttcgggacagactctacctttaaagccttcagcgcgatgccgaagacatccctttgcttttatatcgtcgaacgggagtactgtaaatcttgcagcgaggatgacacgaagaagtgtgtggacaccaaactcgaacagcctcaatccattctgatcgagcacaagggaacaattatcggcaaacagaatgatacctgcacagctaaggccagctgttggctggaatctgttaaatccttcttttatgggctcaagaacatgctgggcagcgtgttcggatcctttttcgtcggcattcttctgttcctcgccccctttgtgctgctggtgcttttctttatgttcgggtggaagatcctcttttgcttcaaatgttgcagacgcacccggggactgtttaagtacagacatttcaaagacgatgaggaaacgggctatcggcgcatcattgagagactcaattctaagaaagggaagaaccggctcctggacggagagagacttgctgatcgcaagatcgccgaactgtttagcaccaaaacacacattggc

SEQ ID NO: 13928 - RNA, 2916 nt, synthetic construct
  misc_feature 1..2916: note = derived and/or modified CDS sequence (opt5) from CCHFV(Mamon, Artificial)__KX013478.1__Gn-4aa-Gc
  source 1..2916: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtcagcgatgcctgtgactccagctgcgaggtgatgattcccaagggaacgggcgatatccttgttgactgttctgggggacagcaacacttcctgaaagataacctcattgacctgggctgccctcatatccccctgctcgggaagatggcgatttacatctgtcggatgtccaatcaccctcgcaccacagtggcttttctgttctggtttagcttcggatatgtcattacctgcatcttttgcaaagcccttttctactctctgatcattatcggcacactcggcaagaaaattaagcagtatagagaactgaagccccagacctgtacgatctgcgagacagcccctgtgaacgctattgatgccgagatgcatgaccttaattgttcctacaacatctgcccgtattgtgctagccggctgacctctgacgggctcgcccgccacgttccccagtgccctaaaagaaaggaaaaagtggaggaaacagagctgtacctgaatctcgaacggatcccctggattgtccgcaagctgcttcaagtgtccgagagcaccggagtggcgctgaaaagatcctcttggctcatcgtcctgcttgttctgctcaccgtgagcctgtcccctgtgcagagcgcccccgtcggccggaagccgctgtttctcgattctattgtgaaagggatgaagaacctgcttaattccacaagcctggagacgtctctcagcatcgaagctccttggggagccattaacgttcagtccaccttcaagcccacagtgtctaccgctaatatcgccctgagctggtccagcgtcgagcaccgcggcaacaaaatccttgtgacagggagatctgaatccattatgaagctggaggaacggaccggagttagctgggacctcggcgtggaggatgcgtctgagtccaaactgctgacggtcagcatcatggacctctcccagatgtactctcctgtgtttgaatatctgagcggcgatagacaagtcgaggaatggcccaaggccacatgtaccggggactgccccgagcgctgtggatgcacctcctctacatgtcttcataaagaatggcctcacagccggaattggagatgcaacccgacctggtgctggggcgtggggacaggatgtacgtgctgtggcgttgatgtgaaggacctgttcaccgatcatatgtttgtcaagtggaaagtggagtacattaagacagaggctatcgtttgcgtggaactcacctcccaggagcgccagtgtagcctgattgaagccgggacacggttcaacctgggccccgtcaccatcacgctttctgagcctagaaatattcaacagaaacttccccctgagatcatcaccctgcaccccaaggtggaagagggattctttgacctgatgcacgtgcagaaagttctctccgctagcacagtctgcaagctgcagtcttgtacccatggcattccgggggatcttcaagtgtatcacatcggaaacctgctcaagggcgaccgcgtgaatgggcatctgattcacaaaatcgaacctcatttcaacacatcctggatgagctgggacggatgcgatctggactactattgtaatatgggcgattggccctcttgcacctacacgggggtcacacagcacaaccacgccgcctttgtgaatcttctcaacattgagaccgactatacaaagaccttccattttcacagcaaacgggttaccgctcatggcgatacacctcagctggacctgaaggcgagacccacgtacggagccggcgaaatcaccgtgctcgtcgaggtggctgatatggagctgcacaccaaaaaggttgaaatctccgggcttaagttcgccagcctggcctgtacaggatgctacgcttgttcttccggcattagctgcaaagtgcgcatccacgtcgacgagcctgatgaactcacagtgcatgttaagtcctctgaccccgatgtggtcgccgcgagcacctccctgatggctcggaaactggagtttgggacggactctacattcaaggcctttagcgccatgccgaaaacctccctttgcttctatattgtggaaagagagtactgtaagtcttgcagcgaggaagatacccagaaatgtgtggacacaaagctcgagcaacctcagtccatcctgattgaacacaagggaaccatcatcggcaaacagaatgacacatgcacggctaagaccagctgttggctggagtctgtcaaatcctttttctatgggctcaagaacatgctgggcagcgtttttggaaatttcttcattggcatccttctgtttctcgcccccttcgtgctgctggtgctctttttcatgtttgggtggaaaattctcttctgctttaagtgttgccgccggacaagaggactgctgaagtaccggcatctcaaagatgacgaagagaccggctatcgcagaatcattgagcggctgaacaataagaaagggaagaacagacttctggatggagaacgcctcgctgaccggaaaatcgccgagctgttctctacaaagacccacatcggc

SEQ ID NO: 13929 - RNA, 2916 nt, synthetic construct
  misc_feature 1..2916: note = derived and/or modified CDS sequence (opt5) from CCHFV(Min, Artificial)__KX013481.1__Gn-4aa-Gc
  source 1..2916: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacagctcctgcgaggtgatgattcccaagggaacgggcgatatcctggttgactgtagcgggggacagcaacacttcctcaaagataacctgattgacctgggctgccctcatatccccctcctggggaagatggcgatttacatctgtcggatgtctaatcaccctcgcaccacaatggcttttcttttctggttttccttcggatatgtgattacctgcatcttttgcaaagccctgttctacagcctcatcattatcggcacactgggcaagaaaattaagcagtatagagaacttaagccccagacctgtacgatctgcgagacagcccctgtcaacgctattgatgccgagatgcatgacctgaattgttcttacaacatctgcccgtattgtgcttcccggctcaccagcgacgggctggcccgccacgtgccccagtgccctaaaagaaaggaaaaagttgaggaaacagagctgtacctcaatctggaacggatcccctggattgtgcgcaagctgctgcaagtctctgagtccaccggagtggcgctcaaaagaagctcctggctgatcgtgcttctggtcctcctgaccgtttctctgagccctgtgcagtccgcccccgtgggccggaagccgctctttctggatagcattgtcaaagggacaaagaaccttcttaattctacgtccctcgagaccagcctgtctatcgaagctccttggggagccattaacgtgcagagcacattcaagcccaccgtttccacagctaatatcgccctttcttggagctccgtggagcaccgcggcaacaaaatcctggtcaccgggagaagcgaatctattatgaagctcgaggaacggacgggagtgtcctgggacctgggcgttgaggatgcgagcgagtctaaactgctcacagtgtccatcatggacctgagccagatgtactcccctgtctttgaatatctttctggcgatagacaagtggaggaatggcccaaggccacctgtaccggggactgccccgagcgctgtggatgcacaagctccacctgtctgcataaagaatggcctcactctcggaattggagatgcaacccgacatggtgctggggcgtcgggacgggatgtacctgctgtggcgtggatgttaaggacctcttcacagatcatatgtttgtgaagtggaaagtcgagtacattaagaccgaggctatcgtgtgcgttgaactgacaagccaggagcgccagtgttccctgattgaagccgggacccggttcaaccttggccccgtgacgatcaccctcagcgagcctagaaatattcaacagaaactgccccctgagatcatcacactgcaccccaaggtcgaagagggattctttgacctcatgcacgtgcagaaagtgctgtctgcttccaccgtttgcaaacttcagagctgtacacatggcattccgggggatctgcaagtctatcacatcggaaacctcctgaagggcgaccgcattaatgggcatctgatccacaagattgaacctcatttcaacacctcttggatgtcctgggacggatgcgatcttgactactattgtaatatgggcgattggcccagctgcacgtacacaggggtgacccagcacaaccacgccgcctttgtgaatctcctgaacatcgagacagactataccaagaccttccattttcactctaaacgggtcacagctcatggcgatacgcctcagctggacctcaaggcgagacccacctacggagccggcgaaatcacagtgctggttgaggtggctgatatggagcttcacaccaaaaaggtcgaaattagcgggctgaagttcgcctccctcgcctgtacaggatgctacgcttgcagctctggcatctcctgtaaagtgcgcattcacgttgacgagcctgatgaactgaccgtgcatgtcaagagctccgaccccgatgtggttgccgcgtctacgagcctgatggctcggaaacttgagtttgggacagactccaccttcaaggccttttctgccatgccgaaaaccagcctctgcttctatatcgtggaaagagagtactgtaagtcctgctctgaggaagatacacagaaatgtgtcgacaccaagctggagcaacctcagagcattctgatcgaacacaagggaacaatcattggcaaacagaatgacacgtgcaccgctaaggcctcctgttggctcgagagcgtgaaatcctttttctatgggctgaagaacatgcttggctctgtgtttggaaatttcttcatcggcattctgctctttctggctcccttcgtcctgcttgttctctttttcatgtttgggtggaaaatcctgttctgctttaagtgttgccgccggacaagaggactgctcaagtaccggcatctgaaagatgacgaagagaccggctatcgcagaattatcgagcggcttaacaataagaaagggaagaacagactgctcgatggagaacgcctggccgaccggaaaatcgcggagctgttcagcacaaagacccacattggc

SEQ ID NO: 13930 - RNA, 2916 nt, synthetic construct
  misc_feature 1..2916: note = derived and/or modified CDS sequence (opt5) from CCHFV(Nakiwogo, Artificial)__KX013484.1__Gn-4aa-Gc
  source 1..2916: mol_type = other RNA
gccgagggcgtgagcaacgactgcgtctccagaacccagcttatcaagacagaagttgctgagattcacgaagattcttacgggggacccggcgagaaaatcacgatttgtaatgggagcaccatcgtggaccaacggctcggatccgaactgggctgctatacaattaaccgcgtgaagacctacaaactttgtgaaaattctgccacagagaaggggtgcgagatcgatagcgtccctgtgaaatgtaagcagggattctgcctgaaggttacccaggagggcagaggccatgtgaaactctcccgggggacagaaatcgtcctggacgtgtgtgatacctcttgcgagcttatgattccgaagggaacgggcgacatcctggttgattgtagcgggggacagcaacactttctccaggacaacctgattgatctgggctgccccaatgtgcctctcctggggaaaatggcgatctatatttgtcgcatgtccaaccatcccaagaccacaatggctttcctgttttggttcagctttggatacgtcattacctgcgtggtgtgcaaagtccttttctatctcctgatcgttatcggcacacttggcaagaagctgaaacagtacagagagctcaagcctcagacctgtatcgtgtgcgaatctattcccgtgaatgtcatcgacgccgagatgcacgaactgaactgtaattataacatttgcccttactgtgcctcccggctgacgagcgatgggctcgtgcgccatgttacacaatgcccgaaaagaaaggagaaagtggaagagaccgagctgtaccttaatctggaacggatcccctggctcgtccgcagactgcttcaggtgtctgagtccacaggaatggctctgaagcggagctgttggatgaccaccctcctgattctgctcgttgtgtctctgtcccctgtccagagcgcccccgtgggccgcaaacctctttatctggactccatcgctaaggggatgaagtctctcctgaacagcacaaatcttgaaacgtccctgagcatcgaggccccctggggagcgattaacgtccagtctacctttaaaccgacagtgtccgccgctaatatcgccctcagctggtctagcgttgaacacagaggcaacaagattctggtgtccgggcggtctgagagcatcatgaaactggaggaacgcaccggaatttcctggagcctcggcgtcgaggatgcttctgaatccaagacactgaccgtgagcgttatggacctttctcaaatgtactcccctgtgttcgagtatctgagcggcgacagacaggtcgaagagtggcccaaagccacgtgcacaggggattgtcctgagcggtgcggatgtacctcctctacctgcctccacaaggaatggccccatagcagaaactggcgctgcaatcccacatggtgttggggcgtggggaccggatgcacatgttgcggcctggacgtgcgggatctgtttacggactacatgatggttaagtggaaagtcgagtatgtgaagaccgaagcgatcatgtgtgtggagcttacatcccaggagagacaatgctctctcatcgaagccgggacccgcttcaacctgggccctgtcacaattaccctgagcgagccgcggaatgtgcagcagagactcccctccgaaatcgttacgctgcaccctaaaattgaggaaggatttttcgatcttatgcatgtgcagaaggtcctgttttgtaaacacagcctccaagctacctcttgcacacacggcgtgcccggggacctgcaggtttaccatgtgggaaacctgcttaagggcgataaggtcaatgggcactccatccataaaattgagagccacttcaacacctcttggatgtcctgggacggatgtgatctcgactatttctgcaatatgggcgattggcctagctgtacatacaccggggtgacgcagcataaccgcgccgcttttgttaatatgctgaacatcgagacagactacaccaagacattccactttcactctaaacgggtgaccgcccatggcgacacaccccagctggatctcaaggccagaccgacctatggagctggcgaagtcacggtgctggtggaggtcgcggaccttgaactgcacaccaaaaagattgaggttagcgggctcaagttcgcctccctgacatgcagcggatgctacgcttgttcttccggcatcagctgcaaagtgcgcatccatgtgaatgaacctgatgagtttaccgtccacgtgaagtccaacgaccccgatgttgtggccgccgggtctagcctgatggctcggaaaattgagcttggagccgactccacattcaaggcgttttctagcatgcctaaaaattccctctgtttctatatcgtcgaaagagattactgctctagctgtaccgacgatgacacgcaaaagtgcgtgaacacaaaactggagcacccccagtccattctgatcgaacataagggcaccattatcgggaagcagaatgatacctgtcctacaaaaaccagctgctggctcgagtctgttaagtcctttttctatggcctgaaaaacatgcttggaggcatctttgggaacgtgttcctgggaatttttctcttcctggctcccttcgccctgcttatcctctttttctttttcggctggcgcctgctgttttgtctcaagtgctgtcggagaacacgggggctgcttaaatacaagcagctgaaggacgaagaggaggccggatataaaaagattatcgaacgcctcaatgataaaaagggcaaaagcagactgttcgacggggagcggctggctgacagaaagattgccgaactgttttctacgaagacccacatcggc

SEQ ID NO: 13931 - RNA, 2916 nt, synthetic construct
  misc_feature 1..2916: note = derived and/or modified CDS sequence (opt5) from CCHFV(Saf, Artificial)__KX013487.1__Gn-4aa-Gc
  source 1..2916: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacagctcctgcgaggtgatgattcccaagggaacgggcgatatcctggttgactgtagcgggggacagcaacactacctcaaagataacctgattgacctgggctgccctcatatccccctcctggggaagatggcgatttatatctgtcggatgtctaatcaccctcgcaccacaatggctttcctcttttggttctcctttggatacgtgattacctgcatcttctgcaaagccctgttttatagcctcatcattatcggcacactgggcaagaaaattaagcagtacagagaacttaagccccagacctgtacgatctgcgagacagcccctgtcaacgctattgatgccgagatgcatgacctgaattgttcttataacatctgcccgtactgtgcttcccggctcaccagcgacgggctggcccgccacgtgccccagtgccctaaaagaaaggaaaaagttgaggaaacagagctgtacctcaatctggaacggatcccctggattgtgcgcaagctcctgcaagtctctgagtccaccggagtggcgctcaaaagaagctcctggctgatcgtgcttctggtcctcctgaccgtttctctgagccctgtgcagtccgcccccgtgggccggaagccgcttttcagcgattctattgtcaaagggatgaagaacctgcttaattccacaagcctggagacgtctctcagcatcgaagctccttggggagccattaacgtgcagtccacctttaagcccacagtttctaccgctaatatcgccctgagctggtccagcgtggagcaccgcggcaacaaaatccttgtcacagggagatctgaatccattatgaagctggaggaacggaccggagtgagctgggacctcggcgttgaggatgcgtctgagtccaaactgctgacggtgagcatcatggacctctcccagatgtattctcctgtcttcgaatacctgagcggcgatagacaagtggaggaatggcccaaggccacatgtaccggggactgccccgagcgctgtggatgcacctcctctacatgtcttcataaagaatggcctcacagccggaattggagatgcaacccgacctggtgctggggcgtcgggacaggatgtacgtgctgtggcgtggatgttaaggacctgtttaccgatcatatgttcgtgaagtggaaagtcgagtatattaagacagaggctatcgtgtgcgttgaactcacctcccaggagcgccagtgtagcctgattgaagccgggacacggtttaacctgggccccgtgaccatcacgctttctgagcctagaaatattcaacagaaacttccccctgagatcatcaccctgcaccccaaggtcgaagagggattcttcgacctgatgcacgtgcagaaagtgctctccgctagcacagtttgcaagctgcagtcttgtacccatggcattccgggggatcttcaagtctaccacatcggaaacctgctcaagggcgaccgcgtgaatgggcatctgattcacaaaatcgaacctcattttaacacatcctggatgagctgggacggatgcgatctggactattactgtaatatgggcgattggccctcttgcacctatacgggggtgacacagcacaaccacgccgccttcgtcaatcttctcaacattgagaccgactacatgaagacatttcatttccacagcaaacgggtgaccgctcatggcgatacccctcagctggacctgaaggcgagacccacatacggagccggcgaaatcacggttctcgtggaggtcgctgatatggagctgcacaccaaaaaggtggaaatctccgggcttaagtttgttagcctggcctgtacaggatgctatgcctgttcttccggcattagctgcaaagtgcgcatccacgtcgacgagcctgatgaactcaccgtgcatgttaagtcctctgaccccgatgtggtcgctgccagcacatccctgatggcgcggaaactggagttcgggaccgactctacgtttaaggctttcagcgccatgccgaaaacatccctttgcttttacattgtggaaagagagtattgtaagtcttgcagcgaggaagatacccagaaatgtgtggacaccaagctcgagcaacctcagtccatcctgattgaacacaagggaacaatcatcggcaaacagaatgatacctgcacagccaaggctagctgttggctggagtctgtcaaatccttcttttacgggctcaagaacatgctgggcagcgttttcggaaactttttcattggcatccttctgttcctcgccccctttgtgctgctggtgcttttctttatgttcgggtggaaaattctcttttgcttcaagtgttgccgccggacgagaggactgctgaagtatcggcatctcaaagacgacgaagagaccggctaccgcagaatcattgagcggctgaataataagaaagggaagaacagacttctggatggagaacgcctcgctgaccggaaaatcgccgagctgttttctacaaagacccacatcggc

SEQ ID NO: 13932 - RNA, 2916 nt, synthetic construct
  misc_feature 1..2916: note = derived and/or modified CDS sequence (opt5) from CCHFV(Ast199, Artificial)__KX056051.1__Gn-4aa-Gc
  source 1..2916: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgcctgtgacagctcctgcgagattatgatccccaaaggaacgggcgatattctggtggactgtagcgggggacagcaacacttcctcaaggataacctgatcgacctgggctgccctcatattcccctcctggggaaaatggcgatctacatttgtagaatgtctaatcaccctcggaccacaatggcttttcttttctggttttccttcggatatgttattacctgcatcttttgcaaggccctgttctacagcctcattatcattggcacactgggcaaaaagatcaagcagtatcgcgaacttaaaccccagacctgtacgatttgcgagacagcccctgtgaacgctatcgatgccgagatgcatgacctgaattgttcttacaacatctgcccgtattgtgcttccagactcaccagcgacgggctggcccggcacgtcacacagtgccccaagcgcaaagaaaaggtggaggaaaccgagctgtacctcaatctggaaagaatcccttggatcgttcggaaacttctgcaagtgtctgagtccaccggagtcgcgctcaagcgctgtagctggctgattgtgcttctggtgctcctgacagtctccctgtctcccgttcagagcgcccctgtgggcagaaaacccctctttctggattccatcgtgaaggggatgaagaaccttctgaatagcacgtctctcgagacctccctgagcattgaagctccgtggggagccatcaacgtccagtctacattcaaacctaccgtgagcacagctaatatcgccctttcctggtctagcgttgagcaccggggcaacaagattctggtgaccgggcgctccgaaagcatcatgaaactcgaggaaagaacgggagtctcttgggacctgggcgtggaggatgcgtccgagagcaagctgctcacagtttctattatggacctgtcccagatgtacagccccgtgtttgaatatctttccggcgatcggcaagtcgaggaatggcctaaagctacctgcaccggggactgtcccgagagatgcggatgtacatctagcacatgcctgcataaggaatggccccactcccgcaattggcggtgcaaccctacctggtgttggggcgtggggacgggatgcacctgttgcggcgtcgatgtgaaggacctcttcacagatcatatgtttatcaaatggaaggttgagtacattaaaaccgaggccatcgtgtgtgtcgaactgacatctcaggagagacagtgcagcctgattgaagccgggacccgcttcaaccttggcccggtgacgatcaccctctccgagccccggaatatccaacagaagctgcctcccgagattatcacactgcaccctaaaattgaagagggattctttgacctcatgcacgttcagaaggtgctgagcgcttctaccgtctgtaaacttcagtcctgcacacatggcatccccggggatctgcaaatttatcacatcggaaacctcctgaaaggcgacagactgaatgggcatcttatccacaagattgaaccgcatttcaacaccagctggatgtcttgggacggatgtgatctcgactactattgcaatatgggcgattggccttcctgtacgtacacaggggtgacccagcacaaccacgccgcctttgtgaatctgctgaacatcgagacagactataccaaaaccttccattttcacagcaagcgcgttacagctcatggcgatacgccccagctcgacctgaaagcgcggcctacctacggagccggcgaaattacagtccttgtggaggtggctgatatggagctgcacaccaagaaggtcgaagtgtctgggctcaaattcgccagcctggcctgcacaggatgctacgcttgttccagcggcatctcttgcaaggttcgcattcacgtggacgagcccgatgaactgaccgtccatgtgaaatccagcgaccctgatgttgtggccgcgtccacgtctcttatggctagaaagctcgagtttgggacagacagcaccttcaaagccttttccgccatgcccaagacctctctgtgtttctatatcgtcgaacgggagtactgcaaaagctgttccgaggatgacacaaagaagtgcgtggacaccaaactggaacagccgcaatctatcctcattgagcacaagggaacaatcattggcaaacagaatgatacgtgtaccgctaaggccagctgctggctggaatccgttaagagctttttctatgggcttaagaacatgctgggctctgtgtttggaaatttcttcgtcggcatcctcctgtttctggctcctttcgtgcttctcgtgctgtttttcatttttgggtggaagatcctgttctgttttaaatgctgtagacgcacacggggactcttcaagtacagacatctgaaagacgatgaggaaaccggctatcggaagatcattgagcgccttaactccaaaaaggggaagaatagactgctcgacggagagcggctggccgatagaaaaatcgcggaactgtttagcacaaagacccacattggc

SEQ ID NO: 13933 - RNA, 2916 nt, synthetic construct
  misc_feature 1..2916: note = derived and/or modified CDS sequence (opt5) from CCHFV(Ast149, Artificial)__KX056054.1__Gn-4aa-Gc
  source 1..2916: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgcctgtgacagctcctgcgagattatgatccccaaaggaacgggcgatattctggtggactgtagcgggggacagcaacacttcctcaaggataacctgatcgacctgggctgccctcatattcccctcctggggaaaatggcgatctacatttgtagaatgtctaatcaccctcggaccacaatggcttttcttttctggttttccttcggatatgttattacctgcatcttttgcaaggccctgttctacagcctcattatcattggcacactgggcaaaaagatcaagcagtatcgcgaacttaaaccccagacctgtacgatttgcgagacagcccctgtgaacgctatcgatgccgagatgcatgacctgaattgttcttacaacatctgcccgtattgtgcttccagactcaccagcgacgggctggcccggcacgtcacacagtgccccaagcgcaaagaaaaggtggaggaaaccgagctgtacctcaatctggaaagaatcccttggatcgttcggaaacttctgcaagtgtctgagtccaccggagtcgcgctcaagcgcagctcctggctgattgtgcttctggtgctcctgacagtctctctgagccccgttcagtccgcccctgtgggcagaaaacccctctttctggatagcatcgtgaaggggatgaagaaccttcttaattctacgtccctcgagaccagcctgtctattgaagctccgtggggagccatcaacgtccagagcacattcaaacctaccgtgtccacagctaatatcgccctttcttggagctccgttgagcaccggggcaacaagattctggtgaccgggcgcagcgaatctatcatgaaactcgaggaaagaacgggagtctcctgggacctgggcgtggaggatgcgagcgagtctaagctgctcacagtttccattatggacctgagccagatgtactcccccgtgtttgaatatctttctggcgatcggcaagtcgaggaatggcctaaagccacctgtaccggggactgccccgagagatgtggatgcacaagctccacctgtctgcataaggaatggccccactctcgcaattggcggtgcaaccctacatggtgctggggcgtggggacgggatgtacctgctgtggcgtcgatgtgaaggacctcttcacagatcatatgtttatcaaatggaaggttgagtacattaaaaccgaggctatcgtgtgcgtcgaactgacaagccaggagagacagtgttccctgattgaagccgggacccgcttcaaccttggcccggtgacgatcaccctcagcgagccccggaatatccaacagaagctgcctcccgagattatcacactgcaccctaaaattgaagagggattctttgacctcatgcacgttcagaaggtgctgtctgcttccaccgtctgcaagctgcagagctgtacacatggcatccccggggatctgcaaatttatcacatcggaaacctcctgaaaggcgacagactgaatgggcatcttatccacaagattgaaccgcatttcaacacctcttggatgtcctgggacggatgcgatctcgactactattgtaatatgggcgattggcctagctgcacgtacacaggggtgacccagcacaaccacgccgcctttgtgaatctgctgaacatcgagacagactataccaaaaccttccattttcactctaagcgcgttacagctcatggcgatacgccccagctcgacctgaaagcgcggcctacctacggagccggcgaaattacagtccttgtggaggtggctgatatggagctgcacaccaagaaggtcgaagtgagcgggctcaaattcgcctccctggcctgtacaggatgctacgcttgcagctctggcatctcctgtaaggttcgcattcacgtggacgagcccgatgaactgaccgtccatgtgaaaagctccgaccctgatgttgtggccgcgtctacgagccttatggctagaaagctcgagtttgggacagactccaccttcaaagccttttctgccatgcccaagaccagcctgtgcttctatatcgtcgaacgggagtactgtaaatcctgctctgaggatgacacaaagaagtgtgtggacaccaaactggaacagccgcaaagcatcctcattgagcacaagggaacaatcattggcaaacagaatgatacgtgcaccgctaaggcctcctgttggctggaaagcgttaaatcctttttctatgggcttaagaacatgctgggctctgtgtttggaaatttcttcgtcggcatcctcctgtttctggctcctttcgtgcttctcgccctgtttttcatttttgggtggaagatcctgttctgctttaaatgttgcagacgcacacggggactcttcaagtacagacatctgaaagacgatgaggaaaccggctatcggaagatcattgagcgccttaacagcaaaaaggggaagaatagactgctcgacggagagcggctggcggatagaaaaatcgccgaactgttttctacaaagacccacattggc

SEQ ID NO: 13934 - RNA, 2916 nt, synthetic construct
  misc_feature 1..2916: note = derived and/or modified CDS sequence (opt5) from CCHFV(Ast137, Artificial)__KX056057.1__Gn-4aa-Gc
  source 1..2916: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgcctgtgacagctcctgcgagattatgatccccaaaggaacgggcgatattctggtggactgtagcgggggacagcaacacttcctcaaggataacctgatcgacctgggctgccctcatattcccctcctggggaaaatggcgatccacatttgtagaatgtctaatcatcctcggaccacaatggcttttcttttctggttttccttcggatacgttattacctgcatcttttgcaaggccctgttctatagcctcattatcattggcacactgggcaaaaagatcaagcagtaccgcgaacttaaaccccagacctgtacgatttgcgagacagcccctgtgaacgctatcgatgccgagatgcacgacctgaattgttcttataacatctgcccgtactgtgcttccagactcaccagcgacgggctggcccggcacgtcacacagtgccccaagcgcaaagaaaaggtggaggaaaccgagctgtatctcaatctggaaagaatcccttggatcgttcggaaacttctgcaagtgtctgagtccaccggagtcgcgctcaagcgcagctcctggctgattgtgcttctggtgctcctgacagtctctctgagccccgttcagtccgcccctgtgggcagaaaacccctctttctggatagcatcgtgaaggggacgaagaaccttcttaattctacctccctcgagacaagcctgtctattgaagctccgtggggagccatcaacgtccagagcaccttcaaacctacagtgtccaccgctaatatcgccctttcttggagctccgttgagcatcggggcaacaagattctggtgacggggcgcagcgaatctatcatgaaactcgaggaaagaacaggagtctcctgggacctgggcgtggaggatgcgagcgagtctaagctgctcaccgtttccattatggacctgagccagatgtactcccccgtgtttgaatacctttctggcgatcggcaagtcgaggaatggcctaaagccacctgtacaggggactgccccgagagatgtggatgcaccagctccacatgtctgcacaaggaatggccccattctcgcaattggcggtgcaaccctacgtggtgctggggcgtggggaccggatgtacatgctgtggcgtcgatgtgaaggacctcttcaccgatcacatgtttatcaaatggaaggttgagtatattaaaacagaggctatcgtgtgcgtcgaactgaccagccaggagagacagtgttccctgattgaagccgggacgcgcttcaaccttggcccggtgaccatcacactcagcgagccccggaatatccaacagaagctgcctcccgagattatcaccctgcaccctaaaattgaagagggattctttgacctcatgcatgttcagaaggtgctgtctgcttccacagtctgcaagctgcagagctgtacccacggcatccccggggatctgcaaatttaccatatcggaaacctcctgaaaggcgacagactgaatgggcaccttatccataagattgaaccgcacttcaacacgtcttggatgtcctgggacggatgcgatctcgactattactgtaatatgggcgattggcctagctgcacatataccggggtgacacagcacaaccatgccgcctttgtgaatctgctgaacatcgagaccgactacaccaaaacattccactttcattctaagcgcgttacggctcacggcgatacaccccagctcgacctgaaagcgcggcctacctatggagccggcgaaattaccgtccttgtggaggtggctgatatggagctgcacacaaagaaggtcgaagtgagcgggctcaaattcgcctccctggcctgtaccggatgctacgcttgcagctctggcatctcctgtaaggttcgcattcatgtggacgagcccgatgaactgacggtccacgtgaaaagctccgaccctgatgttgtggccgcgtctacaagccttatggctagaaagctcgagtttgggaccgactccaccttcaaagccttttctgccatgcccaagacaagcctgtgcttctacatcgtcgaacgggagtattgtaaatcctgctctgaggatgacaccaagaagtgtgtggacacaaaactggaacagccgcaaagcatcctcattgagcataagggaacgatcattggcaaacagaatgatacctgcacagctaaggcctcctgttggctggaaagcgttaaatcctttttctacgggcttaagaacatgctgggctctgtgtttggaaatttcttcgtcggcatcctcctgtttctggctcctttcgtgcttctcgtgctgtttttcatttttgggtggaagatcctgttctgctttaaatgttgcagacgcacccggggactcttcaagtatagacacctgaaagacgatgaggaaacaggctaccggaagatcattgagcgccttaacagcaaaaaggggaagaatagactgctcgacggagagcggctggccgatagaaaaatcgcggaactgttttctaccaagacgcatattggc

SEQ ID NO: 13935 - RNA, 2916 nt, synthetic construct
  misc_feature 1..2916: note = derived and/or modified CDS sequence (opt5) from CCHFV(Ast133, Artificial)__KX056060.1__Gn-4aa-Gc
  source 1..2916: mol_type = other RNA
agcgaggaacccgacgatgactgcatctccagaacccagctgctcaagacagagacggccgaaattcacgatgacaactacggcgggcctggagataaaatcaccatttgtaatggctctacaatcgtggaccaacggctggggagcgagcttggatgctataccattaaccgcgtcaagtccttcaaactgtgtgaaaattctgctacaggcaagacctgcgagatcgatagcacaccggttaaatgtagacaggggttttgcctcaagatcacccaggagggacggggccatgtgaagctgtcccgcggctctgaagtggtccttgacgcctgtgatagctcctgcgagattatgatccccaaagggacgggagacattctggtggattgtagcggcgggcagcaacacttcctcaaggacaacctgatcgatctgggatgccctcatattcccctcctgggcaaaatggcgatctacatttgtagaatgtctaatcaccctcggaccacaatggcttttcttttctggttttccttcgggtatgttattacctgcatcttttgcaaggccctgttctacctcctgattatcattggaacacttggcaaaaagatcaagcagtatcgcgaactgaaaccccagacctgtacgatttgcgagacagcccctgtgaacgctatcgacgccgagatgcatgacctcaattgtagctacaacatctgcccgtattgtgcttctagactgacctccgatggcctggcccggcacgtcacacagtgccccaagcgcaaagaaaaggtggaggaaaccgagctctacctgaatcttgaaagaatcccttggatcgttcggaaactgctccaagtgagcgagtctaccggggtcgcgctgaagcgctccagctggcttattgtgctgctcgtgctgctgacagtctccctctctcccgttcagagcgcccctgtgggaagaaaacccctgttttccgacagcatcgtgaagggcatgaagaaccttcttaattctacgtccctcgagaccagcctgtctattgaagctccgtggggagccatcaacgtccagagcacattcaaacctaccgtgtccacagctaatatcgccctttcttggagctccgttgagcaccggggaaacaagattctggtgaccggccgcagcgaatctatcatgaaactcgaggaaagaacgggggtctcctgggatctgggagtggaggacgcgagcgagtctaagctgctcacagtttccattatggatctgagccagatgtactcccccgtgtttgaatatctttctggcgaccggcaagtcgaggaatggcctaaagccacctgtaccggcgattgccccgagagatgtgggtgcacaagctccacctgtctgcataaggaatggccccactctcgcaattggcggtgcaaccctacatggtgctggggagtgggcacggggtgtacctgctgtggagtcgacgtgaaggatctcttcacagaccatatgtttatcaaatggaaggttgagtacattaaaaccgaggctatcgtgtgcgtcgaactgacaagccaggagagacagtgttccctgattgaagccggcacccgcttcaaccttgggccggtgacgatcaccctcagcgagccccggaatatccaacagaagctgcctcccgagattatcacactgcaccctaaaattgaagagggcttctttgatctcatgcacgttcagaaggtgctgtctgcttccaccgtctgcaagctgcagagctgtacacatggaatccccggcgacctgcaaatttatcacatcgggaacctcctgaaaggagacagagtgaatggccatctgatccacaagattgaaccgcatttcaacacctcttggatgtcctgggatgggtgcgaccttgattactattgtaatatgggagactggcctagctgcacgtacacaggcgtgacccagcacaaccacgccgcctttgttaatctcctgaacatcgagacagattataccaaaaccttccattttcactctaagcgcgtcacagctcatggggacacgccccagctggatctcaaagcgcggcctacctacggcgccggagaaattacagtgctggtggaggtcgctgacatggagcttcacaccaagaaggtggaaatcagcggcctgaaattcgcctccctcacatgtaccgggtgctacgcctgcagctctggaatttcctgtaaggttagaatccacgtggatgagcccgacgaactgacggtccatgtgaaaagctccgatcctgacgttgtggctgcctctacaagcctgatggcgcgcaaacttgagtttggcaccgattccaccttcaaggctttttctgccatgcccaagacaagcctctgcttctatatcgtcgaacgggagtactgtaaatcctgctctgaggacgacaccaagaagtgtgtggatacaaaactggaacagccgcaaagcattctgatcgagcacaaggggacgattatcggaaaacagaatgatacctgcacagccaaggcttcctgttggctcgaaagcgttaaatcctttttctatggcctgaagaacatgcttgggtctgtgtttggcagcttcttcgtcgggattctgctctttctggcccctttcgtgctgcttgtgctctttttcatgtttggctggaagatcctgttctgctttaaatgttgcagacgcacccgggggctgttcaagtacagacatctcaaagacgacgaggaaacaggatatcggcgcatcattgagagacttaattctaagaaaggcaagaaccggctgctggatggggagagactcgctgaccgcaagatcgccgaactgttttccagcaaaacccacattgga

SEQ ID NO: 13936 - RNA, 2916 nt, synthetic construct
  misc_feature 1..2916: note = derived and/or modified CDS sequence (opt5) from CCHFV(SK/2015/human, Artificial)__KX458183.1__Gn-4aa-Gc
  source 1..2916: mol_type = other RNA
agcgaggaatccggcgacgattgcatctctagaacccggctgctccgcacagagacggccgaaattcacggggacagctacggaggccccggggataagatcaccatttgtaacggatccacaatcgtggaccagagactgggctctgagatggggtgctataccattaatcgggtcaagagcttcaagctgtgtgaaaactccgctacaggaaaatcttgcgagatcgatagcatccctgttcgctgtagacaaggctactgcctgaagattacccaggagggccgggggcatgtgaaactctcccgcggaagcgaagtggtcctggacgcctgtgattcttcctgcgaggtgatgatcccgaagggcacaggggacattcttgttgattgtagcggaggccagcagcactttctgaaggacaatctcatcgatctggggtgccccaacattcctctgctcggaaaaatggcgatctatatttgtagaatgtctaatcatcccaagaccacgatggctttcctgttttggttctcctttggctacgtgattacctgcatcctttgcaaagccatcttctatctgctcatcattgtcggcacactggggaagcggtttaaacaataccgcgaacttaagcctcagacctgtacaatctgcgagaccacgcccgccaacgctattgacgccgagatgcacgatctgaattgtagctatacaatctgcccttactgtgcttctagactcacctccgacggactggcccggcatgtgacacagtgcccgaagcgcaaagaaaaggttgaggaaaccgagctgtacctcaacctggaaagaatcccctgggtggtccggaaacttcttcaggtgagcgagtccaccggcgtggcgctcaagcgctctagctggctgattgtccttctggttctcttcacagtgtccctgagccctgtgcaatctgcccccatcgggagacggcctctgtttctcgactccattgtcagaggaatgaaaaatctgcttaacagcacgtctctggagaccagcctctccatcgaagctccctggggcgccattaatgtgcagtctacatataagccgaccgttagcacagctaacatcgccctgtcctggagctctgtggagcaccgcgggaataaaatccttgtctccggacggagcgaatctattatgaagctggaggaaagaaccggcgtgtcctgggatctcggcgttgaggacgcgagcgagtccaagctgctgacggtgtctgtcatggatctcagccagatgtactcccctgtgttcgaatatctgtctggggaccgccaggtcgaggaatggcccaaagccacatgtaccggagattgccctgagcggtgtggctgcaccacaagcacctgtcttcacaaggaatggccccattccagaaactggcgctgcaatcccacatggtgctggggagtggggacgggctgtacctgctgtgggctggacgttaaagatctctttacagactacatgttcgtgaagtggaaagtcgagtatatcaagaccgaggctattgtgtgcgttgaactgacaagccaaggccggcagtgttctctgatcgaggccggaaccagatttaaccttggctccgtgacgattaccctcagcgaacctcgcaacatccagcacaagctgccgcccgagattatcacactgcatcctcggatcgaggaagggttcttcgatctcatgcacgtccaaaaagtgctgtctgcttccaccgtgtgcaaacttcagagctgtacacacggagttcccggcgacctgcaggtctaccatattgggaatctcctgaaaggagataaggtgaacggccacctgatccataaaattgagcctcactttaatacctcttggatgagctgggacgggtgcgaccttgattattactgtaacatgggcgactggccctcctgcacgtacacaggagtgacccagcataatcacgccagcttcgtcaacctcctgaatatcgaaacagattataccaagaactttcacttccattctaagagagtgaccgcccacggcgacacaccgcaactggatctcaaagctcgccctacgtacggggcgggagagattaccgttctggtggaagtcgccgacatggagcttcatacaaagaaaatcgagatctccggcctgaagtttgctagcctcacctgtacagggtgctatgcctgctcctctggaattagctgtaaagtgcggatccacgttgatgaacccgacgagctgaccgtgcacgtcaagtccgatgaccctgatgtggttgccgcttctagctccctgatggccagaaaacttgagttcggcacggactctacatttaaggcgttcagcgctatgcccaagacctccctctgcttttacattgtggaacgggaatattgtaaaagctgctctaaggaggatacccagaaatgtgtcaatacaaagctggagcagcctcagtccatcctgattgaacatcgcgggaccatcatcggcaaacaaaacaatacatgcattgccaaggccagctgttggctcgagtctgtgaagtccttcttttacggactgaaaaacatgcttagcggcatcttcgggaatctgtttctcggaattttcctgttcctggctccctttatccttctcattctgttctttatgttcggctggagaatcctgttttgcttcaagtgttgccggagaacgcgcgggctctttaaatatcggcacctgaaggacgacgaagagaccggatacagacgcatcattgaaagacttaacaataaaaagggcaagaacaaactgctcgatggggagcggctggccgaccgcagaatcgctgagctgttctctacaaagacccatattggc

SEQ ID NO: 13937 - RNA, 2916 nt, synthetic construct
  misc_feature 1..2916: note = derived and/or modified CDS sequence (opt5) from CCHFV(YL16070, Artificial)__KY354081.1__Gn-4aa-Gc
  source 1..2916: mol_type = other RNA
gccgagggcgggagctccgactgcatctctagaacccagctggtgaagacagaagtcgctgagattcacgaagatagctacggaggccccggggagaaaatcacgatttgtaacggatccaccatcgttgaccaacggctcggctctgaactggggtgctatacaattaatcgcgtcaagagctacaaactttgtgagaactccgcctctggaaagagctgcgagatcgattccatccctgtgaaatgtaagcagggcttctgcctgaagattacccaggaaggcagagggcatgtgaaactcagccggggaacagagatcgtgctggacgtttgtgattcttcctgcgaacttatgattccgaagggcaccggggacatcctggtggattgtagcggaggccagcaacactttctccagaataacctgattgacctggggtgccccaatgtccctctcctgggaaaaatggcgatctatgtgtgtcgcatgtctaaccatcccaagacaaccatggctttcctcttttggttctcctttggctacgttattacgtgcatcgtgtgcagagtcctgttctatctcctgatcgccattggcaccgtggggaaaaagctgaagcagtaccgggagctgaaacctcagacatgtatcgtgtgcgagagcgtccccgttaatgccattgatgctgaaatgcacgagctcaactgttcttataatatctgcccttactgtgcctcccgcctgagcaccgacggactgattagacatgtgacacaatgcccgaagcggcgcgaaaaagtggaggaaaccgagctctttctgaaccttgagagaatcccctggctggtccggaagctccttcaggtgtccgaatctacgggcatggctcttaaacgcagctgttggatgatcacactgctcattctgctgctcgtttccatgagccctgtgcagtctgcccccgtcgggagaaagcctctgttccttgattccatcgcgaaaggaatgaaaagcctgctcaattctaccagcctggagacatccctttctattgaagccccctggggcgctatcaacgtgcagagcacctttaagccgaccgtttccgccgctaatattgccctgagctggtcttccgtggagcaccgggggaacaagatcctcgtcagcggacgctctgaatccatcatgaagctggaggagagaacaggcgtgagctggaatctgggcgtcgaagacgcgtccgagtctaaaacgctcaccgtgagcgttatggatctgtcccaaatgtactctcctgtgttcgaatatcttagcggggaccggcaggtcgaggaatggcccaaggccacatgcaccggagactgtcctgagagatgcggctgtacatcctctacctgcctgcacaaagagtggccccatagccgcaactggcggtgcaaccccacgtggtgttggggagtggggacaggctgcacctgttgcgggctcgatgttaaggactttttcaccgattacatgctggtgaagtggaaagtcgaatatattaagacagaggctatcgtgtgtgtggaactgacctcccaggagagacaatgcagccttattgaggccggcacacgctttaatctcggacctgttacgatcaccctgtctgaaccgcggaacgtccagcagagactgccccctgagattgtgacactccaccccaaaatcgaagagggcttcttcgacctgatgcatgtgcagaagattctttccgctagcaccgtctgtaaactgcaatcttgcacacacggggtgcctggagattttcaggtttaccacgtgggcaatctcctgcgcggggacaaggtcaacggacatagcatccacaagatcgaaccccatttcaatacctcctggatgagctgggatggctgtgacctggattatttttgcaacatgggggactggccgtcttgtacgtacaccggcgtgacacagcacaatcgggccgccttcattaacatgcttaatatcgagaccgattatacaaaaacctttcatttccactccaagagagttacggctcacggagacacacctcagctcgacctgaaagcgcgccccgcctacggcgctggggaggtgaccgtcctggtggaagttgccgatctcgagctgcatacaaagaaacttgaagtgagcggactgaagattgcctcccttacctgctctggctgctacgcttgtagctccgggatctcttgcaaggtccggattcacgtgaacgagcctgacgaatttaccgtgcatgtcagaagctccgatcccgacgttgtggccgcgggatctagcctgatggctcgcaaaatcgagttcggcgccgattccacatttaaggccttcagctctatgcctaaagactccctgtgtttttatatcgtggagaaggattactgcagctcttgtacggacgatgacacccaaaaatgcgtcaatacaaaacttgatcacccccagtccattctcatcgaacacaaggggaccattatcggcaagcagaacgacacatgtagcaccaagacgtcttgctggctgaaatccttcaagggatttttctatggcctgaaaaatatgctcagcgggattttcggaaacgtgtttctgggcatccttctgttcctcgctccgtttgttctgctgatcttctttttctttttcgggtggcggcttctcttttgtctgaagtgctgtaaaaagacaaagggactgctcaaatacaagcatctgaaagataaggaggaagccggctataaaaagattatcgagagacttaatgggaagaaaggcaagtcccagctgttcgacggagaacggctcgctaaccgcaaaattgccgagctgtttagcaccaagatccacattggc

SEQ ID NO: 13938 - RNA, 2916 nt, synthetic construct
  misc_feature 1..2916: note = derived and/or modified CDS sequence (opt5) from CCHFV(Oman_812956, Artificial)__KY362518.1__Gn-4aa-Gc
  source 1..2916: mol_type = other RNA
agcgaggaatccggcgaggactgcatctctagaacccagctgctccggacagaaacggccgagattcacggggataactacggaggccccggggacaagatcaccatttgtaatggaagcacaatcgtggatcaacgcctgggctccgaacttgggtgctataccattaacagagtcaaatctttcaagctgtgtgagaatagcgctacaggaaaatcctgcgagatcgacaacacccctgttaagtgtaaacagggcttttgcctcaagatcacacaggaaggccgggggcatgtgaagctgtctcgcgatagcgaggtggtccttgacgcctgtgattccagctgcgaaattatgatcccgaaaggaaccggcgacattctggtggattgttctgggggacagcaacacttcctcaaggacaatctgatcgatctgggctgccccaacattcctctcctggggaaaatggcgatctacatttgtagaatgtccaatcatcccaagacgaccatggcttttcttttctggtttagcttcggatatgttatcacatgcatcctgtgcaaagtgatcttttacctcctgattgtcgtgggcacccttggcaagaagttcaaacagtatcgggagctgaagcctcagacatgtaccatttgcgagacgacacccgttaacgccatcgacgccgaaatgcacgatctcaattgttcttacaacatttgcccttattgtgcttcccgcctgaccagcgacgggctggccagacatgtgatgcagtgcccgaaacggaaggagaaaatcgaagagacagaactctacctgaatcttgagcgcatcccctgggtcgtgagaaagctgctccaagtgtctgagtccaccggagtcgctctgaaacggagctcctggcttattgttctgctcgtgctgctgaccgtgtctctcagccctgtccagtccgcccccatcggccgcaagcctctgtttttcgacagcattgcgaaggggatgaaaaaccttctcaattctacatccctggaaacgagcctgtctatcgaggccccctggggagctattaacgtgcagagcacctttaagccgacagtttccaccgccaatatcgctctttcttggagctccgtggaacacagaggcaacaaaatcctggtcagcgggcggtctgagtccattatgaagctcgaggaacgcacaggaatcagctgggatctgggcgtggaggacgcctctgaatccaaactgctcaccgttagcgtgatggatctgtcccagatgtactctcctgtcttcgagtatcttagcggcgacagacaagtggaagagtggcccaaggcgacgtgtacaggggattgccctgaacggtgtggatgcacctcctctacctgtctgcacaaggagtggccccatagcagaaactggcgctgcaatcccacatggtgctggggcgtcgggaccggatgtacatgctgtggcctcgacgtgaaagatctgtttacggactacatgttcgttaagtggaaagtggagtatattaagaccgaagccatcgtctgcgtggagctgacatcccaggaacggcagtgtagccttattgaggctgggaccagattcaacctcggccctgttacaatcaccctgtctgagccgcgcaatattcaacagaaactgccccctgaaatcgtgacgctccacccccggatcgaggaaggatttttcgatctgatgcatgtccagaaggtgctttccgccagcaccgtgtgcaagctgcagtcttgtacacacggcgttcctggggacctccaagtctaccacattggaaacctgctgaaaggcgataaggtgaatgggcatcttatccacaaagtggagccccattttaacacctcctggatgagctgggacggatgcgacctcgattattactgtaatatgggcgactggccgtcttgcacatataccggggtcacgcagcacaaccatgctgccttcgtgaatctgctgaacattgaaacagattacaccaagaattttcacttccacagcaaaagagttacagcccatggcgacacccctcagctcgatctgaaggctcgccccaactacggagcgggcgagatcaccgtgcttgtcgaggtggccgacatggaactgcacacaaagaaaattgagatctccgggctcaagtttgctagcctgacgtgtaccggatgctatgcctgttcttccggcatcagctgcaaagttcggattcatgtggatgaacctgacgagctgacagtccacgtgaagtccgaagatcccgacatcgttgccgcttctagctcccttatggccagaaaactcgagttcgggaccgattctacatttaaggcgttcagcgctatgcctaaaacctccctgtgcttttacattgtggagcgcgaatattgtaagtcttgcagcaaggaggacacgcagaaatgtgtcaatgccaagctggaacggccccaatccatcctcattgagcacaaaggaacaatcatcggcaagcagaacgatacctgcaccgccaaagctagctgttggctggaatctgtgaagtccttcttttacgggcttaagaatatgctgagcggcattttcggaaacgtgttcatcggcatttttctcttcctggccccgtttatcctgcttattctcttctttatgttcgggtggagaatcctgttttgcttcaaatgttgccgccggacaagaggactgtttaagtatcggcatctcaaagacgacgaggagaccggctaccgcaagatcattgaaagactgaacaataaaaaggggaagaacaaacttctggatggagagcggctcgctgacagaaagatcgccgaactgttctctacaaaaacgcacattggc

SEQ ID NO: 13939 - RNA, 2916 nt, synthetic construct
  misc_feature 1..2916: note = derived and/or modified CDS sequence (opt5) from CCHFV(UCCR4405, Artificial)__KY484029.1__Gn-4aa-Gc
  source 1..2916: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgcctgtgacagctcctgcgaggtgatgattcccaaaggaacgggcgatatcctggttgactgtagcgggggacagcaacacttcctcaaggataacctgattgacctgggctgccctcatatccccctcctggggaaaatggcgatttacatctgtagaatgtctaatcaccctcggaccacaatggcttttcttttctggttttccttcggatatgtgattacctgcatcttttgcaaggccctgttctacagcctcatcattatcggcacactgggcaaaaagattaagcagtatcgcgaacttaaaccccagacctgtacgatctgcgagacagcccctgtcaacgctattgatgccgagatgcatgacctgaagtgttcttacaatatctgcccgtattgtgcttccagactcaccagcgacgggctggcccggcacgtgacacagtgccccaaacgcaaggaaaaagttgaggaaaccgagctgtacctcaacctggaaagaatcccttggattgtgcggaaacttctgcaagtctctgagtccaccggagtggcgctcaaacgcagctcctggctgatcgtgcttctggtcctcctgacagtttctctgagccccgtgcagtccgcccctgtgggcagaaagcccctctttctggatagcacggtcaaggggatgaaaaatcttctgaactctacctccctcgagacaagcctgtctattgaagctccgtggggagccatcaatgtgcagagcaccttcaagcctacagtttccaccgctaacattgccctttcttggagctccgtggagcaccggggcaataaaatcctggtcacggggcgcagcgaatctatcatgaagctcgaggaaagaacaggagtgtcctgggacctgggcgttgaggatgcgagcgagtctaaactgctcaccgtgtccattatggacctgagccagatgtactcccccgtctttgaatatctttctggcgatcggcaagtggaggaatggcctaaggccacctgtacaggggactgccccgagagatgtggatgcaccagctccacatgtctgcataaggaatggccccactctcgcaactggcggtgcaatcctacgtggtgctggggcgtcgggaccggatgtacatgctgtggcgtggatgttaaagacctcttcaccgatcatatgtttgtgaagtggaaagtcgagtacatcaagacagaggctattgtgtgcgttgaactgaccagccaggagagacagtgttccctgatcgaagccgggacgcgcttcaaccttggcccggtgaccattacactcagcgagccccggaacatccaacagaaactgcctcccgagattatcaccctgcaccctaagatcgaagagggattctttgacctcatgcacgtccagaaggtgctgtctgcttccacagtgtgcaaacttcagagctgtacccatggcattcccggggatctgcaaatctatcacattggaaatctcctgaagggcgacagagttaacgggcatctgatccacaaaattgaaccgcatttcaatacgtcttggatgtcctgggacggatgcgatcttgactactattgtaacatgggcaattggcctagctgcacatacaccggggtcacacagcacaaccacgccgcctttgtgaatctcctgaacatcgagaccgattataccaagacattccattttcactctaaacgcgtgacggctcatggcgacacaccccagctggatctcaaggcgcggcctacctacggagccggcgaaatcaccgtcctggtggaggttgctgacatggagcttcacacaaagaaagtggaaattagcgggctgaagttcgcctccctcgtctgtaccggatgctacgcctgcagctctggcatctcctgtaaagtgcgcattcacgttgatgagcccgacgaactgacggtgcatgtcaagagctccgatcctgacgtggttgctgcctctacaagcctgatggcgagaaaacttgagtttgggaccgattccatcttcaaggctttttctgccatgcccaaaaccagcctctgcttctatattgtggaacgggagtactgtaagtcctgctctgaggacgatacaaagaaatgtgtcgacaccaagctggaacagccgcaaagcatcctgatcgagcacaaaggaacaattatcggcaagcagaatgacacgtgcaccgccaaggcttcctgttggctcgaaagcgtgaagtcctttttctatgggctgaagaacatgcttggctctgtgtttggaaatttcttcgtcggcattctgctctttctggcccctttcgttctgcttgtgctctttttcatgtttgggtggaaaatcctgttctgctttaagtgttgcagacgcacacggggactgttcaaatacagacatctcaaggatgacgaggaaaccggctatcggcgcattatcgagagactgaacagcaaaaaggggaagaatcggcttctggatggagagagactcgctgaccgcaaaatcgccgaactgttttctacaaagacccacattggc

SEQ ID NO: 13940 - RNA, 2916 nt, synthetic construct
  misc_feature 1..2916: note = derived and/or modified CDS sequence (opt5) from CCHFV(UCCR4401, Artificial)__KY484035.1__Gn-4aa-Gc
  source 1..2916: mol_type = other RNA
agcgaggaaccctccgacgattgcatctctagaacccagctgctccggacagagacggccgaaattcacggcgacaactacgggggacctggcgataagatcaccatttgtaatgggagcacaatcgtggaccaacgcctgggatccgagcttggctgctataccattaacagagtccggtctttcaaactgtgtgaaaatagcgctacagggaagaactgcgagatcgattccgttccggtgaaatgtcgccagggatactgcctcagaatcacccaggagggccggggccatgtgaagctgtctcgcgggagcgaagtcgtgcttgacgcctgtgatacatcctgcgagattatgatccccaaaggaaccggcgacattctggttgattgtagcgggggacagcaacactttctcaaggacaatctgatcgatctgggctgccctaagattcccctcctggggaaaatggcgatctatatttgtagaatgtctaaccatcctaagacgaccatggctttcctgttttggttctcctttggatacgtgatcacatgcatcctttgcaaagccattttctatctcctgatcattgtcggcacccttggcaagcggctgaaacagtaccgcgaactcaagccccagacatgtaccatctgcgagacgacacctgtgaatgccattgacgctgagatgcacgatctgaactgtagctataatatctgcccgtactgtgcctctagactgacctccgacgggctcgctcggcatgttatccagtgccccaagcgcaaagaaaaggtggaggaaacagagctgtaccttaacctggaacggattccttgggtcgtgagaaaactcctgcaagtgagcgagtctaccggagtcgcccttaagcgctccagctggctgatcgttctcctggtgctgtttaccgtgtccctctctcccgtccagagcgcgcctattggcagaaaacccctgttccttgactccacagccaaggggatgaaaaatctgctcaacagcacgtctctggagacctcccttagcatcgaagctccgtggggagccattaatgtgcagtctacatataagcctaccgttagcacagctaacatcgccctgtcctggtctagcgtggagcaccggggcaataagatcctcgtctccgggagaagcgaatctattatgaaactggaggaacgcaccggaatctcctgggatctgggcgtggaggacgcgagcgagtctaagctcctgacggtttccgtgatggatcttagccagatgtactcccccgtctttgaatatctgtctggcgaccggcaagtggaggaatggcctaaagccacatgtaccggggattgccccgagagatgtggatgcaccagctccacatgtctccacaaggaatggccccattctcgcaactggcggtgcaaccctacctggtgctggggcgtcgggacaggatgtacgtgctgtggcctggacgtgaaagatctgttcaccgactacatgtttgttaagtggaaggtggagtatattaaaacagaggctatcgtctgcgtggaacttaccagccaggagagacagtgttccctcattgaagccgggacacgcttcaatctgggcccggttaccatcacgctgagcgagccccggaacattcaacagaagctccctcccgagatcatcaccctgcaccctagaattgaagagggatttttcgatcttatgcatgtgcagaaagtcctgtctgcttccacagtgtgcaagctccagagctgtacccacggcgtgcccggggacctgcaagtttaccacatcggaaatctgcttaaaggcgataaggtcaacgggcatctcattcacaagatcgaaccgcatttcaatacatcttggatgtcctgggacggatgcgacctggattattactgtaacatgggcgactggcctagctgcacctacacgggggtgacacagcacaatcatgcctcttttgtgaacctgctcaatattgagaccgattataccaaaaacttccactttcacagcaagcgcgtcaccgcccatggcgacacaccccagctggatcttaaagctcggcctacatacggagcgggcgaaatcacggtgctggttgaggtggccgacatggagctccacaccaagaaaatcgaaatttccgggctgaagttcgctagcctggcctgtacaggatgctatgcctgctctagcggcatcagctgtaaggtccgcattcatgtggatgagcccgacgaacttaccgttcacgtgaaatccgatgaccctgatgtcgtggctgcctctagctccctcatggcgagaaagctggagtttgggacagactctaccttcaaggcttttagcgccatgcccaaaacgtccctgtgcttctacatcgttgaacgggagcactgtaaatcttgcagcgaggaagatacaaagaaatgtgtgaataccaagctcgagcagccgcaatccattctgatcgaacataagggaaccatcattggcaaacagaacagcacatgcaccgccaaggcttcttgttggcttgagtccgtcaaatcctttttctatgggctgaagaatatgctctctggcatctttggaaacgtgttcatgggcatttttctgttcctggcccctttcatccttctcattctgtttttcatgtttgggtggagaatcctgttctgctttaaatgttgccggcgcacaagaggactcttcaagtaccggcacctgaaggacgacgaagagacgggctatagacgcatcattgagaaacttaataacaagaaagggaagaacaaactgctcgatggagaacggctggctgacagacgcatcgccgagctgttttccaccaagacacatattggc

SEQ ID NO: 13941 - RNA, 2916 nt, synthetic construct
  misc_feature 1..2916: note = derived and/or modified CDS sequence (opt5) from CCHFV(UCCR4448, Artificial)__KY484042.1__Gn-4aa-Gc
  source 1..2916: mol_type = other RNA
agcgaggaaacctccgacgattgcatctctagaacacagctgctccggacggagaccgccgaaattcacggcgacaactacgggggacccggcgataagatcacaatttgtaatgggagcaccatcgtggaccagcgcctgggatccgagcttggctgctatacaattaacagagtcaaatctttcaagctgtgtgaaaatagcgctaccgggaaatcctgcgagatcgattctgttcctgtgaagtgtcggcagggatactgcctccgcatcacacaggagggcagaggccatgtgaaactgagccgggggtccgaagtcgtgcttgacgcctgtgataccagctgcgagattatgatcccgaagggaacgggcgacattctggttgattgttctgggggacagcaacactttctcaaggacaacctgatcgatctgggctgccccaaaattcctctcctggggaagatggcgatctatatttgtcgcatgtccaatcatcccaaaaccacaatggctttcctgttttggttcagctttggatacgtgattacctgcatcctgtgcaaggccatcttctatctcctgatcattatcggcacacttggcaaaagatttaagcagtaccgggaactgaagcctcagacctgtacgatttgcgagacaacccccgtcaacgccatcgacgctgagatgcacgatctcaattgttcttataacatctgcccttactgtgcctcccgcctgacaagcgacgggctggctagacatgtgacccagtgcccgaaacggaaggaaaaagttgaggaaaccgagctctacctgaatcttgaacgcattccctgggtggtcagaaagctgctccaagtgtctgagtccacaggagtggccctgaaacggagctcctggcttatcgtcctgctcgttctgttcacgatttctctgagccctgtgcagtccgcgcccatcagccgcaagcctctctttctggactctattgtgaaaggcatgaagaaccttcttaattccaccagcctcgagacatctctgagcatcgaagccccctggggagctatcaacgtccagtccacctataagccgacagtgtctaccgccaatattgctcttagctggtccagcgttgagcacagagggaacaaaatcctggtgtctggccggtccgaaagcattatgaagctcgaggaaaagacggggatctcttgggatctgggagtcgaggacgcctccgagagcaagctgctcacagtgtccgttatggatctgtctcagatgtacagccctgtgttcgaatatctttccggcgacagacaagtcgaggaatggcccaaagcgacctgtaccggcgattgccctgagcgctgtgggtgcacatctagcacctgtctgcacaaggaatggccccattcccggaattggagatgcaaccccacatggtgctggggagtgggcacggggtgtacctgctgtggactcgacgtcaaggatctgtttacagactacatgttcgtgaaatggaaggttgagtatattaaaaccgaggccatcgtgtgcgtcgaactgacaagccaggagcgccagtgttctcttattgaagctggcacccggtttaacctcgggcctgtgacgatcaccctgtccgagccgagaaatatccaacagaagctgccccctgagattatcacactccacccccgcattgaagagggcttcttcgatctgatgcatgttcagaaagtgcttagcgcctctaccgtctgcaagctgcagtcctgtacacacggagtgcctggcgacctccaagtgtaccacatcgggaacctgctgaagggagataaagttaatggccatcttattcacaagatcgaaccccattttaacaccagctggatgtcttgggacgggtgcgacctcgattattactgtaatatgggagactggccgagctgcacgtacacaggcgtcacccagcacaaccatgcttccttcgtgaatctgctgaacatcgagacagattataccaaaaattttcacttccacagcaagcgggtgaccgcccatggggacacacctcagctcgatctgaaagccagacccacgtacggcgctggagaaattaccgtccttgtggaggttgcggacatggagctgcacacaaagaagatcgaaatttctggcctcaaatttgcctccctgacctgtacagggtgctatgcttgcagctccggaatctcttgtaaggtgcgcattcatgtcgatgagcctgacgaactgaccgtgcacgttaaaagcgatgaccccgatgtggtcgccgcctcctctagccttatggctcggaagctcgagttcggcacggactccacatttaaagccttctctgcgatgcctaagaccagcctgtgcttttacatcgtggaaagagagcactgtaaatcctgcagcgaggaagataccaagaagtgtgttaacacaaaactggagcagccccaatctatcctcattgaacataaggggaccatcattggaaaacaaaattccacatgcacggctaaggccagctgttggctggagtctgtgaaatccttcttttatggccttaagaacatgctgagcgggatcttcggcaatgtctttattggaatcttcctcttcctggccccgtttatcctgcttattctcttctttatgttcggctggaagatcctgttttgcttcaaatgttgccgccggaccagagggctgtttaagtaccggcacctcaaagacgacgaagagacaggatatcgcagaattatcgagcggctgaacaataagaaaggcaagaacaaacttctggatggggaaattctcgctgacagacgcatcgccgagctgttctctaccaaaacacatattgga

SEQ ID NO: 13942 - RNA, 2916 nt, synthetic construct
  misc_feature 1..2916: note = derived and/or modified CDS sequence (opt5) from CCHFV(SPU 45/88, Artificial)__KJ682809.1__Gn-4aa-Gc
  source 1..2916: mol_type = other RNA
agcgaggaatcctctgacgattgcctgagcagaacccagctcctgcggacagagaacacggaaatccactccgacaattacggcgggcccggagataagattaccatctgtaacggctctacaattgtggaccaacgccttgggagcgagctgggatgctataccatcaatagagtgaaatccttcaagctctgtgaaaactctgccacaggcaaaagctgcgagattgattccacccctgttcggtgtcgccaggggttttgcctgaagatcacacaggagggaagaggccatgtgaaacttagccggggctctgaagtggtcctggacgcttgtgattccagctgcgagatcatgattccgaaggggaccggagacatcctcgtggattgttctggcgggcagcaacacttcctgaaggacaatctggttgatctcggatgccccaacattcctctgcttggcaaaatggccatctacatttgtcgcatgtccaatcatcccaagacgaccatggggtttctgttctggtttagcttcggatatgtgatcacatgcattctctgcaaagtcatcttttacctgcttatcgtggttggcaccctgggcaagaaattcaagcagtatagagaactcaagcctcagacatgtaccatttgcgagacgacacccgtgaacgcgatcgacgctgagatgcacgatctgaattgttcttacaacatttgcccttattgtgcctcccggctgaccagcgacgggctcgcccgccatgtcatgcagtgcccgaaaagaaaggagaaaatcgaagaaacagagctgtaccttaatctggaacggattccctggatcgtgcgcaagctcctgcaagtgtccgagtctaccggagtcgctcttaaaagaagctcctggctggttgtgctcctggtgctgctcaccgtcagcctgtctcctgtgcagtccgcccccatcggccggaagcctctttttctggacagcattgttaaagggaagaagaacctccttaattctacaagcctggagacgtccctgtctatcgaagctccctggggagccattaacgtgcagagcaccttcaaaccgacagtctccgcggccaatatcgctctcagctggtcttccgtggagcaccgcggcaacaagattctggttagcgggagatctgaatccatcatgaaactggaggaacggaccggaatcagctgggatctcggcgtggaggacgcctccgagtctaagctgcttacagtcagcgtgatggatctgtcccagatgtactctcctgtctttgaatatctcagcggcgacagacaagtggaggaatggcccaaagctacctgtacgggggattgccctgagcgctgtggatgcacatccagcacctgtctgcacaaggaatggccccattctcggaactggagatgcaatcccacctggtgctggggcgttgggacaggatgtacctgctgtggcctggacgtgaaggatcttttcacagactacatgtttgtcaaatggaaggtggattatattaaaacggaggccatcgtttgcgtggagctcacctcccaggaacgccagtgtagcctgattgaggcggggacacggttcaacctgggccctgtcaccatcacactctctgaaccgagaaatattcaacagaagctgccccctgagatcgtgacccttcacccccgcattgaggaaggattctttgacctgatgcatgtgcagaacgttctctccgccagcacggtctgcaaactgcagtcttgtacccacggcgtgcctggggatctgcaaatctaccacatcggaaatcttctcaagggcgacaaggtgaacgggcatctgattcacaaaatcgagccccatttcaatacaagctggatgtcctgggacggatgcgatctggactattactgtaacatgggcgattggccgagctgctcttataccggggtcacacagcacaatcatgctgcctttgtgaacatgctcaatattgaaaccgactacacgaagaacttccactttcactccaaacgggttacagctcatggcgatacccctcagctggaccttaaggccagacccacatacggagccggcgagatcaccgtgctggtcgaagtggctgatatggagctccacaccaaaaagattgagatcagcgggctgaagttcgcgtccctgacatgtacgggatgctatgcctgctctagcggcatctcctgtaaagttcgcattcatgtggacgaacctgatgagcttaccgtccacgtgaagtctgaagaccccgatatcgttgctgccagctcctctctcatggcccggaaactggagtttgggacagacagcaccttcaaggctttttccgccatgcctaaaacaagcctgtgcttctacattgtggaaagagagtattgtaagtcttgctccaaagaggatacccagaagtgtgtcaatacgaagctcgaacaaccccagagcatcctgattgagcacaaaggaacaatcatcggcaagcagaacgatacctgcaccgcgaaagcctcttgttggcttgaatccgtcaagagctttttctacgggctgaaaaatatgctctctggcatttttggaaacgtgttcatcggcattctgctgttccttgctccgtttatcatgctcattctgttctttatgttcgggtggcgcatcctgttttgcttcaagtgttgccggagaacacggggactctttaagtatcgccatctgaaagacgacgaggaaatcggctacagaaagattatcgagcggcttaacaataaaaaggggaaaaacaagctgctcgacggagagagactggccgatcgcaagattgctgaactgttctccaccaaaacacacatcggc

SEQ ID NO: 13943 - RNA, 2916 nt, synthetic construct
  misc_feature 1..2916: note = derived and/or modified CDS sequence (opt5) from CCHFV(3010, Artificial)__DQ019222.1__Gn-4aa-Gc
  source 1..2916: mol_type = other RNA
gccgagggcgtgagcaacgactgcgtctccagaacccagctgatcaagacagaagttgctgagattcacgaagattcttacgggggacccggcgagaaaatcacgatttgtaatgggagcaccatcgtggaccaacggctcggatccgaactgggctgctatacaattaaccgcgtgaagacctacaaactttgtgagaatagcgccacagagaaggggtgcgaaatcgatagcgtccctgtgaaatgtaagcagggattctgcctgaaggttacccaggagggcagaggccatgtgaaactctcccgggggacagaaatcgtcctggacgtgtgtgatacctcttgcgagcttatgattccgaagggaacgggcgacatcctggttgattgtagcgggggacagcaacactttctccaggacaacctgattgatctgggctgccccaatgtgcctctcctggggaaaatggcgatctatatttgtcgcatgtccaaccatcccaagaccacaatggctttcctgttttggttcagctttggatacgtcattacctgcattgtgtgcaaagtgctgttctatctcctgatcgtcatcggcacactttctaagaagctgaaacagtacagagagctcaagcctcagacctgtattgtttgcgaatccacgcccgtgaatgccatcgacgccgagatgcacgaactgaactgtaattataacatttgcccttactgtgctagccggctgacatctgatggcctcgtgcgccatgtcaatcaatgcccgaaaagaaaggagaaagtggaagagaccgagctgtaccttaacctggaacggatcccctggctcgttcgcagactgcttcaggtgtccgagagcacagggatggccctgaagcggtcttgttggatgaccaccctcctgattctgctcgtcgtgtccctgagccctgttcagtccgctcccgtgggacgcagacctctttttctggactctatcgtcaaaggcatgaagaatctcctgaacagcacatcccttgaaacgagcctgtctatcgaggccccctggggagcgattaatgtgcagtccacctataagccgacagtcagcaccgccaacatcgctctctcttggagctccgtggaacaccggggaaacaaagttctggtgtctggccgcagcgagtccattatgaagctggaggaaagaacagggatcagctgggatctcggagtcgaggacgcctctgaatccaaactgcttaccgtgagcgttatggacctgtctcaaatgtactcccctgtgttcgagtatctcagcggcgatcggcaggtcgaagagtggcccaaggctacgtgcacaggcgactgtcctgagagatgcgggtgtacctcctctacctgcctgcacaaagaatggccccatagccgcaattggcggtgcaaccccacatggtgttggggagtgggcaccgggtgcacatgttgcggactggatgtgaaggacctttttacggattacatgttcgttaagtggaaagtcgagtatattaagaccgaagccatcgtgtgtgtggagctcacatcccaggagagacaatgctctctgatcgaagcgggcacccgctttaatctggggagcgtcacaattaccctctccgagcctcggaacatccagcagaaactgccgcccgaaattatcacgcttcaccctaagattgaggaaggcttctttgacctgatgcatgtgcagaaagttctcagcgcctctaccgtgtgtaagctgcaatcctgcacacacggagtccccggcgatcttcaggtgtaccacatcgggaatcttctcaagggagacagagttaacggccatctgattcacaaaatcgagcagcatttcaataccagctggatgtcttgggatgggtgtgacctggattattactgcaacatgggagactggccttcctgtacatacaccggcgtgacgcagcacaatcatgctagcttcgtcaacctcctgaatatcgagacagactataccaagacatttcacttccactctaaacgcgtgaccgcccatggggatacaccccaacttgacctgaaggctcggccgacctacggcgccggagaagttacggtgctcgtcgaggtggccgatatggaactgcacaccaaaaagattgagatcagcggcctgaagtttgctgggcttacatgcaccggatgctatgcgtgttccagcggcatttcttgcaaagtgagaatccatgtcgacgaacctgatgagctcacagttcacgtgaagtccgacgatcccgacgtggtcgccgctagctcctctctgatggcccgcaaactggagttcgggaccgatagcacgtttaaggccttctccgctatgcctaaaacatctctctgtttttacattgtggaacgggagtattgcaagagctgttccaaagaagacacccagaagtgcgttaacaccaagctggagcagccccagtctatccttatcgaacacaaaggaacaattatcggcaagcaaaataacacctgtacagccaaagcgagctgctggctggagtccgtgaagtctttcttttacgggctcaaaaatatgctgggcggaattttcggcaacgtctttatcgggattttcacgtttctgacccctttcatccttctcatcctgttctttatgttcggatggagaatcctgttttgtttcaagtgctgtcgccggacaagaggcctctttaagtatcggcatctgaaagatgacgaggaaaccgggtaccgcaagatcattgagagacttaacaataaaaaggggaaaaaccggctgctcgatggcgaaagactggctgaccgcaagatcgccgagctgttctctacaaagacccacattggg

SEQ ID NO: 13944 - RNA, 972 nt, synthetic construct
  misc_feature 1..972: note = derived and/or modified CDS sequence (opt5) from CCHFV(10200)__U39455.2__Gn
  source 1..972: mol_type = other RNA
agcgaggaaccctccgacgattgcgtgtctagaacccagctgctccggacagagacggccgaaatccacggcgacaactacgggggacctggcgataagattaccatctgtaatgggagcacaattgtcgaccaacgcctgggatccgagcttggctgctataccatcaacagagttcggtctttcaaactgtgtgaaaatagcgctacagggaagaactgcgagattgattccgtgccggtgaaatgtcgccagggatactgcctcagaatcacccaggagggccggggccatgtcaagctgtctcgcgggagcgaagtggttcttgacgcctgtgatacatcctgcgagatcatgattcccaaaggaaccggcgacatcctggtggattgtagcgggggacagcaacactttctcaaggacaatctgattgatctgggctgccctaagatccccctcctggggaaaatggcgatttatatctgtagaatgtctaaccatcctaagacgaccatggctttcctgttttggttctcctttggatacgtcattacatgcatcctttgcaaagccatcttctatctcctgattatcgtgggcacccttggccggcgcctgaagcagtacagagaactcaaaccccagacatgtaccatttgcgagacgacacctgttaatgccatcgacgctgagatgcacgatctgaactgtagctataatatttgcccgtactgtgcctctcggctgacctccgacgggctcgctcgccatgtgatccagtgccccaagagaaaggaaaaagtcgaggaaacagagctgtaccttaacctggaacggatcccttgggtggtgcgcaagctcctgcaagtcagcgagtctaccggagttgcccttaaaagatccagctggctgattgtgctcctggtgctgtttaccgtctccctctctcccgtgcagagcgcgcctatcggc

SEQ ID NO: 13945 - RNA, 972 nt, synthetic construct
  misc_feature 1..972: note = derived and/or modified CDS sequence (opt5) from CCHFV(IbAr10200)__AF467768.2__Gn
  source 1..972: mol_type = other RNA
agcgaggaaccctccgacgattgcatctctagaacccagctgctccggacagagacggccgaaattcacggcgacaactacgggggacctggcgataagatcaccatttgtaatgggagcacaatcgtggaccaacgcctgggatccgagcttggctgctataccattaacagagtccggtctttcaaactgtgtgaaaatagcgctacagggaagaactgcgagatcgattccgttccggtgaaatgtcgccagggatactgcctcagaatcacccaggagggccggggccatgtgaagctgtctcgcgggagcgaagtcgtgcttgacgcctgtgatacatcctgcgagattatgatccccaaaggaaccggcgacattctggttgattgtagcgggggacagcaacactttctcaaggacaatctgatcgatctgggctgccctaagattcccctcctggggaaaatggcgatctatatttgtagaatgtctaaccatcctaagacgaccatggctttcctgttttggttctcctttggatacgtgatcacatgcatcctttgcaaagccattttctatctcctgatcattgtcggcacccttggcaagcggctgaaacagtaccgcgaactcaagccccagacatgtaccatctgcgagacgacacctgtgaatgccattgacgctgagatgcacgatctgaactgtagctataatatctgcccgtactgtgcctctagactgacctccgacgggctcgctcggcatgttatccagtgccccaagcgcaaagaaaaggtggaggaaacagagctgtaccttaacctggaacggattccttgggtcgtgagaaaactcctgcaagtgagcgagtctaccggagtcgcccttaagcgctccagctggctgatcgttctcctggtgctgtttaccgtgtccctctctcccgtccagagcgcgcctattggc

SEQ ID NO: 13946 - RNA, 972 nt, synthetic construct
  misc_feature 1..972: note = derived and/or modified CDS sequence (opt5) from CCHFV(Turkey-Kelkit06)__GQ337054.1__Gn
  source 1..972: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtaaaaattctgctacagggaagacctgcgaagttgacagcacaccggtgaaatgtcggcagggattttgcctcaagatcacccaggagggccgcggccatgtgaagctgtccagagggtctgaggtcgtgcttgatgcctgtgacagctcctgcgaagttatgatccccaaaggaacgggcgatattctggtggactgtagcgggggacagcaacacttcctcaaggataacctgatcgacctgggctgccctcatattcccctcctggggcggatggcgatctacatttgtcgcatgtctaatcaccctagaaccacaatggcttttcttttctggttttccttcggatatgtcattacctgcatcttttgcaaagccctgttctacagcctcatcatcattggcacactgggcaagaaaatcaagcagtatcgggagcttaagccccagacctgtacgatttgcgaaacagcccctgtgaacgctatcgatgccgagatgcatgacctgaattgttcttacaacatttgcccgtattgtgcttcccgcctcaccagcgacgggctggccagacacgttacacagtgccccaaacggaaggagaaagtggaagagaccgaactgtacctcaatctggagcgcatcccttggatcgtcagaaaacttctgcaagtgtctgaatccaccggagtggcgctcaagcggagctcctggctgattgtccttctggttctcctgacagtgtctctgagccccgtgcagtccgcccctgtcggc

SEQ ID NO: 13947 - RNA, 972 nt, synthetic construct
  misc_feature 1..972: note = derived and/or modified CDS sequence (opt5) from CCHFV(SR3)__AJ538199.1__Gn
  source 1..972: mol_type = other RNA
agcgaggaatccggcgacgattgcatctctagaacccagctgctccggacagagacggccgaagtgcacggggacaactacggaggccccggggataagattaccatctgtaatggaagcacagtcgttgaccaacgcctgggctccgagcttgggtgctataccattaacagagtgcggtctttcaaactgtgtgaaaatagcgctacaggaaagtcctgcgagatcgattctattcctgtgaaatgtaagcagggctactgcctcaaaatcacccaggagggccgcgggcatgtcaagctgagcagaggatccgaagtggttcttgacgtgtgtgatagctcttgcgaggtcatgatcccgaagggcacaggggacattctggtggattgttccggaggccagcaacactttctcaaagacaacctggttgatctggggtgccccaagatccctctcctgggaaaaatggccatttatatctgtcggatgagcaatcatcccaagaccacgatggcgttcctgttttggttctcttttggctacgtgattacctgcatcctttgcaaagctattttctttctcctgatcatcttcggcacacttgggaagcgctttaagcagtatagagaactgaaacctcagacctgtacaatttgcgagaccacgcccgtcaacgccatcgacgccgagatgcacgatctcaattgttcctacaacatttgcccttattgtgctagccggctgacatctgacggactggcccgccatgtgacccagtgcccgagacggaaggaaaaagtggaggaaacagagctctacctgaatcttgaacgcatcccctgggtcgttagaaagctgctccaagtgtccgagagcaccggcaccgtgctgaaacggtcctcttggcttattgtcctgctcgtgctgttcacagttagcctgtcccctgtgcagagcgctcccatcggg

SEQ ID NO: 13948 - RNA, 972 nt, synthetic construct
  misc_feature 1..972: note = derived and/or modified CDS sequence (opt5) from CCHFV(UCCR4413)__KY484038.1__Gn
  source 1..972: mol_type = other RNA
agcgagtcctctgccagcggctgcatctccagaacccagatgattaagtctgaaacagctgagatccacgacgatatttacgggggacccggcgaaaaactgacgatctgtaacgggaccacagtggtcgaccaacggctcggaagcgagctgggctgctataccattaatcgcatcaagacatacaaactttgtgaaaactccgttaaggagaaaacctgcgagatcgattctgtgcctgtgaagtgtagacaggggctgtgcctcaagattacacaggaaggacggggccatgtcaaactgagccgcggctccgagatcgtgcttgacatttgtgatagctcttgcgaactgatgatcccgaaggggaccggagacattctcgttgattgttccggcgggcagcaacacttcctgcaggacaatctggtggatctcggatgccccaacatccctctgcttggcaaagtcgccatttatatctgtagaatgagcaatcatcccaagacgaccatggcgtttctgttctggttttctttcgggtacgtgatcacatgcattctctgcaaaatcctgttttatcttctgattatcaccggaacactcggcaagaagctgaaacagtaccgggagctgaagcctcagacctgtacgatttgcgagtccacacccgttaacgctatcgacgccgaaatgcacgatctcaattgtagctataacatctgcccttactgtgcctctcgcctgacctccgacggccttattagacatgtgaatctgtgcccgaaacggaaggagaaagtcgaagagacagaactctacctgaaccttgagcgcatcccctggttcgtgagaaagctgctccaagtgagcgagtccaccggggtcgctctgaaacggtctagctggctgctcattctggttatccttctgaccgtgtccatgagccctgtgcagtctgcccccattaat

SEQ ID NO: 13949 - RNA, 972 nt, synthetic construct
  misc_feature 1..972: note = derived and/or modified CDS sequence (opt5) from CCHFV(66019)__AB069669.1__Gn
  source 1..972: mol_type = other RNA
agcgaggaatccggcgacgattgcatctctagaacccagctgctccggacagagacggccgaagtgcacggggacaactacggaggccccggggataagattaccatctgtaatggaagcacaattgtcgaccaacgcctgggctccgagcttgggtgctataccatcaacagagttaaatctttcaagctgtgtgaaaatagcggaacaggcaaatcctgcaagattgataacacccctgtgaaatgtcggcagggcttttgcctcaagatcacacaggaggggcgcggacatgtgaagctgtctagaggcagcgaggtcgtgcttgacgcttgtgattccagctgcgaaatcatgattccgaaagggaccggagacatcctggttgattgttctggcgggcagcaacacttcctcaaggacaatctggtggatctgggatgccccaacattcctctcctgggcaaaatggccatctacatttgtcggatgtccaatcatcccaagacgaccatggcgtttcttttctggtttagcttcggctatgtcatcacatgcatcttttgcaaaattatcttctacctgctcattgtggttgggaccctgggaaagaagtttaaacagtatcgcgagcttaagcctcagacatgtaccatctgcgaaacgacacccaccaacgctattgacgccgagatgcacgatctgaaatgttcttacaatatctgcccttattgtgcctccagactcacaagcgacggcctggctcggcatgtgacccagtgcccgaagcgcaaagagaaggtcgaagagaccgaactgtacctcaacctggagcggattccctggatcgtgagaaaacttctgcaagtgtctgaatccacaggggtcgccctcaagcgcagctcctggctgatcgttcttctggtgctcctgacggtgtctctgagccctgtccagtccgctcccattgga

SEQ ID NO: 13950 - RNA, 972 nt, synthetic construct
  misc_feature 1..972: note = derived and/or modified CDS sequence (opt5) from CCHFV(7001)__AB069670.1__Gn
  source 1..972: mol_type = other RNA
gccgagggcgggagctccgactgcatctctagaacccagctggtgaagacagaagtcgctgagattcacgaagatagctacggaggccccggggagaaaatcacgatttgtaacggatccaccatcgttgaccaacggctcggctctgaactggggtgctatacaattaatcgcgtgagaagctacaaactttgtgagaactccgcctctggaaagagctgcgagatcgattccatccctgtgaagtgtaaacagggcttctgcctgaagattacccaggaaggccgggggcatgtcaagctcagccgcggaacagagatcgtgctggacgtttgtgattcttcctgcgaacttatgattccgaaaggcaccggggacatcctggtggattgtagcggaggccagcaacactttctccagaataacctgattgacctggggtgccccaatgtccctctcctgggaaagatggcgatctatgtgtgtagaatgtctaaccatcccaaaacaaccatggctttcctgttttggttctcctttggctacgttattacgtgcatcgcctgccgggtgcttttctatctcctgatcgccattggcaccgtcgggaagaaacttaagcagtaccgcgagctgaagcctcagacatgtatcgtgtgcgagagcgtgcccgtcaatgctattgatgccgaaatgcacgagctcaactgttcttataatatctgcccttactgtgcttccagactgagcaccgacggactgattcggcatgttacacaatgcccgaaacgcagagaaaaggtggaggaaaccgagctctttctgaaccttgagcggatcccctggctggtgcgcaaactcctgcaggtctccgaatctacgggcatggcccttaagagaagctgttggatgatcacactgctcattctgctgctcgtgtccatcagccctgttcagtctgcgcccgtgggg

SEQ ID NO: 13951 - RNA, 972 nt, synthetic construct
  misc_feature 1..972: note = derived and/or modified CDS sequence (opt5) from CCHFV(75024)__AB069671.1__Gn
  source 1..972: mol_type = other RNA
agcgaggaatccggcgacgattgcatctctagaacccagctgctccggacagagacggccgaaattcacggggacaactacggaggccccggggataagatcaccatttgtaatggaagcacaatcgtggaccaacgcctgggctccgagatggggtgctataccattaacagagtcaaatctttcaaactttgtgaaaatagcgctacaggaaagtcctgcgagatcgattctatccctgttaagtgtcggcagggctactgcctgaaaattacccaggagggccgcgggcatgtgaagctcagcagaggatccgaagtggtcctggacgcctgtgatagctcttgcgaggtgatgatcccgaagggcacaggggacattcttgttgattgttccggaggccagcaacactttctgaaagacaacctcatcgatctggggtgccccagcattcctctgctcggaaagatggcgatctatatttgtcggatgtctaatcatcccaaaaccacgatggctttcctgttttggttctcctttggctacgtgattacctgcatcctttgcaaggccatcttctatctgctcatcattgtcggcacactggggaaacgctttaagcagtacagagaacttaagcctcagacctgtacaatctgcgagaccacgcccgccaacgctattgacgccgagatgcacgatctgaattgtagctataacatctgcccttactgtgcttctcggctcacatccgacggactggcccgccatgtgacccagtgcccgaaaagaaaggaaaaagttgaggaaacagagctgtacctcaatctggaacggatcccctgggtggtccgcaaacttctgcaagtgagcgagtccaccggcgtggcgctcaagagatctagctggctgattgtccttctggttctcttcgccatctccctgagccctgtgcagtctgctcccattggg

SEQ ID NO: 13952 - RNA, 972 nt, synthetic construct
  misc_feature 1..972: note = derived and/or modified CDS sequence (opt5) from CCHFV(7803)__AB069672.1__Gn
  source 1..972: mol_type = other RNA
agcgaggaatccggcgacgattgcatctctagaacccagctgctccggacagagacggccgaaattcacggggacaactacggaggccccggggataagatcaccatttgtaatggaagcacaatcgtggaccaacgcctgggctccgagatggggtgctataccattaacagagtcaaatctttcaaactttgtgaaaatagcgctacaggaaagtcctgcgagatcgattctatccctgttaagtgtcggcagggctactgcctgaaaattacccaggagggccgcgggcatgtgaagctcagcagaggatccgaagtgatcctggacgcctgtgatagctcttgcgaggtcatgattccgaagggcacaggggacatccttgtggattgttccggaggccagcaacactttctgaaagacaacctcattgatctggggtgccccagcatccctctgctcggaaagatggcgatttatatctgtcggatgtctaatcatcccaaaaccacgatggctttcctgttttggttctcctttggctacgttattacctgcatcctttgcaaggccatcttctatctgctcattatcgtgggcacactggggaaacgctttaagcagtacagagaacttaagcctcagacctgtacaatttgcgagaccacgcccgccaacgctatcgacgccgagatgcacgatctgaattgtagctataacatctgcccttactgtgcttctcggctcacatccgacggactggcccgccatgtcacccagtgcccgaaaagaaaggaaaaagtggaggaaacagagctgtacctcaatctggaacggattccctgggttgtgcgcaaacttctgcaagtcagcgagtccaccggcgtggcgctcaagagatctagctggctgatcgtgcttctggtcctcttcgccatttccctgagccctgttcagtctgctcccatctcc

SEQ ID NO: 13953 - RNA, 972 nt, synthetic construct
  misc_feature 1..972: note = derived and/or modified CDS sequence (opt5) from CCHFV(79121)__AB069673.1__Gn
  source 1..972: mol_type = other RNA
gccgagggcgggagctccgactgcatctctagaacccagctggtgaagacagaagtcgctgagattcacgaagatagctacggaggccccggggagaaaatcacgatttgtaacggatccaccatcgttgaccaaggcctcgggtctgaactgggatgctatacaattaatcgggtgcgcagctacaaactttgtgagaactccgcctctggcaagagctgcgagatcgattccatccctgtgaagtgtaaacagggcttctgcctgaagattacccaggaagggagaggacatgtcaagctcagccggggcacagagatcgtgctggacgtttgtgattcttcctgcgaacttatgattccgaaagggaccggagacatcctggtggattgtagcggcgggcagcaacactttctccagaataacctgattgacctgggatgccccaatgtccctctcctgggcaagatggcgatctatgtgtgtcgcatgtctaaccatcccaaaacaaccatggctttcctgttttggttctcctttggctacgttattacgtgcatcgcctgcagagtgcttttctatctcctgatcgccattgggaccgtcggaaagaaacttaagcagtaccgggagctgaagcctcagacatgtatcgtgtgcgagagcgtgcccgtcaatgctattgatgccgaaatgcacgagctcaactgttcttataatatctgcccttactgtgcttcccgcctgagcaccgacggcctgattagacatgttacacaatgcccgaaacggcgcgaaaaggtggaggaaaccgagctctttctgaaccttgagagaatcccctggctggtgcggaaactcctgcaggtctccgaatctacggggatggcccttaagcgcagctgttggatgatcacactgctcattctgctgctcgtgtccatcagccctgttcagtctgcgcccgtggga

SEQ ID NO: 13954 - RNA, 972 nt, synthetic construct
  misc_feature 1..972: note = derived and/or modified CDS sequence (opt5) from CCHFV(8402)__AB069674.1__Gn
  source 1..972: mol_type = other RNA
agcgaggaatccggcgacgattgcatctctagaacccagctgctccggacagagacggccgaaattcacaacgacaattacgggggacccggcgataagatcaccatttgtaacgggagcacagtggtcgaccaacgcctgggatccgagcttggctgctataccatcaatagagttaaatctttcaagctgtgtgaaaacagcgctacagggaaatcctgcgagattgattctacccctgtgaagtgtcggcagggattttgcctcaaaatcacacaggagggccgcggccatgtgaagctgagcagagggtccgaagtcgtgcttgacgcctgtgatagctcttgcgagatcatgattccgaagggaaccggcgacatcctggttgattgttccgggggacagcaacacttcctcaaagacaatctgattgatctgggctgccccaacatccctctcctggggaagatggcgatttacatctgtcggatgagcaatcatcccaaaacgaccatggcttttcttttctggttttctttcggatatgtggtcacatgcattctgtgcaaggtgatcttttacctcctgatcgttgtgggcacccttggcaaaaagttcaagcagtatcgcgaactgaaacctcagacatgtaccatttgcgagacgacacccgtcaacgccatcgacgccgagatgcacgatctcaattgttcctacaacatttgcccttattgtgctagcagactgacctctgacgggctggcccggcatgtgatgcagtgcccgaagcgcaaagaaaagatcgaggaaacagagctctacctgaatcttgaacggattccctgggtggtcagaaaactgctccaagtttccgagagcaccggagtggctctgaagcgctcctcttggcttgtggtcctgctcgtgctgctgaccgttagcctctcccctgtgcagagcgcccccatcggc

SEQ ID NO: 13955 - RNA, 972 nt, synthetic construct
  misc_feature 1..972: note = derived and/or modified CDS sequence (opt5) from CCHFV(88166)__AB069675.1__Gn
  source 1..972: mol_type = other RNA
agcgaggaatccggcgacgattgcatctctagaacccagctgctccggacagagacggccgaaattcacagcgacaactacgggggacccggcgataagatcaccatttgtaatgggtccacagtggtcgaccaacgcctgggatctgagcttggctgctataccatcaacagagttaagagcttcaaactgtgtgaaaattccgctacagggaaatcttgcgagattgatagcacccctgtgaagtgtcggcagggattttgcctcaaaatcacacaggagggccgcggccatgtgaagctgtccagagggagcgaagtcgtgcttgacgcctgtgattcttcctgcgagatcatgattccgaagggaaccggcgacatcctggttgattgtagcgggggacagcaacacttcctcaaagacaacctgattgatctgggctgccccaatatccctctcctggggaagatggcgatttacatctgtcggatgtctaaccatcccaaaacgaccatgggatttcttttctggttttccttcggctatgtggtcacatgcattctgtgcaaggtgatcttttacctcctgatcgttgtgggcacccttgggaaaaagttcaagcagtatcgcgaactgaaacctcagacatgtaccatttgcgagacgacacccgtcaatgctatcgacgccgagatgcacgatctcaactgtagctacaatatttgcccttattgtgcctctagactgacctccgacggactggctcggcatgtgatgcagtgcccgaagcgcaaagaaaagatcgaggaaacagagctctacctgaaccttgaacggattccctgggtggtcagaaaactgctccaagttagcgagtccaccggcgtggccctgaagcgctctagctggcttgtggtcctgctcgtgctgctgaccgtttccctcagccctgtgcagtctgctcccatcggg

SEQ ID NO: 13956 - RNA, 972 nt, synthetic construct
  misc_feature 1..972: note = derived and/or modified CDS sequence (opt5) from CCHFV(BA88166)__AF338470.1__Gn
  source 1..972: mol_type = other RNA
agcgaggaatccggcgacgattgcatctctagaacccagctgctccggacagagacggccgaaattcacagcgacaactacgggggacccggcgataagatcaccatttgtaatgggtccacagtggtcgaccaacgcctgggatctgagcttggctgctataccatcaacagagttaagagcttcaaactgtgtgaaaattccgctacagggaaatcttgcgagattgatagcacccctgtgaagtgtcggcagggattttgcctcaaaatcacacaggagggccgcggccatgtgaagctgtccagagggagcgaagtcgtgcttgacgcctgtgattcttcctgcgagatcatgattccgaagggaaccggcgacatcctggttgattgtagcgggggacagcaacacttcctcaaagacaacctgattgatctgggctgccccaatatccctctcctggggaagatggcgatttacatctgtcggatgtctaaccatcccaaaacgaccatgggatttcttttctggttttccttcggctatgtggtcacatgcattctgtgcaagggcatcttttacctcctgatcgtggttgggacccttggcaaaaagttcaagcagtatcgcgaactgaaacctcagacatgtaccatttgcgagacgacacccgtgaatgctatcgacgccgagatgcacgatctcaactgtagctacaatatttgcccttattgtgcctctagactgacctccgacggactggctcggcatgtcatgcagtgcccgaagcgcaaagaaaagatcgaggaaacagagctctacctgaaccttgaacggattccctgggtggtgagaaaactgctccaagtcagcgagtccaccggggttgccctgaagcgctctagctggcttgtggtgctgctcgtcctgctgaccgtgtccctcagccctgttcagtctgctcccatcgga

SEQ ID NO: 13957 - RNA, 972 nt, synthetic construct
  misc_feature 1..972: note = derived and/or modified CDS sequence (opt5) from CCHFV(BA66019)__AF350448.1__Gn
  source 1..972: mol_type = other RNA
agcgaggaatccggcgacgattgcatctctagaacccagctgctccggacagagacggccgaagtgcacggggacaactacggaggccccggggataagattaccatctgtaatggaagcacaattgtcgaccaacgcctgggctccgagcttgggtgctataccatcaacagagttaagtctttcaagctgtgtgaaaatagcggaacaggcaaatcctgcaagattgataaacatcctgtgaagtgtcggcagggcttttgcctcaagatcacccaggaggggcgcggacacgtgaaactgtctagaggcagcgaggtcgtgcttgacgcttgtgattccagctgcgaaatcatgattccgaaggggacaggagacatcctggttgattgttctggcgggcagcaacatttcctcaaagacaacctggtggatctgggatgccccaatattcctctcctgggcaagatggccatctacatttgtcggatgtccaaccaccccaaaaccacgatggcgtttcttttctggtttagcttcggctatgtcattacctgcatcttttgcaagatcatcttctacctgctcattgtggttgggacactgggaaagaaatttaagcagtatcgcgagcttaaacctcagacctgtacaatctgcgaaaccacgcccacaaatgctattgacgccgagatgcatgatctgaagtgttcttacaacatctgcccttattgtgcctccagactcaccagcgacggcctggctcggcacgtgacacagtgcccgaaacgcaaggagaaagtcgaagagaccgaactgtacctcaatctggagcggattccctggatcgtgagaaaacttctgcaagtgtctgaatccaccggggtcgccctcaagcgcagctcctggctgatcgttcttctggtgctcctgacagtgtctctgagccctgtccagtccgctcccattgga

SEQ ID NO: 13958 - RNA, 972 nt, synthetic construct
  misc_feature 1..972: note = derived and/or modified CDS sequence (opt5) from CCHFV(BA8402)__AF350449.1__Gn
  source 1..972: mol_type = other RNA
agcgaggaatccggcgacgattgcatctctagaacccagctgctccggacagagacggccgaaattcacaacgacaattacgggggacccggcgataagatcaccatttgtaacgggagcacagtggtcgaccaacgcctgggatccgagcttggctgctataccatcaatagagttaactctttcaatctgtgtgaaaacacagctaccgggaaaagctgcgagattgattccacacctgtgaagtgtcggcagggattttgcctcaaaatcacccaggagggccgcggccatgtgaagctgtctagagggagcgaagtcgtgcttgacgcctgtgagtccagctgcgaaatcatgattccgaaaggaacgggcgatatcctggttgactgttctgggggacagcaacacttcctcaaggataatctgattgacctgggctgccccaacatccctctcctggggaagatggcgatttacatctgtcggatgtccaatcatcccaaaaccacaatggcttttcttttctggtttagcttcggatatgtggtgacctgcattctgtgcaaggtcatcttttacctcctgatcgttgtgggcacacttggcaaaaagttcaaacagtatcgcgagctgaagcctcagacctgtacgatttgcgagacaacccccgtcaacgccatcgatgccgaaatgcacgacctcaattgttcttacaacatttgcccttattgtgcttccagaccgacaagcgatgggctggcccggcatgtgatgcagtgccccaagcgcaaagagaagatcgaagagaccgctctgtacctcaatctggaacggattccttgggtggtcagaaaacttctgcaagtttctgagtccaccggagtggccctcaagcgcagctcctggctggtggtccttctggtgctcctgacagtttctctgagccccgtgcagtccgcgcctatcggc

SEQ ID NO: 13959 - RNA, 972 nt, synthetic construct
  misc_feature 1..972: note = derived and/or modified CDS sequence (opt5) from CCHFV(Matin)__AF467769.2__Gn
  source 1..972: mol_type = other RNA
agcgaggaatccggcgacgattgcatctctagaacccagctgctccggacagagacggccgaaattcacagcgactcctacgggggacccggcgataagatcaccatttgtaacgggtctacagtggtcgaccaacgcctgggaagcgagcttggctgctataccatcaatagagttaaatccttcaagctgtgtgaaaactctgctacagggaaaagctgcgagattgattccacccctgtgaagtgtcggcagggattttgcctcaaaatcacacaggagggccgcggccatgtgaagctgagcagagggtctgaagtcgtgcttgacgcctgtgattccagctgcgagatcatgattccgaagggaaccggcgacatcctggttgattgttctgggggacagcaacacttcctcaaagacaatctgattgatctgggctgccccaacatccctctcctggggaagatggcgatttacatctgtcggatgtccaatcatcccaaaacgaccatggtgtttcttttctggtttagcttcggatatgtcattacatgcatcctgtgcaaggtgatcttttacctcctgattgttgtgggcacccttggcaaaaagttcaagcagtatcgcgaactgaaacctcagacatgtaccatctgcgagacgacacccgtcaacgctattgacgccgagatgcacgatctcaattgttcttacaacatctgcccttattgtgcctccagactgaccagcgacgggctggctcggcatgtgatgcagtgcccgaagcgcaaagaaaagattgaggaaacagagctctacctgaatcttgaaagaatcccctgggtggtccggaaactgctccaagtttccgagtctaccggagtggccctgaagcgcagctcctggcttgtggtcctgctcgtgctgctgaccgttagcctctctcctgtgcagtccgctcccatcggc

SEQ ID NO: 13960 - RNA, 972 nt, synthetic construct
  misc_feature 1..972: note = derived and/or modified CDS sequence (opt5) from CCHFV(Baghdad 12)__AJ538197.2__Gn
  source 1..972: mol_type = other RNA
agcgaggaatccggcgacgattgcatctctagaacccggctgctccgcacagagacggccgaaattcacggggacagctacggaggccccggggataagatcaccatttgtaacggatccacaatcgtggaccagagactgggctctgagatggggtgctataccattaatcgggtcaagagcttcaaactttgtgaaaactccgctacaggaaaatcttgcaagatcgatagcatccctgttaaatgtcgccaaggctactgcctgaagattacccaggagggcagagggcatgtgaagctctcccggggaagcgaggtggtcctggacgcctgtgattcttcctgcgaagtgatgatcccgaaaggcacaggggacattcttgttgattgtagcggaggccagcagcactttctgaaggacaatctcatcgatctggggtgccccaacattcctctgctcggaaaaatggcgatctatatttgtcgcatgtctaatcatcccaagaccacgatggctttcctgttttggttctcctttggctacgtgattacctgcatcctttgcaaagccatcttctatctgctcatcattgtcggcacactggggaagagatttaagcaataccgggagcttaaacctcagacctgtacaatctgcgaaaccacgcccgtgaacgccattgacgctgagatgcacgatctgaattgtagctataacatctgcccttactgtgcctctcgcctcacatccgacggactggctagacatgttacccagtgcccgaagcggaaagagaaggtggaagagacagaactgtacctcaatctggagcgcatcccctgggtcgtgagaaaacttctccaggtgagcgaatccaccggcgtcgccctgaagcggtctagctggctgattgttcttctggtgctcctggcggtgtccagctctcctgtccaatccgcccccatcggg

SEQ ID NO: 13961 - RNA, 972 nt, synthetic construct
  misc_feature 1..972: note = derived and/or modified CDS sequence (opt5) from CCHFV(VLG/TI29414)__AY179961.1__Gn
  source 1..972: mol_type = other RNA
agcgaggaacccggcgacgattgcatctccagaacccagctgctccgggccgagcctgctgaaattcacgacgataactacgggggaccgggcgacaagatcacaatttgtaatgggtctacgatcgtggatcaacgcctgggaagcgagcttggctgctataccattaacagagtcaaatccttcaagctgtgtgaaaattctgccacagggaaaacctgcgagatcgacagcacacccgttaagtgtcggcagggattttgcctcaaaatcacccaggagggccgcggccatgtgaagctgtccagagggtctgaagtggtccttgatgcgtgtgacagctcctgcgaggtgatgattcctaagggaacaggcgatatcctggttgactgtagcgggggacagcaacacttcctcaaagataacctgattgacctgggctgcccccatatccctctcctggggaagatggctatttacatctgtcggatgtctaatcacccccgcaccacgatggcctttcttttctggttttccttcggatatgtgattacctgcatcttttgcaaagccctgttctacagcctcatcattatcggcacactgggcaagaaaattaagcagtatagagaacttaagcctcagacctgtacaatctgcgagaccgctccggtcaacgccattgatgctgagatgcatgacctgaattgttcttacaacatctgcccctattgtgcctcccggctcacgagcgacgggctggcgcgccacgtgcctcagtgccccaaaagaaaggaaaaagttgaggaaacagagctgtacctcaatctggaacggatcccttggaacgtgcgcaaacttctgcaagtctctgagtccaccggagtggccctcaagagaagctcctggctgattgtgcttctggtcctcctgacagtttctctgagccccgtgcagtccgctccggtgggc

SEQ ID NO: 13962 - RNA, 972 nt, synthetic construct
  misc_feature 1..972: note = derived and/or modified CDS sequence (opt5) from CCHFV(TADJ/HU8966)__AY179962.1__Gn
  source 1..972: mol_type = other RNA
agcgaggaatccggcgacgattgcatctctagaacccagctgctccggacagagacggccgaaattcacggggacgattacggaggccccggggacaagatcaccatttgtaacggaagcacaatcgtggatcaacgcctgggctccgagcttgggtgctataccattaatagagtcaaatctttcaagctgtgtgaaaacagcgctacaggaaagaattgcgagatcgactccgttcctgtgaagtgtcggcagggctactgcctcaaaatcacccaggagggccgcgggcatgtgaagctgtctagaggaagcgaagtcgtgcttgatgcctgtgactccagctgcgaggttatgattccgaagggcacaggggatatctctgtggactgttccggaggccagcaacactttctgaaagataacctcattgacctggggtgccccaagatccctctgctcggaaaaatggcgatttatatctgtcggatgagcaatcatcccaagaccacgatggctttcctgttttggttctcttttggctacgtcattacccgcatcctttgcaaagccatcttctatctgctcattatcgtgggcacactggggaagagatttaagcagtaccgggaacttaaacctcagacctgcacaatttgtgagaccacgcccgccaacgctatcgatgccgagatgcacgacctgaattgctcctataacatttgtccttactgcgctagccgcctcacatctgacggactggccagacatgttacccagtgtccgaagcggaaagaacgcgtggaggaaacagagctgtacctcaatctggaaagaatcccctggatcgtccggaaacttctgcaagtgtccgagagcaccggcgtggcgctcaaacgctcctcttggctgattgtccttctggttctcttcaccgtgagcctgtcccctgtgcagagcgcccccatcggg

SEQ ID NO: 13963 - RNA, 972 nt, synthetic construct
  misc_feature 1..972: note = derived and/or modified CDS sequence (opt5) from CCHFV(Hodzha)__AY223476.1__Gn
  source 1..972: mol_type = other RNA
agcgaggaatccggcgacgattgcatctctagaacccagctgctccggacagagacggccgaaattcacggggacgattacggaggccccggggacaagatcaccatttgtaacggaagcacaatcgtggatcaacgcctgggctccgagcttgggtgctataccattaatagagtcaaatctttcaagctgtgtaaaaacagcgctacaggaaagtcctgcgaaatcgactctacccctgttaaatgtcggcagggctactgcctcaagatcacacaggagggccgcgggcatgtgaagctgagcagaggatccgaggtggtccttgatgcctgtgacagctcttgcgaagtgatgattccgaaaggcaccggggatatcctggttgactgttccggaggccagcaacactttctcaaggataatctgattgacctggggtgcccccggatccctctcctgggaaaaatggcgatttatatctgtcgcatgagcaaccatcccaagacgaccatggctttcctgttttggttctcttttggctacgtgattacatgcatcctttgcaaagccatcttctatctcctgattatcgtcggcacccttgggaagagatttaagcagtaccgggagctgaaacctcagacatgtaccatttgcgaaacgacacccgccaatgctatcgatgccgagatgcacgacctcaactgttcctataatatttgcccttactgtgctagccgcctgacctctgacggactggccagacatgtgacacagtgcccgaagcggaaagagaaggttgaagagaccgaactctacctgaaccttgagcgcatcccctggatcgtgagaaaactgctccaagtctccgaaagcaccggcgtggcgctgaagcggtcctcttggcttattgtgctgctcgtcctgttcgccgttagcctgtcccctgtgcagagcgctcccatcggg

SEQ ID NO: 13964 - RNA, 972 nt, synthetic construct
  misc_feature 1..972: note = derived and/or modified CDS sequence (opt5) from CCHFV(Kosovo/9553/2001)__AY675511.1__Gn
  source 1..972: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacagctcctgcgaggtgatgattcccaagggaacgggcgatatcctggttgactgtagcgggggacagcaacacttcctcaaagataacctgattgacctgggctgccctcatatccccctcctggggaagatggcgatttacatcgctcggatgtctaatcaccctaaaaccacaatggcctttcttttctggttttccctgggatatgtgattacctgtatcctctgcaaggccctgttctacagccttatcattatcggcacactgggcaaaaagattaagcagtatcgcgaactcaaaccccagacctgcacgatctgtgagacagctcctgtcaacgccattgatgctgagatgcatgacctgaattgctcttacaacatctgtccgtattgcgcctccagactgaccagcgacgggctcgcgcggcacgtgaagcagtgtcccaaacgcaaggaaaaagttgaggaaacagagctgtaccttaatctggaaagaatcccttgggtggtccggaagctcctgcaagtgtctgagtccaccggagtggcccttaaacgcagctcctggctgattgtcctcctggttctgctcaccgtgtctctgagccccgtgcagtccgctcctgtcggc

SEQ ID NO: 13965 - RNA, 972 nt, synthetic construct
  misc_feature 1..972: note = derived and/or modified CDS sequence (opt5) from CCHFV(SPU41/84)__AY900142.1__Gn
  source 1..972: mol_type = other RNA
agcgaggaatcctctgacgattgcatcagcagaacccagctgctccggacagagacggccgaaattcacggcgacaactacgggggacccggcgataagatcaccatttgtaatgggtccacagtggtcgaccaacgcctgggatctgagcttggctgctataccatcaacagagttaaaacattcaagctgtgtgaaaatagcgctaccgggaaatcctgcgagattgattctgtgcctgtgaagtgtcggcagggatactgcctcaaaatcacacaggagggccgcggccatgtcaagctgagcagagggtccgaagtggttcttgacgcctgtgataccagctgcgaggtgatgatcccgaagggaacgggcgacattctggtcgattgttctgggggacagcaacactttctcaaagacaacctgatcgatctgggctgccccaagattcctctcctggggaaaatggcgatctatatttgtcggatgtccaatcatcccaagaccacaatggctttcctgttttggttcagctttggatacgtgattacctgcatcatctgcaaagttatcttctatcttctcattatcgtgggcacactgggcaagcgctttaagcagtacagagaacttaaacctcagacctgtacgatttgcgagacaacccccgtcaacgccatcgacgccgagatgcacgatctgaattgttcttataacatttgcccttactgtgcttcccggctcacaagcgacgggctggcccgccatgtgacccagtgcccgaagagaaaagaaaaggtggaggaaaccgagctgtacctcaatctggaacggatcccctgggtcgttcgcaaacttctgcaagtgtctgagtccacaggagtggctctcaagagaagctcctggctggtcgtgcttctggttctcctgacggtgtctctgagccctgtccagtccgcccccatcagc

SEQ ID NO: 13966 - RNA, 972 nt, synthetic construct
  misc_feature 1..972: note = derived and/or modified CDS sequence (opt5) from CCHFV(UG3010)__AY900143.1__Gn
  source 1..972: mol_type = other RNA
gccgagggcgtgagcaacgactgcgtctccagaacccagctgatcaagacagaagttgctgagattcacgaagattcttacgggggacccggcgagaaaatcacgatttgtaatgggagcaccatcgtggaccaacggctcggatccgaactgggctgctatacaattaaccgcgtgaagacctacaaactttgtgaaaattctgccacagagaaggggtgcgagatcgatagcgtccctgtgaaatgtaagcagggattctgcctgaaggttacccaggagggcagaggccatgtgaaactctcccgggggacagaaatcgtcctggacgtgtgtgatacctcttgcgagcttatgattccgaagggaacgggcgacatcctggttgattgtagcgggggacagcaacactttctccaggacaacctgattgatctgggctgccccaatgtgcctctcctggggaaaatggcgatctatatttgtcgcatgtccaaccatcccaagaccacaatggctttcctgttttggttcagctttggatacgtcattacctgcatcgtgtgcaaagtgcttttctatctcctgatcgtcatcggcacactttctaagaagctgaaacagtacagagagctcaagcctcagacctgtattgtttgcgaatccacgcccgtgaatgccatcgacgccgagatgcacgaactgaactgtaattataacatttgcccttactgtgctagccggctgacatctgatggcctcgtgcgccatgtcaatcaatgcccgaaaagaaaggagaaagtggaagagaccgagctgtaccttaacctggaacggatcccctggctcgttcgcagactgcttcaggtgtccgagagcacagggatggccctgaagcggtcttgttggatgaccaccctcctgattctgctcgtcgtgtccctgagccctgttcagtccgctcccgtggga

SEQ ID NO: 13967 - RNA, 972 nt, synthetic construct
  misc_feature 1..972: note = derived and/or modified CDS sequence (opt5) from CCHFV(Hy13)__AY900145.1__Gn
  source 1..972: mol_type = other RNA
agcgaggaatccggcgacgattgcatctctagaacccagctgagccggacagagacggccgaaattcactccgacaactacgggggacccggcgataagatcaccatttgtaatgggtctacaatcgtggaccaacgcctcggaagcgagctgggctgctataccattaacagagtcaaatccttcaagctgtgtgaaaattctgctacagggaaaagctgcgagatcgattccacccctatcaagtgtcggcagggattttgccttaaaattacacaggagggccgcggccatgttaagctcagcagagggtctgaagtggtgctggacgcctgtgattccagctgcgagatcatgattccgaagggaaccggcgacatccttgtcgattgttctgggggacagcaacacttcctgaaagacaacctcattgatctgggctgccccaatatccctctgctcgggaagatggcgatttacatctgtcggatgtccaaccatcccaaaacgaccatggcttttctgttctggtttagcttcggatatgtgatcacatgcattctttgcaaggttatcttttacctgctcattgtggtcggcaccctgggcaaaaagttcaagcagtatcgcgaacttaaacctcagacatgtaccatctgcgagacgacacccgtgaatgccattgacgccgagatgcacgatctgaactgttcttacaatatctgcccttattgtgcttccagactcaccagcgacgggctggcccggcatgttatgcagtgcccgaagcgcaaagaaaaggtggaggaaacagagctgtacctcaacctggaaagaatcccctgggtcgtgcggaaacttctgcaagtgtccgagtctaccggagtcgctctcaagcgcagctcctggctggttgtgcttctggtgctcctgaccgtcagcctgtctcctgtgcagtccgcccccattggc

SEQ ID NO: 13968 - RNA, 972 nt, synthetic construct
  misc_feature 1..972: note = derived and/or modified CDS sequence (opt5) from CCHFV(Semunya)__DQ094832.1__Gn
  source 1..972: mol_type = other RNA
gccgagggcgtgagcaacgactgcgtctccagaacccagctgatcaagacagaagttgctgagattcacgaagattcttacgggggacccggcgagaaaatcacgatttgtaatgggagcaccatcgtggaccaacggctcggatccgaactgggctgctatacaattaaccgcgtgaagacctacaaactttgtgaaaattctgccacagagaaggggtgcgagatcgatagcgtccctgtgaaatgtaagcagggattctgcctgaaggttacccaggagggcagaggccatgtgaaactctcccgggggacagaaatcgtcctggacgtgtgtgatacctcttgcgagcttatgattccgaagggaacgggcgacatcctggttgattgtagcgggggacagcaacactttctccaggacaacctgattgatctgggctgccccaatgtgcctctcctggggaaaatggcgatctatatttgtcgcatgtccaaccatcccaagaccacaatggctttcctgttttggttcagctttggatacgtcattacctgcgtggtgtgcaaagtccttttctatctcctgatcgttatcggcacacttggcaagaagctgaaacagtacagagagctcaagcctcagacctgtatcgtgtgcgaatctattcccgtgaatgccatcgacgccgagatgcacgaactgaactgtaattataacatttgcccttactgtgcttcccggctgacgagcgatgggctcgtccgccatgtgacacaatgcccgaaaagaaaggagaaagttgaagagaccgagctgtaccttaatctggaacggatcccctggctcgtgcgcagactgcttcaggtctctgagtccacaggaatggccctgaagcggagctgttggatgaccaccctcctgattctgctcgtggtttctctgtcccctgtgcagagcgctcccgtcggc

SEQ ID NO: 13969 - RNA, 972 nt, synthetic construct
  misc_feature 1..972: note = derived and/or modified CDS sequence (opt5) from CCHFV(SPU128/81/7)__DQ157174.1__Gn
  source 1..972: mol_type = other RNA
agcgaggaaccctccgacgattgcatctctagaacccagctgctccggacagagacggccgaaattcacggcgacaactacgggggacctggcgataagatcaccatttgtaatgggagcacaatcgtggaccaacgcctgggatccgagcttggctgctataccattaacagagtcaaatctttcaagctgtgtgaaaatagcgctacagggaaatcctgcgagatcgagtctgttccggtgaagtgtcggcagggatactgcctccgcatcacccaggaaggcagaggccatgtgaaactgagccgggggtccgaggtcgtgcttgatgcctgtgacacaagctgcgaaattatgatccccaagggaaccggcgatattctggttgactgttctgggggacagcaacactttctcaaggataacctgatcgacctgggctgccctaaaattcccctcctggggaagatggcgatctatatttgtcgcatgtccaatcatcctaaaacgaccatggctttcctgttttggttcagctttggatacgtgatcacatgcatcctttgcaaggccattttctatctcctgatcattatcggcacccttggcaaaagatttaagcagtaccgggagctgaagccccagacatgtaccatttgcgagacgacacctgtcaacgccatcgatgctgaaatgcacgacctcaattgttcttataacatctgcccgtactgtgcctcccgcctgaccagcgatgggctggctagacatgtgacacagtgccccaaacggaaggagaaagttgaagagaccgaactctacctgaatcttgagcgcattccttgggtggtcagaaagctgctccaagtgtctgagtccaccggagtggccctgaaacggagctcctggcttatcgtcctgctcgttctgttcacagtgtctctgagccccgtgcagtccgcgcctattggc

SEQ ID NO: 13970 - RNA, 972 nt, synthetic construct
  misc_feature 1..972: note = derived and/or modified CDS sequence (opt5) from CCHFV(ROS/HUVLV-100)__DQ206448.1__Gn
  source 1..972: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacagctcctgcgaggtgatgattcccaagggaacgggcgatatcctggttgactgtagcgggggacagcaacacttcctcaaagataacctgattgacctgggctgccctcatatccccctcctggggaagatggcgatttacatctgtcggatgtctaatcaccctcgcaccacaatggcttttcttttctggttttccttcggatatgtgattacctgcatcttttgcaaagccctgttctacagcctcatcattatcggcacactgggcaagaaaattaagcagtatagagaacttaagccccagacctgtacgatctgcgagacagcccctgtcaacgctattgatgccgagatgcatgacctgaattgttcttacaacatctgcccgtattgtgcttcccggctcaccagcgacgggctggcccgccacgtgccccagtgccctaaaagaaaggaaaaagttgaggaaacagagctgtacctcaatctggaacggatcccctggattgtgcgcaaacttctgcaagtctctgagtccaccggagtggcgctcaagagaagctcctggctgatcgtgcttctggtcctcctgaccgtttctctgagccctgtgcagtccgcccccgtgggc

SEQ ID NO: 13971 - RNA, 972 nt, synthetic construct
  misc_feature 1..972: note = derived and/or modified CDS sequence (opt5) from CCHFV(AP92)__DQ211625.1__Gn
  source 1..972: mol_type = other RNA
agcgagggcggggacggaggctgcatctccagaacccagctgattaagacagaaacggccgaggtgcacggggatgactacggaggccccggggagaaaatcaccatttgtaacggatctacaatcgtcgatcaacggctcggcagcgaactgggctgctataccattaatcgcatcaagtccttcaaactttgtgaaaactctgctcaggggaagaattgcgagatcgacagcgcccctgttcagtgtagacagggatactgcctgaaaatttcccaagagggccgggggcatgtgaagctctctcgcggaagcgaaatcgtgctggatgtctgtgacacatcctgcgagattatgatcccgaagggcaccggggatattcttgtggactgtagcggaggccagcagcactttctgcagtctaacctcgttgatctgggctgccccaatatccctctgctcgggaaaatggcgatttatatctgtagaatgtccaaccatcccaagacaaccatggctttcctgttttggttcagctttggatacgtgatcacgtgcattctttgcaaaaccctgttctatatcctcattatcattggcacactggggaagaaacttaagcaataccgggaactgaagcctcagacctgtacaatctgcgagtctgtccccgtgaatgccatcgacgccgagatgcacgatctcaactgttcctataatatttgcccttactgtgctagccgcctgacctctgaaggactgacgagacatgttaaccagtgcccgaaacggaaggagaaagtggaagagacagaactctacctgaatcttgagcgcatcccctggattgtcagaaagctgctccaggtgtccgagagcaccggcgtggccctgaaacggtcctcttggatgatcgtccttctgattctcctgatcgttagcatgtcccctgtgcaaagcgctcccatctct

SEQ ID NO: 13972 - RNA, 972 nt, synthetic construct
  misc_feature 1..972: note = derived and/or modified CDS sequence (opt5) from CCHFV(ArD8194)__DQ211626.1__Gn
  source 1..972: mol_type = other RNA
gccgagggcgggagcaacgactgcgtgtccagaacccagctggtcaagacagaagttgctgagatccacgaagattcttacggaggccccggggagaaaattacgatctgtaatggaagcaccattgtggaccaacggctcggctccgaactggggtgctatacaatcaaccgcgtgagaacctacaagctgtgtgaaaattctgccacagagaaaagctgcgagattgattccgtccctgtgaagtgtaaacagggattctgccttaagatcacccaggagggccggggccatgttaagctctctcgcgggacagaaatcgtgctggacgtctgtgataccagctgcgagcttatgattccgaaaggaacgggcgacatcctggtggattgttccgggggacagcaacactttctccaggacaacctgattgatctgggctgccccaatatccctctcctggggagaaccgcgatttatgtttgtcggatgagcaaccatcccaagacaaccatggctttcctgttttggttctcttttggatacgtgatcacatgcgtcgtgtgcaaagtgcttttctatctcctgattgtcatcggcacccttggcaagcgcctgaaacagtacagagagctcaagcctcagacgtgtatcgtttgcgaatccattcccgtgaatgccatcgacgccgagatgcacgatctgaactgtaattataacatttgcccttactgtgctagccggctgacatctgacgggctcgtgcgccatgtcacccaatgcccgaagagaaaagaaaaggtggaggaaacagagctgtaccttaatctggagcggatcccctggctcgttcgcaaactgcttcaggtgtccgaaagcaccggagtcgccctgaagagatcttgttggatgattaccctcctgatcctgctcacagtgtccatgagccctgttcagtccgctcccgtgggc

SEQ ID NO: 13973 - RNA, 972 nt, synthetic construct
  misc_feature 1..972: note = derived and/or modified CDS sequence (opt5) from CCHFV(ArD15786)__DQ211627.1__Gn
  source 1..972: mol_type = other RNA
gccgagggcgggagcaacgactgcgtgtccagaacccagctggtcaagacagaagttacggagatccacgaagattcttacggaggccccggggagaaaattaccatctgtaatggaagcacaattgtggaccaacggctcggctccgaactggggtgctataccatcaaccgcgtgagaacatacaagctgtgtgaaaattctgctaccgagaaaagctgcgagattgattccgtccctgtgaagtgtaaacagggattctgccttaagatcacacaggagggccggggccatgttaagctctctcgcgggaccgaaatcgtgctggacgtctgtgatacgagctgcgagcttatgattccgaaaggaaccggcgacatcctggtggattgttccgggggacagcaacactttctccaggacaacctgattgatctgggctgccccaatatccctctcctggggcagacagccatttatgtttgtagaatgagcaaccatcccaagaccacaatggcgttcctgttttggttctcttttggatacgtgattacctgcgtcgtgtgcaaagtgcttttctatctcctgatcgtcatcggcacgcttggcaagcggctgaaacagtaccgcgagctcaagcctcaaacatgtatcgtttgcgaatccattcccgtgaatgctatcgacgccgagatgcacgatctgaactgtaattataacatttgcccttactgtgccagcagactgacctctgacgggctcgtgcggcatgtcacacagtgcccgaagcgcaaagaaaaggtggaggaaaccgagctgtaccttaatctggagagaatcccctggctcgttcggaaactgcttcaggtgtccgaaagcaccggagtcgctctgaagcgctcttgttggattatcacactcctgatcctgctcacggtgtccatgagccctgttcagtccgcccccgtgggc

SEQ ID NO: 13974 - RNA, 972 nt, synthetic construct
  misc_feature 1..972: note = derived and/or modified CDS sequence (opt5) from CCHFV(ArD39554)__DQ211628.1__Gn
  source 1..972: mol_type = other RNA
agcgagtccaacaataacgactgcgtgtctagaacccagctgatcaagacagaaaatgccgagattcacggcgatgactacgggggacccggcgagaaaatcacgatttgtaacgggagcaccatcgtcgaacaacggctcggatccgaactgggctgctatacaattaatcgcatcaagtctttcaaactttgtgagaacagcgcttccgggaagggatgcgagatcgattctacccctgttaaatgtaagcagggcttttgcctgaagattacacaggaaggcagagggcatgtgaaactcagccggggatccgagatcattctggacgtgtgtgatagctcttgcgaaatgatgatcccgaagggctccggggacattcttgtcgattgtagcggaggccagcaacacttcctgcaggacaatctcgtggatctggggtgccccaacgttcctctgctcggaaaaatggccatctacatttgtcgcatgtctaatcatcccaagaccacaatggcgtttctgttctggttttccttcggctatgtgattacctgcatcttttgcaaagtcatcttctacgtgcttatcattatcggcacgctggggaagagaattaagcagtatcgggagctcaaacctcagacctgtacaatctgcgaggctacccccgttaacgccatcgacgccgaaatgcacgatctgaattgtagctacaacatttgcccttattgtgcttctcgccttacatccgagggactggtgagacatgtcacccaatgcccgaagcggaaagaaaagatcgaggaaacggagctctacctgaatctggagcgcattccctggtttgtgagaaaactccttcaggtgagcgaatccacaggcgtcgccctgaagcggtctagctggctggttaccctcctggtgcttctgacagtgtccctcagccctgtccagtctgctcccatcggg

SEQ ID NO: 13975 - RNA, 972 nt, synthetic construct
  misc_feature 1..972: note = derived and/or modified CDS sequence (opt5) from CCHFV(Drosdov)__DQ211630.1__Gn
  source 1..972: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgcctgtgacagctcctgcgaggtgatgattcccaaaggaacgggcgatatcctggttgactgtagcgggggacagcaacacttcctcaaggataacctgattgacctgggctgccctcatatccccctcctggggaaaatggcgatttacatctgtagaatgtctaatcaccctcggaccacaatggcttttcttttctggttttccttcggatatgtgattacctgcatcttttgcaaggccctgttctacagcctcatcattatcggcacactgggcaaaaagattaagcagtatcgcgaacttaaaccccagacctgtacgatctgcgagacagcccctgtcaacgctattgatgccgagatgcatgacctgaagtgttcttacaatatctgcccgtattgtgcttccagactcaccagcgacgggctggcccggcacgtgacacagtgccccaaacgcaaggaaaaagttgaggaaaccgagctgtacctcaacctggaaagaatcccttggattgtgcggaaacttctgcaagtctctgagtccaccggagtggcgctcaagcgcagctcctggctgatcgtgcttctggtcctcctgacagtttctctgagccccgtgcagtccgcccctgtgggc

SEQ ID NO: 13976 - RNA, 972 nt, synthetic construct
  misc_feature 1..972: note = derived and/or modified CDS sequence (opt5) from CCHFV(Oman)__DQ211632.1__Gn
  source 1..972: mol_type = other RNA
agcgaggaatccggcgaggactgcatctctagaacccagctgctccggacagaaacggccgagattcacggggataactacggaggccccggggacaagatcaccatttgtaatggaagcacaatcgtggatcaacgcctgggctccgaacttgggtgctataccattaacagagtcaaatctttcaagctgtgtgagaatagcgctacaggaaaatcctgcgagatcgacaacacccctgttaagtgtaaacagggcttttgcctcaagatcacacaggaaggccgggggcatgtgaagctgtctcgcgatagcgaggtggtccttgacgcctgtgattccagctgcgaaattatgatcccgaaaggaaccggcgacattctggtggattgttctgggggacagcaacacttcctcaaggacaatctgatcgatctgggctgccccaacattcctctcctggggaaaatggcgatctacatttgtagaatgtccaatcatcccaagacgaccatggcttttcttttctggtttagcttcggatatgttatcacatgcatcctgtgcaaagtgatcttttacctcctgattgtcgtgggcacccttggcaagaagttcaaacagtatcgggagctgaagcctcagacatgtaccatttgcgagacgacacccgttaacgccatcgacgccgaaatgcacgatctcaattgttcttacaacatttgcccttattgtgcttcccgcctgaccagcgacgggctggccagacatgtgatgcagtgcccgaaacggaaggagaaaatcgaagagacagaactctacctgaatcttgagcgcatcccctgggtcgtgagaaagctgctccaagtgtctgagtccaccggagtcgctctgaaacggagctcctggcttattgttctgctcgtgctgctgaccgtgtctctcagccctgtccagtccgcccccatcggc

SEQ ID NO: 13977 - RNA, 972 nt, synthetic construct
  misc_feature 1..972: note = derived and/or modified CDS sequence (opt5) from CCHFV(SPU97/85)__DQ211633.1__Gn
  source 1..972: mol_type = other RNA
agcgaggaatccgacggcgattgcatctctagaacccagctgctccggacagagacggccgaaattcacagcgacaactacgggggacccggcgataagatcaccatttgtaatgggtccacaatcgtggaccaacgcctgggatctgagcttggctgctataccattaacagagtcaagagcttcaaactgtgtgaaaattccgctacagggaaatcttgcgagatcgatagcacccctgttaagtgtcggcagggattttgcctcaaaatcacacaggagggccgcggccatgtgaagctgtccagagggagcgaaattgtgcttgacgcctgtgattcttcctgcgagatcatgattccgaagggaaccggcgacatcctggtcgattgtagcgggggacagcaacacttcctcaaagacaacctgattgatctgggctgccccaatatccctctcctggggcggatggcgatttacatctgtcgcatgtctaaccatcccaagacgaccatggcttttcttttctggttttccttcggatatgtgatcacatgcattctgtgcaaagttatcttttacctcctgattgtggccggcaccgtcggcaagaaattcaagcagtatagagaacttcggcctcagacatgtaccatctgcgagacgacacccgtgaatgccattgacgctgagatgcacgatctgaactgtagctacaatatctgcccttattgtgcctctcgcctcacctccgacgggctggctagacatgttatgcagtgcccgaagcggaaagaaaagatcgaggaaacagagctgtacctcaacctggaacgcattccctgggtggtcagaaaacttctgcaagtgagcgagtccaccggagtggccctcaagcggtctagctggctgaccgtccttctggttctcctgatcgtgtccctgagccctgtgcagtctgcgcccattggc

SEQ ID NO: 13978 - RNA, 972 nt, synthetic construct
  misc_feature 1..972: note = derived and/or modified CDS sequence (opt5) from CCHFV(SPU103/87)__DQ211634.1__Gn
  source 1..972: mol_type = other RNA
agcgaggaatcctctgacgattgcatcagcagaacccagctgctccggacagagacggccgaaattcacggcgacaactacgggggacccggcgataagatcaccatttgtaatgggtccacaatcgtggaccaacgcctgggatctgagcttggctgctataccattaacagagtcaaaacattcaagctgtgtgaaaatagcgctaccgggaaatcctgcgagatcgattctgttcctgtgaagtgtcggcagggatactgcctcaaaatcacacaggagggccgcggccatgtgaagctgagcagagggtccgaagtcgtgcttgacgcctgtgataccagctgcgaggttatgattccgaagggaacgggcgacatcctggtggattgttctgggggacagcaacactttctcaaagacaacctgattgatctgggctgccccaagatccctctcctggggaaaatggcgatttatatctgtcggatgtccaatcatcccaagaccacaatggctttcctgttttggttcagctttggatacgtcattacctgcgtgctttgcaaagccatcttctatctcctgatcattgttggcacacttggcaagcgcctgaagcagtacagagaactcaaacctcagacctgtacgatctgcgagacaacccccgtgaacgccattgacgctgagatgcacgatctgaattgttcttataacatctgcccttactgtgcctcccggctgacaagcgacgggctcgctcgccatgtcacccagtgcccgaagagaaaagaaaaggtggaggaaaccgagctgtaccttaatctggaacggattccctgggtggtccgcagactcctgcaagtttctgagtccacaggagtggcccttaaacggagctcctggctgatcgtgctcctggtcctgtttacggtgtctctcagccctgttcagtccgcgcccatcagc

SEQ ID NO: 13979 - RNA, 972 nt, synthetic construct
  misc_feature 1..972: note = derived and/or modified CDS sequence (opt5) from CCHFV(SPU415/85)__DQ211635.1__Gn
  source 1..972: mol_type = other RNA
agcgaggaatccgacggcgattgcatctctagaacccagctgctccggacagagacgaccgaaattcacagcgacaactacgggggacccggcgataagatcacaatttgtaatgggtccaccatcgtggaccaacgcctgggatctgagcttggctgctatacaattaacagagtcaagagcttcaagctgtgtgaaaattccgccaccgggaaatcttgcgagatcgatagcacacctgttaagtgtcggcagggattttgcctcaaaatcacccaggagggccgcggccatgtgaagctgtccagagggagcgaaattgtgcttgacgcttgtgattctaactgcgagatcatgattccgaagggaacgggcgacatcctggtcgattgttccgggggacagcaacacttcctcaaagacaatctgattgatctgggctgccccaacatccctctcctggggaagatggccatttacatctgtcggatgagcaatcatcccaaaaccacaatggcgtttcttttctggttttctttcggatatgtgattacctgcatcctgtgcaaggttatcttttacctcctgattgtggctggcacagtcggcaaaaagttcaagcagtatcgcgaacttagacctcagacctgtacgatctgcgagacaattcccgtgaacgccatcgacgccgagatgcacgatctgaattgttcctacaacatctgcccttattgtgctagccggctcacctctgacgggctggcccgccatgttatgcagtgcccgaaaagaaaggaaaaagtggaggaaacagagctgtacctcaatctggaacggattccctgggtcgtgcgcaaacttctgcaagtgtccgagagcaccggagtcgctctcaaaagatcctcttggctgaccgttcttctggtgctcctgatcgtgagcctgtcccctgtccagagcgcccccattggc

SEQ ID NO: 13980 - RNA, 972 nt, synthetic construct
  misc_feature 1..972: note = derived and/or modified CDS sequence (opt5) from CCHFV(Turkey200310849)__DQ211636.1__Gn
  source 1..972: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgaggttgacagcacaccggtgaagtgtcggcagggattttgcctcaaaatcacccaggagggccgcggccatgtgaagctgtccagagggtctgaagtcgtgcttgatgcctgtgacagctcctgcgaggttatgatccccaagggaacgggcgatattctggtggactgtagcgggggacagcaacacttcctcaaagataacctgatcgacctgggctgccctcatattcccctcctggggaagatggcgatctacatttgtcggatgtctaatcaccctcgcaccacaatggcttttcttttctggttttccttcggatatgtcattacctgcatcagctgcaaagccctgttttactctctcatcatcattggcacactgggcaagaaaatcaagcagtatagagaacttaagccccagacctgtacgatttgcgagacagcccctgtgaacgctatcgatgccgagatgcatgacctgaattgttcctacaacatttgcccgtattgtgctagccggctcacctctgacgggctggcccgccacgttacacagtgccccaaaagaaaggaaaaagtggaggaaaccgagctgtacctcaatctggaacggatcccttggatcgtccgcaaacttctgcaagtgtccgagagcaccggagtggcgctcaagagatcctcttggctgattgtccttctggttctcctgacagtgagcctgtcccccgtgcagagcgcccctgtcggc

SEQ ID NO: 13981 - RNA, 972 nt, synthetic construct
  misc_feature 1..972: note = derived and/or modified CDS sequence (opt5) from CCHFV(Kosova Hoti)__EU037902.1__Gn
  source 1..972: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccagaagggccgcggccatgtgaagctgtccagagggtctgaggtggtccttgatgcctgtgacagcaactgcgaagtgatgattcccaaaggaacgggcgatatcctggttgactgttccgggggacagcaacacttcctcaaggataatctgattgacctgggctgccctcatatccccctcctggggaaaatggcgatttacatctgtcggatgagcaaccaccctaagaccacaatggcttttcttttctggttttctttcggatatgtgattacctgcatcttttgcaaagccctgttctactccctcatcattatcggcacactgggcaagaagattaaacagtatcgcgagcttaagccccagacctgtacgatctgcgaaacagcccctgtcaatgctattgatgccgagatgcatgacctgaactgtagctacaatatctgcccgtattgtgcttctagactcacctccgacgggctggcccggcacgtgaaacagtgccccaagcgcaaagagaaggttgaagagacagaactgtacctcaacctggagagaatcccttgggtggtccggaaacttctgcaagtgagcgaatctaccggagtggcgctcaagcgctccagctggctgattgtccttctggttctcctgaccgtgtccctgtctcccgtgcagagcgcccctgtcggc

SEQ ID NO: 13982 - RNA, 972 nt, synthetic construct
  misc_feature 1..972: note = derived and/or modified CDS sequence (opt5) from CCHFV(YL04057)__FJ562094.1__Gn
  source 1..972: mol_type = other RNA
gccgagggcgggagctccgactgcatctctagaacccagctggtgaagacagaagtcgctgagattcacgaagatagctacggaggccccggggagaaaatcacgatttgtaacggatccaccatcgttgaccaacggctcggccgcgaactggggtgctatacaattaatagagtgcggtcttacaaactttgtgagaacagcgcctccggaaagtcttgcgagatcgatagcatccctgtgaagtgtaaacagggcttctgcctgaagattacccaggaaggccgcgggcatgtcaagctctccagaggaacagagatcgtgctggacgtttgtgatagctcttgcgaacttatgattccgaaaggcaccggggacatcctggtggattgttccggaggccagcaacactttctccagaataacctgattgacctggggtgccccaatgtccctctcctgggaaagatggcgatctatgtgtgtcggatgagcaaccatcccaaaacaaccatggctttcctgttttggttctcttttggctacgttattacgtgcatcgcctgccgcgtgcttttctatctcctgatcgccattggcaccgtcgggaagaaacttaagcagtacagagagctgaagcctcagacatgtatcgtgtgcgagtccgtgcccgtcaatgctattgatgccgaaatgcacgagctcaactgtagctataatatctgcccttactgtgcttctcggctgtccaccgacggactgattcgccatgttacacaatgcccgaaaagacgggaaaaggtggaggaaaccgagctctttctgaaccttgagcgcatcccctggctggtgagaaaactcctgcaggtcagcgaatccacgggcatggcccttaagcggtcttgttggatgatcacactgctcattctgctgctcgtgagcatctcccctgttcagagcgcgcccgtgggg

SEQ ID NO: 13983 - RNA, 972 nt, synthetic construct
  misc_feature 1..972: note = derived and/or modified CDS sequence (opt5) from CCHFV(V42/81)__GU477490.1__Gn
  source 1..972: mol_type = other RNA
agcaaggagcccggcgacgattgcatctccagaacccagctgatgcggacagaaacggccgagattcacgacgataactacgggggacctggcgacaaaatcaccatttgtaatgggtctacaatcgtggatcaacgcctcggaagcgaactgggctgctataccattaacagagtcaagtccttcaaactttgtgaaaattctgctacagggaaggcctgcgaggttgacagcaccccggtgaaatgtcggcagggattttgcctgaagatcacacaggagggccgcggccatgtgaagctctccagagggtctgaggtcgtgctggatgcgtgtgacagctcctgcgaagttatgatccccaaaggaaccggcgatattcttgtggactgtagcgggggacagcaacacttcctgaaggataacctcatcgacctggagtgccctcatattcccctgctcggcaaactggctatctacatttgtcggatgtctaatcaccctcgcacgaccatggcctttcttttctggtttgggttcggatatgtcatcacatgcattctgtgcaaggccctcttttactccctgatcatcattggcacccttggcaaaaagatcaagcagtatagagaactgaaaccccagacatgtaccatttgcgagacggctcctgtgaacgccatcgatgctgagatgcatgacctcaattgtagctacaacatttgcccgtattgtgcctctcggctgacatccgacgggctggcgcgccacgttacccagtgccccaagagaaaagaaaaggtggaggaaacagagctctacctgaatcttgaacggatcccttggatcgtccgcaaactgctccaagtgagcgagtctaccggagtggtcctgaagagatccagctggcttattgttctgctcgtgctgctgaccgtgtccctctctcccgtccagagcgcccctgtgggc

SEQ ID NO: 13984 - RNA, 972 nt, synthetic construct
  misc_feature 1..972: note = derived and/or modified CDS sequence (opt5) from CCHFV(Afg09-2990)__HM452306.1__Gn
  source 1..972: mol_type = other RNA
agcgaggaatccggcgacgattgcatctctagaacccagctgctccggacagagacggccgaagtgcacggggacaactacggaggccccggggataagattaccatctgtaatggaagcacagtcgttgaccaacgcctgggctccgagcttgggtgctataccattaacagagtgcggtctttcaaactgtgtgaaaatagcgctacaggaaagtcctgcgagatcgattctattcctgtgaaatgtaagcagggctactgcctcaaaatcacccaggagggccgcgggcatgtcaagctgagcagaggatccgaagtggttcttgacgtgtgtgatagctcttgcgaggtcatgatcccgaagggcacaggggacattctggtggattgttccggaggccagcaacactatctcaaagacaacctggttgatctggggtgccccaagatccctctcctgggaaaaatggccatttacatctgtcggatgagcaatcatcccaagaccacgatggcgtttcttttctggttttctttcggctatgtgattacctgcatcctgtgcaaagctatctttttcctcctgattatctttggcacacttgggaagcgcttcaagcagtacagagaactgaaacctcagacctgtacaatttgcgagaccacgcccgtcaacgccatcgacgccgagatgcacgatctcaattgttcctataacatttgcccttactgtgctagccggctgacatctgacggactggcccgccatgtgacccagtgcccgagacggaaggaaaaagtggaggaaacagagctctacctgaatcttgaacgcatcccctgggtcgttagaaagctgctccaagtgtccgagagcaccggcaccgtgctgaaacggtcctcttggcttattgtcctgctcgtgctgtttacagttagcctgtcccctgtgcagagcgctcccatcggg

SEQ ID NO: 13985 - RNA, 972 nt, synthetic construct
  misc_feature 1..972: note = derived and/or modified CDS sequence (opt5) from CCHFV(Sudan Al-Fulah 3-2008)__HQ378184.1__Gn
  source 1..972: mol_type = other RNA
agcgaggaaccctccgacgattgcatctctagaacccagctgctccggacagagacggccgaaattcacggcgacaactacgggggacctggcgataagatcaccatttgtaatgggagcacaatcgtggaccaacgcctgggatccgagcttggctgctataccattaacagagtcaaatctttcaagctgtgtgaaaatagcgctacagggaaatcctgcgttatcgattctgtgccggtgaagtgtcggcagggatactgcctccgcatcacccaggagggcagaggccatgtcaaactgagccgggggtccgaggtggttcttgacgcctgtgatacaagctgcgaaattatgatccccaagggaaccggcgacattctggtggattgttctgggggacagcaacactttctcaaggacaacctggtcgatctgggctgccctaaaatccccctcctggggaagatggcgatttatatctgtcgcatgtccaatcatcctaaaacgaccatggctttcctgttttggttcagctttggatacgtgattacatgcatcctttgcaaggccatcttctatctcctgattatcattggcacccttggcaaaagatttcggcagtaccgcgagctgaagccccagacatgtaccatctgcgaaacgacacctgttaacgccattgacgctgagatgcacgatctcaattgttcttataacatctgcccgtactgtgcctccagactgaccagcgacgggctggctcggcatgtgacacagtgccccaagcgcaaagagaaggtcgaagagaccgaactctacctgaatcttgagagaatcccttgggtggtgcggaaactgctccaagtctctgaatccaccggagttgccctgaagcgcagctcctggcttattgtgctgctcgtgctgttcacagtctctctgagccccgtgcagtccgcgcctatcggc

SEQ ID NO: 13986 - RNA, 972 nt, synthetic construct
  misc_feature 1..972: note = derived and/or modified CDS sequence (opt5) from CCHFV(Sudan AB1-2009)__HQ378187.1__Gn
  source 1..972: mol_type = other RNA
agcgaggaaccctccgacgattgcatctctagaacccagctgctccggacagagacggccgaaattcacggcgacaactacgggggacctggcgataagatcaccatttgtaatgggagcacaatcgtggaccaacgcctgggatccgagcttggctgctataccattaacagagtcaaatctttcaagctgtgtgaaaatagcgctacagggaaaaactgcgagatcgattccgttccggtgaagtgtcggcagggatactgcctccgcatcacccaggagggcagaggccatgtgaaactgtctcgggggagcgaagtcgtgcttgacgcctgtgatacatcctgcgagattatgatccccaagggaaccggcgacattctggttgattgtagcgggggacagcaacactttctcaaggacaatctgatcgatctgggctgccctaaaattcccctcctggggaagatggcgatctatatttgtcgcatgtctaaccatcctaaaacgaccatggctttcctgttttggttctcctttggataccttatcacatgcatcctctgcaaggccattttctatctgcttatcattatcggcaccctgggcaaaagactcaagcagtaccgggaactgaagccccagacatgtaccatttgcgagacgacacctgtgaatgccatcgacgctgagatgcacgatctgaactgtagctataatatctgcccgtactgtgcctctcgcctcacctccgacgggctggctagacatgtcattcagtgccccaaacggaaggaaaaagtggaggaaacagagctttacctgaacctcgaacgcatcccttgggttgtgagaaagctgcttcaagtcagcgagtctaccggagtggccctgaaacggtccagctggctcattgtgctgctggtcctctttaccgtttccctgtctcccgtgcagagcgcgcctatcggc

SEQ ID NO: 13987 - RNA, 972 nt, synthetic construct
  misc_feature 1..972: note = derived and/or modified CDS sequence (opt5) from CCHFV(NIVA 118595)__JN572083.1__Gn
  source 1..972: mol_type = other RNA
agcgaggaatccggcgacgattgcatctctagaacccagctgctccggacagagacggccgaagtgcacggggacaactacggaggccccggggataagattaccatctgtaatggaagcacagtcgttgaccaacgcctgggctccgagcttgggtgctataccattaacagagtgaaatctttcaagctgtgtgaaaatagcgctacaggaaaatcctgcgagatcgattctattcctgtgaagtgtcggcagggctactgcctcaaaatcacccaggagggccgcgggcatgtcaagctgagcagaggatccgaagtggttcttgacgcctgtgatagctcttgcgaggtgatgatcccgaagggcacaggggacattctggtcgattgttccggaggccagcaacactttctcaaagacaacctgatcgatctggggtgccccaagattcctctcctgggaaaaatggcgatctatatttgtcggatgagcaatcatcccaagaccacgatggctttcctgttttggttctcttttggctacgtgattacctgcatcctttgcaaagttatcttctatctcctgatcatttttggcacacttgggaagcgcttcaagcagtacagagaactgaaacctcagacctgtacaatctgcgagaccacgcccgtgaacgccattgacgccgagatgcacgatctcaattgttcctataacatctgcccttactgtgctagccggctgacatctgacggactggcccgccatgtcacccagtgcccgaagagaaaagaaaaggtggaggaaacagagctctacctgaatcttgaacggattccctgggtggtccgcaaactgctccaagtttccgagagcaccggcatcgctctgaagagatcctcttggcttatcgtgctgctcgtgctgtttaccgtcagcattacacctgtgcagtccgcccccatcggg

SEQ ID NO: 13988 - RNA, 972 nt, synthetic construct
  misc_feature 1..972: note = derived and/or modified CDS sequence (opt5) from CCHFV(SCT ex Afghanistan)__KC344856.1__Gn
  source 1..972: mol_type = other RNA
agcgaggaatccggcgacgattgcatctctagaacccagctgctccggacagagacggccgaagtgcacaacgacaattacgggggacccggcgataagattaccatctgtaacgggagcacaattgtcgaccaacgcctgggatccgagcttggctgctataccatcaatagagttaaatctttcaagctgtgtgaaaacagcgctacagggaaatcctgcaagattgattctacccctgtgaaatgtcggcagggattttgcctcaagatcacacaggagggccgcggccatgtgaagctgagcagagggtccgaggtcgtgcttgacgcctgtgatagctcttgcgaaatcatgattccgaaaggaaccggcgacatcctggttgattgttccgggggacagcaacacttcctcaaggacaatctgattgatctgggctgccccaacatccctctcctggggaaaatggcgatttacatctgtcggatgagcaatcatcccaagacgaccatggcttttcttttctggttttctttcggatatgtgattacatgcatcttttgcaaagtcatcttctacctgctcattgtggttggcaccctgggcaagaagtttaaacagtatcgcgagcttaagcctcagacatgtaccatctgcgaaacgacacccaccaacgccattgacgccgagatgcacgatctgaattgttcctacaacatctgcccttattgtgctagcagactcacatctgacgggctggcccggcatgtgacccagtgcccgaaacgcaaggagaaagtcgaagagaccgaactgtacctcaatctggagcggattccctggatcgtgagaaaacttctgcaagtgtccgaaagcacaggagtcgctctcaagcgctcctcttggctgatcgttcttctggtgctcctgacggtgagcctgtcccctgtccagagcgcccccattggc

SEQ ID NO: 13989 - RNA, 972 nt, synthetic construct
  misc_feature 1..972: note = derived and/or modified CDS sequence (opt5) from CCHFV(Zahedan 2007)__KC867273.1__Gn
  source 1..972: mol_type = other RNA
agcgaggaatccggcgacgattgcatctctagaacccagctgctccggacagagacggccgaagtgcacggggacaactacggaggccccggggataagattaccatctgtaatggaagcacagtcgttgaccaacgcctgggctccgagcttgggtgctataccattaacagagtgcggtctttcaaactgtgtgaaaatagcgctacaggaaagtcctgcgagatcgattctattcctgtgaaatgtaagcagggcttttgcctcaaaatcacccaggagggccgcgggcatgtcaagctgagcagaggatccgaagtggttcttgacgtgtgtgatagctcttgcgaggtcatgatcccgaagggcacaggggacattctggtggattgttccggaggccagcaacacttcctcaaagacaacctggttgatctggggtgccccaagatccctctcctgggaaaaatggccatttacatctgtcggatgagcaatcatcccaagaccacgatggcgtttcttttctggttttctttcggctatgtgattacctgcatcctgtgcaaagctatctttttcctcctgattatctttggcacacttgggaagcgcttcaagcagtacagagaactgaaacctcagacctgtacaatttgcgagaccacgcccgtcaacgccatcgacgccgagatgcacgatctcaattgttcctataacatttgcccttactgtgctagccggctgacatctgacggactggcccgccatgtgacccagtgcccgagacggaaggaaaaagtggaggaaacagagctctatctgaatcttgaacgcatcccctgggtcgttagaaagctgctccaagtgtccgagagcaccggcaccgtgctgaaacggtcctcttggcttattgtcctgctcgtgctgtttacagttagcctgtcccctgtgcagagcgctcccatcggg

SEQ ID NO: 13990 - RNA, 972 nt, synthetic construct
  misc_feature 1..972: note = derived and/or modified CDS sequence (opt5) from CCHFV(SPU 44/08)__KJ682805.1__Gn
  source 1..972: mol_type = other RNA
agcgaggaatccaacgacgattgcctgtctagaacccagctcctgcggacagagaatgccgaaatccacagcgacaactacggcgggcccggagataagattacgatctgtaatggctccaccattgtggaccaacgccttgggtctgagctgggatgctatacaatcaacagagtcaagagcttcaaactctgtgaaaattccgctaccggcaaatcttgcgagattgatagcacacctgttcggtgtcgccaggggttttgcctgaagatcacccaggagggaagaggccatgtgaaactttcccggggcagcgaagtggtcctggacgcctgtgattcttcctgcgagatcatgattccgaaggggacaggagacatcctcgtggattgtagcggcgggcagcaacacttcctgaaggacaacctggttgatctcggatgccccaatattcctctgcttggcaaaatggcgatctacatttgtcgcatgtctaaccatcccaagaccacgatggcttttctgttctggttttccttcgggtatgtgattacctgcatcctctgcaaagccatcttttacctgcttatcgtcgtgggaacactgggcaagaaattcaagcagtatagagaactcaagcctcagacctgtacaatttgcgagaccaatcccgttaacgccatcgacgctgagatgcacgatctgaattgtagctacaacatttgcccttattgtgcctctcggctgacgtccgacggcctcgctcgccatgtgatgcagtgcccgaaaagaaaggagaaaatcgaagaaacagagctgtaccttaatctggaacggattccctgggtcgtgcgcaagctcctgcaagtgagcgagtccaccggggtcgcccttaaaagatctagctggctggttatcctcctggtgctgctcacagtgtccctgagccctgtccagtctgcgcccatctcc

SEQ ID NO: 13991 - RNA, 972 nt, synthetic construct
  misc_feature 1..972: note = derived and/or modified CDS sequence (opt5) from CCHFV(SPU 383/87)__KJ682806.1__Gn
  source 1..972: mol_type = other RNA
agcgaggaatccaacgacgattgcctgtctagaacccagctcctgcggacagagaatgccgaaatccacagcgacaactacggcgggcccggagataagattacgatctgtaatggctccaccattgtggaccaacgccttgggtctgagctgggatgctatacaatcaacagagtcaagagcttcaaactctgtgaaaattccgctaccggcaaatcttgcgagattgatagcacacctgttcggtgtcgccaggggttttgcctgaagatcacccaggagggaagaggccatgtgaaactttcccggggcagcgaagtggtcctggacgcctgtgattcttcctgcgagatcatgattccgaaggggacaggagacatcctcgtggattgtagcggcgggcagcaacacttcctgaaggacaacctggttgatctcggatgccccaatattcctctgcttggcaaaatggcgatctacatttgtcgcatgtctaaccatcccaagaccacgatggcttttctgttctggttttccttcgggtatgtgattacctgcatcctctgcaaagtcatcttttacctgcttgtggttgtgggaacactgggcaagaaattcaagcagtatagagaactcaagcctcagacctgtacaatctgcgagaccaatcccgtcaacgccattgacgccgagatgcacgatctgaattgtagctacaacatctgcccttattgtgcttctcggctgacgtccgacggcctcgcccgccatgtgattcagtgcccgaaaagaaaggagaaaatcgaagaaacagagctgtaccttaatctggaacggattccctgggtggtccgcaagctcctgcaagttagcgagtccaccggggtggctcttaaaagatctagctggctggtgatcctcctggtcctgctcacagtgtccctgagccctgttcagtctgcccccatctcc

SEQ ID NO: 13992 - RNA, 972 nt, synthetic construct
  misc_feature 1..972: note = derived and/or modified CDS sequence (opt5) from CCHFV(SPU 130/89)__KJ682807.1__Gn
  source 1..972: mol_type = other RNA
agcgaggaacccaactacgactgcctgtccagaacccagctcctgcggacagagaatgccgaaatccactctgataactatggcgggcctggagacaagattacgatctgtaatggcagcaccattgtggatcaacgccttgggtccgagctgggatgctacacaatcaacagagtcaaatctttcaagctctgtgaaaatagcgctaccggcaaatcctgcgagattgactctacaccggttcggtgtcgccaggggttttgcctgaagatcacccaggagggaagaggccatgtgaaacttagccggggctccgaagtggtcctggatgcctgtgacagctcttgcgagatcatgattcccaaggggacaggagatatcctcgtggactgttccggcgggcagcaacacttcctgaaggataacctggttgacctcggatgccctaatattcccctgcttggcaaaatggcgatctatatttgtcgcatgagcaaccatcctaagaccacgatggcttttctgttctggttttctttcgggtacgtgattacctgcatcctctgcaaagtcatcttttatctgcttatcgtggttggaacactgggcaagaaattcaagcagtacagagaactcaagccccagacctgtacaatttgcgagaccaatcctgtgaacgccatcgatgccgagatgcacgacctgaattgttcctataacatttgcccgtactgtgctagccggctgacgtctgatggcctcgcccgccatgtcatgcagtgccccaaaagaaaggagaaaatcgaagaaacagagctgtaccttaatctggaacggattccttgggtggtgcgcaagctcctgcaagtctccgagagcaccggggttgctcttaaaagatcctcttggctggtggtgctcctggtcctgctcacagtgagcctgtcccccgttcagagcgcccctatctct

SEQ ID NO: 13993 - RNA, 972 nt, synthetic construct
  misc_feature 1..972: note = derived and/or modified CDS sequence (opt5) from CCHFV(SPU 497/88)__KJ682808.1__Gn
  source 1..972: mol_type = other RNA
agcgaggaatccaacgacgattgcctgtctagaacccagctcctgcggacagagaatgccgaaatccacagcgacaactacggcgggcccggagataagattacgatctgtaatggctccaccattgtggaccaacgccttgggtctgagctgggatgctatacaatcaacagagtcaagagcttcaagctctgtgaaaattccgctaccggcaaatcttgcgagattgatagcacacctgttcggtgtcgccaggggttttgcctgaagatcacccaggagggaaaaggccatgtgaaactttccagaggcagcgaagtggtcctggacgcctgtgattcttcctgcgagatcatgattccgaaggggacaggagacatcctcgtggattgtagcggcgggcagcaacacttcctgaaagacaacctggttgatctcggatgccccaatattcctctgcttggcaagatggcgatctacatttgtcggatgtctaaccatcccaaaaccacgatggtgtttctgttctggttttccttcgggtatgtcattacctgcattctctgcaaggtgatcttttacctgcttatcgttgtgggaacactgggcaaaaagttcaagcagtatcgcgaactcaaacctcagacctgtacaatttgcgagaccaatcccgtcaacgctatcgacgccgagatgcacgatctgaattgtagctacaacatttgcccttattgtgcctctagactgacgtccgacggcctcgctcggcatgtgatgcagtgcccgaagcgcaaagaaaagatcgaggaaacagagctgtaccttaatctggaaagaatcccctgggtggtccggaaactcctgcaagttagcgagtccaccggggtggcccttaagcgctctagctggctggtgatcctcctggtcctgctcacagtgtccctgagccctgttcagtctgctcccatctcc

SEQ ID NO: 13994 - RNA, 972 nt, synthetic construct
  misc_feature 1..972: note = derived and/or modified CDS sequence (opt5) from CCHFV(SPU 18/88)__KJ682810.1__Gn
  source 1..972: mol_type = other RNA
agcgaggaatccaacgacgattgcctgtctagaacccagctcctgcggacagagaatgccgaaatccacagcgacaactacggcgggcccggagataagattacgatctgtaatggctccaccattgtggaccaacgccttgggtctgagctgggatgctatacaatcaacagagtcaagagcttcaaactctgtgaaaattccgctaccggcaaatcttgcgagattgatagcacacctgttcggtgtcgccaggggttttgcctgaagatcacccaggagggaagaggccatgtgaaactttcccggggcagcgaagtggtcctggacgcctgtgattcttcctgcgagatcatgattccgaaggggacaggagacatcctcgtggattgtagcggcgggcagcaacacttcctgaaggacaacctggttgatctcggatgccccaatattcctctgcttggcaaaatggcgatctacatttgtcgcatgtctaaccatcccaagaccacgatggggtttctgttctggttttccttcggatatgtgattacctgcatcctctgcaaagtcatcttttacctgcttatcgtggttggcacactgggcaagaaattcaagcagtatagagaactcaagcctcagacctgtacaatttgcgagaccaatcccgtgaacgctatcgacgccgagatgcacgatctgaattgtagctacaacatttgcccttattgtgcctctcggctgacgtccgacgggctcgctcgccatgtcatgcagtgcccgaaaagaaaggagaaaatcgaagaaacagagctgtaccttaatctggaacggattccctgggtggtgcgcaagctcctgcaagtcagcgagtccaccggagttgcccttaaaagatctagctggctggtgatcctcctggtgctgctcacagtctccctgagccctgtgcagtctgctcccatctcc

SEQ ID NO: 13995 - RNA, 972 nt, synthetic construct
  misc_feature 1..972: note = derived and/or modified CDS sequence (opt5) from CCHFV(SPU 48/90)__KJ682813.1__Gn
  source 1..972: mol_type = other RNA
agcgaggaaccctccgacgattgcatctctagaacccagctgctccggacagagacggccgaaattcacggcgacaactacgggggacctggcgataagatcaccatttgtaatgggagcacaatcgtggaccaacgcctgggatccgagcttggctgctataccattaacagagtcaaatctttcaagctgtgtgaaaatagcgctacagggaaatcctgcgttatcgattctgtgccggtgaagtgtcggcagggatactgcctccgcatcacccaggagggcagaggccatgtcaaactgagccgggggtccgaggtggttcttgacgcctgtgatacaagctgcgaaattatgatccccaagggaaccggcgacattctggtggattgttctgggggacagcaacactttctcaaggacaacctgatcgatctgggctgccctaaaattcccctcctggggaagatggcgatctatatttgtcgcatgtccaatcatcctacgaccacaatggctttcctgttttggttcagctttggatacgtcattacctgcatcctttgcaaagccattttctatctcctgatcattatcggcacacttggcaagagatttcggcagtaccgcgagctgaaaccccagacctgtacgatttgcgaaacaacccctgtgaacgccatcgacgctgagatgcacgatctcaattgttcttataacatctgcccgtactgtgcctccagactgacaagcgacgggctggctcggcatgttacccagtgccccaagcgcaaggagaaagtggaagagaccgaactctacctgaatcttgagagaatcccttgggtcgtgcggaagctgctccaagtgtctgaatccacaggagtcgccctgaaacgcagctcctggcttatcgttctgctcgtgctgttcacggtgtctctgagccccgtccagtccgcgcctattggc

SEQ ID NO: 13996 - RNA, 972 nt, synthetic construct
  misc_feature 1..972: note = derived and/or modified CDS sequence (opt5) from CCHFV(SPU 187/90)__KJ682814.1__Gn
  source 1..972: mol_type = other RNA
agcgaggaaccctccgacgattgcatctctagaacccagctgctccggacagagacggccgaaattcacggcgacaactacgggggacctggcgataagatcaccatttgtaatgggagcacaatcgtggaccaacgcctgggatccgagcttggctgctataccattaacagagtcaaatctttcaagctgtgtgaaaatagcgctacagggaaatcctgcgagatcgattctgttccggtgaagtgtcggcagggatactgcctccgcatcacccaggagggcagaggccatgtgaaactgagccgggggtccgaagtcgtgcttgacgcctgtgatacaagctgcgagattatgatccccaagggaaccggcgacattctggttgattgttctgggggacagcaacactttctcaaggacaacctgatcgatctgggctgccctaaaattcccctcctggggaagatggcgatctatatttgtcgcatgtccaatcatcctaaaacgaccatggctttcctgttttggttcagctttggatacgtgatcacatgcatcctttgcaaggccattttctatctcctgatcattatcggcacccttggcaaaagatttaagcagtaccgggaactgaagccccagacatgtaccatttgcgagacgacacctgtcaacgccatcgacgctgagatgcacgatctcaattgttcttataacatctgcccgtactgtgcctcccgcctgaccagcgacgggctggctagacatgtgacacagtgccccaaacggaaggaaaaagttgaggaaaccgagctctacctgaatcttgaacgcattccttgggtggtcagaaagctgctccaagtgtctgagtccaccggagtggccctgaaacggagctcctggcttatcgtcctgctcgttctgttcacagtgtctctgagccccgtgcagtccgcgcctattggc

SEQ ID NO: 13997 - RNA, 972 nt, synthetic construct
  misc_feature 1..972: note = derived and/or modified CDS sequence (opt5) from CCHFV(Haskovo-V46/13)__KR092379.1__Gn
  source 1..972: mol_type = other RNA
agcgaggaactgggcgacgattgcatctccagaacccagctcctgcggacagagacggccgaaattcacgacgataactacgggggacccggcgacaagatcaccatttgtaatgggtctacaatcgtggatcaacgccttggaagcgagctgggctgctataccattaacagagggaaatccttcaagctctgtgaaaattctgctacaggaaaaacctgcgagatcgacagcacacctgtcaagtgtcggcagggcttttgcctgaaaatcacccaggagggccgcgggcatgttaaactttccagaggatctgaagtggtgctggatgcctgtgacagctcctgcgaggtcatgattccgaagggcacgggggatatcctcgtggactgtagcggaggccagcaacacttcctgaaggataacctgattgacctcgggtgcccccatatccctctgcttggaaagatggcgatttacatctgtcggatgtctaatcacccccgcaccacaatggcttttctgttctggttttccttcggctatgttattacctgcatcttttgcaaagccctcttctacagcctgatcattatcggcacacttgggaagaaaattaagcagtatagagaactgaagcctcagacctgtacgatctgcgagacaacccccgtgaacgccattgatgctgagatgcatgacctcaattgttcttacaacatctgcccttattgtgcctcccggctgacaagcgacggactggctcgccacgtcacccagtgcccgaaaagaaaggaaaaagtggaggaaaccgagctctacctgaatcttgaacggatcccctggattgttcgcaagctgctccaagtgtctgagtccacaggcgtcgccctgaaaagaagctcctggcttatcgtgctgctcgtgctgctgcctgtctctctcagccccgttcagtccgcgcctgtgggg

SEQ ID NO: 13998 - RNA, 972 nt, synthetic construct
  misc_feature 1..972: note = derived and/or modified CDS sequence (opt5) from CCHFV(24-R-2012)__KR814856.1__Gn
  source 1..972: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacacgagctgcgaggtgatgattcccaagggaaccggcgatatcctggttgactgttccgggggacagcaacacttcctcaaagataacctgattgacctgggctgccctcatatccccctcctggggaagatggcgatttacatctgtcggatgagcaatcaccctcgcacaaccatggcttttcttttctggttttctttcggatatgtgattacatgcatcttttgcaaagccctgttctactccctcatcattatcggcaccctgggcaagaaaattaagcagtatagagaacttaagccccagacgtgtacaatctgcgagaccgcccctgtcaacgctattgatgccgagatgcatgacctgaattgtagctacaacatctgcccgtattgtgcttctcggctcacatccgacgggctggcccgccacgtgccccagtgccctaaaagaaaggaaaaagttgaggaaaccgagctgtacctcaatctggaacggatcccctggattgtgcgcaaacttctgcaagtcagcgagtctaccggagtggcgctcaagagatccagctggctgatcgtgcttctggtcctcctgacagtttccctgtctcctgtgcagagcgcccccgtgggc

SEQ ID NO: 13999 - RNA, 972 nt, synthetic construct
  misc_feature 1..972: note = derived and/or modified CDS sequence (opt5) from CCHFV(36-ST-2014)__KR814857.1__Gn
  source 1..972: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgcctgtgacagctcctgcgagattatgatccccaaaggaacgggcgatattctggtggactgtagcgggggacagcaacacttcctcaaggataacctgatcgacctgggctgccctcatattcccctcctggggaaaatggcgatctacatttgtagaatgtctaatcaccctcggaccacaatggcttttcttttctggttttccttcggatatgttattacctgcatcttttgcaaggccctgttctacagcctcattatcattggcacactgggcaaaaagatcaagcagtatcgcgaacttaaaccccagacctgtacgatttgcgagacagcccctgtgaacgctatcgatgccgagatgcatgacctgaattgttcttacaacatctgcccgtattgtgcttccagactcaccagcgacgggctggcccggcacgtcacacagtgccccaagcgcaaagaaaaggtggaggaaaccgagctgtacctcaatctggaaagaatcccttggatcgttcggaaacttctgcaagtgtctgagtccaccggagtcgcgctcaagcgcagctcctggctgattgtgcttctggtgctcctgacagtctctctgagccccgttcagtccgcccctgtgggc

SEQ ID NO: 14000 - RNA, 972 nt, synthetic construct
  misc_feature 1..972: note = derived and/or modified CDS sequence (opt5) from CCHFV(44-ST-2010)__KR814859.1__Gn
  source 1..972: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgcctgtgacagctcctgcgagattatgatccccaaaggaacgggcgatattctggtggactgtagcgggggacagcaacacttcctcaaggataacctgatcgacctgggctgccctcatattcccctcctggggaaaatggcgatctacatttgtagaatgtctaatcaccctcggaccacaatggcttttcttctgtggttctcctttggatatgttattacctgcatcttctgcaaggccctcttttacagcctgattatcattggcacacttggcaaaaagatcaagcagtatcgcgaactgaaaccccagacctgtacgatttgcgagacagcccctgtgaacgctatcgatgccgagatgcatgacctcaattgttcttacaacatctgcccgtattgtgcttccagactgaccagcgacgggctggcccggcacgtcacacagtgccccaagcgcaaagaaaaggtggaggaaaccgagctctacctgaatcttgaaagaatcccttggatcgttcggaaactgctccaagtgtctgagtccaccggagtcgcgctgaagcgcagctcctggcttattgtgctgctcgtgctgctgacagtctctctcagccccgttcagtccgcccctgtgggc

SEQ ID NO: 14001 - RNA, 972 nt, synthetic construct
  misc_feature 1..972: note = derived and/or modified CDS sequence (opt5) from CCHFV(47-ST-2013)__KR814861.1__Gn
  source 1..972: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtaaaaattctgctacagggaagacctgcgaaatcgacagcacaccggttaagtgtagacagggattttgcctcaagatcacccaggagggccggggccatgtgaaactgtcccgcgggtctgaggtggtccttgatgcctgtgacagctcctgcgaaattatgatccccaagggaacgggcgatattctggtggactgtagcgggggacagcaacacttcctcaaagataacctgatcgacctgggctgccctcatattcccctcctggggaagatggcgatctacatttgtagaatgtctaatcaccctcggaccacaatggcttttcttttctggttttccttcggatatgttattacctgcatcttttgcaaagccctgttctacagcctcattatcattggcacactgggcaagaagatcaaacagtatcgcgagcttaagccccagacctgtacgatttgcgaaacagcccctgtgaacgctatcgatgccgagatgcatgacctgaattgttcttacaacatctgcccgtattgtgcttccagactcaccagcgacgggctggcccggcacgtcacacagtgccccaaacgcaaggagaaagtggaagagaccgaactgtacctcaatctggagagaatcccttggatcgttcggaaacttctgcaagtgtctgaatccaccggagtcgcgctcaagcgcagctcctggctgattgtgcttctggtgctcctgacagtctctctgagccccgttcagtccgcccctgtgggc

SEQ ID NO: 14002 - RNA, 972 nt, synthetic construct
  misc_feature 1..972: note = derived and/or modified CDS sequence (opt5) from CCHFV(52-R-2014)__KR814862.1__Gn
  source 1..972: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacacgagctgcgaggtgatgattcccaagggaaccggcgatatcctggttgactgttccgggggacagcaacacttcctcaaagataacctgattgacctgggctgccctcatgtgcccctcctggggaagatggcgatctacatttgtcggatgagcaatcaccctcgcacaaccatggcttttcttttctggttttctttcggatatgtcatcacatgcatcttttgcaaagccctgttctactccctcattatcattggcaccctgggcaagaaaatcaagcagtatagagaacttaagccccagacgtgtacaatttgcgagaccgcccctgtgaacgctatcgatgccgagatgcatgacctgaattgtagctacaacatttgcccgtattgtgcttctcggctcacatccgacgggctggcccgccacgttccccagtgccctaaaagaaaggaaaaagtggaggaaaccgagctgtacctcaatctggaacggatcccctggatcgtccgcaaacttctgcaagtgagcgagtctaccggagtggcgctcaagagatccagctggctgattgtccttctggttctcctgacagtgtccctgtctcctgtgcagagcgcccccgtcggc

SEQ ID NO: 14003 - RNA, 972 nt, synthetic construct
  misc_feature 1..972: note = derived and/or modified CDS sequence (opt5) from CCHFV(75-R-2012)__KR814863.1__Gn
  source 1..972: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcgccccggttaagtgtcggcagggattttgcctcaaaatcacacaggagggccgcggccatgtgaagctgtccagagggtctgaagtggtccttgatgcgtgtgacagctcctgcgaggtgatgattcccaagggaaccggcgatatcctggttgactgtagcgggggacagcaacacttcctcaaagataacctgattgacctgggctgccctcatatccccctcctggggaagatggctatttacatctgtcggatgtctaatcaccctcgcacgaccatggcctttcttttctggttttccttcggatatgtgattacatgcatcttttgcaaagccctgttctacagcctcatcattatcggcaccctgggcaagaaaattaagcagtatagagaacttaagccccagacatgtaccatctgcgagacggctcctgtcaacgccattgatgctgagatgcatgacctgaattgttcttacaacatctgcccgtattgtgcctcccggctcacaagcgacgggctggcgcgccacgtgccccagtgccctaaaagaaaggaaaaagttgaggaaaccgagctgtacctcaatctggaacggatcccctggattgtgcgcaaacttctgcaagtctctgagtccacaggagtggccctcaagagaagctcctggctgatcgtgcttctggtcctcctgaccgtttctctgagccctgtgcagtccgctcccgtgggc

SEQ ID NO: 14004 - RNA, 972 nt, synthetic construct
  misc_feature 1..972: note = derived and/or modified CDS sequence (opt5) from CCHFV(75-ST-2010)__KR814864.1__Gn
  source 1..972: mol_type = other RNA
agcgaggaatccggcgacgattgcatctctagaacccagctgctccggacagagacggccgaaattcacgacgataactacgggggacccggcgacaagatcaccatttgtaatgggagcacaatcgtggatcaacgcctgggatccgagcttggctgctataccattaacagagtcaaatctttcaagctgtgtgaaaatagcgctacagggaaaacctgcgagatcgactccacacctgttaagtgtcggcagggattttgcctcaaaatcacccaggagggccgcggccatgtgaagctgtctagagggagcgaagtggtccttgatgcctgtgactccagctgcgaggtgatgattccgaagggaacgggcgatatcctggttgactgttctgggggacagcaacacttcctcaaagataacctgattgacctgggctgcccccatatccctctcctggggaagatggcgatttacatctgtcggatgtccaatcacccccgcaccacaatggcttttcttttctggtttagcttcggatatgtgattacctgcctgttttgcaaagccctcttctactctctgatcatcattggcacacttggcaagaaaatcaagcagtatagagaactgcggcctcagacctgtacgatttgcgagacagcccccgtcaacgctatcgatgccgagatgcatgacctcaattgttcctacaacatttgcccttattgtgctagccgcctgacctctgacgggctggccagacacgtgccgcagtgccccaagcggaaagaaaaggttgaggaaacagagctctacctgaatcttgaacgcatcccttggatcgtgagaaaactgctccaagtctccgagagcaccggagtggcgctgaagcggtcctcttggcttattgtgctgctcgtcctgctgaccgttagcctctcccccgtgcagagcgcccctgtgggc

SEQ ID NO: 14005 - RNA, 972 nt, synthetic construct
  misc_feature 1..972: note = derived and/or modified CDS sequence (opt5) from CCHFV(3820-ST-2007)__KR814868.1__Gn
  source 1..972: mol_type = other RNA
agcgaggaacccggcgacgattgcatctccagaacccagctgctcaagacagagacggccgaaattcacgacgataactacgggtctcctggagacaaaatcaccatttgtaatggcagcacaatcgtggatcaacggctggggtccgagcttggatgctataccattaaccgcgtcaagtctttcaaactgtgtgaaaatagcgctacaggcaagacctgcgagatcgactccacaccggttaaatgtagacaggggttttgcctcaagatcacccaggagggacggggccatgtgaagctgtctcgcggcagcgaagtggtccttgatgcctgtgactccagctgcgagattatgatccccaaagggacgggagatattctggtggactgttctggcgggcagcaacacttcctcaaggataacctgatcgacctgggatgccctcatattcccctcctgggcaaaatggcgatctacatttgtagaatgtccaatcaccctcggaccacaatggcttttcttttctggtttagcttcgggtatgttattacctgcatcttttgcaaggccctgttctactctctcattatcattggaacactgggcaaaaagatcaagcagtatcgcgaacttaaaccccagacctgtacgatttgcgagacagcccctgtgaacgctatcgatgccgagatgcatgacctgaattgttcctacaacatctgcccgtattgtgctagcagactcacctctgacggcctggcccggcacgtcacacagtgccccaagcgcaaagaaaaggtggaggaaaccgagctgtacctcaatctggaaagaatcccttggatcgttcggaaacttctgcaagtgtccgagagcaccggggtcgcgctcaagcgctcctcttggctgattgtgcttctggtgctcctggccgtcagcctgtcccccgttcagagcgctcctgtggga

SEQ ID NO: 14006 - RNA, 972 nt, synthetic construct
  misc_feature 1..972: note = derived and/or modified CDS sequence (opt5) from CCHFV(4701-ST-2009)__KR814872.1__Gn
  source 1..972: mol_type = other RNA
agcgaggaacccggcgacgattgcatctccagaacccagctgctcaagacagagacggccgaaattcacgacgataactacgggggacctggcgacaaaatcaccatttgtaatgggtctacagtggtcgatcaacggctgggaagcgagcttggctgctataccatcaaccgcgttaagtccttcaaactgtgtgaaaattctgctacagggaagacctgcgagattgacagcacaccggtgaaatgtagacagggattttgcctcaagatcacccaggagggccggggccatgtgaagctgtcccgcgggtctgaagtcgtgcttgatgcctgtgacagctcctgcgagatcatgattcccaaaggaacgggcgatatcctggttgactgtagcgggggacagcaacacttcctcaaggataacctgattgacctgggctgccctcatatccccctcctggggaaaatggcgatttacatctgtagaatgtctaatcaccctcggaccacaatggcttttcttttctggttttccttcggatatgtgattacctgcatcttttgcaaggccctgttctacagcctcatcattatcggcacactgggcaaaaagattaagcagtatcgcgaacttaaaccccagacctgtacgatctgcgagacagcccctgtcaacgctattgatgccgagatgcatgacctgaattgttcttacaacatctgcccgtattgtgcttccagactcaccagcgacgggctggcccggcacgtgacacagtgccccaagcgcaaagaaaaggttgaggaaaccgagctgtacctcaatctggaaagaatcccttggattgtgcggaaacttctgcaagtctctgagtccaccggagtggcgctcaagcgcagctcctggctgatcgtgcttctggtcctcctgacagtttctctgagccccgtgcagtccgcccctgtgggc

SEQ ID NO: 14007 - RNA, 972 nt, synthetic construct
  misc_feature 1..972: note = derived and/or modified CDS sequence (opt5) from CCHFV(5170-R-2011)__KR814873.1__Gn
  source 1..972: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgtgtgtgacagctcctgcgagattatgatccccaaaggaacgggcgatattctggttgactgtagcgggggacagcaacacttcctcaaggataacctgatcgacctgggctgccctcatattcccctcctggggaaaatggccatctacatttgtagaatgtctaatcaccctcggaccacaatggcgtttcttttctggttttccttcggatatgtgattacctgcatcttttgcaaggctctgttctacagcctcattatcattggcacactgggcaaaaagatcaagcagtatcgcgaacttaaaccccagacctgtacgatttgcgagacagcccctgtcaacgccatcgatgctgagatgcatgacctgaattgttcttacaacatctgcccgtattgtgcctccagactcaccagcgaagggctggctcggcacgtgacacagtgccccaagcgcaaagagaaggttgaagagaccgaactgtacctcaatctggagagaatcccttggatcgtgcggaaacttctgcaagtctctgagtccaccggagtggccctcaagcgcagctcctggctgattgtgcttctggtcctcctgacagtttctctgagccccgtgcagtccgcgcctgtgggc

SEQ ID NO: 14008 - RNA, 972 nt, synthetic construct
  misc_feature 1..972: note = derived and/or modified CDS sequence (opt5) from CCHFV(200406546-Turkey)__KR864902.1__Gn
  source 1..972: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgtgtgtgacagctcctgcgaggttatgattcccaagggaacgggcgatatcctggtggactgtagcgggggacagcaacacttcctcaaagataacctgattgacctgggctgccctcatgtccccctcctggggcggatggccatctacatttgtcgcatgtctaatcaccctagaaccacaatggcgtttcttttctggttttccttcggatatgtgattacctgcatcttttgcaaggctctgttctacagcctcatcatcattggcacactgggcaaaaagtttaaacagtatcgggaacttaagccccagacctgtacgatctgcgagacagcccctgttaacgccattgatgctgagatgcatgacctgaattgttcttacaacatctgcccgtattgtgcctcccgcctcaccagcgacgggctggctagacacgtgccccagtgccctaagcggaaagaaaaggtcgaggaaacagagctgtacctcaatctggaacgcattccctggatcgtgagaaaacttctgcaagtgtctgagtccaccggagtcgccctcaagcggagctcctggctgatcgttcttctggtgctcctgaccgtgtctctgagccctgtccagtccgcgcccgtgggc

SEQ ID NO: 14009 - RNA, 972 nt, synthetic construct
  misc_feature 1..972: note = derived and/or modified CDS sequence (opt5) from CCHFV(1-CR/HU-2015)__KU161584.1__Gn
  source 1..972: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacagctcctgcgaggtgatgattcccaagggaacgggcgatatcctggttgactgtagcgggggacagcaacacttcctcaaagataacctgattgacctgggctgccctcatatccccctcctggggaagatggcgatttacatctgtcggatgtctaatcaccctcgcaccacaatggcttttcttttctggttttccttcggatatgtgattacctgcatcttttgcaaagccctgttctacagcctcatcattatcggcacactgggcaagaaaattaagcagtatagagaacttaagccccagacctgtacgatctgcgagacagcccctgtcaacgctattgatgccgagatgcatgacctgaattgttcttacaacatctgcccgtattgtgcttcccggctcaccagcgacgggctggcccgccacgtgacacagtgccccaaaagaaaggaaaaagttgaggaaaccgagctgtacctcaatctggaacggatcccttggattgtgcgcaaacttctgcaagtctctgagtccaccggagtggcgctcaagagaagctcctggctgatcgtgcttctggtcctcctgacagtttctctgagccccgtgcagtccgcccctgtgggc

SEQ ID NO: 14010 - RNA, 972 nt, synthetic construct
  misc_feature 1..972: note = derived and/or modified CDS sequence (opt5) from CCHFV(Gaib)__KX013445.1__Gn
  source 1..972: mol_type = other RNA
agcgaggaatcctctgacgattgcatcagcagaacccagctgctccggacagagacggccgaaattcacaacgacaattacggcgggcccggagataagatcaccatttgtaacggctccacaatcgtggaccaacgcctggggtctgagcttggatgctataccattaatagagtcaagagcttcaaactgtgtgaaaactccgctacaggcaaatcttgcgagatcgatagcatccctgttaagtgtcggcaggggttttgcctcaaaattacccaggagggacgcggccatgtgaagctgtccagaggcagcgaagtggtccttgacgcctgtgattcttcctgcgagatcatgattccgaaggggacaggagacatcctggtggattgtagcggcgggcagcaacacttcctcaaagacaatctgattgatctgggatgccccaacatccctctcctgggcaagatggcgatttacatctgtcggatgtctaatcatcccaaaaccacgatggcttttcttttctggttttccttcgggtatgttattacctgcatcttttgcaaggccatcttctacctgctcattatcgtgggaacactgggcaaaaagtttaagcagtatcgcgaacttaaacctcagacctgtacaatttgcgagaccacgcccgtcaacgccatcgacgctgagatgcacgatctgaattgtagctacaacatctgcccttattgtgcctctagactcacatccgacggcctggctcggcatgtggttcactgcccgaagcgcaaagaaaagattgaggaaaccgagctgtacctcaatctggaaagagtgccctgggtcgtgcggaaacttctccaggtgagcgagtccacaggggtcgccctgaagcgctctagctggctgatcgttcttctggtgctcctgaccgtgtccctgagccctgtccaatctgcgcccattgga

SEQ ID NO: 14011 - RNA, 972 nt, synthetic construct
  misc_feature 1..972: note = derived and/or modified CDS sequence (opt5) from CCHFV(Hodzha)__KX013448.1__Gn
  source 1..972: mol_type = other RNA
agcgaggaatccggcgacgattgcatctctagaacccagctgctccggacagagacggccgaaattcacggggacgattacggaggccccggggacaagatcaccatttgtaacggaagcacaatcgtggatcaacgcctgggctccgagcttgggtgctataccattaatagagtcaaatctttcaagctgtgtgaaaacagcgctacaggaaaatcctgcgagatcgactctacccctgttaagtgtcggcagggctactgcctcaaaatcacacaggagggccgcgggcatgtgaagctgagcagaggatccgaagtggtccttgatgcctgtgacagctcttgcgaggtgatgattccgaagggcaccggggatatcctggttgactgttccggaggccagcaacactttctcaaagataatctgattgacctggggtgcccccggatccctctcctgggaaagatggcgatttatatctgtcgcatgagcaaccatcccgaaacgaccatggctttcctgttttggttctcttttggctacgtgattacatgcatcctttgcaaagccatcttctatctcctgattatcgtcggcacccttgggaagagatttaaacagtaccgggagctgaagcctcagacatgtaccatttgcgagacgacacccgccaatgctatcgatgccgaaatgcacgacctcaactgttcctataatatttgcccttactgtgctagccgcctgacctctgacggactggccagacatgtgacacagtgcccgaagcggaaagagaaggttgaagagaccgaactctacctgaaccttgagcgcatcccctggatcgtgagaaaactgctccaagtctccgagagcaccggcgtggcgctgaagcggtcctcttggcttattgtgctgctcgtcctgttcgccgttagcctgtcccctgtgcagagcgctcccatcggg

SEQ ID NO: 14012 - RNA, 972 nt, synthetic construct
  misc_feature 1..972: note = derived and/or modified CDS sequence (opt5) from CCHFV(IbAn7620)__KX013451.1__Gn
  source 1..972: mol_type = other RNA
agcgaggaaccctccgacgattgcatctctagaacccagctgctccggacagagacggccgaaattcacggcgacaactacgggggacctggcgataagatcaccatttgtaatgggagcacaatcgtggaccaacgcctgggatccgagcttggctgctataccattaacagagtcaaatctttcaagctgtgtgaaaatagcgctacagggaaaaactgcgagatcgattccgttccggtgaagtgtcggcagggatactgcctccgcatcacccaggagggcagaggccatgtgaaactgtctcgggggagcgaaattgtccttgacgcctgtgatacatcctgcgagatcatgattcccaagggaaccggcgacatcctggtggattgtagcgggggacagcaacactttctcaaggacaatctgattgatctgggctgccctaaaatccccctcctggggaagatggcgatttatatctgtcgcatgtctaaccatcctaaaacgaccatggctttcctgttttggttctcctttggatacgttatcacatgcattctttgcaaggccatcttctatctcctgattatcattggcacccttggcaaaagactgaagcagtaccgggaactcaagccccagacatgtaccatctgcgagacgacacctgtgaatgccatcgacgctgagatgcacgatctgaactgtagctataatatttgcccgtactgtgcctctcgcctgacctccgacgggctcgctagacatgtcatccagtgccccaaacggaaggaaaaagtggaggaaacagagctgtaccttaacctggaacgcattccttgggttgtgagaaagctcctgcaagtcagcgagtctaccggagtggcccttaaacggtccagctggctgatcgtgctcctggtcctgtttaccgtttccctctctcccgtgcagagcgcgcctattggc

SEQ ID NO: 14013 - RNA, 972 nt, synthetic construct
  misc_feature 1..972: note = derived and/or modified CDS sequence (opt5) from CCHFV(K128_76)__KX013454.1__Gn
  source 1..972: mol_type = other RNA
agcgacgagtccggcgatgactgcatctctagaacccagctgctccggacagaaacggccgagattcacggggataactacggaggccccggggacaagatcaccatttgtaatggaagcacaatcgtggatcaacgcctgggctccgaacttgggtgctataccattaacagagtcaaatctttcaagctgtgtgagaatagcgctacaggaaaatcctgcgaaatcgactctatccctgttaagtgtcggcagggctactgcctcaaaattacccaggagggccgcgggcatgtgaagctgagcagaggatccgaggtggtccttgatgcctgtgacagctcttgcgaagtgatgatcccgaagggcacaggggatattctggttgactgttccggaggccagcaacactttctcaaagataacctgatcgacctggggtgccccaagattcctctcctgggaaaaatggcgatctatatttgtcggatgagcaatcatcccaagaccacgatggctttcctgttttggttctcttttggctacgtgattacctgcatcgtctgcaaagccatcttctatctgctcatcattgtgggcacactggggaagcgctttaagcagtacagagagcttaaacctcagacctgtacaatctgcgaaaccacgcccacaaacgccattgatgctgagatgcacgacctgaattgttcctataacatctgcccttactgtgccagccggctcacctctgacggactggctcgccatgttacacactgcccgaagagaaaagagaaggtggaagagaccgaactgtacctcaatctggagcggatcccctgggtcgtgcgcaaacttcttcaggtgtccgaaagcaccggcgtcgccctcaagagatcctcttggctgattgttcttctggtcctcttcgcggtgagcctgtcccctgtgcaaagcgcccccatctct

SEQ ID NO: 14014 - RNA, 972 nt, synthetic construct
  misc_feature 1..972: note = derived and/or modified CDS sequence (opt5) from CCHFV(K168_40)__KX013457.1__Gn
  source 1..972: mol_type = other RNA
agcgacgagtccggcgatgactgcatctctagaacccagctgctccggacagaaacggccgagattcacggggataactacggaggccccggggacaagatcaccatttgtaatggaagcacaatcgtggatcaacgcctgggctccgaacttgggtgctataccattaacagagtcaaatctttcaagctgtgtgagaatagcgctacaggaaaatcctgcgaagttgactctatccctgtgaagtgtcggcagggctactgcctcaaaatcacccaggagggccgcgggcatgtgaagctgagcagaggatccgaggtcgtgcttgatgcctgtgacagctcttgcgaagttatgattccgaagggcacaggggatatcctggtggactgttccggaggccagcaacactttctcaaagataacctgattgacctggggtgccccaagatccctctcctgggaaaaatggcgatttatatctgtcggatgagcaatcatcccaagaccacgatggctttcctcttttggttctcttttggctacgtcattacctgcatcgtgtgcaaagccatcttctatctgctcattatcgttggcacactggggaagcgctttaagcagtacagagagcttaaacctcagacctgtacaatttgcgaaaccacgcccacaaacgccatcgatgctgagatgcacgacctgaattgttcctataacatttgcccttactgtgccagccggctcacctctgacggactggctcgccatgtgacacactgcccgaagagaaaagagaaggtcgaagagaccgaactgtacctcaatctggagcggatcccctgggtggtgcgcaaacttctgcaggtctccgaaagcaccggcgttgccctcaagagatcctcttggctgatcgtgcttctggtgcttttcgcggtcagcctgtcccctgtgcaaagcgcccccattggg

SEQ ID NO: 14015 - RNA, 972 nt, synthetic construct
  misc_feature 1..972: note = derived and/or modified CDS sequence (opt5) from CCHFV(K168_125)__KX013460.1__Gn
  source 1..972: mol_type = other RNA
agcgacgagtccggcgatgactgcatctctagaacccagctgctccggacagaaacggccgagattcacggggataactacggaggccccggggacaagatcaccatttgtaatggaagcacaatcgtggatcaacgcctgggctccgaacttgggtgctataccattaacagagtcaaatctttcaagctgtgtgagaatagcgctacaggaaaatcctgcgaagttgactctatccctgtgaagtgtcggcagggctactgcctcaaaatcacccaggagggccgcgggcatgtgaagctgagcagaggatccgaggtcgtgcttgatgcctgtgacagctcttgcgaagttatgattccgaagggcacaggggatatcctggtggactgttccggaggccagcaacactttctcaaagataacctgattgacctggggtgccccaaggtccctctcctgggaaaaatggcgatctatatttgtcggatgagcaatcatcccaagaccacgatggctttcctgttttggttctcttttggctacgtgattacctgcatcgtttgcaaagccatcttctatcttctcatcattgtgggcacactggggaagcgctttaagcagtacagagagcttaaacctcagacctgtacaatctgcgaaaccacgcccacaaacgccattgatgctgagatgcacgacctgaattgttcctataacatctgcccttactgtgccagccggctcacctctgacggactggctcgccatgtcacacactgcccgaagagaaaagagaaggtggaagagaccgaactgtacctcaatctggagcggattccctgggtggtccgcaaacttctgcaggtttccgaaagcaccggcgtggccctcaagagatcctcttggctgatcgtgcttctggtcctcttcgcggtgagcctgtcccctgttcaaagcgcccccatcggg

SEQ ID NO: 14016 - RNA, 972 nt, synthetic construct
  misc_feature 1..972: note = derived and/or modified CDS sequence (opt5) from CCHFV(K229_194)__KX013463.1__Gn
  source 1..972: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgcctgtgacagctcctgcgagattatgatccccaaaggaacgggcgatattctggtggactgtagcgggggacagcaacacttcctcaagggcaacctgatcgatctggggtgccctcatattcccctcctgggaaaaatggcgatctacatttgtagaatgtctaatcaccctcggaccacaatggcttttcttttctggttttccttcggctatgttattacctgcatcttttgcaaggccctgttctacagcctcattatcattggcacactggggaaaaagatcaagcagtatcgcgaacttaaaccccagacctgtacgatttgcgagacagcccctgtgaacgctatcgacgccgagatgcatgatctgaattgttcttacaacatctgcccgtattgtgcttccagactcaccagcgacggactggcccggcacgtcacacagtgccccaagcgcaaagaaaaggtggaggaaaccgagctgtacctcaatctggaaagaatcccttggatcgttcggaaacttctgcaagtgtctgagtccaccggcgtcgcgctcaagcgcagctcctggctgattgtgcttctggtgctcctgacagtctctctgagccccgttcagtccgcccctgtgggg

SEQ ID NO: 14017 - RNA, 972 nt, synthetic construct
  misc_feature 1..972: note = derived and/or modified CDS sequence (opt5) from CCHFV(K315_14)__KX013469.1__Gn
  source 1..972: mol_type = other RNA
agcgaggaacccggcgacgattgcatctccagaacccagctgctcaagacagagacggccgaaattcacgacgataactacgggggacctggcgacaaaatcaccatttgtaatgggtctacagtggtcgatcaacggctgggaagcgagcttggctgctataccatcaaccgcgttaagtccttcaaactgtgtaaaaattctgctacagggaagacctgcgaaattgacagcacaccggtgaagtgtagacagggattttgcctcaagatcacccaggagggccggggccatgtgaaactgtcccgcgggtctgaggtcgtgcttgatgtttgtgacagctcctgcgaaatcatgattcccaagggaacgggcgatatcctggtggactgtagcgggggacagcaacacttcctcaaagataacctgattgacctgggctgccctcatatccccctcctggggaagatggccatttacatctgtagaatgtctaatcaccctcggaccacaatggcgtttcttttctggttttccttcggatatgtcattacctgcatcttttgcaaagctctgttctacagcctcatcattatcggcacactgggcaagaagattaaacagtatcgcgagcttaagccccagacctgtacgatctgcgaaacagcccctgtgaacgccattgatgctgagatgcatgacctgaattgttcttacaacatctgcccgtattgtgcctccagactcaccagcgaggggctggctcggcacgttacacagtgccccaaacgcaaggaaaaagtggaggaaaccgagctgtacctcaatctggaaagaatcccttggattgtccggaaacttctgcaagtgtctgagtccaccggagtggccctcaagcgcagctcctggctgatcgtccttctggttctcctgacagtgtctctgagccccgtgcagtccgcgcctgtcggc

SEQ ID NO: 14018 - RNA, 972 nt, synthetic construct
  misc_feature 1..972: note = derived and/or modified CDS sequence (opt5) from CCHFV(K323_27)__KX013472.1__Gn
  source 1..972: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgcctgtgacagctcctgcgagattatgatccccaaaggaacgggcgatattctggtggactgtagcgggggacagcaacacttcctcaaggataacctgatcgacctgggctgccctcatattcccctcctggggaaaatggcgatctacatttgtagaatgtctaatcaccctcggaccacaatggcttttcttttctggttttccttcggatatgttattacctgcatcttttgcaaggccctgttctacctcctgattatcattggcacacttggcaaaaagatcaagcagtatcgcgaactgaaaccccagacctgtacgatttgcgagacagcccctgtgaacgctatcgatgccgagatgcatgacctcaattgtagctacaacatctgcccgtattgtgcttctagactgacctccgacgggctggcccggcacgtcacacagtgccccaagcgcaaagaaaaggtggaggaaaccgagctctacctgaatcttgaaagaatcccttggatcgttcggaaactgctccaagtgagcgagtctaccggagtcgcgctgaagcgctccagctggcttacagtgctgctcgtgctgctgacggtctccctctctcccgttcagagcgcccctgtgggc

SEQ ID NO: 14019 - RNA, 972 nt, synthetic construct
  misc_feature 1..972: note = derived and/or modified CDS sequence (opt5) from CCHFV(K340_6)__KX013475.1__Gn
  source 1..972: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctacaaccgggaagacatgcgagatcgacagcaccccggttaaatgtagacagggattttgcctcaagatcacgcaggagggccggggccatgtgaagctgtcccgcgggtctgaagtggtccttgatgcttgtgacagctcctgcgagattatgatccccaaaggaaccggcgatattctggtggactgtagcgggggacagcaacacttcctcaaggataacctgatcgacctgggctgccctcatattccccctctcgggaaaatggccatctacatttgtagaatgtctaatcacccccggacaaccatggcgtttctgttctggttttccttcggatatgttatcacatgcatcttttgcaaggctcttttctacagcctgattatcattggcaccctcggcaaaaagatcaagcagtatcgcgaactgaaacctcagacgtgtacaatttgcgagaccgccccggtgaacgccatcgatgctgagatgcatgaccttaattgttcttacaacatctgcccctattgtgcctccagactgacaagcgacgggctcgctcggcacgtcacccagtgccctaagcgcaaagaaaaggtggaggaaaccgagctgtacctgaatctcgaacggattccctggatcgttagaaaactgcttcaagtgtctgagtccacaggagtcgccctgaagcgcagctcctggctcattgtgctgcttgtgctgctcacggtctctctgagccctgttcagtccgcgcccgtgggc

SEQ ID NO: 14020 - RNA, 972 nt, synthetic construct
  misc_feature 1..972: note = derived and/or modified CDS sequence (opt5) from CCHFV(Mamon)__KX013478.1__Gn
  source 1..972: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtcagcgatgcctgtgactccagctgcgaggtgatgattcccaagggaacgggcgatatccttgttgactgttctgggggacagcaacacttcctgaaagataacctcattgacctgggctgccctcatatccccctgctcgggaagatggcgatttacatctgtcggatgtccaatcaccctcgcaccacagtggcttttctgttctggtttagcttcggatatgtcattacctgcatcttttgcaaagcccttttctactctctgatcattatcggcacactcggcaagaaaattaagcagtatagagaactgaagccccagacctgtacgatctgcgagacagcccctgtgaacgctattgatgccgagatgcatgaccttaattgttcctacaacatctgcccgtattgtgctagccggctgacctctgacgggctcgcccgccacgttccccagtgccctaaaagaaaggaaaaagtggaggaaacagagctgtacctgaatctcgaacggatcccctggattgtccgcaagctgcttcaagtgtccgagagcaccggagtggcgctgaaaagatcctcttggctcatcgtcctgcttgttctgctcaccgtgagcctgtcccctgtgcagagcgcccccgtcggc

SEQ ID NO: 14021 - RNA, 972 nt, synthetic construct
  misc_feature 1..972: note = derived and/or modified CDS sequence (opt5) from CCHFV(Nakiwogo)__KX013484.1__Gn
  source 1..972: mol_type = other RNA
gccgagggcgtgagcaacgactgcgtctccagaacccagctgatcaagacagaagttgctgagattcacgaagattcttacgggggacccggcgagaaaatcacgatttgtaatgggagcaccatcgtggaccaacggctcggatccgaactgggctgctatacaattaaccgcgtgaagacctacaaactttgtgaaaattctgccacagagaaggggtgcgagatcgatagcgtccctgtgaaatgtaagcagggattctgcctgaaggttacccaggagggcagaggccatgtgaaactctcccgggggacagaaatcgtcctggacgtgtgtgatacctcttgcgagcttatgattccgaagggaacgggcgacatcctggttgattgtagcgggggacagcaacactttctccaggacaacctgattgatctgggctgccccaatgtgcctctcctggggaaaatggcgatctatatttgtcgcatgtccaaccatcccaagaccacaatggctttcctgttttggttcagctttggatacgtcattacctgcgtggtgtgcaaagtccttttctatctcctgatcgttatcggcacacttggcaagaagctgaaacagtacagagagctcaagcctcagacctgtatcgtgtgcgaatctattcccgtgaatgtcatcgacgccgagatgcacgaactgaactgtaattataacatttgcccttactgtgcctcccggctgacgagcgatgggctcgtgcgccatgttacacaatgcccgaaaagaaaggagaaagtggaagagaccgagctgtaccttaatctggaacggatcccctggctcgtccgcagactgcttcaggtgtctgagtccacaggaatggctctgaagcggagctgttggatgaccaccctcctgattctgctcgttgtgtctctgtcccctgtccagagcgcccccgtgggc

SEQ ID NO: 14022 - RNA, 972 nt, synthetic construct
  misc_feature 1..972: note = derived and/or modified CDS sequence (opt5) from CCHFV(Saf)__KX013487.1__Gn
  source 1..972: mol_type = other RNA
agcgaggaacccggcgacgattgcatctccagaacccagctgctccggacagagacggccgaaattcacgacgataactacgggggacctggcgacaagatcaccatttgtaatgggtctacaatcgtggatcaacgcctgggaagcgagcttggctgctataccattaacagagtcaaatccttcaagctgtgtgaaaattctgctacagggaaaacctgcgagatcgacagcacaccggttaagtgtcggcagggattttgcctcaaaatcacccaggagggccgcggccatgtgaagctgtccagagggtctgaagtggtccttgatgcctgtgacagctcctgcgaggtgatgattcccaagggaacgggcgatatcctggttgactgtagcgggggacagcaacactacctcaaagataacctgattgacctgggctgccctcatatccccctcctggggaagatggcgatttatatctgtcggatgtctaatcaccctcgcaccacaatggctttccttttctggttttcctttggatacgtgattacctgcatcttctgcaaagccctgttttatagcctcatcattatcggcacactgggcaagaaaattaagcagtacagagaacttaagccccagacctgtacgatctgcgagacagcccctgtcaacgctattgatgccgagatgcatgacctgaattgttcttataacatctgcccgtactgtgcttcccggctcaccagcgacgggctggcccgccacgtgccccagtgccctaaaagaaaggaaaaagttgaggaaacagagctgtacctcaatctggaacggatcccctggattgtgcgcaaacttctgcaagtctctgagtccaccggagtggcgctcaagagaagctcctggctgatcgtgcttctggtcctcctgaccgtttctctgagccctgtgcagtccgcccccgtgggc

SEQ ID NO: 14023 - RNA, 972 nt, synthetic construct
  misc_feature 1..972: note = derived and/or modified CDS sequence (opt5) from CCHFV(Ast199)__KX056051.1__Gn
  source 1..972: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgcctgtgacagctcctgcgagattatgatccccaaaggaacgggcgatattctggtggactgtagcgggggacagcaacacttcctcaaggataacctgatcgacctgggctgccctcatattcccctcctggggaaaatggcgatctacatttgtagaatgtctaatcaccctcggaccacaatggcttttcttttctggttttccttcggatatgttattacctgcatcttttgcaaggccctgttctacagcctcattatcattggcacactgggcaaaaagatcaagcagtatcgcgaacttaaaccccagacctgtacgatttgcgagacagcccctgtgaacgctatcgatgccgagatgcatgacctgaattgttcttacaacatctgcccgtattgtgcttccagactcaccagcgacgggctggcccggcacgtcacacagtgccccaagcgcaaagaaaaggtggaggaaaccgagctgtacctcaatctggaaagaatcccttggatcgttcggaaacttctgcaagtgtctgagtccaccggagtcgcgctcaagcgctgtagctggctgattgtgcttctggtgctcctgacagtctccctgtctcccgttcagagcgcccctgtgggc

SEQ ID NO: 14024 - RNA, 972 nt, synthetic construct
  misc_feature 1..972: note = derived and/or modified CDS sequence (opt5) from CCHFV(Ast137)__KX056057.1__Gn
  source 1..972: mol_type = other RNA
agcgaggaacccggcgacgattgcatctccagaacccagctgctcaagacagagacggccgaaattcacgacgataactacgggggacctggcgacaaaatcaccatttgtaatgggtctacaatcgtggatcaacggctgggaagcgagcttggctgctataccattaaccgcgtcaagtccttcaaactgtgtgaaaattctgctacagggaagacctgcgagatcgacagcacaccggttaaatgtagacagggattttgcctcaagatcacccaggagggccggggccatgtgaagctgtcccgcgggtctgaagtggtccttgatgcctgtgacagctcctgcgagattatgatccccaaaggaacgggcgatattctggtggactgtagcgggggacagcaacacttcctcaaggataacctgatcgacctgggctgccctcatattcccctcctggggaaaatggcgatccacatttgtagaatgtctaatcatcctcggaccacaatggcttttcttttctggttttccttcggatacgttattacctgcatcttttgcaaggccctgttctatagcctcattatcattggcacactgggcaaaaagatcaagcagtaccgcgaacttaaaccccagacctgtacgatttgcgagacagcccctgtgaacgctatcgatgccgagatgcacgacctgaattgttcttataacatctgcccgtactgtgcttccagactcaccagcgacgggctggcccggcacgtcacacagtgccccaagcgcaaagaaaaggtggaggaaaccgagctgtatctcaatctggaaagaatcccttggatcgttcggaaacttctgcaagtgtctgagtccaccggagtcgcgctcaagcgcagctcctggctgattgtgcttctggtgctcctgacagtctctctgagccccgttcagtccgcccctgtgggc

SEQ ID NO: 14025 - RNA, 972 nt, synthetic construct
  misc_feature 1..972: note = derived and/or modified CDS sequence (opt5) from CCHFV(Ast133)__KX056060.1__Gn
  source 1..972: mol_type = other RNA
agcgaggaacccgacgatgactgcatctccagaacccagctgctcaagacagagacggccgaaattcacgatgacaactacggcgggcctggagataaaatcaccatttgtaatggctctacaatcgtggaccaacggctggggagcgagcttggatgctataccattaaccgcgtcaagtccttcaaactgtgtgaaaattctgctacaggcaagacctgcgagatcgatagcacaccggttaaatgtagacaggggttttgcctcaagatcacccaggagggacggggccatgtgaagctgtcccgcggctctgaagtggtccttgacgcctgtgatagctcctgcgagattatgatccccaaagggacgggagacattctggtggattgtagcggcgggcagcaacacttcctcaaggacaacctgatcgatctgggatgccctcatattcccctcctgggcaaaatggcgatctacatttgtagaatgtctaatcaccctcggaccacaatggcttttcttttctggttttccttcgggtatgttattacctgcatcttttgcaaggccctgttctacctcctgattatcattggaacacttggcaaaaagatcaagcagtatcgcgaactgaaaccccagacctgtacgatttgcgagacagcccctgtgaacgctatcgacgccgagatgcatgacctcaattgtagctacaacatctgcccgtattgtgcttctagactgacctccgatggcctggcccggcacgtcacacagtgccccaagcgcaaagaaaaggtggaggaaaccgagctctacctgaatcttgaaagaatcccttggatcgttcggaaactgctccaagtgagcgagtctaccggggtcgcgctgaagcgctccagctggcttattgtgctgctcgtgctgctgacagtctccctctctcccgttcagagcgcccctgtggga

SEQ ID NO: 14026 - RNA, 972 nt, synthetic construct
  misc_feature 1..972: note = derived and/or modified CDS sequence (opt5) from CCHFV(SK/2015/human)__KX458183.1__Gn
  source 1..972: mol_type = other RNA
agcgaggaatccggcgacgattgcatctctagaacccggctgctccgcacagagacggccgaaattcacggggacagctacggaggccccggggataagatcaccatttgtaacggatccacaatcgtggaccagagactgggctctgagatggggtgctataccattaatcgggtcaagagcttcaaactttgtgaaaactccgctacaggaaaatcttgcgagatcgatagcatccctgttcgctgtagacaaggctactgcctgaagattacccaggagggccgggggcatgtgaaactctcccgcggaagcgaagtggtcctggacgcctgtgattcttcctgcgaggtgatgatcccgaagggcacaggggacattcttgttgattgtagcggaggccagcagcactttctgaaggacaatctcatcgatctggggtgccccaacattcctctgctcggaaaaatggcgatctatatttgtagaatgtctaatcatcccaagaccacgatggctttcctgttttggttctcctttggctacgtgattacctgcatcctttgcaaagccatcttctatctgctcatcattgtcggcacactggggaagcggtttaaacaataccgcgaacttaagcctcagacctgtacaatctgcgagaccacgcccgccaacgctattgacgccgagatgcacgatctgaattgtagctatacaatctgcccttactgtgcttctagactcacctccgacggactggcccggcatgtgacacagtgcccgaagcgcaaagaaaaggttgaggaaaccgagctgtacctcaacctggaaagaatcccctgggtggtccggaaacttctccaggtgagcgagtccaccggcgtggcgctgaagcgctctagctggctgattgtccttctggttctcttcacagtgtccctgagccctgtgcaatctgcccccatcggg

SEQ ID NO: 14027 - RNA, 972 nt, synthetic construct
  misc_feature 1..972: note = derived and/or modified CDS sequence (opt5) from CCHFV(YL16070)__KY354081.1__Gn
  source 1..972: mol_type = other RNA
gccgagggcgggagctccgactgcatctctagaacccagctggtgaagacagaagtcgctgagattcacgaagatagctacggaggccccggggagaaaatcacgatttgtaacggatccaccatcgttgaccaacggctcggctctgaactggggtgctatacaattaatcgcgtcaagagctacaaactttgtgagaactccgcctctggaaagagctgcgagatcgattccatccctgtgaaatgtaagcagggcttctgcctgaagattacccaggaaggcagagggcatgtgaaactcagccggggaacagagatcgtgctggacgtttgtgattcttcctgcgaacttatgattccgaagggcaccggggacatcctggtggattgtagcggaggccagcaacactttctccagaataacctgattgacctggggtgccccaatgtccctctcctgggaaaaatggcgatctatgtgtgtcgcatgtctaaccatcccaagacaaccatggctttcctgttttggttctcctttggctacgttattacgtgcatcgtgtgcagagtcctgttctatctcctgatcgccattggcaccgtggggaaaaagctgaagcagtaccgggagcttaaacctcagacatgtatcgtgtgcgagagcgtccccgttaatgccattgatgctgaaatgcacgagctcaactgttcttataatatctgcccttactgtgcctcccgcctgagcaccgacggactgattagacatgtgacacaatgcccgaagcggcgcgaaaaagtggaggaaaccgagctctttctgaaccttgagagaatcccctggctggtccggaagctccttcaggtgtccgaatctacgggcatggctcttaaacgcagctgttggatgatcacactgctcattctgctgctcgtttccatgagccctgtgcagtctgcccccgtcggg

SEQ ID NO: 14028 - RNA, 972 nt, synthetic construct
  misc_feature 1..972: note = derived and/or modified CDS sequence (opt5) from CCHFV(UCCR4448)__KY484042.1__Gn
  source 1..972: mol_type = other RNA
agcgaggaaacctccgacgattgcatctctagaacacagctgctccggacggagaccgccgaaattcacggcgacaactacgggggacccggcgataagatcacaatttgtaatgggagcaccatcgtggaccaacgcctgggatccgagcttggctgctatacaattaacagagtcaaatctttcaagctgtgtgaaaatagcgctaccgggaaatcctgcgagatcgattctgttcctgtgaagtgtcggcagggatactgcctccgcatcacacaggagggcagaggccatgtgaaactgagccgggggtccgaagtcgtgcttgacgcctgtgataccagctgcgagattatgatcccgaagggaacgggcgacattctggttgattgttctgggggacagcaacactttctcaaggacaacctgatcgatctgggctgccccaaaattcctctcctggggaagatggcgatctatatttgtcgcatgtccaatcatcccaaaaccacaatggctttcctgttttggttcagctttggatacgtgattacctgcatcctttgcaaggccatcttctatctcctgatcattatcggcacacttggcaaaagatttaagcagtaccgggaactgaagcctcagacctgtacgatttgcgagacaacccccgtcaacgccatcgacgctgagatgcacgatctcaattgttcttataacatctgcccttactgtgcctcccgcctgacaagcgacgggctggctagacatgtgacccagtgcccgaaacggaaggaaaaagttgaggaaaccgagctctacctgaatcttgaacgcattccctgggtggtcagaaagctgctccaagtgtctgagtccacaggagtggccctgaaacggagctcctggcttatcgtcctgctcgttctgttcacgatttctctgagccctgtgcagtccgcgcccatcagc

SEQ ID NO: 14029 - RNA, 972 nt, synthetic construct
  misc_feature 1..972: note = derived and/or modified CDS sequence (opt5) from CCHFV(SPU 45/88)__KJ682809.1__Gn
  source 1..972: mol_type = other RNA
agcgaggaatcctctgacgattgcctgagcagaacccagctcctgcggacagagaacacggaaatccactccgacaattacggcgggcccggagataagattaccatctgtaacggctctacaattgtggaccaacgccttgggagcgagctgggatgctataccatcaatagagtcaaatccttcaagctctgtgaaaactctgccacaggcaaaagctgcgagattgattccacccctgttcggtgtcgccaggggttttgcctgaagatcacacaggagggaagaggccatgtgaaacttagccggggctctgaagtggtcctggacgcttgtgattccagctgcgagatcatgattccgaaggggaccggagacatcctcgtggattgttctggcgggcagcaacacttcctgaaggacaatctggttgatctcggatgccccaacattcctctgcttggcaaaatggccatctacatttgtcgcatgtccaatcatcccaagacgaccatggggtttctgttctggtttagcttcggatatgtgatcacatgcattctctgcaaagtcatcttttacctgcttatcgtggttggcaccctgggcaagaaattcaagcagtatagagaactcaagcctcagacatgtaccatttgcgagacgacacccgtgaacgcgatcgacgctgagatgcacgatctgaattgttcttacaacatttgcccttattgtgcctcccggctgaccagcgacgggctcgcccgccatgtcatgcagtgcccgaaaagaaaggagaaaatcgaagaaacagagctgtaccttaatctggaacggattccctggatcgtgcgcaagctcctgcaagtgtccgagtctaccggagtcgctcttaaaagaagctcctggctggttgtgctcctggtgctgctcaccgtcagcctgtctcctgtgcagtccgcccccatcggc

SEQ ID NO: 14030 - RNA, 1932 nt, synthetic construct
  misc_feature 1..1932: note = derived and/or modified CDS sequence (opt5) from CCHFV(10200)__U39455.2__Gc
  source 1..1932: mol_type = other RNA
ttcctggacagcaccgccaagggcatgaaaaacctccttaattccacatctcttgagacgagcctgtccatcgaagctccctggggagccattaacgtgcagtctacctacaagcctacagtcagcaccgcgaatatcgctctctcctggtctagcgttgagcacagagggaacaaaattctggtgtccggccggagcgaatctatcatgaaacttgaggaacgcacagggatttcctgggatctgggagtggaggacgccagcgagtctaaactcctgaccgtctccgtgatggatctgagccagatgtattctccggtttttgaatacctctccggcgacagacaggtggaggaatggcccaaggccacatgcaccggggattgtcctgagcggtgcggatgtacgagctctacctgcctgcataaggagtggccccactctcgcaattggagatgtaaccctacatggtgctggggcgtcggcaccgggtgtacatgctgtggacttgacgtgaaagatctgttcaccgactatatgtttgttaagtggaaagtggaatacatcaagacggaggctatcgtctgcgtggaactcacaagccaggagcggcagtgttccctgattgaagccggcacccgcttcaatcttgggcccgtgacaatcaccctgagcgagcctagaaacattcaacagaaactcccgcccgagatcattaccctgcatcctcggatcgaagagggatttttcgatctgatgcacgtccagaaggttctctctgcttccacagtgtgcaagctgcagagctgcacgcatggcgtgcccggggaccttcaagtctatcacattggaaatctgctcaaaggcgataaggtgaacggccacctgatccataaaatcgaacctcactttaatacctcttggatgagctgggacgggtgtgatcttgactactattgcaacatgggagactggccctcctgtacatacaccggcgttacacagcataatcacgcctctttcgtgaacctgctcaatattgagaccgattacacgaagaactttcacttccatagcaaacgcgtcacagcgcacggggacaccccgcagctggatctgaaggccagacctacctatggagctggcgaaatcacagtgctcgttgaggtggccgacatggagctgcataccaaaaagattgaaatctccgggcttaagtttgctagcctggcctgcacaggatgttacgcgtgttcttccagcatttcttgcaaagtccggatccacgtggatgagcccgacgaactcacggtccatgtgaagtccgatgaccctgatgttgtggccgctagctcctctctgatggcccgcaaacttgagttcggcaccgacagcacatttaaggctttctccgccatgcccaaaacctctctgtgcttctatatcgtcgaaagagagcactgtaagagctgctccgaggaagatacaaagaaatgtgtgaacaccaagctcgagcagccccaaagcattctgatcgaacacaaaggcacgattatcgggaagcaaaattctacctgcacagccaaggcttcctgctggctggagagcgttaagtcctttttctacggactcaagaacatgctgtccggcatttttgggaatgtgttcatgggaatctttcttttcctggcgccttttatcctcctgattctgttctttatgttcggctggcggatcctgttttgtttcaaatgctgtcgcagaacccgggggctctttaagtatagacatctgaaagacgacgaggaaacaggctaccgccggattatcgagaagctgaacaataaaaagggaaagaacaaactcctggatggcgaaagacttgccgacgggcgcattgctgagctgttcagcaccaagacgcacatcgga

SEQ ID NO: 14031 - RNA, 1932 nt, synthetic construct
  misc_feature 1..1932: note = derived and/or modified CDS sequence (opt5) from CCHFV(IbAr10200)__AF467768.2__Gc
  source 1..1932: mol_type = other RNA
ttcctggacagcaccgccaagggcatgaaaaacctccttaattccacatctcttgagacgagcctgtccatcgaagctccctggggagccattaacgtgcagtctacctacaagcctacagtcagcaccgcgaatatcgctctctcctggtctagcgttgagcacagagggaacaaaattctggtgtccggccggagcgaatctatcatgaaacttgaggaacgcacagggatttcctgggatctgggagtggaggacgccagcgagtctaaactcctgaccgtctccgtgatggatctgagccaaatgtattctccggtttttgaatacctctccggcgacagacaggtgggggagtggcccaaggccacatgcaccggagattgtcctgaacggtgcggctgtacgagctctacctgcctgcataaggagtggccccactctcgcaattggagatgtaaccctacatggtgctggggcgtcgggaccggatgtacatgctgtggccttgacgtgaaagatctgttcaccgactatatgtttgttaagtggaaagtggagtacatcaagacggaagctatcgtctgcgtggagctcacaagccaggaacggcagtgttccctgattgaggccgggacccgcttcaatcttggacccgtgacaatcaccctgagcgaacctagaaacattcaacagaaactcccgcccgagatcattaccctgcatcctcggatcgaggaaggctttttcgatctgatgcacgtccagaaggttctctctgcttccacagtgtgcaagctgcagagctgcacgcatggggtgcccggagaccttcaagtctatcacattggcaatctgctcaaaggcgataaggtgaacgggcacctgatccataaaatcgagcctcactttaatacctcttggatgagctgggacggatgtgatcttgactactattgcaacatgggcgactggccctcctgtacatacaccggggttacacagcataatcacgcctctttcgtgaacctgctcaatattgaaaccgattacacgaagaactttcacttccatagcaaacgcgtcacagcgcacggagacaccccgcagctggatctgaaggccagacctacctatggcgctggggagatcacagtgctcgttgaagtggccgacatggagctgcataccaaaaagattgagatctccggacttaagtttgctagcctggcctgcacaggctgttacgcgtgctcctccggcattagctgtaaagtccggatccacgtggatgaacccgacgagctcacggtccatgtgaagtctgatgaccctgatgttgtggccgcttccagctccctgatggcccgcaaacttgagttcgggaccgactctacatttaaggctttcagcgccatgcccaaaacctccctgtgcttctatatcgtcgaaagagaacactgtaagtcttgcagcgaggaggatacaaagaaatgtgtgaacaccaagctcgaacagccccaatccattctgatcgagcacaaaggaacgattatcggcaagcagaatagcacatgcaccgccaaggcttcttgctggctggaatccgttaagagctttttctacgggctcaagaacatgctgtctggaatttttggcaatgtgttcatggggatctttcttttcctggcgccttttatcctcctgattctgttctttatgttcggctggcggatcctgttttgtttcaaatgctgtcgcagaacccggggactctttaagtatagacatctgaaagacgacgaggagacaggctaccgccggattatcgaaaagctgaacaataaaaaggggaagaacaaactcctggatggagagagacttgccgaccgccggattgctgaactgttctccaccaagacgcacatcggc

SEQ ID NO: 14032 - RNA, 1932 nt, synthetic construct
  misc_feature 1..1932: note = derived and/or modified CDS sequence (opt5) from CCHFV(Turkey-Kelkit06)__GQ337054.1__Gc
  source 1..1932: mol_type = other RNA
ttcctggacagcatcgtgaagggcatgaaaaacctccttaattccacctctctggagacaagcctgtccattgaagccccctggggagctatcaacgtccagtctacgtttaagcctaccgttagcacagccaatattgcgctctcctggtctagcgtggtgcacagagggaacaaaatcctggtcaccggccggtccgagagcattatgaaacttgaggagcgcacaggggtgtcttgggatctgggagttgaagacgcttccgagagcaaactcctgaccgtgtctatcatggatctgtcccaaatgtacagcccggtcttcgagtatctctctggcgacagacaggtggaagagtggcccaaggccacatgcaccggggattgtcctgaacggtgcggatgtacgtcctctacctgcctgcataaggagtggtcccactctcgcaattggagatgtaaccccacatggtgctggggcgttggcaccgggtgtacatgctgtggagtggacgtcaaagatctttttaccgaccatatgttcgtgaagtggaaagtggagtacatcaagacggaagccattgtctgcgttgctctgacaagccaggagcggcagtgttccctcatcgaagccggcacccgctttaatctggggcctgtgacaattacccttagcgagcccagaaacatccaacagaaactgcctccggaaattatcaccctccaccccaagattgaggagggattctttgatctgatgcatgtgcagaaggtcctgtctgcttccacagtgtgcaaactccagagctgcacgcacggcatccctggggacctgcaagtttatcacatcggaaatcttctgaagggcgatcgggtgaacggccatctcattcacaaaatcgaatctcatttcaataccagctggatgtcctgggacgggtgtgatctggactactattgcaacatgggagactggccctcttgtacatacaccggcgtcacacagcacaatcacgccgcgtttgtgaaccttctgaatattgagaccgattatacgaagacattccattttcacagcaaacgcgttaccgcccatggggacacccctcagctcgatctgaaggctagacccacatacggagccggcgggatcaccgtgctggtcgaagtggctgacatggagctccacacaaagaaggtcgaaatttccggactgaagttcgccagccttgcgtgcacgggctgttacgcctgcagctccggcatcagctgtaaagtgcggatccatgttgatgagccggacgagctgaccgtgcacgtcaagtcttccgatcctgacgtggttgctgccagcacatccctcatggctcgcaaactggaatttgggaccgattctacattcaaggccttcagcgccatgcccaaaacctccctttgcttttatattgtggagagagaatactgtaagtcttgcagcgaggacgatacgcagaagtgtgtcgacacccggctggaacaacctcagtccatcctcattgagcacaaaggaacaatcattggcaagcagaacgatacctgcacagctaaagcgagctgctggctggagtctgtgaagtccttcttttatgggctgaaaaacatgctcggaagcgtgttcggcaatctgtttatcgggatccttctgttcctcgccccctttgttctgctggtccttttctttatgttcggctggaagattctcttttgtttcaagtgctgtcgcagaacccggggactgtttaaatacagacatctgaaggacgacgaagagacgggctatcgccggatcattgaaagactcaactctaaaaaggggaaaaatcgcctgcttgatggagaccggctggctgatagaaagatcgccgaactcttctccacaaagacccacattggc

SEQ ID NO: 14033 - RNA, 1935 nt, synthetic construct
  misc_feature 1..1935: note = derived and/or modified CDS sequence (opt5) from CCHFV(SR3)__AJ538199.1__Gc
  source 1..1935: mol_type = other RNA
ctgttcctcgacagcatcgtgaagggcatgaaaaacctgcttaattccacctctctggagacaagcctctccattgaagccccctggggagctatcaacgtccagtctacgtacaagcctaccgttagcacagccaatattgcgctgtcctggtctagcgtggagcacagagggaacaaagtgcttgtctccggccggagcgaatctatcatgaagctggaggaacgcaccgggatttcctgggatctcggagtggaggacgctagcgagtctaaactgctgacagtttccgtgatggatctcagccaaatgtattctccggtctttgaatacctgtccggcgacagacaggtggaggaatggcccaaggctacctgcacaggggattgtcctgagcggtgcggatgtaccagctccacgtgccttcataaggagtggccccactctcgcaattggagatgtaaccctacctggtgctggggcgttggcacagggtgtacctgctgtggactggacgtgaaagatctcttcacagactatatgtttgtcaagtggaaagtggaatacatcaagaccgaggccatcgtgtgcgtcgaactgacgagccaggagcggcagtgttcccttattgaagccggcacacgcttcaatctggggagcgttaccatcacactctctgagcccagaaacattcaacagaaactgcctccggagatcattaccctgcatcccaagatcgaagagggatttttcgatctcatgcacgtgcagaaggtgctgtccgccagcaccgtctgcaaacttcagtcttgcacacatggcgtgcctggggacctgcaagtttatcacattggaaatctcctgaagggcgatcgggtgaacggccaccttatccataaaatcgaacagcactttaatacgagctggatgtcctgggacgggtgtgatctggactactattgcaacatgggagactggccctcttgtacctacacaggcgtcacccagcataatcacgctagcttcgtgaacctcctgaatattgagacagattacaccaagacgtttcacttccattccaaacgcgttacagcccacggggacacccctcagctggatctcaaggcgagacccacctatggagccggcgaaatcacagtgctggtcgaggtggctgacatggagcttcataccaaaaagattgaaatcagcgggctgaagtttgccggactcacatgcacgggctgttacgcttgttcttccggcattagctgcaaagtccggatccacgtggatgagccggacgaactgaccgttcatgtgaagtctgatgaccctgatgtcgtggccgcgtccagctcccttatggcccgcaaactggagttcgggacagactctacctttaaggctttcagcgccatgcccaaaacatccctctgcttctatatcgttgaaagagagtactgtaagtcttgcaacaaggaggatacccaaaaatgtgtgaacacgaagctggaacagcctcagagcattctgatcgagcacaaaggaaccattatcggcaagcaaaataacacatgcaccgctaaagcctcctgctggctcgaaagcgtcaagtcctttttctatgggctgaagaatatgcttggaggcatttttgggaacgtgttcatcggcatctttacattcctgaccccctttattctcctgatcctgttctttatgttcggatggcggattctcttttgtttcaaatgctgtcgcagaacgcggggcctttttaagtacagacacctgaaagacgacgaggagacagggtatcgcaagatcattgaacggctgaataacaaaaagggaaagaatagactcctggatggcgagcgccttgccgaccggaaaatcgctgaactgttctctaccaagacacatattggg

SEQ ID NO: 14034 - RNA, 1935 nt, synthetic construct
  misc_feature 1..1935: note = derived and/or modified CDS sequence (opt5) from CCHFV(UCCR4413)__KY484038.1__Gc
  source 1..1935: mol_type = other RNA
ttcctgagctccatcgtgaagggcaaaaagaacctcctgaatagcgccagccttgagacctccctgtctattgaagctccctggggagccatcaacgcgcagagcacatttaaacctacgatttccaccgctaatatcgccctctcttggagctccgtcgagcacagagggaacaaggttctggtgagcggccggtctgaatccattatgaaacttgaggaacgcacagggatcagctggaatctgggagtggaggacgcctctgagtccagaatgctcaccgtcagcgtgatggatctgtctcaaatgtacctgccggttttcgaatatctctccggcgaccgccaggtggaggaatggcccaaggctacatgcaccggggattgtcctgagcggtgcggatgtacaagctctacctgcctgcataaggagtggccccactctagaaactggcggtgtaatcctacgtggtgctggggcgtcggcaccgggtgtacatgctgtggacttgacgtgaaagatctgtttaccgactacatgttcgttaagtggaaagtggaatatatcaagacagaggccattgtctgcgtggaactcaccagccaggagcgccagtgttccctgatcgaagctggcacgagatttaaccttgggcccgtgacaattaccctgagcgagcctcggaatatccaacagaaactcccgtctgagattgtcacactgcatcccaagatcgaagagggattctttgatctgatgcacgttcagaaggtgctctccgccagcaccgtgtgcaaactgcagtcttgcacccatggcgtcgcgggggaccttcaagtgtaccacgttggaaacctgctcaagggcgataaaattaatggccacagcatccataagatcgaacctcacctgaacacatcctggatgtcttgggacgggtgtgatcttgactattactgcaatatgggagattggcccagctgtacgtataccggcgtgacacagcataaccacgccgctttcgtcaatctgctcaacattgagaccgactacacaaaatcctttcacttccatagcaagcgcgtgaccgcccacggggacacgcctcagctggatctgaaagctagacccatgtacggagccggcgaaatcacagttctcgtggaggtcgcggacatggagctgcattctaagaacattgaaatctccgggcttaagtttgccagcctgacctgctctggatgttatgcttgctccagcggcatttcctgtaaagtgcggatccacgtcgatgagccggacgaactcgccgtgcatgttaagtctgatgacctggatgtggtcgctgccagctcctctcttatggcccgcaaaatcgagttcggcaccgacagcacatttaaggctttctccagcatgcctaaagaatctctgtgcttctacattgtggagagagatttttgtaagtcctgcgcggccgaggacacccagaagtgtgttaaagctaagctcgaacaaccccagagcatcctgattgagcacaaagggacaatcattggaaagcagaatgatacgtgctctaccaaaacatcctgctggctggaatctttcaagtcctttttctatggcctcaagaacatgctgagcggggtgtttggatccgccatcatgggcatccttctgttcctcgccccttttattctgctgatccttttctttttctttgggtggcggattctcttctgtctgcgctgctgtagacggaccagaggcctgtttaaatacaagcacatcaaagacgacgaggaggctggatataagaaaattatcgaaaagctcaataacaagaaaggcgggacaagcaagctgcttgatggagagcgcctggccgaccggaaaattgcggaactcttctctaccaaggctcatatcggc

SEQ ID NO: 14035 - RNA, 1932 nt, synthetic construct
  misc_feature 1..1932: note = derived and/or modified CDS sequence (opt5) from CCHFV(66019)__AB069669.1__Gc
  source 1..1932: mol_type = other RNA
ttcagcgactccatcgtgaagggcatgaaaaacctgctcaattctaccagcctggagacatccctttctattgaagccccctggggagctatcaacgtccagagcacgtttaagcctaccgtttccacagccaatattgcgctgtcttggagctccgtggagcacagagggaacaaaatcctcgtgagcggccggtctgaatccattatgaagctggaggaacgcaccgggatcagctgggatcttggagtcgaggacgcttctgagtccaaactgctcacagtgagcgttatggatctgtctcaaatgtactccccggtgttcgaatatctgagcggcgacagacaggtcgaggaatggcccaaggctacctgcacagggaattgtcctgatcggtgcggatgtacctcctctacgtgcctccataaggagtggccccacagccgcaactggagatgtaatcctacctggtgctggggcgtgggcacagggtgtacctgctgtggactggacgttaaagatctttttacagactacatgttcgtgaagtggaaagtcgagtatatcaagaccgaagccattgtgtgcgtggagctgaactcccaggaacggcagtgtagcctcatcgaggctggcacgcgctttaatctggggcccgtcacaattaccctttctgaacctagaaacatccaacagaaactgccgtccgagattatcacactccatccccggattgaggaaggattctttgatctgatgcacgttcagaaggtgctgagcgcctctaccgtgtgcaagctccagagctgcacccatggcgtccctggggacctgcaaatctaccacatcggaaatcttctgaaaggcgatcgcgtgaacggccacctcattcataagatcgagccccacttcaatacatcctggatgtcttgggacgggtgtgatctggactattactgcaacatgggagactggcctagctgtacgtataccggcgttacacagcataatcacgctgcctttgtgaaccttctgaacattgaaaccgattacaccaaaaatttccactttcattccaagagagtcacagcgcacggggacacgccccagctcgatctgaaagcccggccgacatacggagctggcgagatcaccgtgctggttgaagtggccgacatggagctccataccaagaaaattgctatcagcgggctgaagttcgcctctcttacatgcaccggatgttatgcgtgctccagcggcatctcttgtaaggtccgcattcacgtggatgagcctgacgaactgacagtccatgtgaaatccgaggatcccgacatcgttgccgctagctcctctctcatggccagaaagctggaatttggcacggatagcaccttcaaagccttctccgccatgcctaagacatctctttgcttttacattgtggagcgggaatattgtgagagctgctccaaagaggacacccagaagtgtgtcaacacaaagctggaacaaccccagagcatcctcattgagcacaaagggaccatcatcggaaagcagaatgatacgtgcaccgccaaagctagctgctggctggaatccgtgaagtctttcttttacggcctgaaaaacatgctctctgggattttcggaaatgtttttatcggcattttcctgtttcttgcgcccttcatcctgctcattctgtttttcatgtttgggtggcgcatcctgttctgttttaagtgctgtagacggacaagaggccttttcaagtatcgctacctcaaagacgacgaggagtccggatatcggagaattatcgaacgcctgaacaataagaaaggcaagaacaaactgctcgatggggagcggctggccgacagacgcatcgctgaacttttcagcaccaagacacacattgga

SEQ ID NO: 14036 - RNA, 1932 nt, synthetic construct
  misc_feature 1..1932: note = derived and/or modified CDS sequence (opt5) from CCHFV(7001)__AB069670.1__Gc
  source 1..1932: mol_type = other RNA
ttcctggacaacatcgccaagggcatgaaaagcctccttaattccacctctcttgagacaagcctgtccattgaagctccctggggagccatcaacgtgcagtctacgtttaagcctaccgtcagcgcggctaatattgccctctcctggtctagcgttgagcacagagggaacaaaatcctggtgtccggccggagcgaatctattatgaagctggaggaacgcacaggggtgtcctggaatctgggagtcgaggatgccagcgagtctaaaaccctcacagtgtccgttatggacctgagccaaatgtactctccggtgttcgaatatctgtccggcgatagacaggtcgaggaatggcccaaggctacctgcacaggggactgtcctgagcggtgcggatgtaccagctccacgtgcctccataaggagtggccccactctcgcaactggagatgtaatcctacctggtgctggggcgtgggcacagggtgtacctgctgtggactggatgttaaagactttttcacagattacatgcttgtgaagtggaaagtcgaatatatcaagaccgaggccatcgtgtgcgtggaactgacgagccaggagcggcagtgttccctcattgaagctggcacacgctttaacctggggcccgtcaccatcacacttagcgagcctagaaatgttcaacagcggctgccgcccgagattgtgaccctccatcctaaaatcgaagagggattctttgacctgatgcacgtgcagaagattctgtctgcctccaccgtctgcaagctccagagctgcacacatggcgtgcccggggatttccaagtttaccacgtgggaaacctgcttcgcggcgacaaagtcaatggccactctatccataagattgaacctcactttaacacgagctggatgtcctgggatgggtgtgacctggattatttctgcaatatgggagactggccctcttgtacctacacaggcgtgacccagcataacagagcggcctttatcaatatgctcaacatcgagacagactataccaaaacgttccactttcacagcaagcgggttacagctcatggggataccccgcagctggaccttaaagcccgccctgcttacggagccggcgaagtgaccgtcctggtggaggtcgcggatctcgagctgcacacaaagaaactggaagtgtccgggctcaagattgccagcctgacctgctctggatgttacgcttgctccagcggcatctcttgtaaggttcggattcatgtgaacgagcccgacgaatttacagtccacgtgagatccagcgatcctgacgttgtggccgctggctcctctcttatggcccgcaaaatcgagttcggggccgatagcacgtttaaggctttctcctctatgcccaaagacagcctgtgcttttatattgtcgaaaaggattactgttccagctgcaccgacgatgacacacagaaatgtgtgaataccaagctcgaccatccccaatctatcctgatcgagcacaagggaacaattatcggcaaacagaacgatacctgctccacgaagaccagctgctggcttgagtctgtgaaagggttcttttatggactgaagaatatgctctccggcattttcgggaacgtttttctgggcatcttcctgtttctcgcgcctttcgtcctgcttattttcttctttttcttcggatggagactgctcttttgtctgaaatgctgtcggagaacacgcggcctgcttaagtacaagcacctcaaagacgaagaggaagccgggtataagaaaatcatcgagcggctgaatggaaagaaaggcaagagccagctgttcgatggggagagactcgctgaccgcaagattgccgaactgttttctaccaaaatccatattgga

SEQ ID NO: 14037 - RNA, 1932 nt, synthetic construct
  misc_feature 1..1932: note = derived and/or modified CDS sequence (opt5) from CCHFV(75024)__AB069671.1__Gc
  source 1..1932: mol_type = other RNA
ttcctggacagcatcgtgagaggcatgaagaaccagctcaattccacctctctggagacaagcctttccattgaagccccctggggagctatcaacgtccaatctacgtacaaacctaccgttagcacagccaatattgcgctgtcctggtctagcgtggagcaccgggggaacaagatcctcgtgtccggccgcagcgaatctattatgaaactggaggaaagaaccgggatctcctgggatcttggagtcgaggacgctagcgagtctaagctgctcacagtgtccgttatggatctgagccagatgtattctccggtgtttgaatacctgtccggcgaccggcaggtcgaggaatggcccaaagctacctgcacaggggattgtcctgagcgctgcggatgtaccacgagcacatgcctccataaggagtggccccactccagaaattggcggtgtaaccctacctggtgctggggcgtgggcaccgggtgtacatgctgtggactggacgttaaggatcttttcaccgactatatgatcgtgaaatggaaggtcgaatacattaaaacggaggccatcgtgtgcgtggaactgacatctcaggagcgccaatgtagcctcattgaagctggcaccagatttaatctggggtccgtcacaatcacccttagcgagccccggaacattcagcagaagctgcctccggagatcattaccctccatccccgcatcgaagagggattctttgatctgatgcacgttcagaaagtgctgtctgcctccacagtgtgcaagctccaaagctgcacgcatggcgtccctggggaccttcaggtgtatcacgttggaaatctgctgaagggcgataaagtgaacggccacctcatccataagattgaaccccacctgaatacctcttggatgagctgggacgggtgtgatcttgactactattgcaacatgggagactggccttcctgtacatacaccggcgtcacacagcataatcacgcttctttcgtgaacctgctcaatatcgagaccgattacacgaaatcctttcacttccatagcaagagagttacagcccacggggacacaccccagctggatctgaaagcgcggccgacctatggagccggcgaaattaccgtgctcgtcgaggtggctgacatggagtttacccctaagaaaatcgaaattagcgggctgaagttcgcctctcttacatgcacgggatgttacgcttgctccagcggcatctcttgtaaggtccgcatccatgtggatgagcccgacgaactgaccgttcacgtgaaatccgatgaccctgatgtcgtggccgcgagctcctctctcatggccagaaagctggagtttggcacagacagcaccttcaaagccttttccgccatgcccaagacatctctttgcttctatattgttgaacgggagtactgtaaaagctgctccaaggaggatacccaaaagtgtgtgaacacgaaactggaacagccccagagcatcctcattgagcataaggggaccatcattggaaaacaaaacaatacatgcaccgctaaggcctcttgctggctggaatccgtcaagagcttcttttatggcctgaaaaacatgctctctgggatcttcggaaatctgtttatgggcatcttcctttttctggcccctttcattctcctgatcctgtttttcatgtttgggtggcgcattcttttctgttttaagtgctgtagacggacaagaggcctcttcaaataccgccacctgaaggacgacgaggagaccggatatcggagaatcattgaacgcctgaacaataaaaagggcaaaaacaagctcctggatggggagcggcttgctgacagacgcatcgcggaactgttttccacgaagacacacattgga

SEQ ID NO: 14038 - RNA, 1932 nt, synthetic construct
  misc_feature 1..1932: note = derived and/or modified CDS sequence (opt5) from CCHFV(7803)__AB069672.1__Gc
  source 1..1932: mol_type = other RNA
ttcctggacagcatcgtgagaggcatgaagaaccccctcaattccacctctctggagacaagcctttccattgaagccccttggggagctatcaacgtccagtctacgtacaaaccgaccgttagcacagccaatattgcgctgtcctggtctagcgtggagcaccgggggaacaagatcctcgtgtccggccgcagcgaatctattatgaaactggaggaaagaaccgggatctcctgggatcttggagtcgaggacgctagcgagtctaagctgctcacagtgtccgttatggatctgagccaaatgtattctcccgtgtttgaatacctgtccggcgaccggcaggtcgaggaatggcctaaagctacctgcacaggggattgtcccgagcgctgcggatgtaccacgagcacatgcctccataaggagtggcctcactccagaaattggcggtgtaaccccacctggtgctggggcgtgggcaccgggtgtacatgctgtggactggacgttaaggatcttttcaccgactatatgatcgtgaaatggaaggtcgaatacattaaaacgcgcggcatcgtgtgcgtggagctgacatctcaggaaagacagtgtagcctcattgaggccgggacccggtttaatctgggatccgtcacaatcacccttagcgaacctcgcaacattcaacagaagctgccgcccgagatcattaccctccatcctagaatcgaggaaggcttctttgatctgatgcacgttcagaaagtgctgtctgcctccacagtgtgcaagctccagagctgcacgcatggggtccccggagacctgcaagtgtatcacgttggcaatcttctgaagggcgataaagtgaacgggcacctcatccataagattgagcctcacctgaatacctcttggatgagctgggacggatgtgatcttgactactattgcaacatgggcgactggccctcctgtacatacaccggggtcacacagcataatcacgcctctttcgtgaacctgctcaatatcgaaaccgattacacgaaatcctttcacttccatagcaagcgggttacagctcacggagacaccccgcagctggatctgaaagcccgccctacctatggcgcgggggagattacagtgctcgtcgaagtggccgacatggagtttacccccaagaaaatcgagattagcggactgaagttcgcttctcttacatgcacgggctgttacgcctgctccagcggcatctcttgtaaggtcagaatccatgtggatgaacctgacgagctgaccgttcacgtgaaatccgatgaccccgatgtcgtggctgccagctcctctctcatggcgcggaagctggaatttgggacagacagcaccttcaaagccttttccgctatgcccaagacatctctttgcttctatattgttgagcgcgaatactgtaaaagctgctccaaggaggatacccagaagtgtgtgaacacgaaactggagcaacctcagagcatcctcattgaacataagggaaccatcattggcaaacagaacaatacatgcaccgccaaggcttcttgctggctggagtccgtcaagagcttcttttatgggctgaaaaacatgctctctggaatcttcggcaactttttcatggggatctttctgttccttgccccgtttattctgctcatcctgttctttatgttcggctggcggattctgttttgtttcaagtgctgtagaagaacacgcggactttttaaataccggcacctcaaggacgacgaagagaccggctatagacgcatcattgagcggctgaataataaaaaggggaaaaacaagctgctcgatggagaaagactggccgaccgccggatcgctgagcttttctccacgaagacacacattggc

SEQ ID NO: 14039 - RNA, 1932 nt, synthetic construct
  misc_feature 1..1932: note = derived and/or modified CDS sequence (opt5) from CCHFV(79121)__AB069673.1__Gc
  source 1..1932: mol_type = other RNA
ttcctggacagcaccgccaagggcatgaaatccctcctgaactctacaagccttgagacgtccctgtctatcgaagctccctggggagccattaatgtgcagagcacctttaagcctacagtctccgcggctaacatcgccctctcttggagctccgttgagcacagaggaaataaaattctggtgagcggccggtctgaatccatcatgaaacttgaggaacgcaccggggtgagctggaacctgggagtcgaggatgcctctgagtccaaaacactcaccgtgagcgttatggacctgtctcaaatgtactccccggtgttcgaatatctgagcggcgatagacaggtcgaggaatggcccaaggctacatgcaccggggactgtcctgagcggtgcggatgtacgtcctctacctgcctccataaggagtggccccacagccgcaattggagatgtaaccctacatggtgctggggcgtgggcaccgggtgtacatgctgtggactggatgttaaagactttttcaccgattacatgcttgtgaagtggaaagtcgaatatattaagacggaggccatcgtgtgcgtggaactgacatcccaggagcggcagtgtagcctcatcgaagctggcacccgctttaatctggggcccgtcacaattaccctttctgagcctagaaacgttcaacagcggctgccgcccgagatcgtgaccctccatcctaaaattgaagagggattctttgacctgatgcacgtgcagaagatcctgtccgccagcacagtctgcaagctccagtcttgcacgcatggcgtgcccggggatttccaaatttaccacgttggaaatctgcttcgcggcgacaaagtgaacggccacagcatccataagattgaacctcactttaatacctcctggatgtcttgggatgggtgtgacctggattatttctgcaacatgggagactggcccagctgtacatacaccggcgtcacacagcataatagagcggcctttatcaacatgctcaatatcgagaccgactatacgaaaacattccactttcactccaagcgggtgaccgctcatggggataccccgcagctggaccttaaagcccgccctgcttacggagccggcgaagttacagtgctggtcgaggtggcggatctcgagctgcacaccaagaacctggaagtcagcgggctcaaaattgcctctctgacatgctccggatgttacgcttgcagctctggcatctcctgtaaggtgcggattcatgttaacgagcccgacgaatttacggtgcacgtcagaagctccgatcctgacgtggttgccgctggctctagccttatggcccgcaagatcgagttcggggccgattccacctttaaggctttctctagcatgcccaaggactccctgtgcttttatattgtggaaaaagattactgtagctcttgcacagacgatgacacccagaagtgtgtcaatacaaaactcgaccatccccaatccatcctgatcgagcacaagggaaccattatcggcaagcagaacgatacgtgcagcaccaaaacatcttgctggcttgagtccgtgaaggggttcttttatggactgaaaaatatgctcagcggcattttcgggaacgtgtttctgggcatcttcctgtttctcgcgcctttcgttctgcttattttcttctttttcttcggatggagactgctcttttgtctgaagtgctgtcggagaacccgcggcctgcttaaatacaagcacctcaaggacgaagaggaagccgggtataaaaagatcatcgagcggctgaatgggaaaaagggcaaatctcagctgttcgatggggagagactcgctgaccgcaagattgccgaactgtttagcacaaagatccatattgga

SEQ ID NO: 14040 - RNA, 1932 nt, synthetic construct
  misc_feature 1..1932: note = derived and/or modified CDS sequence (opt5) from CCHFV(8402)__AB069674.1__Gc
  source 1..1932: mol_type = other RNA
ttcagcgactccatcgtgaagggcatgaaaaacctgctcaattctaccagcctggagacatccctttctattgaagccccctggggagctatcaacgtccagagcacgtttaagcctaccgtttccgccgcgaatattgctctgtcttggagctccgtggagcacagagggaacaaaatcctcgtgagcggccggtctgaatccattatgaagctggaggaacgcacagggatcagctgggatcttggagtcgaggacgcctctgagtccaaactgctcaccgtgagcgttatggatctgtctcaaatgtactccccggtgttcgaatatctgagcggcgacagacaggtcgaggaatggcccaaggccacatgcaccggggattgtcctgagcggtgcggatgtacatcctctacctgcctccataaggagtggccccacagccgcaattggagatgtaaccctacgtggtgctggggcgtgggcaccgggtgtacatgctgtggactggacgttaaagatctttttaccgactacatgttcatcaagtggaaagtggaatatattaagacagaggctatcgtctgcgtggaactgacctcccaggagcggcagtgtacgctcattgaagccggcacacgctttaatctggggcccgtgaccatcacacttagcgagcctagaaacattcaacagaaactgccgcccgagatcgtcaccctccatcctcggattgaagagggattctttgatctgatgcacgttcagaaggtgctgtctgcttccaccgtgtgcaagctccagagctgcacacatggcgtccccggggacctgcaagtgtaccacatcggaaatcttctgaaaggcgataaggttaacggccacctcatccataaaattgaacctcacttcaatacgtcttggatgagctgggacgggtgtgatctggactattactgcaacatgggagactggccctcctgtacctatacaggcgtgacccagcataatcacgccgcgtttgtcaacatgcttaatatcgagacagattacaccaagaacttccactttcattctaaacgcgtgacggcccacggggacacaccgcagctggatctcaaggctagacctacctacggagccggcgaaattaccgttctggtggaggtcgctgacatggagctgcatacaaagaagatcgaaattagcgggctcaagttcgcctccctgacctgcacaggatgttatgcgtgcagctctggcatctcctgtaaagtgcggatccacgtcgatgagcccgacgaacttacggtgcatgttaagagcgaggatcctgacattgtggccgcttcttccagcctgatggcccgcaaactcgaatttggcaccgattccacattcaaggctttctctgccatgcccaaaaccagcctgtgcttttacatcgtcgagagagagtattgtaagtcctgctctaaggaagacacacagaaatgtgtgaacaccaaacttgagcaaccccagagcattctgatcgaacacaaagggacgattatcggaaagcagtccaatacctgcacagccaaagctagctgctggctcgagtctgttaagtccttcttttacggcctgaagaacatgctgagcgggatcttcggaaatgtgtttattggcgtcttcctctttttcgcgccttttatcctgcttattctgttctttatgttcgggtggcggatcctcttttgtttcaaatgctgtcgcagaacccggggcctgttcaagtatagacacctgaaagatgacgaggaaacaggataccgcaagattatcgagcggcttaacaataaaaagggcaagaacaaactcctggacggggaaagactggccgatcgcaagattgctgagctcttttctaccaaaacgcatatcgga

SEQ ID NO: 14041 - RNA, 1932 nt, synthetic construct
  misc_feature 1..1932: note = derived and/or modified CDS sequence (opt5) from CCHFV(88166)__AB069675.1__Gc
  source 1..1932: mol_type = other RNA
ttcagcgactccatcgtgaagggcatgaaaaacctgctcaattctaccagcctggagacatccctttctattgaagccccctggggagctatcaacgtccagagcacgtttaagcctaccatgtccgccgcgaatattgctctgtcttggagctccgttgagcacagagggaacaaaatcctcgtgagcggccggtctgaatccattatgaagctggaggaacgcacagggatcagctggaatcttggagtggaggatgcctctgagtccaaactgctcaccgtcagcgtgatggacctgtctcaaatgtactccccggttttcgaatatctgagcggcgatagacaggtggaggaatggcccaaggccacatgcaccggggactgtcctgagcggtgcggatgtacatcctctacctgcctccataaggagtggccccacagccgcaactggagatgtaatcctacgtggtgctggggcgtcggcaccgggtgtacatgctgtggactggatgtgaaagacctttttaccgattacatgttcatcaagtggaaagttgaatatattaagacagaggctatcgtgtgcgtcgaactgacctcccaggagcggcagtgtacgctcattgaagccggcacacgctttaacctggggcccgtgaccatcacacttagcgagcctagaaatattcaacagaaactgccgcccgagatcgtgaccctccatcctcggattgaagagggattctttgacctgatgcacgtccagaaggttctgtctgcttccaccgtgtgcaagctccagagctgcacacatggcgtgcccggggatctgcaagtctaccacatcggaaaccttctgaaaggcgacaaggtgaatggccacctcatccataaaattgaacctcacttcaacacgtcttggatgagctgggatgggtgtgacctggattattactgcaatatgggagactggccctcctgtacctatacaggcgttacccagcataaccacgccgcgtttgtgaatatgcttaacatcgagacagactacaccaagaacttccactttcattctaaacgcgtcacggcccacggggatacaccgcagctggacctcaaggctagacctacctacggagccggcgaaattaccgtgctggttgaggtggctgatatggagctgcataccaaaaagatcgaaattagcgggctcaagttcgcctccctgacatgcacaggatgttatgcgtgcagctctggcatctcctgtaaagtccggatccacgtggacgagcccgatgaacttacggtccatgtgaaaagcgaggaccctgatctggttgccgcttcttccagcctcatggcccgcaaactggaatttggcaccgactccacattcaaggctttctctgccatgcccaaaaccagcctttgcttttacattgtggagagagagtattgtaagtcctgctctaaggaagatacacagaaatgtgtcaataccaagctggagcaaccccagagcatcctcattgaacacaaagggacgatcattggaaagcagaacaatacctgcacagccaaggcttcctgctggctggagagcgtgaagtctttcttttacggcctgaagaacatgctctccgggatcttcggaaatgtttttatcggcgtgttcctgtttttcgcgccttttattcttctgatcctcttctttatgttcgggtggcggattctgttttgtttcaaatgctgtcgcagaacccggggcctgttcaagtatagacaccttaaagacgatgaggaaacaggataccgcaagatcattgagcggctcaacaataaaaagggcaagaacaaactgctggacggggaaagactcgccgaccgcaagatcgctgagctgtttagcaccaaaacgcatattgga

SEQ ID NO: 14042 - RNA, 1932 nt, synthetic construct
  misc_feature 1..1932: note = derived and/or modified CDS sequence (opt5) from CCHFV(BA88166)__AF338470.1__Gc
  source 1..1932: mol_type = other RNA
tacctggacagcatcgtgaagggcatgaaaaacctccttaattccacctctcttgagacaagcctgtccattgaagccccctggggagctatcaacgtccagtctacgttcaagcctaccatgagcgccgcgaatattgctctctcctggtctagcgttgagcacagagggaacaaaatcctggtgtccggccggagcgaatctattatgaagctggaggaacgcacagggatctcctggaatctgggagtggaggatgccagcgagtctaaactcctgaccgtctccgtgatggacctgagccaaatgtattctccggtttttgaatacctctccggcgatagacaggtggaggaatggcccaaggccacatgcaccggggactgtcctgagcggtgcggatgtacaagctctacctgcctgcataaggagtggccccactctcgcaactggagatgtaatcctacgtggtgctggggcgtcggcaccgggtgtacatgctgtggacttgatgtgaaagacctgttcaccgattatatgtttatcaagtggaaagttgaatacattaagacagaggctatcgtgtgcgtcgaactcaccagccaggagcggcagtgtacgctgattgaagccggcacacgcttcaaccttgggcccgtgatcattaccctgtccgagcctagaaatatccaacagaaactcccgcccgagattgtgacactgcatcctcggatcgaagagggatttttcgacctgatgcacgtccagaaggttctcagcgcttctaccgtgtgcaagctgcagtcctgcacccatggcgtgcccggggatcttcaagtctatcacatcggaaacctgctcaaaggcgacaaggtgaatggccacctgattcataaaatcgaacctcactttaacacaagctggatgtcttgggatgggtgtgaccttgattactattgcaatatgggagactggcccagctgtacgtacaccggcgttacacagcataaccacgccgcgttcgtgaatatgctgaacattgagaccgactacacaaagaactttcacttccattccaaacgcgtcaccgcccacggggatacgccgcagctcgacctgaaggctagacctacatatggagccggcgaaatcaccgtgctggttgaggtggctgatatggagctccataccaaaaagattgaaatctctgggctgaagtttgccagccttacatgcaccggatgttacgcgtgctccagcggcatctcttgtaaagtccggattcacgtggacgagcccgatgaactgacagtccatgtgaagtccgaggaccctgatatcgttgccgctagctcctccctcatggcccgcaaactggagttcggcacggacagcacctttaaggctttctccgccatgcccaaaacatctctttgcttctatattgtggaaagagagtactgtaagagctgctccaaggaagatacccagaaatgtgtcaatacaaagctggagcaaccccagtctatcctcattgaacacaaagggaccatcatcggaaagcagaacaatacgtgcaccgccaaagctagctgctggctggagtccgttaagagctttttctatggcctgaagaacatgctctctgggatttttggaaatgtgttcatcggcgtgtttctgttctttgcgcctttcattcttctgatcctctttttcatgtttgggtggcggattctgttctgttttaaatgctgtcgcagaacacggggcctgttcaagtacagacaccttaaagacgatgaggaaaccggatatcgcaagatcattgagcggctcaacaataaaaagggcaagaacaaactgctggacggggaaagactcgccgaccgcaagatcgctgagctgttctccacaaaaacccatatcgga

SEQ ID NO: 14043 - RNA, 1932 nt, synthetic construct
  misc_feature 1..1932: note = derived and/or modified CDS sequence (opt5) from CCHFV(BA66019)__AF350448.1__Gc
  source 1..1932: mol_type = other RNA
ttcagcgactccatcgtgaagggcatgaaaaacctgctcaattctaccagcctggagacatccctttctattgaagccccctggggagctatcaacgtccagagcacgtttaagcctaccgtttccacagccaatattgcgctgtcttggagctccgtggagcacagagggaacaaaatcctcgtgagcggccggtctgaatccattatgaagctggaggaacgcaccgggatcagctgggatcttggagtcgaggacgcttctgagtccaaactgctcacagtgagcgttatggatctgtctcaaatgtactccccggtgttcgaatatctgagcggcgacagacaggtcgaggaatggcccaaggctacctgcacaggggattgtcctgaccggtgcggatgtacctcctctacgtgcctccataaggagtggccccacagccgcaattggagatgtaaccctacctggtgctggggcgtgggcacagggtgtacctgctgtggactggatgttaaagacctttttacagattacatgttcgtgaagtggaaagtcgagtatatcaagaccgaagccattgtgtgcgtggagctcaattcccaggaacggcagtgtagcctgatcgaggctggcacgcgctttaacctggggcccgtcacaattaccctttctgaacctagaaatatccaacagaaactgccgcccgagattatcacactccatcctcggattgaggaaggattctttgacctgatgcacgttcagaaggtgctgtccgccagcaccgtgtgcaagctccagtcttgcacccatggcgtccccggggatctgcaaatctaccacatcggaaaccttctgaaaggcgaccgcgtgaatggccacctcattcataagatcgagcctcacttcaacacaagctggatgtcctgggatgggtgtgacctggactattactgcaatatgggagattggccctcttgtacgtataccggcgttacacagcataaccacgctgcctttgtgaatcttctgaacattgaaaccgactacaccaaaaacttccactttcatagcaagagagtcacagcgcacggggatacgccgcagctcgacctgaaagcccggcctacatacggagctggcgagatcaccgtgctggttgaagtggccgatatggagctccataccaagaaaattgctatctccgggctgaagttcgccagccttacatgcaccggatgttatgcgtgttcttccggcatcagctgcaaggtccgcattcacgtggacgagcccgatgaactgacagtccatgtgaaatctgaggaccctgatatcgttgccgcttccagctccctcatggccagaaagctggaatttggcacggactctaccttcaaagccttcagcgccatgcccaagacatccctttgcttttacattgtggagcgggaatattgtgagtcttgcagcaaagaggatacccagaagtgtgtcaatacaaagctggaacaaccccagtccatcctcattgagcacaaagggaccatcatcggaaagcagaacgacacgtgcaccgccaaagctagctgctggctggaatctgtgaagtccttcttttacggcctgaaaaatatgctcagcgggattttcggaaacgtttttatcggcattttcctgtttcttgcgcctttcatcctgctcattctgtttttcatgtttgggtggcgcatcctgttctgttttaagtgctgtagacggacaagaggccttttcaagtatcgctacctcaaagacgatgaggagtctggatatcggagaattatcgaacgcctgaataacaagaaaggcaagaataaactgctcgacggggagcggctggccgatagacgcatcgctgaacttttctccaccaagacacacattgga

SEQ ID NO: 14044 - RNA, 1932 nt, synthetic construct
  misc_feature 1..1932: note = derived and/or modified CDS sequence (opt5) from CCHFV(BA8402)__AF350449.1__Gc
  source 1..1932: mol_type = other RNA
ttcagcgactccatcgtgaagggcatgaaaaacctgctcaattctaccagcctggagacatccctttctattgaagccccctggggagctatcaacgtccagagcacgtttaagcctaccgtttccgccgcgaatattgctctgtcttggagctccgtggagcacagagggaacaaaatcctcgtgagcggccggtctgaatccattatgaagctggaggaacgcacagggatcagctgggatcttggagtcgaggacgcctctgagtccaaactgctcaccgtgagcgttatggatctgtctcaaatgtactccccggtgttcgaatatctgagcggcgacagacaggtcgaggaatggcccaaggccacatgcaccggggattgtcctgagcggtgcggatgtacatcctctacctgcctccataaggagtggccccacagccgcaattggagatgtaaccctacgtggtgctggggcgtgggcaccgggtgtacatgctgtggactggacgttaaagatctttttaccgactacatgttcatcaagtggaaagtggaatatattaagacagaggctatcgtctgcgtggaactgacctcccaggagcggcagtgtacgctcattgaagccggcacacgctttaatctggggcccgtgaccatcacacttagcgagcctagaaacattcaacagaaactgccgcccgagatcgtcaccctccatcctcggattgaagagggattctttgatctgatgcacgttcagaaggtgctgtctgcttccaccgtgtgcaagctccagagctgcacacatggcgtccccggggacctgcaagtgtaccacatcggaaatcttctgaaaggcgataaggttaacggccacctcatccataaaattgaacctcacttcaatacgtcttggatgagctgggacgggtgtgatctgcattattactgcaacatgggagactggccctcctgtacctatacaggcgtgacccagcacaatcacgccgcgtttgtcaacatgcttaatatcgagacagactacaccaagaacttccattttcactctaaacgcgtgacggcccatggggatacaccgcagctggacctcaaggctagacctacctacggagccggcgaaattaccgttctggtggaggtcgctgatatggagctgcacaccaaaaagatcgaaattagcgggctcaagttcgcctccctgacatgcacaggatgttatgcgtgcagctctggcatctcctgtaaagtgcggatccatgtcgacgagcccgatgaacttacggtgcacgttaagagcgaggaccctgatattgtggccgcttcttccagcctgatggcccgcaaactcgaatttggcaccgactccacattcaaggctttctctgccatgcccaaaaccagcctgtgcttttacatcgtcgagagagagtattgtgaatcctgctctaaggaggatacacagaagtgtgtgaacaccaaacttgaacaaccccagagcattctgatcgagcacaaggggacgattatcggaaaacagtccaatacctgcacagccaaggctagctgctggctcgagtctgttaaatccttcttttacggcctgaagaacatgctgagcgggatcttcggaaatgtgtttattggcgtcttcctctttttcgcgccttttatcctgcttattctgttctttatgttcgggtggcggatcctcttttgtttcaagtgctgtcgcagaacccggggcctgttcaaatatagacatctgaaggacgatgaagagacaggataccgcaaaattatcgaacggcttaacaataagaaaggcaagaacaagctcctggacggggagagactggccgaccgcaaaattgctgaactcttttctaccaagacgcacatcgga

SEQ ID NO: 14045 - RNA, 1932 nt, synthetic construct
  misc_feature 1..1932: note = derived and/or modified CDS sequence (opt5) from CCHFV(Matin)__AF467769.2__Gc
  source 1..1932: mol_type = other RNA
ttcctggacagcatcattaagggcatgaaaaacctccttaattccacctctcttgagacaagcctgtccatcgaagccccctggggagctattaacgtgcagtctacgtttaagcctaccatgagcgccgcgaatatcgctctctcctggtctagcgtcgagcacagagggaacaaaattctggtttccggccggagcgaatctatcatgaagctggaggaacgcacagggatctcctgggatctgggagtggaggacgccagcgagtctaaactcctgaccgtgtccgtcatggatctgagccaaatgtactctccggtgttcgaatatctctccggcgacagacaggttgaggaatggcccaaggccacatgcaccggggattgtcctgagcggtgcggatgtacaagctctacctgcctgcataaggagtggccccactcccgcaattggagatgtaaccctacgtggtgctggggcgtgggcaccgggtgtacatgctgtggacttgacgtcaaagatctgtttaccgactacatgttcgtgaagtggaaagttgaatatattaagacagaggtgatcgtctgcgtggaactcaccagccaggagcggcagtgttccctgattgaagctggcacgcgctttaatcttgggcccgtgacaatcaccctgagcgagcctagaaacattcaacagaaactcccgcccgagatcgtcacactgcatcctcggattgaagagggattctttgatctgatgcacgttcagaaggtgctctctgcctccaccgtgtgcaagctgcagagctgcacccatggcgtccccggggaccttcaagtgtaccacatcggaaatctgctcaaaggcgataaggttaacggccacctgatccataaaattgaacctcacttcaatacatcttggatgagctgggacgggtgtgatcttgactattactgcaacatgggagactggccctcctgttcttatacgggcgtgacccagcataatcacgctgcctttgtcaacatgctgagcatcgagacagattacaccaagaatttccactttcattccaaacgcgtgacagcgcacggggacaccccgcagctcgatctgaaggccagacctacgtacggagctggcgaaattacagttctggtggaggtcgccgacatggagctccataccaaaaagatcgaaattagcgggctgaagttcgcttctcttacctgcacaggatgttatgcctgctccagcggcatctcttgtaaagtgcggatccacgtcgatgagcccgacgaactgaccgtgcatgttaagtccgaggatcctgacattgtggcggccagctcctctctcatggctcgcaaactggaatttggcacagatagcacgttcaaggccttctccgctatgcccaaaacctctctttgcttttacatcgtcgagagagagtattgtaagagctgctccaaggaagacacacagaaatgtgtgaacaccaagctggagcaaccccagagcattctcatcgaacacaaagggacaattatcggaaagcagaacgatacctgcacggccaaagcctcttgctggctggagtccgttaagagcttcttttacggcctgaagaatatgctctctgggatcttcggaaacgtgtttattggcatcttcctgtttcttgctcctttcgcgctgctcattctgtttttcatgtttgggtggcggatcctgttctgttttaaatgctgtcgcagaacccggggccttttcaagtatagacacctcaaagacgacgaggaaacaggataccgcaagattatcgagcggctgaataacaaaaagggcaagaataaactgctcgatggggaaagactggccgaccgcaagattgctgagcttttctccaccaaaacacatgtcgga

SEQ ID NO: 14046 - RNA, 1932 nt, synthetic construct
  misc_feature 1..1932: note = derived and/or modified CDS sequence (opt5) from CCHFV(Baghdad 12)__AJ538197.2__Gc
  source 1..1932: mol_type = other RNA
ttcctggacagcatcgtgaagggcaccaaaaacctccttaattccacatctcttgagacgagcctgtccattgaagccccctggggagctatcaacgtccagtctacctacaagcctacagttagcaccgccaatattgcgctctcctggtctagcgtggagcacagagggaacaaaatcctggtgtccggccggagcgaatctattatgaagctggaggaacgcacagggatctcctgggatctgggagtcgaggacgctagcgagtctaaactcctgaccgtgtccgttatggatctgagccaaatgtattctccggtgtttgaatacctctccggcgacagacaggtcgaggaatggcccaaggccacatgcaccggggattgtcctgagcggtgcggatgtacgaccagcacatgcctgcataaggagtggccccactcccgcaattggagatgtaaccctacctggtgctggggcgtgggcacagggtgtacctgctgtggacttgacgttaaagatctgttcacggactatatgtttgtgaagtggaaagtcgaatacatcaagacagatgccattgtgtgcgtggagctcacctctcaggaacggcagtgtagcctgatcgaggctggcacacgcttcaatcttgggtccgtcaccattaccctgagcgaacccagaaacatccaacagaaactccctccggagattatcacactgcatccccggattgaggaaggatttttcgacctgatgcacgttcagaaggtgctctctgcctccacggtgtgcaagctgcagagctgcacccatggcgtccctggggatcttcaagtgtatcacatcggaaatctgctcaaaggcgacaaggttaacggccacctgatccataaaattgagccccactttaatacatcttggatgagctgggatgggtgtgaccttgactactattgcaacatgggagattggccttcctgtacctacacaggcgtgacccagcataatcacgcttctttcgtcaacctgctcaatatcgaaacggactacacaaagagctttcacttccattccaaacgcgtgaccgcccacggggatacaccccagctggacctgaaggttagaccgacatatggagcgggcgagattaccgtgctcgtcgaagtggccgatatggagctgcataccaaaaagatcgagattagcgggcttaagtttgcttctctgacgtgcaccggatgttacgcctgctccagcggcatctcttgtaaagtccggatccacgtggacgaacctgatgagctcacagttcatgtgaagtccgacgatcccgacgtcgtggctgccagctcctctctgatggcgcgcaaacttgagttcggcaccgatagcacatttaaggccttctccgctatgcctaaaacctctctgtgcttctatattgttgaaagagaatactgtaagagctgctccaaggaggacacgcagaaatgtgtgaacaccaagctcgagcaaccccagagcatcctgattgaacacaaagggacaatcattggaaagcagaacaatacctgcacagccaaaacctcttgctggctggagtccgtcaagagctttttctatggcctcaagaacatgctgtctgggatctttggaaatttctttatgggcatcttcctttttctggctcccttcattctcctgatcctgtttttcatgtttgggtggcggattcttttctgttttaaatgctgtcgcagaacgcggggcctcttcaagtacagacacctgaaagacgatgaagagacaggatatcgccggatcattgagagactgaacaataagaaaggcaagaacaagctcctggacggggaacgccttgccgatcggagaatcgccgagctgttctccaccaaaacacatattgga

SEQ ID NO: 14047 - RNA, 1932 nt, synthetic construct
  misc_feature 1..1932: note = derived and/or modified CDS sequence (opt5) from CCHFV(VLG/TI29414)__AY179961.1__Gc
  source 1..1932: mol_type = other RNA
ttcctggacagcatcgtgaagggcatgaaaaacctccttaattccaccaaccttgagacatctctgagcattgaagccccctggggagctatcaatgtccagtccacgtttaagcctaccgtttctacagccaacattgcgctcagctggtcctctgtggagcacagaggaaataaaatcctggtgaccggccggagcgaatccattatgaagctggaggaacgcacaggggtcagctgggatctgggagtggaggacgcttctgagtccaaactcctgaccgttagcatcatggatctgtctcaaatgtactccccggtgttcgaatatctcagcggcgacagacaggtcgaggaatggcccaaggccacatgcaccggggattgtcctgagcggtgcggatgtacgtcttccacatgcctgcataaggagtggccccacagccgcaactggagatgtaatcctacatggtgctgggaagtgggcaccggctgtacatgctgtgggtggaacgttaaagacctttttaccgatcatatgttcgtgaagtggaaagtcgagtacatcaagacggaagccattgtgtgcgtggagctgacatcccaggaacggcagtgttctctcatcgaggctggaacccgctttaatctgggccccgtcacaattacccttagcgagcctagaaacatccaacagaaactgccgcccgaaattatcaccctccaccctaaggttgaggaagggttctttgacctgatgcatgtgcagaaggtgctgtccgccagcacagtctgcaaactccagtcttgcacgcacgggattcccggcgatctgcaagtgtatcacatcgggaatcttctgaagggagaccgggttaacggccatctcatccacaaaattgagcctcatttcaatacctcctggatgagctgggatggctgtgacctggattactattgcaacatgggggactggccctcttgtacatacaccggaatgacacagcacaatcacgctgcctttgtgaaccttctgaacatcgaaaccgactatacgaagacattccattttcacagcaaacgcgtcaccgcgcatggcgataccccgcagctcgacctgaaggccagacctacatacggggctggagagattaccgtgctggttgaggtggccgatatggaactccacaccaaaaaggtcgagatctccggcctgaagttcgcttctcttgcctgcacggggtgttacgcgtgcagctccggaattagctgtaaagtgcggatccatgtcgacgaacccgatgagctgaccgtgcacgttaagtctaatgaccctgatgtgatcgccgcttccacaagcctcatggcccgcaaactggaatttggcaccgactctacattcaaggctttctccgccatgcccaaaaccagcctttgcttttatattgccgagagagagtactgtaagtcctgctctgaagaggatacgcagaagtgtgtcgacaccaaactggaacaaccccagagcatcctcattgagcacaagggcacaatcattgggaaacagaacgatacctgcacagctaaggcgtcctgctggctggagtctgtgaaatccttcttttatggactgaagaatatgctcggcagcgttttcgggaactttttcatcggaatcctgctttttctggcccctttcgtgctcctggtcctgtttttcatgtttggctggaagattcttttctgttttaaatgctgtcggcgcaccagagggctcctgaagtaccggctgctcaaagacgacgaagagacgggctatagacgcatcattgaacggctgaataacaagaaaggaaagaatagacttctggatggcgagcgcctcgctgaccggaagatcgccgaactgttcagcacaaaaacccatattggg

SEQ ID NO: 14048 - RNA, 1932 nt, synthetic construct
  misc_feature 1..1932: note = derived and/or modified CDS sequence (opt5) from CCHFV(TADJ/HU8966)__AY179962.1__Gc
  source 1..1932: mol_type = other RNA
ttcctggacagcatcgtgaagggcatgaaaaaccccctcaattccacctctctggagacaagcctttccattgaagccccttggggagctatcaacgtccagtctacgtacaagccgaccgttagcacagccaatattgcgctgtcctggtctagcatcgagcacagagggaacaatattctcgtgtccggccggagcgaatctatcatgaaactggaggaacgcaccgggatctccggagatcttggcgtggaggacgctagcgagtctaagctgctcacagtctccgtgatggatctgagccaaatgtattctcccgtttttgaatacctgtccggggacagacaggtggaggaatggcctaaagctacctgcacaggagattgtcccgagcggtgcggctgtaccagctccacgtgcctccataaggagtggcctcactctcgcaactggagatgtaatcccacctggtgctggggcgtcgggacaggatgtacctgctgtggcctggacgtgaaggatcttttcattgactatatgtttgttaaatggaaggtggattacatcaaaacagaagccattgtctgcgtggagctgaccagccaggaacggcagtgttccctcgtggaggctgggacgcgcttcaacctgggacctgtcacaatcacccttagcgaaccgagaaatattcaacagaagctgccccctgagatcattacactccatccccggatcgaggaaggctttttcgacctgatgcacgttcagaaagtgctgtctgcctccaccgtgtgcaagctccagagctgcacccatggggtccctggagatctgcaagtgtatcacatcggcaaccttctgaagggcgacaaagagaatgggcacctcattcataagatcgaaccccactttaacacatcttggatgagctgggatggatgtgacctggactactattgcaatatgggcgattggccgtcctgtacgtacaccggggttacacagcataaccacgcttctttcgtgaatcttctgaacattgagaccgactacacaaaatcttttcacttccattccaagcgcgtcaccgcccacggagatacgcctcagctcgacctgaaagcgagacccacatatggcgccggggaaatcaccgtgctggttgaggtggctgatatggagctccataccaagaaaattgaaatcacaggactgaagtttgccagccttacctgcacaggctgttacgcttgcagctccggcatcagctgtaaggtccggattcacgtggacgagcctgatgaactgacggtccatgtgaaatctgacgatcccgacgttgtggccgcgtccagctccctcatggcccgcaagctggagttcgggaccgattctacatttaaagccttcagcgccatgcccaagacctccctttgcttctatatcgtcgaaagagagtaccggaaatcttgtagcaaggaggacacacagaagtgcgtgaacaccaaactggaacaacctcagtccattctcatcgagcacaagggaacgattatcggcaaacagaataacacctgtacagctaaggccagctgctggctggaatctgttaaatcctttttctatgggctgaagaatatgctcagcggaatctttggcaacgtgttcgtcgggatttttctgttccttgccccgtttatcctgctcattctgttctttatgttcggctggcgcatcctgtcttgctttaagtgttgcagacggaccagaggacttctcaaacaccgccatctgaaggacgatgaggagacaggctaccggagaattatcgaacgcctgaataacaaaaaggggaaaaataagctcctggacggagagcggcttgctgatagacgcattgcggaactgttctccaccaagacgcacatcggc

SEQ ID NO: 14049 - RNA, 1932 nt, synthetic construct
  misc_feature 1..1932: note = derived and/or modified CDS sequence (opt5) from CCHFV(Hodzha)__AY223476.1__Gc
  source 1..1932: mol_type = other RNA
ttcctggacagcatcgtgaagggcaccaaaaacctccttaattccacatctcttgagacgagcctgtccattgaagccccctggggagctatcaacgtccagtctacctacaagcctacagttagcaccgccaatattgcgctctcctggtctagcgtggagcacagagggaacaaaatcctggtgtccggccggagcgaatctattatgaagctggaggaacgcacagggatctcctgggatctgggagtcgaggacgctagcgagtctaaactcctgaccgtgtccgttatggatctgagccaaatgtattctccggtgtttgaatacctctccggcgacagacaggtcgaggaatggcccaaggccacatgcaccggggattgtcctgagcggtgcggatgtacgagctctacctgcctgcataaggagtggccccactctcgcaattggagatgtaaccctacatggtgctggggcgtgggcaccgggtgtacatgctgtggacttgacgttaaagatctgttcaccgactatatgtttgtgaagtggaaagtcgattacatcaagacggaagccattgtgtgcgtggagctcacaagccaggaacggcagtgttccctggtcgaggctggcacccgcttcaatcttgggcccgttacaatcaccctgagcgaacctagaaacattcaacagaaactcccgcccgagatcattaccctgcatcctcggatcgaggaaggatttttcgacctgatgcacgtgcagaaggtgctctctgcctccacagtctgcaagctgcagagctgcacgcatggcgtgcccggggatcttcaagtttatcacattggaaatctgctcaaaggcgacaaggtgaacggccacctgatccataaaatcgagcctcactttaatacctcttggatgagctgggatgggtgtgaccttgactactattgcaacatgggagattggccctcctgtacatacaccggcgtcacacagcataatcacgcttctttcgtgaacctgctcaatattgaaaccgactacacaaagagctttcacttccattccaaacgcgttacggcccacggggataccccgcagctggacctgaaggcgagacctacctatggagccggcgagatcacagtgctcgtcgaagtggctgatatggagctgcataccaaaaagattgagatcacagggcttaagtttgccagcctgacgtgcaccggatgttacgcttgctcctccggcattagctgtaaagtccggatccacgtggacgaacccgatgagctcacagttcatgtgaagtctgacgatcctgacgtcgtggccgcgtccagctccctgatggcccgcaaacttgaatttggcaccgattctacatttaaggctttcagcgccatgcccaaaacctccctgtgcttctatatcgttgagagagaatactgtaagtcttgcagcaaggaggacacgcagaaatgtgtgaacaccaagctcgagcaaccccagtccattctgatcgaacggaaagggacaattatcggaaagcagaacaatacctgcacagctaaagccagctgctggctggagtctgtcaagtcctttttctatggcctcaagaacatgctgagcgggatttttggaaatgtgttcgtgggcatctttcttttcctggccccttttatcctcctgattctgttctttatgttcgggtggcgcatccttttctgtttcaaatgctgtagacggaccagaggcctctttaagtacaaacacctgaaggacgatgaagagacgggatatcgccggattatcgagagactgaacaataaaaagggcaagaacaaactcctggacggggaacgccttgctgatcggagaattgcggagctgttctctacaaagacccacatcgga

SEQ ID NO: 14050 - RNA, 1932 nt, synthetic construct
  misc_feature 1..1932: note = derived and/or modified CDS sequence (opt5) from CCHFV(Kosovo/9553/2001)__AY675511.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtttaagcctaccgttagcacagccaatattgcgctctcctggtctagcgtggagcacagagggaacaaaatcctggtgaccggccggtccgaaagcattatgaagctggaggaacgcacaggggtctcttgggatctgggagtggaggacgcttccgagagcaaactcctgaccgtttctatcatggatctgtcccaaatgtacagcccggtgttcgaatatctctctggcgacagacaggtcgaggaatggcccaaggccacatgcaccggggattgtcctgagcggtgcggatgtacgtccagcacatgcctgcataaggagtggccccactcccgcaattggagatgtaaccctacatggtgctggggcgtgggcaccgggtgtacatgctgtggagttgacgtgaaagatctttttaccgaccatatgttcgtcaagtggaaagtggaatacatcaagacggaggccattgtgtgcgtcgaactgacatctcaggagcggcagtgtagcctcatcgaagctggcacccgctttaatctggggcccgttacaattaccctttccgagcctagaaacatccaacagaaactgccgcccgagattatcaccctccaccctaagattgaagagggattctttgatctgatgcatgtgcagaaggtgctgagcgcctctacagtctgcaaactccagtcctgcacgcacggcatccccggggacctgcaagtgtatcacatcggaaatcttctgaagggcgatcgggttaacggccatctcattcacaaaatcgaacctcatttcaataccagctggatgtcttgggacgggtgtgatctggactactattgcaacatgggagactggcccagctgtacatacaccggcgtgacacagcacaatcacgctgcctttgtcaaccttctgaatattgagaccgattatacgaagacattccattttcactccaaacgcgtgaccgcgcatggggacaccccgcagctcgatctgaaggccagacctacatacggagctggcgaaatcaccgttctggtggaggtcgccgacatggagctccacaccaaaaaggtggaaatttctgggctgaagttcgctagccttgcctgcacgggatgttacgcgtgctccagcggcatctcttgtaaagtccggatccatgtggatgagcccgacgaactgaccgttcacgtgaagtccagcgatcctgacgtcgtggccgcttctacatccctcatggcccgcaaactggagtttggcaccgatagcacattcaaggctttctccgccatgcccaaaacctctctttgcttttatattgttgaaaaggagtactgtaagagctgctccgaggacgatacgaaaaagtgtgtggacaccaaactggaacagccccaatctatcctcattgagcacagagggacaatcattggaaagcctaacgatacctgcccggccaaaacaagctgctggctggaatccgtcaagagcttcttttatggcctgaagaacatgctcgggtctgtgttcggaaactttttcatcggcatcctgctttttctggctcccttctttctctggatgctgtccttcatgtttgggtggaaaattctgttctgttttaagtgctgtcggcgcaccagaggccttttcaaataccggcatctcaaggacgacgaggagacgggatatagacgcatcattgaacggctgaataataaaaagggcaagaacagactgctcgatggggagcgcctggcggaccggaaaatcgccgaacttttcagcacaaagacccacattgga

SEQ ID NO: 14051 - RNA, 1932 nt, synthetic construct
  misc_feature 1..1932: note = derived and/or modified CDS sequence (opt5) from CCHFV(SPU41/84)__AY900142.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtacaagcctaccgttagcacagccaatattgcgctctcctggtctagcgtggagcacagagggaacaaaatcctggtgtccggccggagcgaatctattatgaagctggaggaacgcaccgggatctcctgggatctgggagtcgaggacgctagcgagtctaaactcctgacagtgtccgttatggatctgagccaaatgtattctccggtgtttgaatacctctccggcgacagacaggtcgaggaatggcccaaggccacatgcacaggggattgtcctgagcggtgcggatgtaccagctccacgtgcctgcataaggagtggccccactctcgcaattggagatgtaaccctacctggtgctggggcgtgggcacagggtgtacctgctgtggacttgacgttaaagatctgttcacagactatatgtttgtgaagtggaaagtcgaatacatcaagaccgaggccattgtgtgcgtggaactcacgagccaggagcggcagtgttccctgatcgaagctggcacacgcttcaatcttgggcccgtcaccattacactgagcgagcctagaaacatccaacagaaactcccgcccgagattatcaccctgcatcctcggattgaagagggatttttcgatctgatgcacgttcagaaggtgctctctgcctccaccgtgtgcaagctgcagagctgcacacatggcgtccccggggaccttcaagtgtatcacatcggaaatctgctcaaaggcgataaggttaacggccacctggtgcataaaatcgaacctcactttaatacgtcttggatgagctgggacgggtgtgatcttgactactattgcaacatgggagactggccctcctgtacctacacaggcgtcacccagcataatcacgcttctttcgtgaacatgctgaatattgagacagattacaccaagaactttcacttccatagcaaacgcgttacggcccacggggacacaccgcagctcgatctgaaggcgagacctacctatggagccggcgaaatcaccgtgctggtcgaggtggctgacatggagctccataccaaaaagattgaaatctccgggctgaagtttaccagccttacatgcacgggatgttacgcctgttcttccggcattagctgcaaagtccggatccacgtggatgagcccgacgaactgaccgttcatgtgaagtctgaggatcctgacgtcgtggctgcctccagctccctcatggcgcgcaaactggaatttggcacagattctacctttaaggccttcagcgctatgcccaaaacatccctttgcttctatatcgttgagagagagtactgtaagtcttgcagcgaagaggacacccagaagtgtgtgaacacgaaactggaacaaccccagtccattctcatcgagcggaaggggaccattatcggaaaacagaataacacatgcaaggccaaagctggctgctggctggagagcgtcaagtctttcttctatgggctgaagaatatgctctccggaatttttggcaacgtgttcatcgggatctttctgttccttgccccttttattctgctcatcctgttctttatgttcggctggcgcattctgttttgtttcaaatgctgtagacggaccagaggactttttaagtaccgccacctcaaagatgacgaagagacaggctatcggaagatcattgaaagactgaataacaaaaaggggaagaataaactgctcgacggagagcgcctggccgatcggagaatcgctgaacttttcagcaccaagacgcacattggc

SEQ ID NO: 14052 - RNA, 1932 nt, synthetic construct
  misc_feature 1..1932: note = derived and/or modified CDS sequence (opt5) from CCHFV(UG3010)__AY900143.1__Gc
  source 1..1932: mol_type = other RNA
tacctggacagcatcgccaagggcatgaaatccctcctgaactctaccaatcttgagacaagcctgtccattgaagctccctggggagccatcaacgtgcagtctacgttcaagcctaccgtcagcgcggctaatattgccctctcctggtctagcgttgagcacagagggaacaaaatcctggtgtccggccggagcgaatctattatgaagctggaggaacgcacagggatctcctggagcctgggagtggaggatgcctctgagtccaaaaccctcacagtcagcgtgatggacctgtctcaaatgtattccccggtttttgaatacctgagcggcgatagacaggtggaggaatggcccaaggctacctgcacaggggactgtcaggagcggtgcggatgtacctcctctacgtgcctccataaggagtggcctcacagccgcaattggagatgtaaccccacctggtgctggggcgtcggcacagggtgtacctgctgtggactggatgtgcgggaccttttcacagattatatgatggttaaatggaaggtggaatacgtcaaaaccgaggccatcatgtgcgtggaactgacgtcccaggagcgccaatgtagcctcattgaagctggcacaagatttaatctggggcctgtgaccatcacactttctgagccccggaacattcagcagcgcctgccttccgagatcgtcaccctccatccgaagattgaagagggattctttgacctgatgcacgttcagaaagtgctgagcgcctctaccgtgtgcaagctccaaagctgcacacatggcgtccccggggatcttcaggtgtatcacgttggaaatcttctgaagggcgacaaagtgaacggccactccatccataagattgaatctcacttcaatacgagctggatgtcctgggatgggtgtgacctcgattacttttgcaacatgggagactggcctagctgtacctatacaggcgtcacccagcataatagagcggccttcatcaacatgctgaatatcgagacagactacaccaaaacgtttcacttccactctaagcgggtgacagctcatggggatacaccccagcttgacctgaaagcccgccctacctacggagctggcgaagttaccgtgctcgtcgaggtggccgatctggagctgcacaccaagaaaattgaagtctccgggctcaagtttgcgagcctgacatgctctggatgttatgcctgctccagcggcatctcctgtaaggtgcggattcatgttaacgagcccgacgaatttacggtgcacgtcaaatctagcgatccggacgtggttgctgccggctcctctcttatggctagaaagatcgagtttggggccgatagcaccttcaaagccttctccagcatgcctaagaactctctgtgcttttacattgtggaacgcgactattgttccagctgcacaaatgatgacacccaaaaatgtgtcgatacaaagctcgagcatccccagtctatcctgatcgagcacaagggaaccattatcggcaaacagaacgacacgtgctccaccaagacaagctgctggcttgaatctgtgaaatccttcttttacgggctgaagaatatgctcggaggcattttcgggaacgtgtttctgggcatcttcctgtttctcgctcctttcgcgctgcttattttcttctttttctttggatggagactcctgttctgtctgaaatgctgtcggagaacccgcggcctgcttaagtataagcaactcaaagacgaggaagaggccgggtacaagaaaatcatcgagcggctgaatgataagaaaggaaagagcagactgttcgacggcgaacgcctcgctgatcggaagattgccgagctgtttagcacaaaaacccacatcggg

SEQ ID NO: 14053 - RNA, 1932 nt, synthetic construct
  misc_feature 1..1932: note = derived and/or modified CDS sequence (opt5) from CCHFV(Hy13)__AY900145.1__Gc
  source 1..1932: mol_type = other RNA
ttcagcgactccatcgtgaagggcatgaaaaacctgctcaattctaccagcctggagacatccctttctattgaagccccctggggagctatcaacgtccagagcacgtttaagcctaccgtttccgccgcgaatattgctctgtcttggagctccgtggagcacagagggaacaaaatcctcgtgagcggccggtctgaatccattatgaagctggaggaacgcacagggatcagctgggatcttggagtcgaggacgcctctgagtccaaactgctcaccgtgagcatcatggatctgtctcaaatgtactccccggttttcgaatatctgagcggcgacagacaggtggaggaatggcccaaggccacatgcaccggggattgtcctgagcggtgcggatgtacatcctctacctgcctccataaggagtggccccacagccgcaattggagatgtaaccctacgtggtgctggggcgtcggcaccgggtgtacatgctgtggactggacgtgaaagatctttttaccgaccatatgttcgttaagtggaaagtggaatacattaagacagaggctatcgtctgcgtggaactgacctcccaggagcggcagtgtagcctcattgaagccggcacgcgctttaatctggggcccgtgacaatcaccctttctgagcctagaaacattcaacagaaactgccgcccgagatcgtcacactccaccctcggattgaagagggattctttgatctgatgcatgttaagaaggtgctgtccgctagcaccgtgtgcaaactccagtcttgcacccacggcgtccccggggaccttcaggtgtatcacatcggaaatctgctgaagggcgataaagttaacggccatctcatccacaagattgaacctcatttcaatacaagctggatgtcctgggacgggtgtgatctggactactattgcaacatgggagactggccctcttgtagctacacgggcgtgacccaacacaatcacgccgcgtttgtcaacatgcttaatatcgagacagattataccaaaattttccattttcactccaagcgcgtgacagcccatggggacaccccgcagctggatctcaaagctagacctacgtacggagccggcgaaatcacagttctggtggaggtcgctgacatggagctgcacaccaagaagattgaaatcagcgggctcaaattcgcctctctgacctgcacaggatgttacgcgtgctccagcggcatctcttgtaaggtgcggattcatgtcgatgagcccgacgaacttaccgtgcacgttaaatccgaggatcctgacatcgtggccgctagctcctctctgatggcccgcaagctcgaatttggcacagatagcacgttcaaggctttctccgccatgcccaaaacctctctgtgcttttatattgtcgagagagagtactgtaagagctgctccaaagaagacacacagaagtgtgtgaacaccaaacttgagcagccccaaagcatcctgattgaacacaaggggacaatcatcggaaaacagaacgatacctgcacgtctaaggccggctgctggctcgagtccgttaagagcttcttttatgggctgaaaaatatgctgtctggaattttcggcaacgtgtttatcgggattttcctctttctggctcctttcatccttctgattctctttttcatgtttggctggcggatcctgttctgttttaagtgctgtcgcagaacccggggactgttcaaatacagacatcttaaggacgacgaggaaacaggctatcgcaaaattatcgagcggctcaataacaagaaggggaaaaataagctgctggatggagaaagactcgcggaccgcaaaatcgccgagctgttctccaccaagacacacattggc

SEQ ID NO: 14054 - RNA, 1932 nt, synthetic construct
  misc_feature 1..1932: note = derived and/or modified CDS sequence (opt5) from CCHFV(Semunya)__DQ094832.1__Gc
  source 1..1932: mol_type = other RNA
ttcctggacagcatcgccaagggcaaaaagtccctcctgaactctaccaatcttgagacaagcctgtccattgaagctccctggggagccatcaacgtgcagtctacgtttaaacctaccgtcagcgcggctaatattgccctctcctggtctagcgttgagcacagagggaacaagatcctggtgtccggccggagcgaatctattatgaaacttgaggaacgcacagggatctcctggagcctgggagtggaggatgcctctgagtccaagaccctcacagtcagcgtgatggacctgtctcaaatgtactccccggttttcgaatatctgagcggcgatagacaggtggaggaatggcccaaggctacctgcacaggggactgtcctgagcggtgcggatgtacctcctctacgtgcctccataaagagtggccccacagccgcaattggagatgtaaccctacctggtgctggggcgtcggcacagggtgtacctgctgtggactggatgtgcgggacctttttacagattacatgatggttaagtggaaagtggaatatgtcaagaccgaggccatcatgtgcgtggaactgacgtcccaggagcgccagtgtagcctcattgaagctggcacaagattcaatctggggcccgtgaccatcacactttctgagcctcggaacgtccaacagcgcctgccgtccgagattgttaccctccatcccaaaatcgaagagggatttttcgacctgatgcacgtgcagaaggtgctgttttgcaagtacagcctccaggccacctcttgcacacatggcgtccctggggatctgcaagtgtatcacgttggaaatcttctgaaaggcgacaaggtgaacggccacagcattcataaaatcgaatcccacttcaatacgtcttggatgagctgggatgggtgtgacctcgattacttttgcaacatgggagactggccctcctgtacctatacaggcgtcacccagcataatagagcggccttcgtgaacatgctgaatattgagacagactacaccaagacgtttcacttccacagcaaacgggttacagctcatggggatacccctcagcttgacctgaaggcccgccccacctacggagctggcgaagtgacagtcctcgtggaggtcgccgatctggagctgcacaccaaaaagatcgaagtgtctgggctcaagtttgcgtccctgacatgcagcggatgttatgcctgttcttccggcatcagctgcaaagttcggattcatgtgaacgagccggacgaatttacggtccacgtgaagtccaacgatcctgacgttgtggctgccggctctagccttatggctagaaaaatcgagttcggggccgattccaccttcaaggccttctctagcatgcccaaaaattccctgtgcttttacattgtcgaacgcgactattgtagctcttgcacagatgacgatacccagaagtgtgtgaacatcaagctcgagcatcctcaatccattctgatcgagcacaaaggaacaatcattggcaagcagaatgatacctgccccacgaaaaccagctgctggcttgaatctgtgaagtccttcttttacgggctgaaaaacatgctcggaggcatcttcgggaatgtttttctgggcattttcctgtttctcgctcccttcgcgctgcttatcctgtttttctttttcggatggagactcctgttctgtctgaagtgctgtcggagaacacgcggccttctcaagtataaacagctgaaggacgaggaagaggccgggtacaaaaagattatcgagcggctgaacgacaaaaagggaaagagcagactctttgacggcgaacgcctggctgatcggaaaatcgccaaacttttctctaccaagacacacattggg

SEQ ID NO: 14055 - RNA, 1932 nt, synthetic construct
  misc_feature 1..1932: note = derived and/or modified CDS sequence (opt5) from CCHFV(SPU128/81/7)__DQ157174.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtacaagcctaccgttagcacagccaatattgcgctctcctggtctagcgtggagcacagagggaacaaaatcctggtgtccggccggagcgaatctattatgaaacttgaggaacgcaccgggatctcctgggatctgggagtcgaggacgctagcgagtctaagctcctgacagtgtccgttatggatctgagccaaatgtattctccggtgtttgaatacctctccggcgacagacaggtcgaggaatggcccaaggctacctgcacaggggattgtcctgagcggtgcggatgtaccagctccacgtgcctgcataaggagtggccccactctcgcaattggagatgtaaccctacctggtgctggggcgtgggcacagggtgtacctgctgtggacttgacgttaaagatctgttcacagactatatgtttgtgaagtggaaagtcgaatacatcaagaccgaggccattgtgtgcgtggaactcacgagccaggagcggcagtgttccctgatcgaagccggcacacgcttcaatcttgggcccgtcaccattacactgagcgagcctagaaacatccaacagaaactcccgcccgagattatcaccctgcatcctcggattgaagagggatttttcgatctgatgcacgttcagaaggtgctctctgcctccaccgtgtgcaagctgcagagctgcacacatggcgtccccggggaccttcaagtgtatcacatcggaaatctgctcaaaggcgataaggttaacggccacctgatccataaaattgaacctcactttaatacgtcttggatgagctgggacgggtgtgatcttgactactattgcaacatgggagactggccctcctgtacctacacaggcgtgacccagcataatcacgcttctttcgtcaacctgctcaatatcgagacagattacaccaagaactttcacttccatagcaaacgcgtgacggcccacggggacacaccgcagctggatctgaaggcgagacctacctatggagccggcgaaattaccgttctcgtggaggtcgctgacatggagctgcataccaaaaagatcgaaatttccgggcttaagtttgccagcctgacctgcacaggatgttacgcttgctctagcggcatcagctgtaaagtgcggatccacgtcgatgagcccgacgaactcacggtgcatgttaagtctgatgaccctgatgtggtcgccgcgtccagctccctgatggcccgcaaacttgagttcggcaccgactctacatttaaggctttcagcgccatgcccaaaacctccctgtgcttctatattgtggaaagagagcactgtaagtcttgcagcgaggaagatacaaagaaatgtgttaacaccaagctcgagcagccccaatccatcctgattgaacacaaagggacgatcattggaaagcagaatagcacatgcacagctaaagcctcttgctggctggagtccgtgaagtcctttttctacggcctcaagaacatgctgtctgggatctttggaaatgtcttcatcggcatttttcttttcctggggccttttatcctcctgattctgttctttatgttcggctggcggatcctgttttgtttcaaatgctgtcgcagaacccggggactcctgaagtatagacatctgaaagaggacgaagagacaggctaccgccggattatcgaaagactcaacaataagaaagggaagaacaagctgcttgacggagagcgcctggccgatcggagaattgctgaactcttttccaccaaaacgcacatcggc

SEQ ID NO: 14056 - RNA, 1932 nt, synthetic construct
  misc_feature 1..1932: note = derived and/or modified CDS sequence (opt5) from CCHFV(ROS/HUVLV-100)__DQ206448.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtttaagcctaccgttagcacagccaatattgcgctctcctggtctagcgtggagcacagagggaacaaaatcctggtgaccggccggtccgaaagcattatgaagctggaggaacgcacaggggtctcttgggatctgggagtggaggacgcttccgagagcaaactcctgaccgtttctatcatggatctgtcccaaatgtacagcccggtgttcgaatatctctctggcgacagacaggtcgaggaatggcccaaggccacatgcaccggggattgtcctgagcggtgcggatgtacgtccagcacatgcctgcataaggagtggccccactcccgcaattggagatgtaaccctacatggtgctggggcgtgggcaccgggtgtacatgctgtggagttgacgtgaaagatctttttaccgaccatatgttcgtcaagtggaaagtggaatacatcaagacggaggccattgtgtgcgtcgaactgacatctcaggagcggcagtgtagcctcatcgaagctggcacccgctttaatctggggcccgttacaattaccctttccgagcctagaaacatccaacagaaactgccgcccgagattatcaccctccaccctaaggtggaagagggattctttgatctgatgcatgtgcagaaggtcctgagcgcctctacagtgtgcaaactccagtcctgcacgcacggcattcccggggacctgcaagtttatcacatcggaaatcttctgaagggcgatcgggtgaacggccatctcatccacaaaattgaacctcatttcaataccagctggatgtcttgggacgggtgtgatctggactactattgcaacatgggagactggcccagctgtacatacaccggcgtcacacagcacaatcacgctgcctttgtgaaccttctgaatatcgagaccgattatacgaagacattccattttcactccaaacgcgttaccgcgcatggggacaccccgcagctcgatctgaaggccagacctacatacggagctggcgaaattaccgtgctggtcgaggtggccgacatggagctccacaccaaaaaggtcgaaatctctgggctgaagttcgctagccttgcctgcacgggatgttacgcgtgctccagcggcatttcttgtaaagtgcggatccatgttgatgagcccgacgaactgaccgtgcacgtcaagtccagcgatcctgacgtggttgccgcttctacatccctcatggcccgcaaactggagtttggcaccgatagcacattcaaggctttctccgccatgcccaaaacctctctttgcttttatatcgtggaaagagagtactgtaagagctgctccgaggaagacacgcagaagtgtgtcgataccaaactggagcaaccccagtctattctcatcgaacacaaggggacaattatcggaaaacagaacgatacctgcacagccaaggctagctgctggctggagtccgtgaaatctttcttttatggcctgaagaacatgctcgggagcgtgttcggaaactttttcattggcatcctgctttttctggcgcctttcgttctcctggtcctgtttttcatgtttgggtggaagatccttttctgttttaaatgctgtcggcgcaccagaggcctcctgaagtaccggctgctcaaagacgacgaggaaacgggatatagacgcattatcgagcggctgaataataagaaaggcaagaacagacttctggacggggaacgcctcgccgatcggaagattgctgagctgttctccacaaaaacccatatcgga

SEQ ID NO: 14057 - RNA, 1932 nt, synthetic construct
  misc_feature 1..1932: note = derived and/or modified CDS sequence (opt5) from CCHFV(AP92)__DQ211625.1__Gc
  source 1..1932: mol_type = other RNA
ttcctggacagcatcgccaagggcgtgaaaaacctccttaattccacctctcttgagacaagcctgtccattgaagctccctggggagccatcaacgcgcagtctacgtacaagcctaccgctagctccgccaatattgccctcacatggtctagcgtcgagcacagagggaacaaaatcctggtttccggccggagcgaatctattatgaaacttgaggaacgcaccgggatctcctggaatctgggagtggaggatgctagcgagtctagaacactcaccatctccgtgatggacctgagccaaatgtattctccggtctttgaatacctgtccggcgatcgccaggtggaggaatggcccaaagccacatgcaccgggaactgtcctgagcggtgcggatgtacgagctctacctgcctctataaggagtggccccattctagaaattggcggtgtaaccctacatggtgctggggcgttggcaccgggtgtacatgctgtggactggacgtgaaggaacttttcaccgatcacatgctggtcaaatggaaggtggagtacattaaaacggaagctatcgtttgcgtggagctcacaagccaggaacgccagtgttccctgattgaggccggcaccagatttagccttgggcccgtcacaatcaccctgtctgagcctcggaatattcaacagaagctcccgcccgaactgatcaccctgcatcctaaaattgaggacggatatttcgatctcatgcacgtgcagaaggtgatgtccgcgagcacagtctgcaagctgcagtcttgcacgcatggcgttcccggggaccttcaaatctaccacgtgggaaacctgctcaaaggcgatcgcgtgaatggccacctgatccataaggtcgaacctcaccttaacaccagctggatgtcctgggacgggtgtgatctggactatttttgcaatatgggagattggccctcttgtacatacaccggcgtgacacagcataaccacgccgctttcgccaatctcctgaacattgagaccgactacacgaaaacatttcacttccatagcaagagagttaccgctcacggggacaccccgcagctggatctcaaagcccggcctcgctatggagcgggcgaaatcacagtgctggtcgaggtggccgacatggagcttcataccaagaaagttgaagtgacagggctgaagtttgcttccctcacgtgcagcggatgttacgcctgctcctccggcattagctgtaaggtcagaatccacgtggatgagcccgacgaactgaccgtccatgtgaaatcttccgatcctgacattgttgctgccagctcctctcttatggcccggaagatcgagttcggcgtggatagcacatttaaggctttctcctctatgcccaaggacagcctgtgcttttatatcgtcgaacgcgattactgtaactcctgcaaaaatgaggagacccagagatgtgtgaacgcgaagctcgaacaaccccagagcattctgatcgagcacacagggaccattatcggaaagcagaatgacacgtgcggctctcggacctcctgctggctggatagcttcaaatctttcttttatgggctcaagtccatgctgagcggaattttcggcaacgtttttcttgggatcttcctgtttctcgcccctttcgctctgctgctgtttttctttttctttggctggagaatcctcttctgttttaaatgctgtcgccggacaagaggactgttcaagtaccgccacattaaagacgacgaagaggtgggctataagaagatcattgagcggctgaataacaaaaaggggaaacatagactcctggatggagaacgccttgccgaccggaagatcgccgagctgttctctaccaaaacacacattggc

SEQ ID NO: 14058 - RNA, 1932 nt, synthetic construct
  misc_feature 1..1932: note = derived and/or modified CDS sequence (opt5) from CCHFV(ArD8194)__DQ211626.1__Gc
  source 1..1932: mol_type = other RNA
ttcctggacagaatcgccaagggcatgaaaagcctcctgaactccacctctcttgagacaagcctgtccattgaagctccctggggagccatcaatgtgcagtctacgtttaagcctaccgtcagcgcggctaacattgccctctcctggtctagcgttgagcacaaagggaataagatcctggtgtccggccggagcgaatctattatgaaacttgaggaacgcacagggatctcctggtgcctgggagtggaggatgccagcgagtctaagaccctcacagtctccgtgatggacctgagccaaatgtactctccggttttcgaatatctgtccggcgatagacaggtggaggaatggcccaaggctacctgtacaggggactgccctgagcggtgtggatgcaccagctccacgtgtctccataaagagtggccccactctcgcaactggagatgcaatcctacctggtgttggggcgtcggcacagggtgcacctgttgcggactggatgtgaaggacctttttacagattacatgctggttaaatggaaggtggaatatatcaaaaccgaggccattatctgtgtcgaactcacgagccaggagcggcagtgctccctgattgaagctggcacacgcttcaaccttgggcccgtgaccatcacactgagcgagcctagaaatgtgcaacagcggctcccgcccgagattatcaccctgcatcctaagattgaagagggatttttcgacctgatgcacgtccagaaggttatgtctgcctccaccgtgtgcaaactccagagctgtacacatggcgtgcccggggatctgcaagtctaccacgtgggaaaccttctgaagggcgacaaagttaatggccactctatccataagatcgaaagccacctcaacacgtcctggatgtcttgggatgggtgcgacctggattatttttgtaatatgggagactggcctagctgcacctacacaggcgtgacccagcataaccacgcggccttcattaatatgcttaacatcgagacagactataccaaaacgtttcacttccattccaagcgcgtcacagctcacggggatacaccccagctggacctcaaagccagaccggcttacggagccggcgaaattaccgtgctggttgaggtggcggatctggagctccataccaagaagatcgaagtcagcgggctgaaatttgcctctctttcctgtagcggatgctacgcttgttcttccggcattagctgcaaggtgcggatccacgtcaatgagcctgacgaatttaccgtgcatgttaaatccaacgatcccgacgtggtcgccgctggctctagcctgatggcccgcaagatcgagtccggggccgattctacatttaaggctttcagctccatgcctaaaaacagcctctgtttctatattgtggaaagagactactgctctagctgtacggatgacgatacccagaagtgcgttgacatcaaactggagcacccccaaagcattcttatcgagcacaagggaacaattatcggcaaacagaatgatacctgccccacaaagacctcttgttggctggaatccatcaaatcctttttctatgggctcaagaacatgctgtctggaatttttggcaatgtgttcctggggatgctcctgtttcttgcgcctttcatcctgctcattctgtttttctttttcggctggcggctgcttttctgcctcaagtgttgccgcagaacgcggaaactgctgaagtacaaacatctcagagacgaggaagagagcggatataagaaaatcattgagcgcctgaacgacaagaagggcaaatcccggcttttcgatggggaaagactggccgaccgcaagatcgctgagctctttagcaccaaaacacacattgga

SEQ ID NO: 14059 - RNA, 1932 nt, synthetic construct
  misc_feature 1..1932: note = derived and/or modified CDS sequence (opt5) from CCHFV(ArD15786)__DQ211627.1__Gc
  source 1..1932: mol_type = other RNA
agcctggactccatcgccaagggcatgaaatctctcctgaacagcacctcccttgagacatctctgagcattgaggctccctggggagccatcaatgtgcagtccacgttcaagcctaccatttctgcggctaacatcgccctcagctggtccagcgtcgagcacaaagggaataagattctggtttctggcagatccgaaagcatcatgaaacttgaggaacggacagggatctcttggtgcctgggagtggaggatgcctccgagagcaagaccctcacagtgtctgtcatggacctgtcccaaatgtacagcccggtgtttgaatatctgtccggcgatcgccaggttgaggaatggcccaaggctacctgtacaggggactgccctgagagatgtggatgcacctctagcacgtgtctccataaagagtggccccactcccggaactggcgctgcaatcctacctggtgttggggcgtgggcacagggtgcacctgttgcggactggatgtcaaggaccttttcacagattacatgctggtgaaatggaaggttgaatatattaaaaccgaggccatcatttgtgtggaactcacgagccaggagagacagtgctctctgatcgaagctggcacacggtttaaccttgggcccgtcaccattacactgtccgagcctcgcaatgtgcaacagagactcccgcccgagatcattaccctgcatcctaagatcgaagagggattctttgacctgatgcacgtgcagaaggtcatgagcgcctctaccgtttgcaaactccagagctgtacacatggcgtgcccggggatctgcaagtgtaccacgtcggaaaccttctgaagggcgacaaagtgaatggccactccatccataagattgaatctcacctcaacacgagctggatgtcctgggatgggtgcgacctggattatttctgtaatatgggagactggcctagctgcacctacacaggcgttacccagcataaccgggcggcctttatcaatatgcttaacattgagacagactataccaaaacgttccactttcactctaagcgcgtgacagctcatggggatacaccccagctggacctcaaagccagaccgacctacggagctggcgaaatcaccgtcctggtggaggttgccgatctggagctccacaccaagaagattgaagtgtccgggctgaaattcgcgagccttacatgttctggatgctacgcctgttccagcggcatctcctgcaaggtccggatccatgtgaatgagcctgacgaatttacggtccacgtgaaatctaacgatcccgacgttgtggctgccggcagctccctgatggctcgcaagattgagtctggggccgatagcaccttcaaagccttttccagcatgcctaagaactctctctgtttctatatcgtcgaaagagactactgctccagctgtacagatgacgatacccagaagtgcgtggacattaaactggagcatccccaatctatccttattgagcacaagggaacaatcatcggcaaacagaatgatacctgccccacgaagacctcctgttggctggaaagcattaaatctttcttttatgggctcaagaacatgctgagcggaatcttcggcaatatttttctggggatgctcctgttccttgctccttttgttctgctcatcctgttctttttctttggctggcggctgcttttctgcctcaagtgttgccgcagaacacggaaactgctgaagtacaaacacctcagagacgaggaagagtccggatataagaaaattatcgagcgcctgaacgacaagaagggcaaaagccggctttttgatggggaaagactggcggaccgcaagattgccgaactcttctctaccaaaacacatgtggga

SEQ ID NO: 14060 - RNA, 1932 nt, synthetic construct
  misc_feature 1..1932: note = derived and/or modified CDS sequence (opt5) from CCHFV(ArD39554)__DQ211628.1__Gc
  source 1..1932: mol_type = other RNA
ttcctggacagcaccgccaagtccatgaaatctctcctgaacagcacatcccttgagacgtctctgagcatcgaagctccctggggcgccattaatgtgcagtccacctttaagcctacagcgtctaccgctaacatcgccctcagctggtccagcgtcgagcacagagggaataaaattctggttacaggacggtctgaatccatcatgaagctcgaggaacgcaccggcattagctggaacctgggggtggaggatgcctctgagtccaaaacactcaccgtgagcgtcatggacctgtctcaaatgtactccacggtgttcgaatatctgagcggagatagacaggttgaggaatggccgaaggctacctgcacaggcgactgtcccgagcggtgcgggtgtacctcctctacatgcctccataaggcctggcctcacagccgcaattggagatgtaaccccacctggtgctggggagtgggcacgggctgtacatgctgtgggctggatgtcaaaaatctttttaccgactacatgctgatcaagtggaaagtggagttcatcaagacagaagctattgtttgcgtggagctcacctcccaggaacggcagtgtagcctgatcgaggccggaacccgctttaaccttggccctgtcacaattacgctgtctgaacccagaaatatccaacagaaactccctccggagctggtgaccctgcatccccgggtggaggaagggttctttgatctcatgcacgtccagaaggttctgtccgcgagcacagtgtgcaaacttcagtcttgcacccatggagtgcctggcgacctgcaagtctatcacgtggggaacctcctgaagggagataagattaatggcaacagcttccacaaaatcgagcccaatcttaacacatcctggatgtcttgggacggctgtgatctggactactattgcaatatgggggattggcctagctgtacctacacgggagttacacagcataaccacgccgcttttgtgaacctcctgaatattgaaaccgactataccaagaacttccattttcactccaaacgcgtcacagcccacggcgagacaccccagctggacctcaaggctagaccgaaatacggggccggagaagtgaccgttctggtggaggtcgcggatatggagcttcatacgaagaagatcgaaatcagcggcctgaaattcgcctctcttacctgcacagggtgttacgcttgctccagcggaatttcttgtaaggtgcggctgcacgtcgacgagcctgatgaacttaccgtgcatgttaaatccgacgatcccgacgtggtcgccgctagctcctctctgatggcccgcaagatcgagtttggcacagatagcaccttcaaagccttctcctctatgcctaaggacaagctctgcttttatattgtggaaagagattactgtagctcctgcagcaaagaggacacgcagaagtgtgttaatgctaaactggagcaaccccagtctatcctgattgaacacaagggcaccatcatcgggaaacagaacgatacatgcaccgtgaaggcgtcctgctggctcgagagcgtcaagtctttcttttatggactgaaaaatatgcttggcgggattttcggaaacgtgatcctgggcattatcatgtttctcgcccccttcgctctgctgcttctctttttcctgtttgggtggcggattctgttctgtctccgctgctgtagacggacaagaggcctgtttaagtacaaacatatcaaggacgacgaagagtccggatataaacgcatcattgagcggcttaataacaagaagggcaaaaataagctgttcgatggggaaagactcgccgacaaaaagatcgccgagctgtttagcaccaaaacgcacattgga

SEQ ID NO: 14061 - RNA, 1932 nt, synthetic construct
  misc_feature 1..1932: note = derived and/or modified CDS sequence (opt5) from CCHFV(C-68031)__DQ211629.1__Gc
  source 1..1932: mol_type = other RNA
ttcagcgactccatcgtgaagggcatgaaaaacctgctcaattctaccagcctggagacatccctttctattgaagccccctggggagctatcaacgtccagagcacgtttaagcctaccgtttccgccgcgaatattgctctgtcttggagctccgtggagcacagagggaacaaaatcctcgtgagcggccggtctgaatccattatgaagctggaggaacgcacagggatcagctgggatcttggagtcgaggacgcctctgagtccaaactgctcaccgtgagcatcatggatctgtctcaaatgtactccccggttttcgaatatctgagcggcgacagacaggtggaggaatggcccaaggccacatgcaccggggattgtcctgagcggtgcggatgtacatcctctacctgcctccataaggagtggccccacagccgcaattggagatgtaaccctacgtggtgctggggcgtcggcaccgggtgtacatgctgtggactggacgtgaaagatctttttaccgactacatgttcgttaagtggaaagtggaatatattaagacagaggctatcgtctgcgtggaactgacctcccaggagcggcagtgtagcctcattgaagccggcacgcgctttaatctggggcccgtgacaatcaccctttctgagcctagaaacattcaacagaaactgccgcccgagatcgtcacactccatcctcggattgaagagggattctttgatctgatgcacgttaagaaggtgctgtccgctagcaccgtgtgcaaactccagtcttgcacccatggcgtccccggggaccttcaggtgtaccacatcggaaatctgctgaagggcgataaagttaacggccacctcatccataagattgaacctcacttcaatacaagctggatgtcctgggacgggtgtgatctggactattactgcaacatgggagactggccctcttgtagctatacgggcgtgacccaacataatcacgccgcgtttgtcaacatgcttaatatcgagacagattacaccaaaattttccactttcattccaagcgcgtgacagcccacggggacaccccgcagctggatctcaaagctagacctacgtacggagccggcgaaatcacagttctggtggaggtcgctgacatggagctgcataccaagaagattgaaatcagcgggctcaaattcgcctctctgacctgcacaggatgttatgcgtgctccagcggcatctcttgtaaggtgcggattcacgtcgatgagcccgacgaacttaccgtgcatgttaaatccgaggatcctgacatcgtggccgctagctcctctctgatggcccgcaagctcgaatttggcacagatagcacgttcaaggctttctccgccatgcccaaaacctctctgtgcttttacattgtcgagagagagtattgtaagagctgctccaaagaagacacacagaagtgtgtgaacaccaaacttgagcagccccaaagcatcctgattgaacacaaggggacaatcatcggaaaacagaacgatacctgcacgtctaaggccggctgctggctcgagtccgttaagagcttcttttacgggctgaaaaatatgctgtctggaattttcggcaacgtgtttatcgggattttcctctttctggctcctttcatccttctgattctctttttcatgtttggctggcggatcctgttctgttttaagtgctgtcgcagaacccggggactgttcaaatatagacaccttaaggacgacgaggaaacaggctaccgcaaaattatcgagcggctcaataacaagaaggggaaaaataagctgctggatggagaaagactcgcggaccgcaaaatcgccgagctgttctccaccaagacacatattggc

SEQ ID NO: 14062 - RNA, 1932 nt, synthetic construct
  misc_feature 1..1932: note = derived and/or modified CDS sequence (opt5) from CCHFV(Drosdov)__DQ211630.1__Gc
  source 1..1932: mol_type = other RNA
ttcctggacagcaccgtgaagggcatgaaaaacctccttaattccacatctcttgagacgagcctgtccatcgaagccccctggggagctattaacgtccagtctacctttaagcctacagttagcaccgccaatatcgcgctctcctggtctagcgtggagcacagagggaacaaaattctggtgacaggccggtccgaaagcatcatgaagctggaggaacgcaccggggtctcttgggatctgggagtggaggacgcttccgagagcaaactcctgacagtttctattatggatctgtcccaaatgtacagcccggtgttcgaatatctctctggcgacagacaggtcgaggaatggcccaaggctacctgcacgggggattgtcctgagcggtgcggatgtacctccagcacatgcctgcataaggagtggccccactcccgcaattggagatgtaaccctacctggtgctggggcgtgggcacagggtgtacctgctgtggagttgacgtgaaagatctttttacggaccatatgttcgtcaagtggaaagtggaatacatgaagacagaggccatcgtgtgcgtcgaactgacctctcaggagcggcagtgtagcctcatcgaagccggcacacgctttaatctggggcccgttaccattaccctttccgagcctagaaacatccaacagaaactgccgcccgagattatcacactccaccctaagattgaagagggattctttgatctgatgcatgtgcagaaggtgctgagcgcctctacggtctgcaaactccagtcctgcacccacggcatccccggggacctgcaaatttatcacatcggaaatcttctgaagggcgatcgggtgaacggccatctcatccacaaaattgaacctcatttcaatacaagctggatgtcttgggacgggtgtgatctggactactattgcaacatgggaaattggcccagctgtacctacacaggcgttacccagcacaaccacgctgcctttgtgaatcttctgaacatcgagacggactatacaaagaccttccattttcactccaaacgcgtcaccgcgcatggggatacaccgcagctcgacctgaaggccagacctacctacggagctggcgaaattacagtgctggttgaggtggccgatatggagctccacacgaaaaaggtcgaaatctctgggctgaagttcgctagccttgtgtgcaccggatgttacgcctgctccagcggcatttcttgtaaagtccggatccatgtggacgagcccgatgaactgacagttcacgtgaagtccagcgaccctgatgtcgtggcggcctctacctccctcatggctcgcaaactggagtttggcacagacagcatcttcaaggccttctccgctatgcccaaaacctctctttgcttttatattgttgaaagagagtactgtaagagctgctccgaggatgacacgaagaaatgtgtggataccaagctggaacagccccaatctatcctcattgagcacaaagggacaatcattggaaagcagaacgatacctgcacagccaaagccagctgctggctggaatccgtcaagagcttcttttatggcctgaagaatatgctcgggtctgtgttcggaaactttttcgtgggcatcctgctttttctggctcctttcgttctcctggtcctgtttttcatgtttgggtggaaaatccttttctgttttaagtgctgtcggcgcaccagaggcctcttcaaataccggcatctgaaggacgacgaggagacgggatatagacgcattatcgaacggctcaattccaaaaagggcaagaacagactgctggacggggagcgccttgcggatcggaaaattgccgaactgttcagcacaaagacccacatcgga

SEQ ID NO: 14063 - RNA, 1932 nt, synthetic construct
  misc_feature 1..1932: note = derived and/or modified CDS sequence (opt5) from CCHFV(Kashmanov)__DQ211631.1__Gc
  source 1..1932: mol_type = other RNA
ttcctggacagcatcgtgaagggcatgaaaaactccctcaattctaccagcctggagacatccctttctattgaagccccctggggagctatcaacgtccagagcacgtttaagcctaccgtttccacagccaatattgcgctgtcttggagctccgtggagcacagagggaacaaaatcctcgtgaccggccggagcgaatctattatgaagctggaggaacgcacaggggtctcctgggatcttggagtggaggacgctagcgagtctaaactgctcaccgtttccatcatggatctgagccaaatgtactctccggtgttcgaatatctgtccggcgacagacaggtcgaggaatggcccaaggccacatgcaccggggattgtcctgagcggtgcggatgtacgagctctacctgcctccataaggagtggccccactcccgcaattggagatgtaaccctacatggtgctggggcgtgggcaccgggtgtacatgctgtggagttgacgtgaaagatctgtttaccgaccatatgttcgtcaagtggaaagtggaatacatcaagacggaggccattgtgtgcgtcgaacttacaagccaggagcggcagtgttccctgatcgaagctggcacccgctttaatctcgggcccgttacaattaccctgagcgagcctagaaacatccaacagaaacttccgcccgagattatcaccctgcaccctaaggtggaagagggattctttgatctcatgcatgtgcagaaggtcctgtctgcctccacagtgtgcaaactgcagagctgcacgcacggcattcccggggacctccaagtttatcacatcggaaatctgcttaagggcgatcggatcaacggccatctgattcacaaaatcgaacctcatttcaatacctcttggatgagctgggacgggtgtgatctcgactactattgcaacatgggagactggccctcctgtacatacaccggcgtgacacagcacaatcacgctgcctttgtcaacctgcttaatattgagaccgattatacgaagacattccattttcactctaaacgcgtgaccgcgcatggggacaccccgcagctggatctcaaggccagacctacatacggagctggcgaaatcaccgttctggtggaggtcgccgacatggagctgcacacaaagaaggtggaaattagcgggctcaagttcgcttccctggcctgcacgggatgttacgcgtgcagctctggcatctcctgtaaagtccggatccatgtggatgagcccgacgaacttaccgttcacgtgaaaagctctgatcctgacgtcgtggccgcttccacaagcctgatggcccgcaaactcgagtttggcaccgattccacattcaaggctttctctgccatgcccaaaaccagcctgtgcttttatattgttgaaagagagtactgtaagtcctgctctgaggaagacacgcagaagtgtgtggataccaaacttgagcaaccccagagcatcctgattgaacacaaggggacaatcattggaaaacagaacgatacctgcacagccaaggcttcctgctggctcgagagcgtcaaatctttcttttatggcctgaagaacatgctggggtccgtgttcggaaactttttcatcggcatcctcctgtttcttgcgcctttcgtgctgctcgttctgtttttcatgtttgggtggaagattctgttctgttttaaatgctgtcggcgcaccagaggccttctcaagtaccggcatctgaaagacgacgaggaaacgggatatagacgcatcattgagcggctgaataataagaaaggcaagaacagactcctggacggggaacgccttgccgatcggaagatcgctgagctgttcagcacaaaaacccacattgga

SEQ ID NO: 14064 - RNA, 1932 nt, synthetic construct
  misc_feature 1..1932: note = derived and/or modified CDS sequence (opt5) from CCHFV(Oman)__DQ211632.1__Gc
  source 1..1932: mol_type = other RNA
ttcctggacagcatcgccaagggcatgaaaaacctccttaattccacctctcttgagacaagcctgtccattgaagctccctggggagccatcaacgtgcagtctacgtttaagcctaccgtcagcacagcgaatattgctctctcctggtctagcgttgagcacagagggaacaaaatcctggtgtccggccggagcgaatctattatgaagctggaggaacgcaccgggatctcctgggatctgggagtggaggacgccagcgagtctaaactcctgacagtctccgtgatggatctgagccaaatgtactctccggttttcgaatatctctccggcgacagacaggtggaggaatggcccaaggctacctgcacaggggattgtcctgagcggtgcggatgtaccagctccacgtgcctgcataaggagtggccccactctcgcaattggagatgtaaccctacctggtgctggggcgtcggcacagggtgtacctgctgtggacttgacgtgaaagatctgtttacagactacatgttcgttaagtggaaagtggaatatatcaagaccgaggccattgtctgcgtggaactcacgagccaggagcggcagtgttccctgatcgaagccggcacacgctttaatcttgggcccgtgaccattacactgagcgagcctagaaacatccaacagaaactcccgcccgagattgtcaccctgcatcctcggatcgaagagggattctttgatctgatgcacgttcagaaggtgctctctgcttccaccgtgtgcaagctgcagagctgcacacatggcgtccccggggaccttcaagtgtaccacattggaaatctgctcaaaggcgataaggttaacggccacctgatccataaagtggaacctcacttcaatacgtcttggatgagctgggacgggtgtgatcttgactattactgcaacatgggagactggccctcctgtacctatacaggcgtcacccagcataatcacgccgcgtttgtgaacctgctcaatatcgagacagattacaccaagaacttccactttcattctaaacgcgttacggcccacggggacacaccgcagctggatctgaaggctagacctaactacggagccggcgaagtgaccgtcctcgtggaggtcgctgacatggagctgcataccaaaaagattgaaatcagcgggcttaagttcgcctccctgacatgcaccggatgttatgcgtgcagctctggcatttcctgtaaagtgcggatccacgttgatgagcccgacgaactcacagtgcatgtcaagagcgaggatcctgacattgtggccgcttcttccagcctgatggcccgcaaacttgaatttggcacggattccaccttcaaggctttctctgccatgcccaaaacaagcctgtgcttttacatcgttgagagagagtattgtaagtcctgctctaaggaagacacccagaaatgtgtgaatgccaagctcgagcggccccaaagcatcctgattgaacacaaagggacaatcattggaaagcagaacgatacctgcacggctaaagcgtcctgctggctggagagcgtcaagtctttcttttacggcctcaagaatatgctgtccgggatcttcggaaacgtgtttattggcatcttcctttttctggcccctttcatcctcctgattctgtttttcatgtttgggtggcgcatccttttctgttttaaatgctgtagacggaccagaggcctcttcaagtatcgccacctgaaagacgacgaggaaacaggataccggaagattatcgagagactgaataacaaaaagggcaagaataaactcctggatggggaacgccttgctgaccggaagattgccgagctgttcagcaccaaaacacatatcgga

SEQ ID NO: 14065 - RNA, 1932 nt, synthetic construct
  misc_feature 1..1932: note = derived and/or modified CDS sequence (opt5) from CCHFV(SPU97/85)__DQ211633.1__Gc
  source 1..1932: mol_type = other RNA
ttcctggacagcatcgtgaagggcaaaaagaacctccttaattccacctctctggagacaagcctgtccattgaagccccctggggagctatcaacgtccagtctacgtttaaacctaccgttagcgccgcgaatattgctctctcctggtctagcgtggagcacagagggaacaagatcctggtgtccggccggagcgaatctattatgaaacttgaggaacgcacagggatctcctgggatctgggagtcgaggacgccagcgagtctaagctcctgaccgtgtccgttatggatctgagccaaatgtactctccggtgttcgaatatctctccggcgacagacaggtcgaggaatggcccaaggccacatgcaccggggattgtcctgagcggtgcggatgtacaagctctacctgcctgcataaagagtggccccactctcgcaattggagatgtaaccctacgtggtgctggggcgtgggcaccgggtgtacatgctgtggacttgacgttaaggatctgtttaccgactacatgttcgtgaaatggaaggtcgaatatatcaaaacagaggctattgtgtgcgtggaactcaccagccaggagcggcagtgttccctgatcgaagccggcacgcgctttaatcttgggcccgtcacaattaccctgagcgagcctagaaacatccaacagaagctcccgcccgagattatcacactgcatcctcggattgaagagggattctttgatctgatgcacgttcagaaggtgctctctgcttccaccgtgtgcaaactgcagagctgcacccatggcgtccccggggaccttcaagtgtaccacatcggaaatctgctcaagggcgataaagttaacggccacctgatccataagattgaacctcacttcaatacatcttggatgagctgggacgggtgtgatcttgactattactgcaacatgggagactggccctcctgtacgtataccggcgtgacacagcataatcacgccgcgtttgtcaacctgctcaatatcgagaccgattacacaaagaacttccactttcattctaagcgcgtgaccgcccacggggacacgccgcagctggatctgaaagctagacctacatacggagccggcgaagttaccgtgctcgtcgaggtggctgacatggagctgcataccaagaagattgaaatcagcgggcttaaattcgcctccctgagctgcacaggatgttatgcgtgctcctccggcattagctgtaaggtccggatccacgtggatgagcccgacgaactcaccgttcatgtgaaatctgaggatcctgacatcgtcgccgctggctccagcctgatggcccgcaaacttgaatttggggctgattccacattcaaagccttctctgccatgcccaagacgagcctgtgcttttacattgtggagagagagtattgtaagtcctgctctcgggaagacacccagaaatgtgttaacacaaagctcgagcgcccccaaagcatcctgattgaacacaaaggaaccatcattggcaagcagaatgatacatgcaccgctaaagcgtcctgctggctggagagcgtgaagtctttcttttacgggctcaagtccatgctgagcggaatcttcggcaacgtctttatcgggattttcctttttatcgcccctttcgtgctgctcattctgtttttcatgtttggctggagaatcctgttctgttttaaatgctgtcggagaacgcgcggacttttcaagtatcggcacctcaaagacgacgaggaaaccggctacagaaagattatcgagcgcctgaataacaaaaaggggaagaataaactgctcgatggagaacggctggctgacagaaagattgccgagcttttctctacaaaatcccatatcggc

SEQ ID NO: 14066 - RNA, 1932 nt, synthetic construct
  misc_feature 1..1932: note = derived and/or modified CDS sequence (opt5) from CCHFV(SPU103/87)__DQ211634.1__Gc
  source 1..1932: mol_type = other RNA
ttcctggacaacatcgtgaagggcatgaaaaatctcctgaacagcacctcccttgagacatctctgagcattgaagccccctggggagctatcaatgtccagtccacgtacaagcctaccgtttctacagccaacattgcgctcagctggtcctctgtggagcacagagggaataaaatcctggtgagcggccggtccgaaagcattatgaaacttgaggaacgcaccgggatctcttgggatctgggagtcgaggacgcttccgagagcaaactcctgacagtgtctgttatggatctgtcccaaatgtatagcccggtgtttgaatacctctctggcgacagacaggtcgaggaatggcccaaggctacctgcacaggggattgtcctgagcggtgcggatgtacctccagcacgtgcctgcataaggagtggccccactcccgcaactggagatgtaatcctacctggtgctggggcgtgggcacagggtgtacctgctgtggacttgacgttaaagatctgttcacagactatatgtttgtgaagtggaaaatcgaatacattaagaccgaggccatcgtctgcgtggaactcacgtctcaggagcggcagtgtagcctgattgaagccggcacacgcttcaaccttgggcccgtgaccatcacactgtccgagcctagaaatattcaacagaaactcccgagcgagatcattaccctgcatccccggatcgaagagggatttttcgatctgatgcacgtccagaaggttctctctgcctccaccgtgtgcaagctgcagagctgcacacatggcgtgcctggggaccttcaagtctatcacatcggaaacctgctcaaaggcgataaggtgaatggccacctggttcataaaattgaaccccactttaacacgtcttggatgagctgggacgggtgtgatcttgactactattgcaatatgggagactggccttcctgtacctacacaggcgtgacccagcataaccacgcttctttcgtcaatctgctcaacatcgagacagattacaccaagaactttcacttccatagcaaacgcgtgacggcccacggggacacaccccagctggatctgaaggcgagaccgacctatggagccggcgaaattaccgttctcgtggaggtcgctgacatggagctgcatacaaagaagatcgaaatttccgggcttaagtttaccagcctgacatgcacgggatgttacgcctgttcttccggcatcagctgcaaagtgcggatccacgtcgatgagcctgacgaactcaccgtgcatgttaagtctgatgaccccgatgtggtcgctgcctccagctccctgatggcgcgcaaacttgagttcggcacagactctacctttaaggccttcagcgctatgcctaaaacatccctgtgcttctatattgtggaaagagagtactgtaagtcttgcagcgaggaagatacccagaagtgtgttaatacgaaactcgagcaaccccagtccatcctgattgaacacaaggggaccatcattggaaaacagaacaatacatgcaaggcccgggctggctgctggctggagagcgtgaaatcctttttctatgggctcaagaacatgctgtctggaatctttggcaatgtcttcatcgggatttttcttttcctggccccctttatcctcctgattctgttctttatgttcggctggcgcatcctcttttgtttcaagtgctgtagacggaccagaggactttttaaataccgccacctgaaggacgacgaggaaacaggctatcggaaaattatcgagagactgaacaataagaaagggaagaacaagctcctggatggagaacgccttgccgaccggagaattgctgagctgttcagcaccaaaacgcatatcggc

SEQ ID NO: 14067 - RNA, 1932 nt, synthetic construct
  misc_feature 1..1932: note = derived and/or modified CDS sequence (opt5) from CCHFV(SPU415/85)__DQ211635.1__Gc
  source 1..1932: mol_type = other RNA
ttcctggacagcatcgtgaagggcatgaaaaacctcctgaatagcacctctcttgagacaagcctgtccattgaagccccctggggcgctatcaacgtccagtctacgtttaagcctaccgttagcgccgcgaatattgctctctcctggtctagcgtggagcacagaggaaacaaaatcctggtgtccggccggagcgaatctattatgaaacttgaggaacgcacagggatctcctgggatctgggagtcgaggacgccagcgagtctaaactcctgaccgtgtccgttatggatctgagccaaatgtactctccggtgttcgaatatctctccggcgacagacaggtcgaggaatggcccaaggccacatgcaccggggattgtcctgagcggtgcggatgtacaagctctacctgcctgcataaggagtggccccactcccgcaattggagatgtaaccctacgtggtgctggggcgtgggcaccgggtgtacatgctgtggacttgacgttaaagatctgtttaccgactacatgttcgtgaagtggaaagtcgaatatatcaagacagaggctattgtgtgcgtggaactcaccagccaggagcggcagtgttccctgatcgaagccggcacgcgctttaatcttgggcccgtcacaattaccctgagcgagcctagaaacatccaacagaaactcccgcccgagattatcacactgcatcctcggattgaagagggattctttgatctgatgcacgttcagcgcgtgctctctgcttccaccgtgtgcaagctgcagagctgcacccatggcgtccccggggaccttcaagtgtaccacatcggaaatctgctcaagggcgataaagttaacggccacctgatccataagattgaacctcacttcaatacatcttggatgagctgggacgggtgtgatcttgactattactgcaacatgggagactggccctcctgtacgtataccggcgtgacacagcataatcacgccgcgtttgtcaacctgctcaatatcgagaccgattacacaaagaacttccactttcattctaagagagtgaccgcccacggggacacgccgcagctggatctgaaagctcggcctacatacggagccggcgaagttaccgtgctcgtcgaggtggctgacatggagctgcataccaagaaaattgaaatcagcgggcttaagttcgcctccctgacatgcaccggatgttatgcgtgcagctctggcatttcctgtaaggtcaaaatccacgtggatgagcccgacgaactcacagttcatgtcaagagcgaggatcctgacatcgtggccgctgggtcttccctgatggcccgcaaacttgaatttggggctgatagcacgttcaaggccttctccgccatgcccaaaacctctctgtgcttttacattgtggagagagagtattgtaagagctgctcccgggaagacacacgcaagtgtgttaacaccaaactcgatagaccccagtctatcctgattgagcacaagggaacaatcattggcaaacaaaataatacctgcacggctaaggcgagctgctggctggaatccgtgaaatccttcttttacgggctcaagaacatgctgtctggaatcttcggcaacgtctttatcgggattttcctttttatcgcccctttcgtgctgctcattctgtttttcatgtttggctggcggatcctgttctgttttaagtgctgtagacgcacccggggacttttcaaatatagacacctcaaggacgacgaggagacaggctaccgcaaaattatcgaacggctgaataacaagaaagggaagaataagctgctcgatggagagagactggctgaccgcaaaattgccgaacttttctccaccaagagccatatcggc

SEQ ID NO: 14068 - RNA, 1932 nt, synthetic construct
  misc_feature 1..1932: note = derived and/or modified CDS sequence (opt5) from CCHFV(Turkey200310849)__DQ211636.1__Gc
  source 1..1932: mol_type = other RNA
ttcctggacagcatcgtgaagggcatgaaaaacctcctgaatagcacctctcttgagacaagcctgtccattgaagccccctggggagctatcaacgtccagtctacgtttaagcctgccgttagcaccgcgaatattgctctctcctggtctagcgtggagcacagagggaacaaaatcctggtgacaggccggtccgaaagcattatgaagctcgaggaacgcaccggggtctcttgggatctgggagtggaggacgcctccgagagcaaactcctgacagtttctatcatggatctgtcccaaatgtacagcccggtgttcgaatatctctctggcgacagacaggtcgaggaatggcccaaggctacctgcacaggggattgtcctgagcggtgcggatgtacctccagcacgtgcctgcataaggagtggccccactcccgcaattggagatgtaaccctacctggtgctggggcgtgggcacagggtgtacctgctgtggagttgacgtgaaagatctttttacagaccatatgttcgtcaagtggaaagtggaatacatcaagaccgaggccattgtgtgcgtcgaactgacgtctcaggagcggcagtgtagcctcatcgaagccggcacacgctttaatctggggcccgttaccattacactttccgagcctagaaacatccaacagaaactgccgcccgagattatcaccctccaccctaagattgaagagggattctttgatctgatgcatgtgcagaaggtgctgagcgcttctaccgtctgcaaactccagtcctgcacacacggcatccccggggacctgcaagtgtatcacatcggaaatcttctgaagggcgatcgggttaacggccatctcattcacaaaatcgaaagccatttcaatacgtcttggatgagctgggacgggtgtgatctggactactattgcaacatgggagactggccttcctgtacctacacaggcgtgacccagcacaatcacgccgcgtttgtcaaccttctgaatattgagacagattataccaagacgttccattttcactctaaacgcgtgacagcccatggggacacaccccagctcgatctgaaggctagaccgacctacggagccggcgaaatcaccgttctggtggaggtcgctgacatggagctccacaccaaaaaggtggaaattagcgggctgaagttcgcctcccttgcgtgcacaggatgttacgcctgcagctctggcatctcctgtaaagtccggatccatgtggatgagcctgacgaactgacggttcacgtgaagtcctctgatcccgacgtcgtggctgcctccaccagcctcatggctcgcaaactggagtttggcacagattccaccttcaaggccttctctgccatgcctaaaacaagcctttgcttttatattgttgaaagagagtactgtaagtcctgctctgaggacgatacccagaagtgtgtggacacgcggctggaacaaccccagagcatcctcattgagcacaaagggaccatcattggaaagcagaacgacacatgcaccgctaaagcgtcctgctggctggaaagcgtcaagtctttcttttatggcctgaaaaacatgctcgggtccgtgttcggaaatctgtttatcggcatccttctgttcctcgccccctttgtgctgctggttcttttctttatgttcgggtggaagattctcttttgtttcaagtgctgtcgcagaacacggggcctgtttaaatacagacatctgaaggatgacgaggagaccggatatcgccggatcattgaaagactcaacagcaaaaagggcaaaaatcgcctgcttgatggggaccggctggctgatagaaagatcgccgagcttttctctacgaagacacacattgga

SEQ ID NO: 14069 - RNA, 1932 nt, synthetic construct
  misc_feature 1..1932: note = derived and/or modified CDS sequence (opt5) from CCHFV(Iran-52)__DQ446215.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtacaagcctaccgttagcacagccaatattgcgctctcctggtctagcgtggagcacagagggaacaaagtgctggtctccggccggagcgaatctatcatgaagctggaggaacgcaccgggatttcctgggatctgggagtggaggacgctagcgagtctaaactcctgacagtttccgtgatggatctgagccaaatgtattctccggtctttgaatacctctccggcgacagacaggtggaggaatggcccaaggctacctgcacaggggattgtcctgagcggtgcggatgtaccagctccacgtgcctgcataaggagtggccccactctcgcaattggagatgtaaccctacctggtgctggggcgttggcacagggtgtacctgctgtggacttgacgtgaaagatctgttcacagactatatgtttgtcaagtggaaagtggaatacatcaagaccgaggccatcgtgtgcgtcgaactcacgagccaggagcggcagtgttccctgattgaagccggcacacgcttcaatcttgggagcgttaccatcacactgtctgagcccagaaacattcaacagaaactccctccggagatcattaccctgcatcccaagatcgaagagggatttttcgatctgatgcacgtgcagaaggtgctctccgccagcaccgtctgcaaactgcagtcttgcacacatggcgtgcctggggaccttcaagtttatcacattggaaatctgctcaagggcgatcgggtgaacggccacctgatccataaaatcgaacagcactttaatacgagctggatgtcctgggacgggtgtgatcttgactactattgcaacatgggagactggccctcttgtacctacacaggcgtcacccagcataatcacgctagcttcgtgaacctgctcaatattgagacagattacaccaagacgtttcacttccattccaaacgcgttacagcccacggggacacccctcagctggatctgaaggcgagacccacctatggagccggcgaaatcacagtgctcgtcgaggtggctgacatggagctgcataccaaaaagattgaaatcagcgggcttaagtttgccggactgacatgcacgggctgttacgcttgttcttccggcattagctgcaaagtccggatccacgtggaggaaccggatgagctcaccgttcatgtgaagtctgacgatcctgacgtcgtggccgcgtccagctccctgatggcccgcaaacttgagttcgggacagattctacctttaaggctttcagcgccatgcccaaaacatccctgtgcttctatatcgttgaaagagagtactgtaagtcttgcagcaaggaagacacccaaaaatgtgtgaacacgaagctcgagcagcctcagtccattctgatcgaacacaaaggaaccattatcggcaagcaaaacaatacatgcaccgctaaagccagctgctggctggagtctgtcaagtcctttttctatgggctcaagaacatgctgggaggcatttttgggaatgtgttcatcggcatctttacattccttaccccctttattctgctcatcctgttctttatgttcggatggcggattctgttttgtttcaaatgctgtcgcagaacgcggggcctttttaagtacagacacctcaaagatgacgaggaaacagggtatcgcaagatcattgagcggctgaacaataaaaagggaaagaacagactgctcgacggcgaacgcctggccgatcggaaaatcgctgagcttttcagcaccaagacacatattggg

SEQ ID NO: 14070 - RNA, 1932 nt, synthetic construct
  misc_feature 1..1932: note = derived and/or modified CDS sequence (opt5) from CCHFV(Iran-53)__DQ446216.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtacaagcctaccgttagcacagccaatattgcgctctcctggtctagcgtggagcacagagggaacaaagtgctggtctccggccggagcgaatctatcatgaagctggaggaacgcaccgggatttcctgggatctgggagtggaggacgctagcgagtctaaactcctgacagtttccgtgatggatctgagccaaatgtattctccggtctttgaatacctctccggcgacagacaggtggaggaatggcccaaggctacctgcacaggggattgtcctgagcggtgcggatgtaccagctccacgtgcctgcataaggagtggccccactctcgcaattggagatgtaaccctacctggtgctggggcgttggcacagggtgtacctgctgtggacttgacgtgaaagatctgttcacagactatatgtttgtcaagtggaaagtggaatacatcaagaccgaggccatcgtgtgcgtcgaactcacgagccaggagcggcagtgttccctgattgaagccggcacacgcttcaatcttgggagcgttaccatcacactgtctgagcccagaaacattcaacagaaactccctccggagatcattaccctgcatcccaagatcgaagagggatttttcgatctgatgcacgtgcagaaggtgctctccgccagcaccgtctgcaaactgcagtcttgcacacatggcgtgcctggggaccttcaagtttatcacattggaaatctgctcaagggcgatcgggtgaacggccacctgatccataaaatcgaacagcactttaatacgagctggatgtcctgggacgggtgtgatcttgactactattgcaacatgggagactggccctcttgtacctacacaggcgtcacccagcataatcacgctagcttcgtgaacctgctcaatattgagacagattacaccaagacgtttcacttccattccaaacgcgttacagcccacggggacacccctcagctggatctgaaggcgagacccacctatggagccggcgaagtgacagtcctcgtggaggtcgctgacatggagctgcataccaaaaagatcgaaattagcgggcttaagtttgccggactgacatgcacgggctgttacgcttgttcttccggcatcagctgcaaagtgcggattcacgttgatgagccggacgaactcaccgtgcatgtcaagtctgatgaccctgatgtggttgccgcgtccagctccctgatggcccgcaaacttgagttcgggacagactctacctttaaggctttcagcgccatgcccaaaacatccctgtgcttctatatcgtggaaagagagtactgtaagtcttgcagcaaggaggatacccaaaaatgtgtcaacacgaagctcgaacagcctcagtccatcctgattgagcacaaaggaaccatcattggcaagcaaaacaatacatgcaccgctaaagccagctgctggctggaatctgtgaagtcctttttctatgggctcaagaacatgctgggaggcatctttgggaatgtgttcattggcatctttacattccttaccccctttatcctgctcattctgttctttatgttcggatggcggatcctgttttgtttcaaatgctgtcgcagaacgcggggcctttttaagtacagacacctcaaagacgacgaggagacagggtatcgcaagattatcgaacggctgaacaataaaaagggaaagaacagactgctcgatggcgagcgcctggccgaccggaaaattgctgaacttttcagcaccaagacacatatcggg

SEQ ID NO: 14071 - RNA, 1932 nt, synthetic construct
  misc_feature 1..1932: note = derived and/or modified CDS sequence (opt5) from CCHFV(Kosova Hoti)__EU037902.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtttaagcctaccgttagcacagccaatattgcgctctcctggtctagcgtggagcacagagggaacaaaatcctggtgaccggccggtccgaaagcattatgaagctggaggaacgcacagggatctcttgggatctgggagtcgaggacgcttccgagagcaaactcctgaccgtgtctatcatggatctgtcccaaatgtacagcccggttttcgaatatctctctggcgacagacaggtggaggaatggcccaaggccacatgcaccggggattgtcctcagcggtgcggatgtacgtcctctacctgcctgcataaggagtggccccactcccgcaattggagatgtaaccctacatggtgctggggcgtcggcaccgggtgtacatgctgtggagtggacgttaaagatctttttaccgaccatatgttcgtgaagtggaaagtcgagtacattaagacggaagccatcgtgtgcgtggagctgacatctcaggaacggcaatgtagcctcattgaggctggcacccgctttaatctggggcccgtcacaatcaccctttccgaacctagaaacattcagcagaaactgccgcccgagatcattaccctccaccctaagatcgaggaaggattctttgatctgatgcatgttcagaaggtgctgagcgcctctacagtgtgcaaactccaatcctgcacgcacggcatccccggggacctgcaggtctatcacattggaaatcttctgaagggcgatcgggtgaacggccatctcatccacaaaattgagcctcatttcaataccagctggatgtcttgggacgggtgtgatctggactactattgcaacatgggagactggcccagctgtacatacaccggcgttacacagcacaatcacgctgcctttgtgaaccttctgaatatcgaaaccgattatacgaagacattccattttcactccaaacgcgtcaccgcgcatggggacaccccgcagctcgatctgaaggccagacctacatacggagctggcgagattaccgtgctggttgaagtggccgacatggagctccacaccaaaaaggtcgagatctctgggctgaagttcgctagccttgcctgcacgggatgttacgcgtgctccagcggcatctcttgtaaagtgcggattcatgtcgatgaacccgacgagctgaccgtgcacgttaagtccagcgatcctgacgtggtcgccgctggcacatctctcatggcccgcaaactggaatttgggaccgattccacattcaaggctttcagcgccatgcccaaaacctccctttgcttttatatcgtggagaaggaatactgtaagtcttgcagcgaggacgatacgaaaaagtgtgttgacaccaaactggagcaaccccagtccattctcatcgaacacagaggaacaattatcggcaagcagaacgacacatgcacagccaaagctagctgctggctggagagcgtgaagtccttcttttatgggctgaagaacatgctcggaagcgtcttcggcaactttttcatcgggattctgctttttctggcgcctttcgtgctcctggtgctgtttttcatgtttggctggaaaatccttttctgttttaagtgctgtcggcgcaccagaggactcttcaaataccggcatctgaaggatgacgaagagacgggctatagacgcattatcgagcggctgaataataaaaaggggaagaacagactcctggatggagaacgccttgccgaccggaaaattgctgagctgttctctacaaagacccacatcggc

SEQ ID NO: 14072 - RNA, 1932 nt, synthetic construct
  misc_feature 1..1932: note = derived and/or modified CDS sequence (opt5) from CCHFV(YL04057)__FJ562094.1__Gc
  source 1..1932: mol_type = other RNA
ttcctggacagcatcgccaagggcaaaaagtccctcctgaactctaccagccttgagacatccctgtctattgaagctccctggggagccatcaatgtgcagagcacgtttaaacctaccgtctccgcggctaacattgccctctcttggagctccgttgagcacagaggaaataagatcctggtgagcggccggtctgaatccattatgaaacttgaggaacgcacaggggtgagctggaacctgggagtcgaggatgcctctgagtccaagaccctcacagtgagcgttatggacctgtctcaaatgtactccccggtgttcgaatatctgagcggcgatagacaggtcgaggaatggcccaaggctacctgcacaggggactgtcctgagcggtgcggatgtacctcctctacgtgcctccataaagagtggccccacagccgcaattggagatgttcccctacctggtgctggggcgtgggcacagggtgtacctgctgtggactggatgttaaggactttttcacagattacatgcttgtgaaatggaaggtcgaatatatcaaaaccgaggccatcgtgtgcgtggaactgacgagccaggagcggcagtgttctctcattgaagctggcacacgctttaacctggggcccgtcaccatcacactttccgagcctagaaatgttcaacagcggctgccgcccgagattgtgaccctccatcctaagatcgaagagggattctttgacctgatgcacgtgcagaagattctgagcgcctctaccgtctgcaaactccagagctgcacacatggcgtgcccggggatttccaagtttaccacgtgggaaacctgcttcgcggcgacaaggtcaatggccactccatccataaaattgaacctcactttaacacgtcttggatgagctgggatgggtgtgacctggattatttctgcaatatgggagactggccctcctgtacctacacaggcgtgacccagcataacagagcggcctttatcaatatgctcaacatcgagacagactataccaagacgttccactttcacagcaaacgggttacagctcatggggataccccgcagctggaccttaaggcccgccctgcttacggagccggcgaagtgaccgtcctggtggaggtcgcggatctcgagctgcacaccaaaaagctggaagtgtctgggctcaagattgcctccctgacatgcagcggatgttacgcttgttcttccggcatcagctgcaaagttcggattcatgtgaatgagcccgacgaatttacagtccacgtgagatcctctgatcctgacgttgtggccgctggcagctcccttatggcccgcaagatcgagttcggggccgattctacgttcaaggctttcagctccatgcccaaagacagcctgtgcttttatattgtcgaaaaagattactgttcttcctgcaccgacgatgacacacagaagtgtgtgaacaccaagctcgaccatccccaaagcatcctgatcgagcacaaaggaacaattatcggcaagcagaacgatacctgctctacgaaaacctcctgctggcttgagagcgtgaaggggttcttttatggactgaaaaatatgctctctggcattttcgggaacgtttttctgggcatcctcctgttcctggcgccttttgtccttctgattttctttttctttttcggatggagactcctgttctgtctgaagtgctgtcggagaacacgcggccttctcaagtacaaacacctgaaggacgaagaggaagccgggtataaaaagatcatcgagcggctgaatgggaaaaagggcaagagccagctctttgatggggagagactggctgaccgcaaaattgccgaacttttctccaccaagatccatattgga

SEQ ID NO: 14073 - RNA, 1932 nt, synthetic construct
  misc_feature 1..1932: note = derived and/or modified CDS sequence (opt5) from CCHFV(V42/81)__GU477490.1__Gc
  source 1..1932: mol_type = other RNA
ttcctggacagcatcgtgaagggcaaaaagaacctccttaattccacctctcttgagacaagcctgtccattgaagccccctggggagctatcaacattcagtctacgtttaaacctaccgtcagcgccgcgaatatcgctctctcctggtctagcgttgagcacagagggaacaagattctggtgtccggccggagcgaatctatcatgaaacttgaggaacgcacaggggtgtcctggaatctgggagtcgaggatgccagcgagtctaagctcctgaccgtgtccatcatggacctgagccaaatgtactctccggttttcgaatatctctccggcgatagacaggtggaggaatggcccaaggccacatgcaccggggactgtcctgagcggtgcggatgtacaagctctacctgcctgcataaagagtggccccactctcgcaactggagatgtaatcctacgtggtgctggggcgtcggcaccgggtgtacatgctgtggagtggatgttaaggacctttttattgatcatatgttcgtgaaatggaaggtcgaatacatcaaaaccgaggctattgtgtgcgtggaactgacaagccaggagcggcagtgttccctcatcgaagccggcacccgctttaacctggggcccgtcacgattacacttagcgagcctagaaatatccaacagaagctgccgcccgagattatcaccctccaccctaagatcgaagagggattctttgacctgatgcatgttcagaaagtgctgtctgcttccacagtgtgcaagctccagagctgcacccacggcattcccggggatctgcaagtctatcacatcggaaaccttctgaaaggcgaccgggtgaatggccatctcattcacaagatcgaacctcatttcaacacctcttggatgagctgggatgggtgtgacctggattactattgcaatatgggagactggccctcctgtacatacacgggcgttacccagcacaaccacgccgcgtttgtgaatcttctgaacattgagacagactataccaaaacattccattttcactctaagcgcgtcaccgcccatggggaaacgccgcagctcgatctgaaagctagacctgcctacggagctggcgagatcacagtgctggttgaggtggccgacatggaactccacaccaagaaggtcgagatcagcgggctgaaattcgcgtcccttgcctgcaccggatgttacgcttgcagctctggcatttcctgtaaggtgcggatccatgtcgatgaacccgacgagctgacagtgcacgttaaaagcaacgatcctgacgtggtcgccgcttctacctccctcatggcccgcaagctggaaagcggcacagattccacgtttaaagccttctctgctatgcccaagaccagcctttgcttctatattgtggagagagagtactgtaagtcctgctctgaagacgatacacagaaatgtgttgagaccaagctggaacaaccccagagcatcctcattgagcacaaagggacaatcatcggaaagcagaatgatacctgcacggcgaaagcctcctgctggctggagagcgtgaagtcctttttctatggcctgaagaacatgctcgggtccgtctttggaaatttctttattggcatcctgcttttcctggctccttttgtgctcctggtgctgttctttatgttcgggtggaaaattctgttttgtttcaagtgctgtcggcgcaccagaggcctctttaaataccggcatctgaaggaagacgaggaaacaggatatagacgcatcattgagcggctgaacagcaaaaagggcaagaatagactcctggacggggaacgccttgccgaccggaaaatcgccgagctgttctctaccaagacacacattgga

SEQ ID NO: 14074 - RNA, 1932 nt, synthetic construct
  misc_feature 1..1932: note = derived and/or modified CDS sequence (opt5) from CCHFV(79121M18)__GU477493.1__Gc
  source 1..1932: mol_type = other RNA
ttcctggacagcaccgccaagggcatgaaatccctcctgaactctacaagccttgagacgtccctgtctatcgaagctccctggggagccattaatgtgcagagcacctttaagcctacagtctccgcggctaacatcgccctctcttggagctccgttgagcacagagggaataaaattctggtgagcggccggtctgaatccatcatgaaacttgaggaacgcaccggggtgagctggaacctgggagtcgaggatgcctctgagtccaagacactcaccgtgagcgttatggacctgtctcaaatgtactccccggtgttcgaatatctgagcggcgatagacaggtcgaggaatggcccaaggctacatgcaccggggactgtcctgagcggtgcggatgtacgtcctctacctgcctccataaggagtggccccacagccgcaattggagatgtaaccctacatggtgctggggcgtgggcaccgggtgtacatgctgtggactggatgttaaagactttttcaccgattacatgcttgtgaagtggaaagtcgaatatattaagacggaggccatcgtgtgcgtggaactgacatcccaggagcggcagtgtagcctcatcgaagctggcacccgctttaatctggggcccgtcacaattaccctttctgagcctagaaacgttcaacagcggctgccgcccgagatcgtgaccctccatcctaaaattgaagagggattctttgacctgatgcacgtgcagaagatcctgtccgccagcacagtctgcaagctccagtcttgcacgcatggcgtgcccggggatttccaaatttaccacgttggaaatctgcttcgcggcgacaaagtgaacggccacagcatccataagattgaacctcactttaatacctcctggatgtcttgggatgggtgtgacctggattatttctgcaacatgggagactggcccagctgtacatacaccggcgtcacacagcataatagagcggcctttatcaacatgctcaatatcgagaccgactatacgaaaacattccactttcactccaagcgggtgaccgctcatggggataccccgcagctggaccttaaagcccgccctgcttacggagccggcgaagttacagtgctggtcgaggtggcggatctcgagctgcacaccaagaaactggaagtcagcgggctcaagattgcctctctgacatgctccggatgttacgcttgcagctctggcatctcctgtaaggtgcggattcatgttaacgagcccgacgaatttacggtgcacgtcagaagctccgatcctgacgtggttgccgctggctctagccttatggcccgcaaaatcgagttcggggccgattccacctttaaggctttctctagcatgcccaaagactccctgtgcttttatattgtggaaaaggattactgtagctcttgcacagacgatgacacccagaaatgtgtcaacacaaagctcgaccatccccaatccatcctgatcgagcacaagggaaccattatcggcaaacagaatgatacgtgcagcaccaagacatcttgctggcttgagtccgtgaaagggttcttttatggactgaagaacatgctcagcggcattttcgggaatgtgtttctgggcatcttcctgtttctcgcgcctttcgttctgcttattttcttctttttcttcggatggagactgctcttttgtctgaaatgctgtcggagaacccgcggcctgcttaagtacaagcacctcaaagacgaagaggaagccgggtataagaaaatcatcgagcggctgaacggaaagaaaggcaagtctcagctgttcgatggggagagactcgctgaccgcaagattgccgaactgtttagcacaaaaatccatattgga

SEQ ID NO: 14075 - RNA, 1932 nt, synthetic construct
  misc_feature 1..1932: note = derived and/or modified CDS sequence (opt5) from CCHFV(Afg09-2990)__HM452306.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtacaagcctaccgttagcacagccaatattgcgctctcctggtctagcgtggagcacagagggaacaaagtgctggtctccggccggagcgaatctatcatgaagctggaggaacgcaccgggatttcctgggatctgggagtggaggacgctagcgagtctaaactcctgacagtttccgtgatggatctgagccaaatgtattctccggtctttgaatacctctccggcgacagacaggtggaggaatggcccaaggctacctgcacaggggattgtcctgagcggtgcggatgtaccagctccacgtgcctgcataaggagtggccccactctcgcaattggagatgtaaccctacctggtgctggggcgttggcacagggtgtacctgctgtggacttgacgtgaaagatctgttcacagactatatgtttgtcaagtggaaagtggaatacatcaagaccgaggccatcgtgtgcgtcgaactcacgagccaggagcggcagtgttccctgattgaagccggcacacgcttcaatcttgggagcgttaccatcacactgtctgagcccagaaacattcaacagaaactccctccggagatcattaccctgcatcccaagatcgaagagggatttttcgatctgatgcacgtgcagaaggtgctctccgccagcaccgtctgcaaactgcagtcttgcacacatggcgtgcctggggaccttcaagtttatcacattggaaatctgctcaagggcgatcgggtgaacggccacctgatccataaaatcgaacagcactttaatacgagctggatgtcctgggacgggtgtgatcttgactactattgcaacatgggagactggccctcttgtacctacacaggcgtcacccagcataatcacgctagcttcgtgaacctgctcaatattgagacagattacaccaagacgtttcacttccattccaaacgcgttacagcccacggggacacccctcagctggatctgaaggcgagacccacctatggagccggcgaaatcacagtgctcgtcgaggtggctgacatggagctgcataccaaaaagattgaaatcagcgggcttaagtttgccggactgacatgcacgggctgttacgcttgttcttccggcattagctgcaaagtccggatccacgtggatgagccggacgaactcaccgttcatgtgaagtctgatgaccctgatgtcgtggccgcgtccagctccctgatggcccgcaaacttgagttcgggacagactctacctttaaggctttcagcgccatgcccaaaacatccctgtgcttctatatcgttgaaagagagtactgtaagtcttgcagcaaggaggatacccaaaaatgtgtgaacacgaagctcgaacagcctcagtccattctgatcgagcacaaaggaaccattatcggcaagcaaaacaatacatgcaccgctaaagccagctgctggctggaatctgtcaagtcctttttctatgggctcaagaacatgctgggaggcatttttgggaatgtgttcatcggcatctttacattccttaccccctttattctgctcatcctgttctttatgttcggatggcggattctgttttgtttcaaatgctgtcgcagaacgcggggcctttttaagtacagacacctcaaagacgacgaggagacagggtatcgcaagatcattgaacggctgaacaataaaaagggaaagaacagactgctcgatggcgagcgcctggccgaccggaaaatcgctgaacttttcagcaccaagacacatattggg

SEQ ID NO: 14076 - RNA, 1932 nt, synthetic construct
  misc_feature 1..1932: note = derived and/or modified CDS sequence (opt5) from CCHFV(Sudan Al-Fulah 3-2008)__HQ378184.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtacaagcctaccgttagcacagccaatattgcgctctcctggtctagcgtggagcacagagggaacaaaatcctggtgtccggccggagcgaatctattatgaagctggaggaacgcaccgggatctcctgggatctgggagtcgaggacgctagcgagtctaaactcctgacagtgtccgttatggatctgagccaaatgtattctccggtgtttgaatacctctccggcgacagacaggtcgaggaatggcccaaggccacatgcacaggggattgtcctgagcggtgcggatgtaccagctccacgtgcctgcataaggagtggccccactctcgcaattggagatgtaaccctacctggtgctggggcgtgggcacagggtgtacctgctgtggacttgacgttaaagatctgttcacagactatatgtttgtgaagtggaaagtcgaatacatcaagaccgaggccattgtgtgcgtggaactcacgagccaggagcggcagtgttccctgatcgaagctggcacacgcttcaatcttgggcccgtcaccattacactgagcgagcctagaaacatccaacagaaactcccgcccgagattatcaccctgcatcctcggattgaagagggatttttcgatctgatgcacgttcagaaggtgctctctgcctccaccgtgtgcaagctgcagagctgcacacatggcgtccccggggaccttcaagtgtatcacatcggaaatctgctcaaaggcgataaggttaacggccacctgatccataaaattgaacctcactttaatacgtcttggatgagctgggacgggtgtgatcttgactactattgcaacatgggagactggccctcctgtacctacacaggcgtgacccagcataatcacgcttctttcgtcaacctgctcaatatcgagacagattacaccaagaactttcacttccatagcaaacgcgtgacggcccacggggacacaccgcagctggatctgaaggcgagacctacctatggagccggcgaaattaccgttctcgtggaggtcgctgacatggagctgcataccaaaaagatcgaaatttccgggcttaagtttgccagcctgacctgcacaggatgttacgcttgttcttccggcatcagctgcaaagtgcggatccacgtcgatgagcccgacgaactcacggtgcatgttaagtctgatgaccctgatgtggtcgccgcgtccagctccctgatggcccgcaaacttgagttcggcaccgactctacatttaaggctttcagcgccatgcccaaaacctccctgtgcttctatattgtggaaaaggagtactgtaagtcttgcagcgaggaagataccaaaaagtgtgttaacaccaaactcgagcagccccaatccatcctgattgaacacaaggggacgatcattggaaaacagaatagcacatgcacagctaaggtgtcttgctggctggagtccgccaagagctttttctatggcctcaaagacatgctgtctgggatctttggaaacgtcttcatcggcatttttcttttcctggccccttttgtgctcctggtgctgttctttatgttcgggtggagaatccttctctgttttcggtgctgtcgcagaacccggggcctgttcaagtacagacacctgaaagacgatgaggaaacaggatatcgccggattatcgagagactcaataacaagaaaggcaagaataagctgcttgacggggaacgcctggctgatcggaaaattgcggagctcttttccaccaagacgcatatcgga

SEQ ID NO: 14077 - RNA, 1932 nt, synthetic construct
  misc_feature 1..1932: note = derived and/or modified CDS sequence (opt5) from CCHFV(Sudan AB1-2009)__HQ378187.1__Gc
  source 1..1932: mol_type = other RNA
ttcctggacagcatcgccaagggcatgaaaaacctccttaattccacctctcttgagacaagcctgtccattgaagctccctggggagccatcaacgtgcagtctacgtacaagcctaccgtcagcacagcgaatattgctctctcctggtctagcgttgagcacagagggaacaaaatcctggtgtccggccggagcgaatctattatgaaacttgaggaacgcaccgggatctcctgggatctgggagtggaggacgccagcgagtctaaactcctgacagtctccgtgatggatctgagccaaatgtattctccggtttttgaatacctctccggcgacagacaggtggaggaatggcccaaggctacctgcacaggggattgtcctgagcggtgcggatgtaccagctccacgtgcctgcataaggagtggccccactctcgcaattggagatgtaaccctacctggtgctggggcgtcggcacagggtgtacctgctgtggacttgacgtgaaagatctgttcacagactatatgtttgttaagtggaaagtggaatacatcaagaccgaggccattgtctgcgtggaactcacgagccaggagcggcagtgttccctgatcgaagccggcacacgcttcaatcttgggcccgtgaccattacactgagcgagcctagaaacatccaacagaaactcccgcccgagattatcaccctgcatcctcggattgaagagggatttttcgatctgatgcacgtccagaaggttctctctgcttccaccgtgtgcaagctgcagagctgcacacatggcgtgcccggggaccttcaagtctatcacatcggaaatctgctcaaaggcgataaggtgaacggccacctgatccataaaattgaacctcactttaatacgtcttggatgagctgggacgggtgtgatcttgactactattgcaacatgggagactggccctcctgtacctacacaggcgttacccagcataatcacgcctctttcgtgaacctgctcaatatcgagacagattacaccaagaactttcacttccatagcaaacgcgtcacggcgcacggggacacaccgcagctggatctgaaggccagacctacctatggagctggcgaaattaccgtgctcgttgaggtggccgacatggagctgcatacaaagaagatcgaaatttccgggcttaagtttgctagcctgacctgcacaggatgttacgcctgctcctccggcatcagctgtaaagtccggatccacgtggatgagcccgacgaactcacggtccatgtgaagtctgatgaccctgatgttgtggcggcctccagctccctgatggctcgcaaacttgagttcggcaccgactctacatttaaggccttcagcgctatgcccaaaacctccctgtgcttctatattgtcgaaagagagcactgtaagtcttgcaacgaggaagatacaaagaaatgtgtgaataccaagctcgagcagccccaaagcatcctgattgaacacaaagggacgatcattggaaagcagaactctacctgcacagcccgggccagctgctggctggagtctgttaaatcctttttctacggcctcaagaatatgctgagcgggatctttggaaacgtgttcatgggcatctttcttttcctggctccttttattctcctgatcctgttctttatgttcgggtggcgcattctgttttgtttcaagtgctgtagacggaccagaggcctctttaaatatcgccatctgaaggacgacgaggaaacaggataccggagaatcattgagcgcctgaataacaaaaagggcaaaaataagctcctggatggggaacggcttgcggacagacgcatcgccgagctgttctctaccaagacgcacattgga

SEQ ID NO: 14078 - RNA, 1932 nt, synthetic construct
  misc_feature 1..1932: note = derived and/or modified CDS sequence (opt5) from CCHFV(NIVA 118595)__JN572083.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtacaagcctaccgttagcgccgcgaatattgctctctcctggtctagcgtggagcacagagggaacaaaatcctggtgtccggccggagcgaatctattatgaagctggaggaacgcacagggatctcctgggatctgggagtcgaggacgccagcgagtctaaactcctgaccgtgtccgttatggatctgagccaaatgtattctccggtgtttgaatacctctccggcgacagacaggtcgaggaatggcccaaggccacatgcaccggggattgtcctgagcggtgcggatgtacaagctctacctgcctgcataaggagtggccccactcccgcaattggagatgtaaccctacgtggtgctggggcgtgggcaccgggtgtacatgctgtggacttgacgttaaagatctgttcaccgactatatgtttgtgaagtggaaagtcgaatacatcaagacagaggctattgtgtgcgtggaactcaccagccaggagcggcagtgttccctgatcgaagccggcacgcgcttcaatcttgggagcgtcacaattaccctgtctgagcccagaaacatccaacagaaactccctccggagattatcacactgcatccccggattgaagagggatttttcgatctgatgcacgttcagaaggtgctctccgctagcaccgtgtgcaagctgcagtcttgcacccatggcgtccctggggaccttcaagtgtatcacatcggaaatctgctcaaaggcgatcgcgttaacggccacctgatccataagattgaacagcaccttaatacaagctggatgtcctgggacgggtgtgatctggactactattgcaacatgggagactggccctcttgtacgtacaccggcgtgacacagcataatcacgccagctttgtcaacctcctgaatatcgagaccgattacacaaaaaccttccactttcattccaagagagtgacggcgcacggggacacacctcagctggatctcaaagcccggcccacctatggagctggcgaaattaccgttctggtggaggtcgccgacatggagcttcatacaaagaaaatcgaaattagcgggctgaagttcgcttctctctcctgcaccggatgttacgcctgcagctctggcatctcctgtaaggtgcgcatccacgtcgatgagccggacgaactgacagtgcatgttaaaagcgatgaccctgatgtggtcgcggcctcctctagccttatggctagaaagctggagtccggcacggactctacctttaaagccttcagcgctatgcccaagacatccctctgcttttatattgtggaacgggagtactgtaaagggtgcagcaaggaggatacccaaaagtgtgttaacacaaaactggaacagcctcagtctatcctgattgagcacaagggaaccatcattggcaaacaaaacaatacgtgcaccgccaaggcctcctgctggctcgaaagcgtgaaatctttcttctatgggctgaagaacatgctttccggaatctttggcaatgtcttcctggggatctttagcttcctcgctccctttgtgctgctgattcttttctttatgttcggctggcgcatcctcttttgtttcaagtgctgtagacggacaagaggactgtttaaataccgccacctgaaggacgacgaggagaccggctatcggaaaattatcgaaagactcaacaataagaaagggaagaacaagctgcttgatggagagcgcctggcggaccggaaaattgccgaactcttctctacaaagacccatatcggc

SEQ ID NO: 14079 - RNA, 1932 nt, synthetic construct
  misc_feature 1..1932: note = derived and/or modified CDS sequence (opt5) from CCHFV(NIV 112143)__JN572085.1__Gc
  source 1..1932: mol_type = other RNA
ttcctggacagcatcgtgaagggcatgaaaaacctcctgaatagcacctctcttgagacaagcctgtccattgaagccccctggggagctatcaacgtccagtctacgtacaagcctaccgttagcgccgcgaatattgctctctcctggtctagcgtggagcacagagggaacaaaatcctggtgtccggccggagcgaatctattatgaaacttgaggaacgcacagggatctcctgggatctgggagtcgaggacgccagcgagtctaagctcctgaccgtgtccgttatggatctgagccaaatgtattctccggtgtttgaatacctctccggcgacagacaggtcgaggaatggcccaaggccacatgcaccggggattgtcctgagcggtgcggatgtacaagctctacctgcctgcataaggagtggccccactcccgcaattggagatgtaaccctacgtggtgctggggcgtgggcaccgggtgtacatgctgtggacttgacgttaaagatctgttcaccgactatatgtttgtgaagtggaaagtcgaatacatcaagacagaggctattgtgtgcgtggaactcaccagccaggagcggcagtgttccctgatcgaagccggcacgcgcttcaatcttgggagcgtcacaattaccctgtctgagcccagaaacatccaacagaaactccctccggagattatcacactgcatccccggattgaagagggatttttcgatctgatgcacgttcagaaggtgctctccgctagcaccgtgtgcaagctgcagtcttgcacccatggcgtccctggggaccttcaagtgtatcacatcggaaatctgctcaaaggcgatcgcgttaacggccacctgatccataagattgaacagcaccttaatacaagctggatgtcctgggacgggtgtgatctggactactattgcaacatgggagactggccctcttgtacgtacaccggcgtgacacagcataatcacgccagctttgtcaacctcctgaatatcgagaccgattacacaaaaaccttccactttcattccaagagagtgacggcgcacggggacacacctcagctggatctcaaagcccggcccacctatggagctggcgaaattaccgttctggtggaggtcgccgacatggagcttcatacaaagaaaatcgaaattagcgggctgaagttcgcttctctctcctgcaccggatgttacgcctgcagctctggcatctcctgtaaggtgcgcatccacgtcgatgagccggacgaactgacagtgcatgttaaaagcgatgaccctgatgtggtcgcggcctcctctagccttatggctagaaagctggagtttggcacggactccaccttcaaagccttttctgctatgcccaagacaagcctctgcttctatattgtggaacgggagtactgtaaagggtgctccaaggaggatacccaaaagtgtgttaacacaaaactggaacagcctcagagcatcctgattgagcacaagggaaccatcattggcaaacaaaacaatacgtgcaccgccaaggcctcttgctggctcgaatccgtgaaatccttcttttatgggctgaagaacatgctttctggaatcttcggcaatgtctttctggggatcttctcctttctcgctcccttcgtgctgctgattctctttttcatgtttggctggcgcatccttttctgttttaagtgctgtagacggacaagaggactgttcaaataccgccacctgaaggacgacgaggagaccggctatcggaaaattatcgaaagactcaacaataagaaagggaagaacaagctgcttgatggagagcgcctggcggaccggaaaattgccgaactctttagcacaaagacccatatcggc

SEQ ID NO: 14080 - RNA, 1932 nt, synthetic construct
  misc_feature 1..1932: note = derived and/or modified CDS sequence (opt5) from CCHFV(SCT ex Afghanistan)__KC344856.1__Gc
  source 1..1932: mol_type = other RNA
ttcctgaacagcatcgtgaagggcatgaaaaatctcctgaactccaccaatcttgagacatctctgagcattgaagccccctggggagctatcaacgtccagtccacgtttaagcctaccgtttctacagccaatattgcgctcagctggtcctctgtggagcacagagggaacaaaatcctggtgagcggccggtccgaaagcattatgaagctcgaggaacgcaccgggatctcttgggacctgggagtcgaggatgcttccgagagcaaatctctcacagtgtccgttatggacctgagccaaatgtactctccggtgttcgaatatctgtccggcgatagacaggtcgaggaatggcccaaggctacctgcacaggggactgtcctgagcggtgcggatgtaccagctccacgtgcctccataaggagtggccccactctcgcaattggagatgtaaccctacctggtgctggggcgtgggcacagggtgtacctgctgtggactggatgttaaagacctttttacagattacatgttcgtgaagtggaaagtcgaatatatcaagaccgaggccattgtgtgcgtggaactgacgagccaggagcggcagtgttccctcatcgaagccggcacacgctttaatctggggcccgtcaccattacacttagcgagcctagaaacatccaacagaaactgccgcccgagattatcaccctccatcctcggattgaagagggattctttgacctgatgcacgttcagaaggtgctgtctgcctccaccgtgtgcaagctccagagctgcacacatggcgtccccggggatctgcaagtgtaccacatcggaaatcttctgaaaggcgacaagctcaacggccacatgatccataaaattgaacctcacttcaatacgtcttggatgagctgggatgggtgtgacctggattattactgcaacatgggagactggccctcctgtacctatacaggcgttacccagcataatcacgctgcctttgtgaaccttctgaacatcgagacagactacaccaagaatttccactttcattctaaacgcgtcacggcgcacggggatacaccgcagctcgacctgaaggccagacctacctacggagctggcgaaattaccgtgctggttgaggtggccgatatggagctccatacaaagaagatcgacattagcgggctgaagttcgcttcccttacctgcgccggatgttatgcgtgcagctctggcatctcctgtaaagtccggatccacgtggatgaacccgacgagctgacagtccatgtgaaaagcgaagatcctgacattgttgccgcttctacgtccctcatcgcccgcaaactggagcttggcaccgatagcacatttaaggctttctccgccatgcccaaaacctctctgtgcttctacattgtggaaagagagtattgtaagagctgctccaaggaggacacacagaaatgtgtcaacaccaagctcgaacacccccaagggatcctgattgagcacaaaggaacgatcatcggcaagcagaatgatacctgcacagccaaagctgggtgctggctggaatctgttaagagctttttctacggactcaagaacatgctgtccggcatttttgggaatgtgttcatcggcatttttcttttcctggcgccttttgtgctcctgatcctgttctttatgttcggatggcggcttctcttttgtttcaaatgctgtcgcagaacccggggcctgtttaagtatagacatctgaaagaggacgaggaaagcgggtaccgccggattatcgagagactcaacaataagaaaggaaagaacaagctgcttgacggcgaacgcctggccgatcggagaattgctgagcttttctctacaaaaacccacatcggg

SEQ ID NO: 14081 - RNA, 1932 nt, synthetic construct
  misc_feature 1..1932: note = derived and/or modified CDS sequence (opt5) from CCHFV(Zahedan 2007)__KC867273.1__Gc
  source 1..1932: mol_type = other RNA
ttcctggacagcatcgtgaaggatatgaaaaacctccttaattccacctctcttgagacaagcctgtccattgaagccccctggggcgctatcaacgtccagtctacgtacaagcctaccgttagcacagccaatattgcgctctcctggtctagcgtggagcacagagggaacaaagtgctggtctccggacggagcgaatctatcatgaagctggaggaacgcaccggcatttcctgggacctgggggtggaggatgctagcgagtctaaactcctgacagtttccgtgatggacctgagccaaatgtattctccggtctttgaatacctctccggagatagacaggtggaggaatggcccaaggctacctgcacaggcgactgtcctgagcggtgcgggtgtaccagctccacgtgcctgcataaggagtggccccactctcgcaattggagatgtaaccctacctggtgctggggagttggcacaggctgtacctgctgtgggcttgatgtgaaagacctgttcacagattatatgtttgtcaagtggaaagtggaatacatcaagaccgaggccatcgtgtgcgtcgaactcacgagccaggagcggcagtgttccctgattgaagccggaacacgcttcaatcttggcagcgttaccatcacactgtctgagcccagaaacattcaacagaaactccctccggagatcattaccctgcatcccaagatcgaagaggggtttttcgacctgatgcacgtgcagaaggtgctctccgccagcaccgtctgcaaactgcagtcttgcacacatggagtgcctggcgatcttcaagtttatcacattgggaatctgctcaagggagaccgggtgaacggccacctgatccataaaatcgaacagcactttaatacgagctggatgtcctgggatggctgtgaccttgactactattgcaacatgggggattggccctcttgtacctacacaggagtcacccagcataatcacgctagcttcgtgaacctgctcaatattgagacagactacaccaagacgtttcacttccattccaaacgcgttacagcccacggcgatacccctcagctggacctgaaggcgagacccacctatggggccggagaaatcacagtgctcgtcgaggtggctgatatggagctgcataccaaaaagattgaaatcagcggccttaagtttgccgggctgacatgcacgggatgttacgcttgttcttccggcattagctgcaaagtccggatccacgtggacgagccggatgaactcaccgttcatgtgaagtctgacgatcctgacgtcgtggccgcgtccagctccctgatggcccgcaaacttgagttcggcacagattctacctttaaggctttcagcgccatgcccaaaacatccctgtgcttctatatcgttgaaagagagtactgtaagtcttgcagcaaggaggacacccaaaaatgtgtgaacacgaagctcgaacagcctcagtccattctgatcgagcacaaagggaccattatcggaaagcaaaacaatacatgcaccgctaaagccagctgctggctggaatctgtcaagtcctttttctatggcctcaagaacatgcttgggggaatttttggcaatgtgttcatcgggatctttacattcctgaccccctttattctgctcatcttctttttcatgtttggctggcggattctgttctgttttaaatgctgtcgcagaacgcggggactgttcaagtacagacaccttaaagacgatgaggagacaggctatcgcaagatcattgaacggctcaacaataaaaaggggaagaacagactgctggacggagagcgcctcgccgatcggaaaatcgctgaactgttcagcaccaagacacatattggc

SEQ ID NO: 14082 - RNA, 1932 nt, synthetic construct
  misc_feature 1..1932: note = derived and/or modified CDS sequence (opt5) from CCHFV(SPU 44/08)__KJ682805.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtttaagcctaccgttagcgccgcgaatattgctctctcctggtctagcgtggagcacagagggaacaaaatcctggtgtccggccggagcgaatctattatgaagctggaggaacgcacagggatctcctgggatctgggagtcgaggacgccagcgagtctaaactcctgaccgtgtccgttatggatctgagccaaatgtactctccggtgttcgaatatctctccggcgacagacaggtcgaggaatggcccaaggccacatgcaccggggattgtcctgagcggtgcggatgtacaagctctacctgcctgcataaggagtggccccactctcgcaattggagatgtaaccctacgtggtgctggggcgtgggcaccgggtgtacatgctgtggacttgacgttaaagatctgtttaccgactacatgttcgtgaagtggaaagtcgattatatcaagacagaagctattgtgtgcgtggagctcaccagccaggaacggcagtgttccctgatcgaggccggcacgcgctttaatcttgggcccgtcacaattaccctgagcgaacctagaaacatccaacagaaactcccgcccgagattgttacactgcatcctcggatcgaggaaggattctttgacctgatgcacattcagaaggtgctctctgcttccaccgtgtgcaagctgcagagctgcacccatggcgtccccggggatcttcaaatctaccacatcggaaatctgctcaaaggcgacaaggtgaacggccacctgattcataaaatcgagcctcacttcaatacatcttggatgagctgggatgggtgtgaccttgactattactgcaacatgggagattggccctcctgttcttatacgggcgttacccagcataatcacgccgcgtttgtgaacatgctgaatattgaaacagactacaccaagaacttccactttcatagcaaacgcgtcacagcccacggggataccccgcagctcgacctgaaggctagacctacgtacggagccggcgagatcacagtgctggttgaagtggctgatatggagctccataccaaaaagattgagatctccgggctgaagttcgccagccttacctgcacaggatgttatgcgtgctcctccggcatcagctgtaaagtccggattcacgtggacgaacccgatgagctgaccgtccatgtgaagtctgaagaccctgatatcgttgccgcttccagctccctcatggcccgcaaactggagtttggcacagactctacgttcaaggctttcagcgccatgcccaaaacctccctttgcttttacattgtggaaagagagtattgtaagtcttgcagcaaggaggatacacagaaatgtgtcaacaccaagctggaacaaccccagtccatcctcattgagcacaaagggacaatcatcggaaagcagaatgatacctgcacggccaaagctagctgctggctggaatctattaagtccttcttttacggcctgaagaacatgctcagcgggatcttcggaaatgtgtttattggcatcttcctgtttcttgcgcctttcattatgctgatcctctttttcatgtttgggtggcggattctgttctgttttaaatgctgtcgcagaacccggggcctgttcaagtatagacaccttaaagacgacgaggagatcggataccgcaagatcattgaacggctcaacaataaaaagggcaagaacaaactgctggacggggagagactcgccgatcgcaagatcgctgaactgttctctacaaaaacccatattgga

SEQ ID NO: 14083 - RNA, 1932 nt, synthetic construct
  misc_feature 1..1932: note = derived and/or modified CDS sequence (opt5) from CCHFV(SPU 383/87)__KJ682806.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtttaagcctaccgttagcgccgcgaatattgctctctcctggtctagcgtggagcacagagggaacaaaatcctggtgtccggccggagcgaatctattatgaagctggaggaacgcacagggatctcctgggatctgggagtcgaggacgccagcgagtctaaactcctgaccgtgtccgttatggatctgagccaaatgtactctccggtgttcgaatatctctccggcgacagacaggtcgaggaatggcccaaggccacatgcaccggggattgtcctgagcggtgcggatgtacaagctctacctgcctgcataaggagtggccccactctcgcaattggagatgtaaccctacgtggtgctggggcgtgggcaccgggtgtacatgctgtggacttgacgttaaagatctgtttaccgactacatgttcgtgaagtggaaagtcgattatatcaagacagaagctattgtgtgcgtggagctcaccagccaggaacggcagtgttccctgatcgaggccggcacgcgctttaatcttgggcccgtcacaattaccctgagcgaacctagaaacatccaacagaaactcccgcccgagattgttacactgcatcctcggatcgaggaaggattctttgacctgatgcacattcagaaggtgctctctgcttccaccgtgtgcaagctgcagagctgcacccatggcgtccccggggatcttcaaatctaccacatcggaaatctgctcaaaggcgacaaggtgaacggccacctgattcataaaatcgagcctcacttcaatacatcttggatgagctgggatgggtgtgaccttgactattactgcaacatgggagattggccctcctgttcttatacgggcgttacccagcataatcacgccgcgtttgtgaacatgctgaatattgaaacagactacaccaagaacttccactttcatagcaaacgcgtcacagcccacggggataccccgcagctcgacctgaaggctagacctacgtacggagccggcgagatcacagtgctggttgaagtggctgatatggagctccataccaaaaagattgagatctccgggctgaagttcgccagccttacctgcacaggatgttatgcgtgctcctccggcatcagctgtaaagtccggattcacgtggacgaacccgatgagctgaccgtccatgtgaagtctgaagaccctgatatcgttgccgcttccagctccctcatggcccgcaaactggagtttggcacagactctacgttcaaggctttcagcgccatgcccaaaacctccctttgcttttacattgtggaaagagagtattgtaagtcttgcagcaaggaggatacacagaaatgtgtcaacaccaagctggaacaaccccagtccatcctcattgagcacaaagggacaatcttcggaaagcagaatgatacctgcacggccaaagctagctgctggctggaatctgtgaagtcctttttctacggcctgaagaacatgctcagcgggatctttggaaatgttttcattggcgtgtttctgttccttgcgccttttatcatgctgattctcttctttatgttcgggtggcggatcctgttttgtttcaaatgctgtcgcagaacccggggcctgttcaagtatagacaccttaaagacgacgaggagattggataccgcaagatcattgaacggctcaacaataaaaagggcaagaacaaactgctggacggggagagactcgccgatcgcaagatcgctgaactgttttctacaaaaacccatatcgga

SEQ ID NO: 14084 - RNA, 1932 nt, synthetic construct
  misc_feature 1..1932: note = derived and/or modified CDS sequence (opt5) from CCHFV(SPU 130/89)__KJ682807.1__Gc
  source 1..1932: mol_type = other RNA
agcctggactccatcgtgaagggcatgaaaaacctccttaattctaccagccttgagacatccctgtctattgaagccccctggggagctatcaacgtccagagcacgttcaagcctaccgtttccgccgcgaatattgctctctcttggagctccgtggagcacagagggaacaaaatcctggtgagcggccggtctgaatccattatgaaacttgaggaacgcacagggatcagctgggatctgggagtcgaggacgcctctgagtccaaactcctgaccgtgagcgttatggatctgtctcaaatgtactccccggtgtttgaatatctcagcggcgacagacaggtcgaggaatggcccaaggccacatgcaccggggattgtcctgagcggtgcggatgtacatcctctacctgcctgcataaggagtggccccacagccgcaattggagatgtaaccctacgtggtgctggggcgtgggcaccgggtgtacatgctgtggacttgacgttaaagatctgttcaccgactacatgtttgtgaagtggaaagtcgattatatcaagacagaagctattgtgtgcgtggagctcacctcccaggaacggcagtgtagcctgatcgaggccggcacgcgcttcaatcttgggcccgtcacaattaccctgtctgaacctagaaacatccaacagaaactcccgcccgagattgttacactgcatcctcggatcgaggaaggatttttcgacctgatgcacattcagaaggtgctctccgctagcaccgtgtgcaagctgcagtcttgcacccatggcgtccccggggatcttcaaatctaccacatcggaaatctgctcaaaggcgacaaggtgaacggccacctgattcataaaatcgagcctcactttaatacaagctggatgtcctgggatgggtgtgaccttgactattactgcaacatgggagattggccctcttgtagctatacgggcgttacccagcataatcacgccgcgttcgtgaacatgctgaatattgaaacagactacaccaagaactttcacttccattccaaacgcgtcacagcccacggggataccccgcagctcgacctgaaggctagacctacgtacggagccggcgagatcacagtgctggttgaagtggctgatatggagctccataccaaaaaggtcgagattagcgggctgaagtttgcctctcttacctgcacaggatgttatgcgtgctccagcggcatctcttgtaaagtgcggatccacgtcgacgaacccgatgagctgaccgtgcatgttaagtccgaagaccctgatattgtggccgctagctcctctctcatggcccgcaaactggagttcggcacagacagcacgtttaaggctttctccgccatgcccaaaacctctctttgcttctacatcgtcgaaagagagcactgtaagagctgctccaaggaggatacacagcggtgtgtgaacaccaaactggaacaaccccagagcattctcatcgagcacaaggggacaattatcggaaaacagaatgatacctgcacggccaaggcttcttgctggctggaatccatcaagagctttttctatggcctgaagaacatgctctctgggatttttggaaatgttttcatcggcgtgtttctgttccttgcgccttttattatcctgattctcttctttatgttcgggtggcgcatcctgttttgtttcaagtgctgtagacggaccagaggcctgcttaaataccgccatctcaaggacgacgaggagattggatatcggaaaatcatcgaaagactgaacaataagaaaggcaagaacaagctgctcgacggggagcgcctggccgatcggaaaattgctgaactgttttccacaaagacccacatcgga

SEQ ID NO: 14085 - RNA, 1932 nt, synthetic construct
  misc_feature 1..1932: note = derived and/or modified CDS sequence (opt5) from CCHFV(SPU 497/88)__KJ682808.1__Gc
  source 1..1932: mol_type = other RNA
ttcctggacagcatcgtgaagggcatgagaaacctccttaattccacctctctggagacaagcctgtccattgaagccccctggggagctatcaacgtccagtctacgtttaaacctaccgttagcgccgcgaatattgctctctcctggtctagcgtggagcaccgggggaacaagatcctggtgtccggccgcagcgaatctattatgaaacttgaggaaagaacagggatctcctgggatctgggagtcgaggacgccagcgagtctaagctcctgaccgtgtccgttatggatctgagccaaatgtactctccggtgttcgaatatctctccggcgaccggcaggtcgaggaatggcccaaagccacatgcaccggggattgtcctgagcgctgcggatgtacaagctctacctgcctgcataaggagtggccccactctagaaattggcggtgtaaccctacgtggtgctggggcgtgggcaccgggtgtacatgctgtggacttgacgttaaggatctgtttaccgactacatgttcgtgaaatggaaggtcgattatatcaaaacagaagctattgtgtgcgtggagctcaccagccaggaacgccagtgttccctgatcgaggccggcacgagatttaatcttgggcccgtcacaattaccctgagcgaacctcggaacatccaacagaagctcccgcccgagattgttacactgcatcctcgcatcgaggaaggattctttgacctgatgcacattcagaaagtgctctctgcttccaccgtgtgcaagctgcagagctgcacccatggcgtccccggggatcttcaaatctaccacatcggaaatctgctcaagggcgacaaagtgaacggccacctgattcataagatcgagcctcacttcaatacatcttggatgagctgggatgggtgtgaccttgactattactgcaacatgggagattggccctcctgttcttatacgggcgttacccagcataatcacgccgcgtttgtgaacatgctgaatattgaaacagactacaccaaaaacttccactttcatagcaagagagtcacagcccacggggataccccgcagctcgacctgaaagctcggcctacgtacggagccggcgagatcacagtgctggttgaagtggctgatatggagctccataccaagaaaattgagatctccgggctgaagttcgccagccttacctgcacaggatgttatgcgtgctcctccggcatcagctgtaaggtccgcattcacgtggacgaacccgatgagctgaccgtccatgtgaaatctgaagaccctgatatcgttgccgcttccagctccctcatggccagaaagctggagtttggcacagactctacgttcaaggctttcagcgccatgcccaaaacctccctttgcttttacattgtggaacgggagtattgtaaatcttgcagcaaggaggatacacagaagtgtgtcaacaccaaactggaacaaccccagtccatcctcattgagcacaaggggacaatcatcggaaaacagaatgatacctgcacggcccgcgctagctgctggctggaatctattaagtccttcttttacggcctgaaaaacatgctcagcgggatcttcggaaatgtgtttattggcatcttcctgtttttcgcgccttttattatgcttatcctgttctttatgttcgggtggcggattctcttttgtttcaagtgctgtagaagaacccgcggcctgttcaagtatcggcacctgaaagacgacgaggaggttggatacagaaagatcatcgaacgccttaacaataaaaagggcaaaaacaagctcctggacggggagcggctggccgatagaaagattgctgaactcttttctacaaaaacccatatcgga

SEQ ID NO: 14086 - RNA, 1932 nt, synthetic construct
  misc_feature 1..1932: note = derived and/or modified CDS sequence (opt5) from CCHFV(SPU 18/88)__KJ682810.1__Gc
  source 1..1932: mol_type = other RNA
ttcctggacagcatcgtgaagggcaaaaagaacctccttaattccacctctctggagacaagcctgtccattgaagccccctggggagctatcaacgtccagtctacgtttaaacctaccgttagcgccgcgaatattgctctctcctggtctagcgtggagcacagagggaacaagatcctggtgtccggccggagcgaatctattatgaaacttgaggaacgcacagggatctcctgggatctgggagtcgaggacgccagcgagtctaagctcctgaccgtgtccgttatggatctgagccaaatgtactctccggtgttcgaatatctctccggcgacagacaggtcgaggaatggcccaaggccacatgcaccggggattgtcctgagcggtgcggatgtacaagctctacctgcctgcataaagagtggccccactctcgcaattggagatgtaaccctacgtggtgctggggcgtgggcaccgggtgtacatgctgtggacttgacgttaaggatctgtttaccgactacatgttcgtgaaatggaaggtcgattatatcaaaacagaagctattgtgtgcgtggagctcaccagccaggaacggcagtgttccctgatcgaggccggcacgcgctttaatcttgggcccgtcacaattaccctgagcgaacctagaaacatccaacagaagctcccgcccgagattgttacactgcatcctcggatcgaggaaggattctttgacctgatgcacattcagaaggtgctctctgcttccaccgtgtgcaaactgcagagctgcacccatggcgtccccggggatcttcaaatctaccacatcggaaatctgctcaagggcgacaaagtgaacggccacctgattcataagatcgagcctcacttcaatacatcttggatgagctgggatgggtgtgaccttgactattactgcaacatgggagattggccctcctgttcttatacgggcgttacccagcataatcacgccgcgtttgtgaacatgctgaatattgaaacagactacaccaaaaacttccactttcatagcaagcgcgtcacagcccacggggataccccgcagctcgacctgaaagctagacctacgtacggagccggcgagatcacagtgctggttgaagtggctgatatggagctccataccaagaagattgagatctccgggctgaaattcgccagccttacctgcacaggatgttatgcgtgctcctccggcatcagctgtaaggtccggattcacgtggacgaacccgatgagctgaccgtccatgtgaaatctgaagaccctgatatcgttgccgcttccagctccctcatggcccgcaagctggagtttggcacagactctacgttcaaggctttcagcgccatgcccaaaacctccctttgcttttacattgtggaaagagagtattgtaagtcttgcagcaaagaggatacacagaagtgtgtcaacaccaaactggaacaaccccagtccatcctcattgagcacaaggggacaatcatcggaaaacagaatgatacctgcacgggcaaggccgggtgctggctggaaagcattaagtctttcttttacggactgaaaaacatgctctccggcatcttcgggaatgtgtttattggcatcttcctgtttcttgctcctttcattatgctgatcctctttttcatgtttggatggcggattctgttctgttttaagtgctgtcgcagaacccggggcctgttcaaatatagacaccttaaggacgacgaggagatcgggtaccgcaaaatcattgaacggctcaagaacaagaaaggaaagaataaactgctggacggcgagagactcgcggatcgcaagatcgccgaactgttcagcacaaaaacccatattggg

SEQ ID NO: 14087 - RNA, 1932 nt, synthetic construct
  misc_feature 1..1932: note = derived and/or modified CDS sequence (opt5) from CCHFV(SPU 431/85)__KJ682812.1__Gc
  source 1..1932: mol_type = other RNA
ttcctggacagcatcgtgaagggcagaaagaacctcctgaatagcacctctcttgagacaagcctgtccattgaagccccctggggcgctatcaacgtccagtctacgtttaagcctaccgttagcgccgcgaatattgctctctcctggtctagcgtggagcaccggggaaacaaaatcctggtgtccggccgcagcgaatctattatgaaacttgaggaaagaacagggatctcctgggatctgggagtcgaggacgccagcgagtctaaactcctgaccgtgtccgttatggatctgagccaaatgtactctccggtgttcgaatatctctccggcgaccggcaggtcgaggaatggcccaaggccacatgcaccggggattgtcctgagcgctgcggatgtacaagctctacctgcctgcataaggagtggccccactccagaaattggcggtgtaaccctacgtggtgctggggcgtgggcaccgggtgtacatgctgtggacttgacgttaaagatctgtttaccgactacatgttcgtgaagtggaaagtcgaatatatcaagacagaggctattgtgtgcgtggaactcaccagccaggagcgccagtgttccctgatcgaagccggcacgagatttaatcttgggcccgtcacaattaccctgagcgagcctcggaacatccaacagaaactcccgcccgagattatcacactgcatcctcgcattgaagagggattctttgatctgatgcacgttcagagagtgctctctgcttccaccgtgtgcaagctgcagagctgcacccatggcgtccccggggaccttcaagtgtaccacatcggaaatctgctcaagggcgataaagttaacggccacctgatccataagattgaacctcacttcaatacatcttggatgagctgggacgggtgtgatcttgactattactgcaacatgggagactggccctcctgtacgtataccggcgtgacacagcataatcacgccgcgtttgtcaacctgctcaatatcgagaccgattacacaaagaacttccactttcattctaagcgggtgaccgcccacggggacacgccgcagctggatctgaaagctcgccctacatacggagccggcgaagttaccgtgctcgtcgaggtggctgacatggagctgcataccaagaaaattgaaatcagcgggcttaagttcgcctccctgacatgcaccggatgttatgcgtgcagctctggcatttcctgtaaggtcaaaatccacgtggatgagcccgacgaactcacagttcatgtgaaaagcgaggatcctgacatcgtcgccgctgggtcttccctgatggccagaaaacttgaatttggggctgatagcacgttcaaggccttctccgccatgcccaaaacctctctgtgcttttacattgtggagcgggagtattgtaagagctgctcccgcgaagacacaagaaagtgtgttaacaccaaactcgatcggccccagtctatcctgattgagcacaagggaacaatcattggcaaacaaaataatacctgcacggctaaggcgagctgctggctggaatccgtgaaatccttcttttacgggctcaagaacatgctgtctggaatcttcggcaacgtctttatcgggattttcctttttatcgcccctttcgtgctgctcattctgtttttcatgtttggctggagaatcctgttctgttttaagtgctgtcgccggaccagaggacttttcaaatatcgccacctcaaggacgacgaggagacaggctaccggaaaattatcgaaagactgaataacaagaaagggaagaataagctgctcgatggagagcgcctggctgaccggaaaattgccgaacttttctccaccaagagccatatcggc

SEQ ID NO: 14088 - RNA, 1932 nt, synthetic construct
  misc_feature 1..1932: note = derived and/or modified CDS sequence (opt5) from CCHFV(SPU 48/90)__KJ682813.1__Gc
  source 1..1932: mol_type = other RNA
ttcagagacagcatcgtgaagggcatgaaaaacctgctcaattccacctctctggagacaagcctttccattgaagccccctggggagctatcaacgtccagtctacgtacaagcctaccgttagcacagccaatattgcgctgtcctggtctagcgtggagcaccgggggaacaaaatcctcgtgtccggccgcagcgaatctattatgaagctggaggaaagaaccgggatctcctgggatcttggagtcgaggacgctagcgagtctaaactgctcacagtgtccgttatggatctgagccaaatgtattctccggtgtttgaatacctgtccggcgaccggcaggtcgaggaatggcccaaggccacatgcacaggggattgtcctgagcgctgcggatgtaccagctccacgtgcctccataaggagtggccccactctagaaattggcggtgtaaccctacctggtgctggggcgtgggcacagggtgtacctgctgtggactggacgttaaagatcttttcacagactatatgtttgtgaagtggaaagtcgaatacatcaagaccgaggccattgtgtgcgtggaactgacgagccaggagcgccagtgttccctcatcgaagctggcacaagattcaatctggggcccgtcaccattacacttagcgagcctcggaacatccaacagaaactgccgcccgagattatcaccctccatcctcgcattgaagagggatttttcgatctgatgcacgttcagaaggtgctgtctgcctccaccgtgtgcaagctccagagctgcacacatggcgtccccggggacctgcaagtgtatcacatcggaaatcttctgaaaggcgataaggttaacggccacctcatccataaaattgaacctcactttaatacgtcttggatgagctgggacgggtgtgatctggactactattgcaacatgggagactggccctcctgtacctacacaggcgtgacccagcataatagagcttctttcgtcaaccttctgaatatcgagacagattacaccaagaactttcacttccacagcaaacgggtgacggcccatggggacacaccgcagctcgatctgaaggcgcgccctacctatggagccggcgaaattaccgttctggtggaggtcgctgacatggagctccacaccaaaaagatcgaaatttccgggctgaagtttgccagccttacctgcacaggatgttacgcttgttcttccggcatcagctgcaaagtgagaatccatgtcgatgagcccgacgaactgacggtgcacgttaagtctgatgaccctgatgtggtcgccgcgtccagctccctcatggcccggaaactggagttcggcaccgactctacatttaaggctttcagcgccatgcccaaaacctccctttgcttctatattgtggaaaaggagtactgtaagtcttgcagcgaggaagataccaaaaagtgtgttaacaccaaactggagcagccccaatccatcctcattgaacataaggggacgatcattggaaaacagaatagcacatgcacagctaaggtgtcttgctggctggagtccgccaagagctttttctatggcctgaaagacatgctctctgggatctttggaaacgtcttcatcggcatttttctgttccttgccccttttatcctgctcattctgttctttatgttcgggtggcgcatcctgctttgttttaagtgctgtagacggaccagaggcctcttcaaataccgccacctgaaggacgatgaggaaacaggatatcggagaattatcgagcgcctgaataacaaaaagggcaagaataaactcctggacggggaacggcttgctgatagacgcattgcggagctgttttccaccaagacgcacatcgga

SEQ ID NO: 14089 - RNA, 1932 nt, synthetic construct
  misc_feature 1..1932: note = derived and/or modified CDS sequence (opt5) from CCHFV(SPU 187/90)__KJ682814.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtacaagcctaccgttagcacagccaatattgcgctctcctggtctagcgtggagcacagagggaacaaaatcctggtgtccggccggagcgaatctattatgaaacttgaggaacgcaccgggatctcctgggatctgggagtcgaggacgctagcgagtctaaactcctgacagtgtccgttatggatctgagccaaatgtattctccggtgtttgaatacctctccggcgacagacaggtcgaggaatggcccaaggctacctgcacaggggattgtcctgagcggtgcggatgtaccagctccacgtgcctgcataaggagtggccccactctcgcaattggagatgtaaccctacctggtgctggggcgtgggcacagggtgtacctgctgtggacttgacgttaaagatctgttcacagactatatgtttgtgaagtggaaagtcgaatacatcaagaccgaggccattgtgtgcgtggaactcacgagccaggagcggcagtgttccctgatcgaagccggcacacgcttcaatcttgggcccgtcaccattacactgagcgagcctagaaacatccaacagaaactcccgcccgagattatcaccctgcatcctcggattgaagagggatttttcgatctgatgcacgttcagaaggtgctctctgcctccaccgtgtgcaagctgcagagctgcacacatggcgtccccggggaccttcaagtgtatcacatcggaaatctgctcaaaggcgataaggttaacggccacctgatccataaaattgaacctcactttaatacgtcttggatgagctgggacgggtgtgatcttgactactattgcaacatgggagactggccctcctgtacctacacaggcgtgacccagcataatcacgcttctttcgtcaacctgctcaatatcgagacagattacaccaagaactttcacttccatagcaaacgcgtgacggcccacggggacacaccgcagctggatctgaaggcgagacctacctatggagccggcgaaattaccgttctcgtggaggtcgctgacatggagctgcatacaaagaagatcgaaatttccgggcttaagtttgccagcctgacctgcacaggatgttacgcttgctctagcggcatcagctgtaaagtgcggatccacgtcgatgagcccgacgaactcacggtgcatgttaagtctgatgaccctgatgtggtcgccgcgtccagctccctgatggcccgcaaacttgagttcggcaccgactctatttttaaggctttcagcgccatgcccaaaacatccctgtgcttctatatcgtggaaagagagcactgtaagtcttgcagcgaggaagataccaagaaatgtgttaacacaaagctcgagcagccccaatccattctgatcgaacacaaagggaccattatcggaaagcagaatagcacgtgcaccgctaaaacatcttgctggctggagtccgtgaagtcctttttctacggcctcaagaacatgctgtctgggatctttggaaatgtcttcattggcatctttcttttcctggccccttttattctcctgatcctgttctttatgttcgggtggcggattctgttttgtttcaaatgctgtcgcagaacccggggcctctttaagtatagacatctgaaagacgacgaggaaacaggataccgccggatcattgagagactgaacaataagaaaggcaagaacaagctcctggatggggaacgccttgccgaccggagaatcgctgagctgttctccaccaaaacgcacatcgga

SEQ ID NO: 14090 - RNA, 1932 nt, synthetic construct
  misc_feature 1..1932: note = derived and/or modified CDS sequence (opt5) from CCHFV(Haskovo-V46/13)__KR092379.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtttaagcctaccgttagcacagccaatattgcgctctcctggtctagcgtggagcacagagggaacaaaatcctggtgaccggccggtccgaaagcattatgaagctggaggaacgcacaggggtctcttgggatctgggagtggaggacgcttccgagagcaaactcctgaccgtttctatcatggatctgtcccaaatgtacagcccggtgttcgaatatctctctggcgacagacaggtcgaggaatggcccaaggccacatgcaccggggattgtcctgagcggtgcggatgtacgtccagcacatgcctgcataaggagtggccccactcccgcaattggagatgtaaccctacatggtgctggggcgtgggcaccgggtgtacatgctgtggagttgacgtgaaagatctttttaccgaccatatgttcgtcaagtggaaagtggaatacatcaagacggaggccattgtgtgcgtcgaactgacatctcaggagcggcagtgtagcctcatcgaagctggcacccgctttaatctggggcccgttacaattaccctttccgagcctagaaacatccaacagaaactgccgcccgagattatcaccctccaccctaagattgaagagggattctttgatctgatgcatgtgcagaaggtgctgagcgcctctacagtctgcaaactccagtcctgcacgcacggcatccccggggacctgcaagtgtatcacatcggaaatcttctgaagggcgatcgggttaacggccatctcattcacaaaatcgaacctcatttcaataccagctggatgtcttgggacgggtgtgatctggactactattgcaacatgggagactggcccagctgtacatacaccggcgtgacacagcacaatcacgctgcctttgtcaaccttctgaatattgagaccgattatacgaagacattccattttcactccaaacgcgtgaccgcgcatggggacaccccgcagctcgatctgaaggccagacctacatacggagctggcgaaatcaccgttctggtggaggtcgccgacatggagctccacaccaaaaaggtggaaatttctgggctgaagttcgctagccttacgtgcaccggatgttacgcctgctccagcggcatctcttgtaaagtccggatccatgtggatgagcccgacgaactgacagttcacgtgaagtccagcgatcctgacgtcgtggcggccggcacctctctcatggctcgcaaactggagtttgggacagattccaccttcaaggccttcagcgctatgcccaaaacgtccctttgcttttatattgttgaaagagagtactgtaagtcttgcagcgaggacgatacccagaagtgtgtggacacaaaactggaacaaccccagtccatcctcattgagcacaagggaaccatcattggcaaacagaacgacacatgcaccgcccgggcctcttgctggctggaaagcgtcaagtccttcttttatgggctgaaaaacatgctcggaagcgtgttcggcaattttctgatcgggatccttctgttcctcgctccttttgtgctgctggttcttttctttatgttcggctggaagattctcttttgtttcaagtgctgtcgcagaacgcggggactgtttaaatacagacatctgaaggatgacgaggagacaggctatcgccggatcattgaaagactcaactctaaaaaggggaaaaatcgcctgcttgatggagagcggctggcggacagaaagatcgccgaactcttctccaccaagacacacattggc

SEQ ID NO: 14091 - RNA, 1932 nt, synthetic construct
  misc_feature 1..1932: note = derived and/or modified CDS sequence (opt5) from CCHFV(24-R-2012)__KR814856.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtttaagcctaccgttagcacagccaatattgcgctctcctggtctagcgtggagcacagagggaacaaaatcctggtgaccggccggtccgaaagcattatgaagctggaggaacgcacaggggtctcttgggatctgggagtggaggacgcttccgagagcaaactcctgaccgtttctatcatggatctgtcccaaatgtacagcccggtgttcgaatatctctctggcgacagacaggtcgaggaatggcccaaggccacatgcaccggggattgtcctgagcggtgcggatgtacgtccagcacatgcctgcataaggagtggccccactcccgcaattggagatgtaaccctacatggtgctggggcgtgggcaccgggtgtacatgctgtggagttgacgtgaaagatctttttaccgaccatatgttcgtcaagtggaaagtggaatacatcaagacggaggccattgtgtgcgtcgaactgacatctcaggagcggcagtgtagcctcatcgaagctggcacccgctttaatctggggcccgttacaattaccctttccgagcctagaaacatccaacagaaactgccgcccgagattatcaccctccaccctaaggtggaagagggattctttgatctgatgcatgtgcagaaggtcctgagcgcctctacagtgtgcaaactccagtcctgcacgcacggcattcccggggacctgcaagtttatcacatcggaaatcttctgaagggcgatcgggtgaacggccatctcatccacaaaattgaacctcatttcaataccagctggatgtcttgggacgggtgtgatctggactactattgcaacatgggagactggcccagctgtacatacaccggcgtcacacagcacaatcacgctgcctttgtgaaccttctgaatatcgagaccgattatacgaagacattccattttcactccaaacgcgttaccgcgcatggggacaccccgcagctcgatctgaaggccagacctacatacggagctggcgaaattaccgtgctggtcgaggtggccgacatggagctccacaccaaaaaggtcgaaatctctgggctgaagttcgctagccttgcctgcacgggatgttacgcgtgctccagcggcatttcttgtaaagtgcggatccatgttgatgagcccgacgaactgaccgtgcacgtcaagtccaacgatcctgacgtggttgccgctagcacatctctcatggcccgcaaactggagtttggcaccgattccacattcaaggctttcagcgccatgcccaaaacctccctttgcttttatatcgtggaaagagagtactgtaagtcttgcagcgaggaagacacgcagaagtgtgtcgataccaaactggagcaaccccagtccattctcatcgaacacaaggggacaattatcggaaaacagaacgatacctgcacagccaaggcttcttgctggctggagagcgtgaaatccttcttttatggcctgaagaatatgctcgggagcgtgttcggaaactttttcattggcatcctgctttttctggcgcctttcgttctcctggtcctgtttttcatgtttgggtggaagatccttttctgttttaaatgctgtcggcgcaccagaggcctcctgaagtaccggctgctcaaagacgacgaggaaacgggatatagacgcattatcgagcggctgaataacaagaaaggcaagaatagacttctggacggggaacgcctcgccgatcggaagattgctgagctgttctctacaaaaacccatatcgga

SEQ ID NO: 14092 - RNA, 1932 nt, synthetic construct
  misc_feature 1..1932: note = derived and/or modified CDS sequence (opt5) from CCHFV(36-ST-2014)__KR814857.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtttaagcctaccgttagcacagccaatattgcgctctcctggtctagcgtggagcacagagggaacaaaatcctggtgaccggccggtccgaaagcattatgaaacttgaggaacgcacaggggtctcttgggatctgggagtggaggacgcttccgagagcaagctcctgaccgtttctatcatggatctgtcccaaatgtacagcccggtgttcgaatatctctctggcgacagacaggtcgaggaatggcccaaggccacatgcaccggggattgtcctgagcggtgcggatgtacgtccagcacatgcctgcataaggagtggccccactcccgcaattggagatgtaaccctacatggtgctggggcgtgggcaccgggtgtacatgctgtggagttgacgtgaaagatctttttaccgaccatatgttcatcaagtggaaagtcgaatacattaagacggaggccatcgtgtgcgtggaactgacatctcaggagcggcagtgtagcctcattgaagctggcacccgctttaatctggggcccgtcacaatcaccctttccgagcctagaaacattcaacagaaactgccgcccgagatcattaccctccaccctaagatcgaagagggattctttgatctgatgcatgttcagaaggtgctgagcgcctctacagtgtgcaaactccagtcctgcacgcacggcatccccggggacctgcaaatttatcacatcggaaatcttctgaagggcgatcggctcaacggccatctgattcacaaaatcgaacctcatttcaataccagctggatgtcttgggacgggtgtgatcttgactactattgcaacatgggagactggcccagctgtacatacaccggcgtcacacagcacaatcacgctgcctttgtgaacctgctcaatattgagaccgattatacgaagacattccattttcactccaaacgcgttaccgcgcatggggacaccccgcagctggatctgaaggccagacctacatacggagctggcgaaatcaccgtgctcgtcgaggtggccgacatggagctgcacaccaaaaaggttgaaatctctgggcttaagttcgctagcctggcctgcacgggatgttacgcgtgctccagcggcatttcttgtaaagtgcggatccatgtcgatgagcccgacgaactcaccgtgcacgtcaagtccagcgatcctgacgtggttgccgcttctacatccctgatggcccgcaaacttgagtttggcaccgatagcacattcaaggctttctccgccatgcccaaaacctctctgtgcttttatattgtggaaagagagtactgtaagagctgctccgaggacgatacgaagaaatgtgtcgacaccaagctcgaccagccccaatctatcctgattgaacacaaagggacaatcatcggaaagcagaacgatacctgcacagccaaagctagctgctggctggagtccgttaagagcttcttttatggcctcaagaacatgctggggtctgtgttcggaaatttcttcgtgggcattcttctgtttctcgcgcctttcgtcctgctggtgctgtttttcatgtgtgggtggaaatttctcttctgctttaagtgttgccggcgcaccagaggcctgttcaaataccggcatctgaaggacgatgaagagacgggatatagacgcatcattgagcggctcaactccaaaaagggcaagaatagactgcttgacggggaacgcctggccgatcggaaaatcgctgagctctttagcacaaagtctcacattgga

SEQ ID NO: 14093 - RNA, 1932 nt, synthetic construct
  misc_feature 1..1932: note = derived and/or modified CDS sequence (opt5) from CCHFV(37-R-2013)__KR814858.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtttaagcctaccgttagcacagccaatattgcgctctcctggtctagcgtggagcacagagggaacaaaatcctggtgaccggccggtccgaaagcattatgaagctggaggaacgcacaggggtctcttgggatctgggagtggacgatgcttccgagagcaaactcctgaccgtttctatcatggacctgtcccaaatgtacagcccggtgttcgagtatctctctggcgatagacaggtcgaagagtggcccaaggccacatgcaccggggactgtcctgaacggtgcggatgtacgtccagcacatgcctgcataaggagtggccccactcccgcaattggagatgtaaccctacatggtgctggggcgtgggcaccgggtgtacatgctgtggagttgatgtgaaagacctttttaccgatcatatgttcgtcaagtggaaagtggagtacatcaagacggaagccattgtgtgcgtcgagctgacatctcaggaacggcagtgtagcctcatcgaggctggcacccgctttaatctggggcccgttacaattaccctttccgaacctagaaacatccaacagaaactgccgcccgagattatcaccctccaccctaaggtggaggaaggattctttgacctgatgcatgtgcagaaggtcctgagcgcctctacagtgtgcaaactccagtcctgcacgcacggcattcccggggatctgcaagtttatcacatcggaaatcttctgaagggcgaccgggtgaacggccatctcatccacaaaattgagcctcatttcaataccagctggatgtcttgggatgggtgtgacctggactactattgcaacatgggagattggcccagctgtacatacaccggcgtcacacagcacaatcacgctgcctttgtgaaccttctgaatatcgaaaccgactatacgaagacattccattttcactccaaacgcgttaccgcgcatggggataccccgcagctcgacctgaaggccagacctacatacggagctggcgagattaccgtgctggtcgaagtggccgatatggagctccacaccaaaaaggtcgagatctctgggctgaagttcgctagccttgcctgcacgggatgttacgcgtgctccagcggcatttcttgtaaagtgcggatccatgttgacgaacccgatgagctgaccgtgcacgtcaagtccaacgaccctgatgtggttgccgctagcacatctctcatggcccgcaaactggaatttggcaccgactccacattcaaggctttcagcgccatgcccaaaacctccctttgcttttatatcgtggagagagaatactgtaagtcttgcagcgaggaggatacgcagaagtgtgtcgacaccaaactggaacaaccccagtccattctcatcgagcacaaggggacaattatcggaaaacagaacgtgacctgcacagccaaggcttcttgctggctggaaagcgtgaaatccttcttttatggcctgaagaatatgctcgggagcgttttcggaaactttttcattggcatcctgctttttctggcgcctttcgtcctcctggtgctgtttttcatgtttgggtggaagatccttttctgttttaaatgctgtcggcgcaccagaggcctcctgaagtaccggctgctcaaagacgatgaggagacgggatatagacgcattatcgaacggctgaataacaagaaaggcaagaatagacttctggacggggagcgcctcgccgatcggaagattgctgaactgttctctacaaaaacccatatcgga

SEQ ID NO: 14094 - RNA, 1932 nt, synthetic construct
  misc_feature 1..1932: note = derived and/or modified CDS sequence (opt5) from CCHFV(44-ST-2010)__KR814859.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtttaagcctaccgttagcacagccaatattgcgctctcctggtctagcgtggagcacagagggaacaaaatcctggtgaccggccggtccgaaagcattatgaaacttgaggaacgcacaggggtctcttgggatctgggagtggaggacgcttccgagagcaagctcctgaccgtttctatcatggatctgtcccaaatgtacagcccggtgttcgaatatctctctggcgacagacaggtcgaggaatggcccaaggccacatgcaccggggattgtcctgagcggtgcggatgtacgtccagcacatgcctgcataaggagtggccccactcccgcaattggagatgtaaccctacatggtgctggggcgtgggcaccgggtgtacatgctgtggagttgacgtgaaagatctttttaccgaccatatgttcatcaagtggaaagtcgaatacattaagacggaggccatcgtgtgcgtggaactgacatctcaggagcggcagtgtagcctcattgaagctggcacccgctttaatctggggcccgtcacaatcaccctttccgagcctagaaacattcaacagaaactgccgcccgagatcattaccctccaccctaagatcgaagagggattctttgatctgatgcatgttcagaaggtgctgagcgcctctacagtgtgcaaactccagtcctgcacgcacggcatccccggggacctgcaaatttatcacatcggaaatcttctgaagggcgatcggctcaacggccatctgattcacaaaatcgaacctcatttcaataccagctggatgtcttgggacgggtgtgatcttgactactattgcaacatgggagactggcccagctgtacatacaccggcgtcacacagcacaatcacgctgcctttgtgaacctgctcaatattgagaccgattatacgaagacattccattttcactccaaacgcgttaccgcgcatggggacaccccgcagctggatctgaaggccagacctacatacggagctggcgaaatcaccgtgctcgtcgaggtggccgacatggagctgcacaccaaaaaggttgaaatctctgggcttaagttcgctagcctggcctgcacgggatgttacgcgtgctccagcggcatttcttgtaaagtgcggatccatgtcgatgagcccgacgaactcaccgtgcacgtcaagtccagcgatcctgacgtggttgccgcttctacatccctgatggcccgcaaacttgagtttggcaccgatagcacattcaaggctttctccgccatgcccaaaacctctctgtgcttttatattgtggaaagagagtactgtaagagctgctccgaggacgatacgaagaaatgtgtcgacaccaagctcgaccagccccaatctatcctgattgaacacaaagggacaatcatcggaaagcagaacgatacctgcacagccaaagctagctgctggctggagtccgttaagagcttcttttatggcctcaagaacatgctggggtctgtgttcggaaatttcttcgtgggcattcttctgtttctcgcgcctttcgtcctgctggtgctgtttttcatgtgtgggtggaaaatcctcttttgcttcaagtgttgccggcgcaccagaggcctgtttaaataccggcatctgaaggacgatgaagagacgggatatagacgcattatcgagcggctcaactccaaaaagggcaagaatagactgcttgacggggaacgcctggccgatcggaaaattgctgagctctttagcacaaagtctcacatcgga

SEQ ID NO: 14095 - RNA, 1932 nt, synthetic construct
  misc_feature 1..1932: note = derived and/or modified CDS sequence (opt5) from CCHFV(46-ST-2012)__KR814860.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtttaagcctaccgttagcacagccaatattgcgctctcctggtctagcgtggagcacagagggaacaaaatcctggtgaccggccggtccgaaagcattatgaagctggaggaacgcacaggggtctcttgggatctgggagtggaggacgcttccgagagcaaactcctgaccgtttctatcatggatctgtcccaaatgtacagcccggtgttcgaatatctctctggcgacagacaggtcgaggaatggcccaaggccacatgcaccggggattgtcctgagcggtgcggatgtacgtccagcacatgcctgcataaggagtggccccactcccgcaattggagatgtaaccctacatggtgctggggcgtgggcaccgggtgtacatgctgtggagttgacgtgaaagatctttttaccgaccatatgttcgtcaagtggaaagtggaatacatcaagacggaggccattgtgtgcgtcgaactgacatctcaggagcggcagtgtagcctcatcgaagctggcacccgctttaatctggggcccgttacaattaccctttccgagcctagaaacatccaacagaaactgccgcccgagattatcaccctccaccctaaggtggaagagggattctttgatctgatgcatgtgcagaaggtcctgagcgcctctacagtgtgcaaactccagtcctgcacgcacggcattcccggggacctgcaagtttatcacatcggaaatcttctgaagggcgatcggatcaacggccatctcattcacaaaatcgaacctcatttcaataccagctggatgtcttgggacgggtgtgatctggactactattgcaacatgggagactggcccagctgtacatacaccggcgtgacacagcacaatcacgctgcctttgtcaaccttctgaatattgagaccgattatacgaagacattccattttcactccaaacgcgtgaccgcgcatggggacaccccgcagctcgatctgaaggccagacctacatacggagctggcgaaatcaccgttctggtggaggtcgccgacatggagctccacaccaaaaaggtggaaatttctgggctgaagttcgctagccttgcctgcacgggatgttacgcgtgctccagcggcatctcttgtaaagtccggatccatgtggatgagcccgacgaactgaccgttcacgtgaagtccagcgatcctgacgtcgtggccgcttctacatccctcatggcccgcaaactggagtttggcaccgatagcacattcaaggctttctccgccatgcccaaaacctctctttgcttttatattgttgaaagagagtactgtaagagctgctccgaggaagacacgcagaagtgtgtggatacccggctggagcaaccccagtctatcctcattgaacacaaagggacaatcattggaaagcagaacgatacctgcacagccaaagctagctgctggctggagtccgtcaagagcttcttttatggcctgaaaaacatgctcgggtctgtgttcggaaatttcttcatcggcatcctgctttttctggcgcctttcgtgctcctggttctgtttttcatgtttgggtggaagattcttttctgttttaagtgctgtcgcagaacccggggcctcctgaaatacagacatctgaaggacgacgaggaaacgggatatcgccggatcattgagagactcaacaataaaaagggcaaaaaccgcctgcttgacggggaacggctggccgatagaaagatcgctgagctcttttccacaaagacccacattgga

SEQ ID NO: 14096 - RNA, 1932 nt, synthetic construct
  misc_feature 1..1932: note = derived and/or modified CDS sequence (opt5) from CCHFV(47-ST-2013)__KR814861.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtttaagcctaccgttagcacagccaatattgcgctctcctggtctagcgtggagcacagagggaacaaaatcctggtgaccggccggtccgaaagcattatgaagctggaggaacgcacaggggtctcttgggatctgggagtggaggacgcttccgagagcaaactcctgaccgtttctatcatggatctgtcccaaatgtacagcccggtgttcgaatatctctctggcgacagacaggtcgaggaatggcccaaggccacatgcaccggggagtgtcctgagcggtgcggatgtacgtccagcacatgcctgcataaggaatggccccactcccgcaattggagatgtaaccctacatggtgctggggcgtgggcaccgggtgtacatgctgtggagttgatgtgaaagacctttttaccgatcatatgttcatcaagtggaaagtcgagtacattaagacggaagccatcgtgtgcgtggagctgacatctcaggaacggcagtgtagcctcattgaggctggcacccgctttaatctggggcccgtcacaatcaccctttccgagcctagaaacattcaacagaaactgccgcccgaaatcattaccctccaccctaagatcgaggaaggattctttgacctgatgcatgttcagaaggtgctgagcgcctctacagtgtgcaaactccagtcctgcacgcacggcatccccggggatctgcaaatttatcacatcggaaatcttctgaagggcgaccgggtcaacggccatctcattcacaaaatcgagcctcatttcaataccagctggatgtcttgggatgggtgtgacctggattactattgcaacatgggagactggcccagctgtacatacaccggcgtgacacagcacaatcacgctgcctttgttaaccttctgaatattgaaaccgactatacgaagacattccattttcactccaaacgcgtgaccgcgcatggggataccccgcagctcgacctgaaggccagacctacatacggagctggcgagatcaccgtcctggtggaggttgccgatatggaactccacaccaaaaaggtggaggtctctgggctgaagttcgctagccttgcctgcacgggatgttacgcgtgctccagcggcatctcttgtaaagtgcggattcatgtcgacgaacccgatgagctgaccgtgcacgttaagtccagcgaccctgatgtggtcgccgcttctacatccctcatggcccgcaaactggaatttggcaccgacagcacattcaaggctttctccgccatgcccaaaacctctctttgcttttatatcgtggagagagagtactgtaagagctgctccgaagatgacacgaagaaatgtgttgataccaagctggagcagccccaatctattctcatcgaacacaaagggacaattatcggaaagcagaacgatacctgcacagccaaagctagctgctggctggagtccgtcaagagcttcttttatggcctgaagaacatgctcgggtctgtgttcggaaatttctttgtgggcatcctgctttttctggcgcctttcgtgctcctggttctgtttttcatgtttgggtggaaaattcttttctgttttaagtgctgtcggcgcaccagaggcctcttcaaataccggcatctgaaggacgacgaggaaacgggatatagacgcatcattgagcggctgaactccaaaaagggcaagaatagactcctggacggggaacgccttgccgatcggaaaatcgctgagctgttcagcacaaagacccacattgga

SEQ ID NO: 14097 - RNA, 1932 nt, synthetic construct
  misc_feature 1..1932: note = derived and/or modified CDS sequence (opt5) from CCHFV(52-R-2014)__KR814862.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtttaagcctaccgttagcacagccaatattgcgctctcctggtctagcgtggagcacagagggaacaaaatcctggtgaccggccggtccgaaagcattatgaagctggaggaacgcacaggggtctcttgggatctgggagtggacgatgcttccgagagcaaactcctgaccgtttctatcatggacctgtcccaaatgtacagcccggtgttcgagtatctctctggcgatagacaggtcgaagagtggcccaaggccacatgcaccggggactgtcctgaacggtgcggatgtacgtccagcacatgcctgcataaggagtggccccactcccgcaattggagatgtaaccctacatggtgctggggcgtgggcaccgggtgtacatgctgtggagttgatgtgaaagacctttttaccgatcatatgttcgtcaagtggaaagtggagtacatcaagacggaagccattgtgtgcgtcgagctgacatctcaggaacggcagtgtagcctcatcgaggctggcacccgctttaatctggggcccgttacaattaccctttccgaacctagaaacatccaacagaaactgccgcccgagattatcaccctccaccctaaggtggaggaaggattctttgacctgatgcatgtgcagaaggtcctgagcgcctctacagtgtgcaaactccagtcctgcacgcacggcattcccggggatctgcaagtttatcacatcggaaatcttctgaagggcgaccgggtgaacggccatctcatccacaaaattgagcctcatttcaataccagctggatgtcttgggatgggtgtgacctggactactattgcaacatgggagattggcccagctgtacatacaccggcgtcacacagcacaatcacgctgcctttgtgaaccttctgaatatcgaaaccgactatacgaagacattccattttcactccaaacgcgttaccgcgcatggggataccccgcagctcgacctgaaggccagacctacatacggagctggcgagattaccgtgctggtcgaagtggccgatatggagctccacaccaaaaaggtcgagatctctgggctgaagttcgctagccttgcctgcacgggatgttacgcgtgctccagcggcatttcttgtaaagtgcggatccatgttgacgaacccgatgagctgaccgtgcacgtcaagtccaacgaccctgatgtggttgccgctagcacatctctcatggcccgcaaactggaatttggcaccgactccacattcaaggctttcagcgccatgcccaaaacctccctttgcttttatatcgtggagagagaatactgtaagtcttgcagcgaggaggatacgcagaagtgtgtcgacaccaaactggaacaaccccagtccattctcatcgagcacaaggggacaattatcggaaaacagaacgatacctgcacagccaaggctggctgctggctggaatctgtgaaatccttcttttatgggctgaagaatatgctcggaagcgtgttcggcaactttttcattgggatcctgctttttctggcgcctttcgttctcctggtcctgtttttcatgtttggctggaagatccttttctgttttaaatgctgtcggcgcaccagaggactcctgaagtaccggctgctcaaagacgacgaggagacgggctatagacgcattatcgaacggctgaataacaagaaagggaagaatagacttctggatggagagcgcctcgccgaccggaagattgctgaactgttcagcacaaaaacccatatcggc

SEQ ID NO: 14098 - RNA, 1932 nt, synthetic construct
  misc_feature 1..1932: note = derived and/or modified CDS sequence (opt5) from CCHFV(75-R-2012)__KR814863.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtttaagcctaccgttagcacagccaatattgcgctctcctggtctagcgtggagcacagagggaacaaaatcctggtgaccggccggtccgaaagcattatgaagctggaggaacgcacaggggtctcttgggatctgggagtggaggacgcttccgagagcaaactcctgaccgtttctatcatggatctgtcccaaatgtacagcccggtgttcgaatatctctctggcgacagacaggtcgaggaatggcccaaggccacatgcaccggggattgtcctgagcggtgcggatgtacgtccagcacatgcctgcataaggagtggccccactcccgcaattggagatgtaaccctacatggtgctggggcgtgggcaccgggtgtacatgctgtggagttgacgtgaaagatctttttaccgaccatatgttcgtcaagtggaaagtggaatacatcaagacggaggccattgtgtgcgtcgaactgacatctcaggagcggcagtgtagcctcatcgaagctggcacccgctttaatctggggcccgttacaattaccctttccgagcctagaaacatccaacagaaactgccgcccgagattatcaccctccaccctaaggtggaagagggattctttgatctgatgcatgtgcagaaggtcctgagcgcctctacagtgtgcaaactccagtcctgcacgcacggcattcccggggacctgcaagtttatcacatcggaaatcttctgaagggcgatcgggtgaacggccatctcatccacaaaattgaacctcatttcaataccagctggatgtcttgggacgggtgtgatctggactactattgcaacatgggagactggcccagctgtacatacaccggcgtcacacagcacaatcacgctgcctttgtgaaccttctgaatatcgagaccgattatacgaagacattccattttcactccaaacgcgttaccgcgcatggggacaccccgcagctcgatctgaaggccagacctacatacggagctggcgaaattaccgtgctggtcgaggtggccgacatggagctccacaccaaaaaggtcgaaatctctgggctgaagttcgctagccttgcctgcacgggatgttacgcgtgctccagcggcatttcttgtaaagtgcggatccatgttgatgagcccgacgaactgaccgtgcacgtcaagtccagcgatcctgacgtggttgccgcttctacatccctcatggcccgcaaactggagtttggcaccgatagcacattcaaggctttctccgccatgcccaaaacctctctttgcttttatatcgtggaaagagagtactgtaagagctgctccgaggaagacacgcagaagtgtgtcgataccaaactggagcaaccccagtctattctcatcgaacacaaggggacaattatcggaaaacagaacgatacctgcacagccaaggctagctgctggctggagtccgtgaaatctttcctgtatggcctcaagaacatgctggggagcgtgtttggaaatttctttattggcatccttctgttcctcgcgccttttgttctgctggtccttttctttatgttcgggtggaagatcctcttttgtttcaaatgctgtcggcgcaccagaggcctgctgaagtaccggctcctgaaagacgacgaggaaacgggatatagacgcattatcgagcggcttaacaataagaaaggcaagaacagactgctcgacggggaacgcctggccgatcggaagattgctgagctgttttccacaaaaacccatatcgga

SEQ ID NO: 14099 - RNA, 1932 nt, synthetic construct
  misc_feature 1..1932: note = derived and/or modified CDS sequence (opt5) from CCHFV(75-ST-2010)__KR814864.1__Gc
  source 1..1932: mol_type = other RNA
ttcctggacagcatcgtgaagggcatgaaaaacctcctgaatagcacctctcttgagacaagcctgtccattgaagccccctggggagctatcaacgtccagtctacgtttaagcctaccgttagcacagccaatattgcgctctcctggtctagcgtggagcacagagggaacaaaatcctggtgaccggccggtccgaaagcattatgaagctcgaggaacgcacaggggtctcttgggatctgggagtggaggacgcttccgagagcaaactcctgaccgtttctatcatggatctgtcccaaatgtacagcccggtgttcgaatatctctctggcgacagacaggtcgaggaatggcccaaggccacatgcaccggggattgtcctgagcggtgcggatgtacgtccagcacatgcctgcataaggagtggccccactcccgcaattggagatgtaaccctacatggtgctggggcgtgggcaccgggtgtacatgctgtggagttgacgtgaaagatctttttaccgaccatatgttcgtcaagtggaaagtggaatacatcaagacggaggccattgtgtgcgtcgaactgacatctcaggagcggcagtgtagcctcatcgaagctggcacccgctttaatctggggcccgttacaattaccctttccgagcctagaaacatccaacagaaactgccgcccgagattatcaccctccaccctaaggtggaagagggattctttgatctgatgcatgtgcagaaggtcctgagcgcctctacagtgtgcaaactccagtcctgcacgcacggcattcccggggacctgcaagtttatcacatcggaaatcttctgaagggcgatcgggtgaacggccatctcatccacaaaattgaacctcatttcaataccagctggatgtcttgggacgggtgtgatctggactactattgcaacatgggagactggcccagctgtacatacaccggcgtcacacagcacaatcacgctgcctttgtgaaccttctgaatatcgagaccgattatacgaagacattccattttcactccaaacgcgttaccgcgcatggggacaccccgcagctcgatctgaaggccagacctacatacggagctggcgaaattaccgtgctggtcgaggtggccgacatggagctccacaccaaaaaggtcgaaatctctgggctgaagttcgctagccttgcctgcacgggatgttacgcgtgctccagcggcatttcttgtaaagtgcggatccatgttgatgagcccgacgaactgaccgtgcacgtcaagtccagcgatcctgacgtggttgccgcttctacatccctcatggcccgcaaactggagtttggcaccgatagcacattcaaggctttctccgccatgcccaaaacctctctttgcttttatatcgtggaaagagagtactgtaagagctgctccgaggaagacacgcagaagtgtgtcgataccaaactggagcaaccccagtctattctcatcgaacacaaggggacaattatcggaaaacagaacgatacctgcacagccaaggctagctgctggctggagtccgtgaaatccttcttttatggcctgaagaacatgctcgggtctgtgttcggaaactttttcattggcatcctgctttttctggcgcctttcgttctcctggtcctgtttttcatgtttgggtggaagatccttttctgttttaaatgctgtcggcgcgccagaggcctcctgaagtaccggcatctgaaagacgacgaggaaaccggatatagaaagattatcgagcgcctcaataataaaaagggcaagaaccggctgcttgacggggaaagactggctgatcgcaaaattgccgagcttttctccacgaagacacacatcgga

SEQ ID NO: 14100 - RNA, 1932 nt, synthetic construct
  misc_feature 1..1932: note = derived and/or modified CDS sequence (opt5) from CCHFV(3756-ST-2007)__KR814866.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtttaagcctaccgttagcacagccaatattgcgctctcctggtctagcgtggagcacagagggaacaaaatcctggtgaccggccggtccgaaagcattatgaagctggaggaacgcacaggggtctcttgggatctgggagtggaggacgcttccgagagcaaactcctgaccgtttctatcatggatctgtcccaaatgtacagcccggtgttcgaatatctctctggcgacagacaggtcgaggaatggcccaaggccacatgcaccggggattgtcctgagcggtgcggatgtacgtccagcacatgcctgcataaggagtggccccactcccgcaattggagatgtaaccctacatggtgctggggcgtgggcaccgggtgtacatgctgtggagttgacgtgaaagatctttttaccgaccatatgttcatcaagtggaaagtcgaatacattaagacggaggccatcgtgtgcgtggaactgacatctcaggagcggcagtgtagcctcattgaagctggcacccgctttaatctggggcccgtcacaatcaccctttccgagcctagaaacattcaacagaaactgccgcccgagatcattaccctccaccctaagatcgaagagggattctttgatctgatgcatgttcagaaggtgctgagcgcctctacagtgtgcaaactccagtcctgcacgcacggcatccccggggacctgcaaatttatcacatcggaaatcttctgaagggcgatcgggtcaacggccatctcattcacaaaatcgaacctcatttcaataccagctggatgtcttgggacgggtgtgatctggactactattgcaacatgggagactggcccagctgtacatacaccggcgtgacacagcacaatcacgctgcctttgttaaccttctgaatattgagaccgattatacgaagacattccattttcactccaaacgcgtgaccgcgcatggggacaccccgcagctcgatctgaaggccagacctacatacggagctggcgaaatcaccgtcctggtggaggttgccgacatggagctccacaccaaaaaggtggaaatctctgggctgaagttcgctagccttacgtgcaccggatgttacgcctgctccagcggcatttcttgtaaagtccggatccatgtggatgagcccgacgaactgacagtccacgtgaagtccagcgatcctgacgttgtggcggcctctacctccctcatggctcgcaaactggagtttggcacagatagcaccttcaaggccttctccgctatgcccaaaacgtctctttgcttttatattgtcgaaagagagtactgtaagagctgctccgaggacgataccaagaaatgtgtggacacaaagctggaacagccccaatctatcctcattgagcacaaagggaccatcatcggaaagcagaacgacacatgcaccgccaaagccagctgctggctggaatccgttaagagcttcttttatggcctgaagaacatgctcgggtctgtgttcggatcctttttcgtcggcattctgctttttctgacgcctttcgtgctcctggtgctgtttttcatgtttgggtggaaaatccttttctgttttaagtgctgtcggcgcacaagaggcctcttcaaataccggcatctgaaggatgacgaggagaccggatatagacgcattatcgaacggctgaatagcaaaaagggcaagaacagactcctggatggggagcgccttgctgaccggaaaattgcggaactgttctctacaaagacccacatcgga

SEQ ID NO: 14101 - RNA, 1932 nt, synthetic construct
  misc_feature 1..1932: note = derived and/or modified CDS sequence (opt5) from CCHFV(3809-ST-2007)__KR814867.1__Gc
  source 1..1932: mol_type = other RNA
ttcctggacagcatcgtgaagggcatgaaaaacctcctgaatagcacctctcttgagacaagcctgtccattgaagccccctggggagctatcaacgtccagtctacgtttaagcctaccgttagcacagccaatattgcgctctcctggtctagcgtggagcacagagggaacaaaatcctggtgaccggccggtccgaaagcattatgaagctcgaggaacgcacaggggtctcttgggatctgggagtggaggacgcttccgagagcaaactcctgaccgtttctatcatggatctgtcccaaatgtacagcccggtgttcgaatatctctctggcgacagacaggtcgaggaatggcccaaggccacatgcaccggggattgtcctgagcggtgcggatgtacgtccagcacatgcctgcataaggagtggccccactcccgcaattggagatgtaaccctacatggtgctggggcgtgggcaccgggtgtacatgctgtggagttgacgtgaaagatctttttaccgaccatatgttcgtcaagtggaaagtggaatacatcaagacggaggccattgtgtgcgtcgaactgacatctcaggagcggcagtgtagcctcatcgaagctggcacccgctttaatctggggcccgttacaattaccctttccgagcctagaaacatccaacagaaactgccgcccgagattatcaccctccaccctaaggtggaagagggattctttgatctgatgcatgtgcagaaggtcctgagcgcctctacagtgtgcaaactccagtcctgcacgcacggcattcccggggacctgcaagtttatcacatcggaaatcttctgaagggcgatcgggtgaacggccatctcatccacaaaattgaacctcatttcaataccagctggatgtcttgggacgggtgtgatctggactactattgcaacatgggagactggcccagctgtacatacaccggcgtcacacagcacaatcacgctgcctttgtgaaccttctgaatatcgagaccgattatacgaagacattccattttcactccaaacgcgttaccgcgcatggggacaccccgcagctcgatctgaaggccagacctacatacggagctggcgaaattaccgtgctggtcgaggtggccgacatggagctccacaccaaaaaggtcgaaatctctgggctgaagttcgctagccttgcctgcacgggatgttacgcgtgctccagcggcatttcttgtaaagtgcggatccatgttgatgagcccgacgaactgaccgtgcacgtcaagtccagcgatcctgacgtggttgccgcttctacatccctcatggcccgcaaactggagtttggcaccgatagcacattcaaggctttctccgccatgcccaaaacctctctttgcttttatatcgtggaaaaggagtactgtagaagctgctccgaggaagacacgcagaagtgtgtcgataccaaactggagcaaccccagtctattctcatcgaacacaaggggacaattatcggaaaacagaacgatacctgcacagccaaggctagctgctggctggagtccgtgaaatccttcttttatggcctgaagaacatgctcgggtctgtgttcggaaactttttcattggcatcctgctttttctgacccctttcgttctcctggtcctgtttttcatgtttgggtggaagatccttttctgttttaaatgctgtcggcgcacgagaggcctcctgaagtaccggcatctgaaagacgacgaggaaacaggatatagacgcattatcgagcggctcaataataagaaaggcaagaacagactgcttgacggggaacgcctggcggatcggaagattgccgagcttttctccaccaaaacacacatcgga

SEQ ID NO: 14102 - RNA, 1932 nt, synthetic construct
  misc_feature 1..1932: note = derived and/or modified CDS sequence (opt5) from CCHFV(3820-ST-2007)__KR814868.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtttaagcctaccgttagcacagccaatattgcgctctcctggtctagcgtggagcacagagggaacaaaatcctggtgaccggccggtccgaaagcattatgaagctggaggaacgcacaggggtctcttgggatctgggagtggaggacgcttccgagagcaaactcctgaccgtttctatcatggatctgtcccaaatgtacagcccggtgttcgaatatctctctggcgacagacaggtcgaggaatggcccaaggccacatgcaccggggattgtcctgagcggtgcggatgtacgtccagcacatgcctgcataaggagtggccccactcccgcaattggagatgtaaccctacatggtgctggggcgtgggcaccgggtgtacatgctgtggagttgacgtgaaagatctttttaccgaccatatgttcatcaagtggaaagtcgaatacattaagacggaggccatcgtgtgcgtggaactgacatctcaggagcggcagtgtagcctcattgaagctggcacccgctttaatctggggcccgtcacaatcaccctttccgagcctagaaacattcaacagaaactgccgcccgagatcattaccctccaccctaagatcgaagagggattctttgatctgatgcatgttcagaaggtgctgagcgcctctacagtgtgcaaactccagtcctgcacgcacggcatccccggggacctgcaaatttatcacatcggaaatcttctgaagggcgatcgggtcaacggccatctcattcacaaaatcgaacctcatttcaataccagctggatgtcttgggacgggtgtgatctggactactattgcaacatgggagactggcccagctgtacatacaccggcgtgacacagcacaatcacgctgcctttgttaaccttctgaatattgagaccgattatacgaagacattccattttcactccaaacgcgtgaccgcgcatggggacaccccgcagctcgatctgaaggccagacctacatacggagctggcgaaatcaccgtcctggtggaggttgccgacatggagctccacaccaaaaaggtggaaatctctgggctgaagttcgctagccttacgtgcaccggatgttacgcctgctccagcggcatttcttgtaaagtccggatccatgtggatgagcccgacgaactgacagtccacgtgaagtccagcgatcctgacgttgtggcggcctctacctccctcatggctcgcaaactggagtttggcacagatagcaccttcaaggccttctccgctatgcccaaaacgtctctttgcttttatattgtcgaaagagagtactgtaagagctgctccgaggacgataccaagaaatgtgtggacacaaagctggaacagccccaatctatcctcattgagcacaaagggaccatcatcggaaagcagaacgacacatgcaccgccaaagccagctgctggctggaatccgttaagagcttcttttatggcctgaagaacatgctcgggtctgtgttcggatcctttttcgtcggcattctgctttttctggctcctttcgtgctcctggtgctgtttttcatgtttgggtggaaaatccttttctgttttaagtgctgtcggcgcacgagaggcctcttcaaataccggcatctgaaggatgacgaggagacaggatatagacgcattatcgaacggctgaatagcaaaaagggcaagaacagactcctggatggggagcgccttgcggaccggaaaattgccgaactgttctctaccaagacacacatcgga

SEQ ID NO: 14103 - RNA, 1932 nt, synthetic construct
  misc_feature 1..1932: note = derived and/or modified CDS sequence (opt5) from CCHFV(4495-ST-2008)__KR814869.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtttaagcctaccgttagcacagccaatattgcgctctcctggtctagcgtggagcacagagggaacaaaatcctggtgaccggccggtccgaaagcattatgaagctggaggaacgcacagggatctcttgggatctgggagtcgaggacgcttccgagagcaaactcctgaccgtgtctatcatggatctgtcccaaatgtacagcccggttttcgaatatctctctggcgacagacaggtggaggaatggcccaaggccacatgcaccggggattgtcctgagcggtgcggatgtacgtccagcacatgcctgcataaggagtggccccactcccgcaattggagatgtaaccctacatggtgctggggcgtcggcaccgggtgtacatgctgtggagtggacgttaaagatctttttaccgaccatatgttcgtgaagtggaaagtcgaatacattaagacggaggccatcgtgtgcgtggaactgacatctcaggagcggcagtgtagcctcattgaagctggcacccgctttaatctggggcccgtcacaatcaccctttccgagcctagaaacattcaacagaaactgccgcccgagatcattaccctccaccctaaggttgaagagggattctttgatctgatgcatgtgcagaaggtgctgagcgcctctacagtctgcaaactccagtcctgcacgcacggcatccccggggacctgcaagtgtatcacatcggaaatcttctgaagggcgatcgggttaacggccatctcattcacaaaatcgaacctcatttcaataccagctggatgtcttgggacgggtgtgatctggactactattgcaacatgggagactggcccagctgtacatacaccggcgtgacacagcacaatcacgctgcctttgtcaaccttctgaatattgagaccgattatacgaagacattccattttcactccaaacgcgtgaccgcgcatggggacaccccgcagctcgatctgaaggccagacctacatacggagctggcgaaatcaccgttctggtggaggtcgccgacatggagctccacaccaaaaaggtggaaatttctgggctgaagttcgctagccttgcctgcacgggatgttacgcgtgctccagcggcatctcttgtaaagtccggatccatgtggatgagcccgacgaactgaccgttcacgtgaagtccagcgatcctgacgtcgtggccgcttctacatccctcatggcccgcaaactggagtttggcaccgatagcacattcaaggctttctccgccatgcccaaaacctctctttgcttttatattgttgaaagagagtactgtaagagctgctccgaggaagacacgcagcggtgtgtggataccaagctggagcaaccccagtctatcctcattgaacacaaagggacaatcattggaaagcagaacgatacctgcacagccaaagctagctgctggctggagtccgtcaagagcttcttttatggcctgaaaaacatgctcgggtctgtgttcggaaatttcttcatcggcatcctgctttttctggcgcctttcgtgctcctggttctgtttttcatgtttgggtggaagattcttttctgttttaagtgctgtcgcagagcccggggcctcctgaaatacagacatctgaaggacgacgaggaaaccggatatcgcaaaatcattgagcggctcaacaataagaaaggcaagaacagactgcttgacggggaacgcctggctgatcggaagatcgccgagctcttttccacgaaaacacacattgga

SEQ ID NO: 14104 - RNA, 1932 nt, synthetic construct
  misc_feature 1..1932: note = derived and/or modified CDS sequence (opt5) from CCHFV(4691-ST-2009)__KR814871.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtttaagcctgccgttagcaccgcgaatattgctctctcctggtctagcgtggagcacagagggaacaaaatcctggtgacaggccggtccgaaagcattatgaagctggaggaacgcaccggggtctcttgggatctgggagtggaggacgcctccgagagcaaactcctgacagtttctatcatggatctgtcccaaatgtacagcccggtgttcgaatatctctctggcgacagacaggtcgaggaatggcccaaggctacctgcacaggggattgtcctgagcggtgcggatgtacctccagcacgtgcctgcataaggagtggccccactcccgcaattggagatgtaaccctacctggtgctggggcgtgggcacagggtgtacctgctgtggagttgacgtgaaagatctttttacagaccatatgttcatcaagtggaaagtcgaatacattaagaccgaggccatcgtgtgcgtggaactgacgtctcaggagcggcagtgtagcctcattgaagccggcacacgctttaatctggggcccgtcaccatcacactttccgagcctagaaacattcaacagaaactgccgcccgagatcattaccctccaccctaagatcgaagagggattctttgatctgatgcatgttcagaaggtgctgagcgcttctaccgtgtgcaaactccagtcctgcacacacggcatccccggggacctgcaaatttatcacatcggaaatcttctgaagggcgatcgggtcaacggccatctcattcacaaaatcgaacctcatttcaatacgagctggatgtcttgggacgggtgtgatctggactactattgcaacatgggagactggcccagctgtacctacacaggcgtgacccagcacaatcacgccgcgtttgttaaccttctgaatattgagacagattataccaagacgttccattttcactccaaacgcgtgacagcccatggggacaccccgcagctcgatctgaaggctagacctacctacggagccggcgaaatcacagtcctggtggaggttgctgacatggagctccacaccaaaaaggtggaaatctctgggctgaagttcgccagccttgcgtgcacaggatgttacgcctgctccagcggcatttcttgtaaagtccggatccatgtggatgagcccgacgaactgacggtccacgtgaagtccagcgatcctgacgttgtggctgcctctacctccctcatggctcgcaaactggagtttggcacagatagcaccttcaaggccttctccgccatgcccaaaacatctctttgcttttatattgtcgaaagagagtactgtaagagctgctccgaggacgataccaagaaatgtgtggacacgaagctggaacagccccaatctatcctcattgagcacaaagggaccatcatcggaaagcagaacgacacatgcaccgctaaagcgagctgctggctggaatccgttaagagcttcttttatggcctgaagaacatgctcgggtctgtgttcggaaatttctttgtcggcattctgctttttctggcccctttcgtgctcctggtgctgtttttcatgtttgggtggaaaatccttttctgttttaagtgctgtcggcgcacaagaggcctcttcaaataccggcatctgaaggatgacgaggagaccggatatagacgcattatcgaacggctgaactccaaaaagggcaagaatagactcctggatggggagcgccttgctgaccggaaaattgccgaactgttcagcacgaagacacacatcgga

SEQ ID NO: 14105 - RNA, 1932 nt, synthetic construct
  misc_feature 1..1932: note = derived and/or modified CDS sequence (opt5) from CCHFV(4701-ST-2009)__KR814872.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtttaagcctaccgttagcacagccaatattgcgctctcctggtctagcgtggagcacagagggaacaaaatcctggtgaccggccggtccgaaagcattatgaagctggaggaacgcacaggggtctcttgggatctgggagtggaggacgcttccgagagcaaactcctgaccgtttctatcatggatctgtcccaaatgtacagcccggtgttcgaatatctctctggcgacagacaggtcgaggaatggcccaaggccacatgcaccggggattgtcctgagcggtgcggatgtacgtccagcacatgcctgcataaggagtggccccactcccgcaattggagatgtaaccctacatggtgctggggcgtgggcaccgggtgtacatgctgtggagttgacgtgaaagatctttttaccgaccatatgttcatcaagtggaaagtcgaatacattaagacggaggccatcgtgtgcgtggaactgacatctcaggagcggcagtgtagcctcattgaagctggcacccgctttaatctggggcccgtcacaatcaccctttccgagcctagaaacattcaacagaaactgccgcccgagatcattaccctccaccctaagatcgaagagggattctttgatctgatgcatgttcagaaggtgctgagcgcctctacagtgtgcaaactccagtcctgcacgcacggcatccccggggacctgcaaatttatcacatcggaaatcttctgaagggcgatcgggtcaacggccatctcattcacaaaatcgaacctcatttcaataccagctggatgtcttgggacgggtgtgatctggactactattgcaacatgggagactggcccagctgtacatacaccggcgtgacacagcacaatcacgctgcctttgttaaccttctgaatattgagaccgattatacgaagacattccattttcactccaaacgcgtgaccgcgcatggggacaccccgcagctcgatctgaaggccagacctacatacggagctggcgaaatcaccgtcctggtggaggttgccgacatggagctccacaccaaaaaggtggaaatctctgggctgaagttcgctagccttacgtgcaccggatgttacgcctgctccagcggcatttcttgtaaagtccggatccatgtggatgagcccgacgaactgacagtccacgtgaagtccagcgatcctgacgttgtggcggcctctacctccctcatggctcgcaaactggagtttggcacagatagcaccttcaaggccttctccgctatgcccaaaacgtctctttgcttttatattgtcgaaagagagtactgtaagagctgctccgaggacgataccaagaaatgtgtggacacaaagctggaacagccccaatctatcctcattgagcacaaagggaccatcatcggaaagcagaacgacacatgcaccgccaaagccagctgctggctggaatccgttaagagcttcttttatggcctgaagaacatgctcgggtctgtgttcggaggctttttcgtcgggattctgctttttctggctcctttcgtgctcctggtgctgtttttcatgtttggctggaaaatccttttctgttttaagtgctgtcggcgcacgagaggactcttcaaataccggcatctgaaggatgacgaggagacaggctatagacgcattatcgaacggctcaattccaaaaaggggaagaacagactgctggatggagagcgccttgcggaccggaaaattgccgaactgttcagcaccaagacacacatcggc

SEQ ID NO: 14106 - RNA, 1932 nt, synthetic construct
  misc_feature 1..1932: note = derived and/or modified CDS sequence (opt5) from CCHFV(Oman-199809166)__KR864901.1__Gc
  source 1..1932: mol_type = other RNA
ttcctggacagcatcgccaagggcatgaaaaacctccttaattccacctctcttgagacaagcctgtccattgaagctccctggggagccatcaacgtgcagtctacgtttaagcctaccgtcagcacagcgaatattgctctctcctggtctagcgttgagcacagagggaacaaaatcctggtgtccggccggagcgaatctattatgaagctggaggaacgcaccgggatctcctgggatctgggagtggaggacgccagcgagtctaaactcctgacagtctccgtgatggatctgagccaaatgtactctccggttttcgaatatctctccggcgacagacaggtggaggaatggcccaaggctacctgcacaggggattgtcctgagcggtgcggatgtaccagctccacgtgcctgcataaggagtggccccactctcgcaattggagatgtaaccctacctggtgctggggcgtcggcacagggtgtacctgctgtggacttgacgtgaaagatctgtttacagactacatgttcgttaagtggaaagtggaatatatcaagaccgaggccattgtctgcgtggaactcacgagccaggagcggcagtgttccctgatcgaagccggcacacgctttaatcttgggcccgtgaccattacactgagcgagcctagaaacatccaacagaaactcccgcccgagattgtcaccctgcatcctcggatcgaagagggattctttgatctgatgcacgttcagaaggtgctctctgcttccaccgtgtgcaagctgcagagctgcacacatggcgtccccggggaccttcaagtgtaccacattggaaatctgctcaaaggcgataaggttaacggccacctgatccataaagtggaacctcacttcaatacgtcttggatgagctgggacgggtgtgatcttgactattactgcaacatgggagactggccctcctgtacctatacaggcgtcacccagcataatcacgccgcgtttgtgaacctgctcaatatcgagacagattacaccaagaacttccactttcattctaaacgcgttacggcccacggggacacaccgcagctggatctgaaggctagacctaactacggagccggcgaaattaccgtgctcgtcgaggtggctgacatggagctgcataccaaaaagatcgaaattagcgggcttaagttcgcctccctgacatgcaccggatgttatgcgtgcagctctggcatctcctgtaaagtccggattcacgtggatgagcccgacgaactcacagttcatgtcaagagcgaggatcctgacatcgtggccgcttcttccagcctgatggcccgcaaacttgaatttggcacggattccaccttcaaggctttctctgccatgcccaaaacaagcctgtgcttttacatcgtggagagagagtattgtaagtcctgctctaaggaagacacccagaaatgtgttaatgccaagctcgagcggccccaaagcattctgatcgaacacaaagggacaattatcggaaagcagaacgatacctgcacggctaaagcgtcctgctggctggagagcgtgaagtctttcttttacggcctcaagaatatgctgtccgggattttcggaaacgtctttatcggcatcttcctttttctggcccctttcattctcctgatcctgtttttcatgtttgggtggcgcattcttttctgttttaaatgctgtagacggaccagaggcctcttcaagtatcgccacctgaaagacgacgaggaaacaggataccggaagatcattgagagactgaataacaaaaagggcaagaataaactcctggatggggaacgccttgctgaccggaagatcgccgagctgttcagcaccaaaacacatattgga

SEQ ID NO: 14107 - RNA, 1932 nt, synthetic construct
  misc_feature 1..1932: note = derived and/or modified CDS sequence (opt5) from CCHFV(200406546-Turkey)__KR864902.1__Gc
  source 1..1932: mol_type = other RNA
ttcctggacagcatcgtgaagggcatgaaaaacctccttaattccacctctctggagacaagcctgtccattgaagccccctggggagctatcaacgtccagtctacgtttaagcctaccgttagcacagccaatattgcgctctcctggtctagcatcgagcacagagggaacaaaattctggtgaccggccggtccgaaagcatcatgaaacttgaggaacgcacaggggtgtcttgggatctgggagtcgaggacgcttccgagagcaaactcctgaccgtgtctatcatggatctgtcccaaatgtacagcccggttttcgaatatctctctggcgacagacaggtggaggaatggcccaaggccacatgcaccggggattgtcctgagcggtgcggatgtacgtcctctacctgcctgcataaggagtggccccactcccgcaattggagatgtaaccctacatggtgctggggcgtcggcaccgggtgtacatgctgtggagtggacgttaaagatctttttaccgaccatatgttcgtgaagtggaaagtcgaatacattaagacggaggccatcgtgtgcgtggaactgacatctcaggagcggcagtgtagcctcattgaagctggcacccgctttaatctggggcccgtcacaatcaccctttccgagcctagaaacattcaacagaaactgccgcccgagatcattaccctccaccctaaggttgaagagggattctttgatctgatgcatgtgcagaaggtgctgagcgcctctacagtctgcaaactccagtcctgcacgcacggcatccccggggacctgcaagtgtatcacatcggaaatcttctgaagggcgatcgggttaacggccatctcattcacaaaatcgaacctcatttcaataccagctggatgtcttgggacgggtgtgatctggactactattgcaacatgggagactggcccagctgtacatacaccggcgtgacacagcacaatcacgctgcctttgtcaaccttctgaatattgagaccgattatacgaagacattccattttcactccaaacgcgtgaccgcgcatggggacaccccgcagctcgatctgaaggccagacctacatacggagctggcgaaatcaccgttctggtggaggtcgccgacatggagctccacacaaagaaggtggaaatttctgggctgaagttcgctagccttgcctgcacgggatgttacgcgtgctccagcggcatctcttgtaaagtccggatccatgtggatgagcccgacgaactgaccgttcacgtgaagtccagcgatcctgacgtcgtggccgcttctacatccctcaccgcccgcaaactggagtttggcacagatagcaccttcaaggctttctccgccatgcccaaaacgtctctttgcttttatattgttgaaaaggagtactgtaagagctgcaacgaggacgatacccagaaatgtgtggacacaaagctggaacaaccccagtccatcctcattgagcacaaagggaccatcattggaaagcagaacgacacatgcaccgccaaagctagctgctggctggaaagcgtcaagtccttcttttatggcctgaagaatatgctcgggagcgtgttcggaaactttttcatcggcatcctgctttttctggcgcctttcgtgctcctggttctgtttttcatgtttgggtggaaaattcttttctgttttaagtgctgtagacggacgcgcggcctcttcaaatacagacatctgaaggatgacgaggagacaggatataaacggatcattgaaagactgaataacaagaagggcaaaaatcgcctcctggatggggagcggcttgccgacagaaagatcgctgaactgttctctaccaaaacacacattgga

SEQ ID NO: 14108 - RNA, 1932 nt, synthetic construct
  misc_feature 1..1932: note = derived and/or modified CDS sequence (opt5) from CCHFV(1-CR/HU-2015)__KU161584.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtttaagcctaccgttagcacagccaatattgcgctctcctggtctagcgtggagcacagagggaacaaaatcctggtgaccggccggtccgaaagcattatgaagctggaggaacgcacaggggtctcttgggatctgggagtggaggacgcttccgagagcaaactcctgaccgtttctatcatggatctgtcccaaatgtacagcccggtgttcgaatatctctctggcgacagacaggtcgaggaatggcccaaggccacatgcaccggggattgtcctgagcggtgcggatgtacgtccagcacatgcctgcataaggagtggccccactcccgcaattggagatgtaaccctacatggtgctggggcgtgggcaccgggtgtacatgctgtggagttgacgtgaaagatctttttaccgaccatatgttcgtcaagtggaaagtggaatacatcaagacggaggccattgtgtgcgtcgaactgacatctcaggagcggcagtgtagcctcatcgaagctggcacccgctttaatctggggcccgttacaattaccctttccgagcctagaaacatccaacagaaactgccgcccgagattatcaccctccaccctaagattgaagagggattctttgatctgatgcatgtgcagaaggtgctgagcgcctctacagtctgcaaactccagtcctgcacgcacggcatccccggggacctgcaagtgtatcacatcggaaatcttctgaagggcgatcgggttaacggccatctcattcacaaaatcgaacctcatttcaataccagctggatgtcttgggacgggtgtgatctggactactattgcaacatgggagactggcccagctgtacatacaccggcgtgacacagcacaatcacgctgcctttgtcaaccttctgaatattgagaccgattatacgaagacattccattttcactccaaacgcgtgaccgcgcatggggacaccccgcagctcgatctgaaggccagacctacatacggagctggcgaaatcaccgttctggtggaggtcgccgacatggagctccacaccaaaaaggtggaaatttctgggctgaagttcgctagccttgcctgcacgggatgttacgcgtgctccagcggcatctcttgtaaagtccggatccatgtggatgagcccgacgaactgaccgttcacgtgaagtccagcgatcctgacgtcgtggccgcttctacatccctcatggcccgcaaactggagtttggcaccgatagcacattcaaggctttctccgccatgcccaaaacctctctttgcttttatattgttgaaagagagtactgtaagagctgctccgaggacgatacgaagaaatgtgtggacaccaagctggaacagccccaatctatcctcattgagcacaaagggacaatcattggaaagcagaacgatacctgcacagccaaagctagctgctggctggaatccgtcaagagcttcttttatggcctgaagaacatgctcgggtctgtgttcggaaactttttcatcggcatcctgctttttctggcgcctttcgtgctcctggttctgtttttcatgtttgggtggaaaattcttttctgttttaagtgctgtcggcgcaccagaggcctcttcaaataccggcatctgaaggacgacgaggagacgggatatagacgcatcattgaacggctgaataataaaaagggcaagaacagactcctggatggggagcgccttgccgaccggaaaatcgctgaactgttctccacaaagacccacattgga

SEQ ID NO: 14109 - RNA, 1932 nt, synthetic construct
  misc_feature 1..1932: note = derived and/or modified CDS sequence (opt5) from CCHFV(Gaib)__KX013445.1__Gc
  source 1..1932: mol_type = other RNA
ttcagcgactccatcgtgaagggcatgaaaaacctgctcaattctaccagcctggagacatccctttctattgaagccccctggggagctatcaacgtccagagcacgtttaagcctaccgtttccacagccaatattgcgctgtcttggagctccatcgagcacagagggaacaaaattctcgtgagcggccggtctgaatccatcatgaagctggaggaacgcaccgggatcagctgggatcttggagtggaggacgcttctgagtccagactgctcacagtcagcgtgatggatctgtctcaaatgtactccccggttttcgaatatctgagcggcgacagacaggtggaggaatggcccaaagctacctgcacaggggattgtcctgagcgctgcggatgtacctcctctacgtgcctccataaggagtggccccacagcagaaattggcggtgtaaccctacctggtgctggggcgtcggcacagggtgtacctgctgtggactggacgtgaaggatctttttacagactacatgttcgttaaatggaaggtggaatatattaaaaccgaggccatcgtctgcgtggaactgacgtcccaggagcgccagtgtagcctcattgaagccggcacaagatttaatctggggcccgtgaccatcacactttctgagcctcggaacattcaacagaagctgccgcccgagatcattaccctccatcctcgcatcgaagagggattctttgatctgatgcacgtccagaaagttctgtccgccagcaccgtgtgcaagctccagtcttgcacacatggcgtgcccggggacctgcaagtctaccacatcggaaatcttctgaagggcgataaagtgaacggccacctcattcataagatcgaacctcacttcaatacgagctggatgtcctgggacgggtgtgatctggactattactgcaacatgggagactggccctcttgtacctatacaggcgttacccagcataatcacgctgcctttgtgaaccttctgaatattgagacagattacaccaaaaacttccactttcatagcaagagagtcacggcgcacggggacacaccgcagctcgatctgaaagcccggcctacctacggagctggcgaaatcaccgtgctggttgaggtggccgacatggagctccatacaaagaaaattgaaatctccgggctgaagttcgctagccttacctgcacaggatgttatgcctgttcttccggcatcagctgcaaggtccgcattcacgtggatgagcccgacgaactgacggtccatgtgaaatctgaggatcctgacatcgttgcggcctccagctccctcatggctagaaagctggaatttggcaccgattctacattcaaagccttcagcgctatgcccaagacctccctttgcttttacattgtggagcgggagtattgtaaatcttgcagccgcgaagacacacagaagtgtgtctccaccaagctggagcaaccccagagcatcctcattgaacacaaagggacgatcatcggaaagcagaacaatacctgcacaaccaaaacaacctgctggctggagtctgtgaagtccttcttttacggcctgaaaaacatgctcagctctattttcgggaatgtttttgtgggaatcttctcctttctggcccctttcattcttctgatcctctttttcatgtttggctggcggattctgttctgttttaagtgctgtcggagaacgcgcgggctgttcaagtatcggcaccttaaagatgacgaggaaacaggctacagacgcatcattgagcggctcaacaataagaaaggaaagagcaaactgctggacggcgaaagactcgccgatcgcaagatcgctgagctgttctctaccaagacacatatcggg

SEQ ID NO: 14110 - RNA, 1932 nt, synthetic construct
  misc_feature 1..1932: note = derived and/or modified CDS sequence (opt5) from CCHFV(Hodzha)__KX013448.1__Gc
  source 1..1932: mol_type = other RNA
ttcctggacagcatcgtgaagggcaaaaagaacctccttaattccacctctcttgagacaagcctgtccattgaagccccctggggagctatcaacgtccagtctacgtacaaacctaccgttagcacagccaatattgcgctctcctggtctagcgtggagcacagagggaacaagatcctggtgtccggccggagcgaatctattatgaaacttgaggaacgcaccgggatctcctgggatctgggagtcgaggacgctagcgagtctaagctcctgacagtgtccgttatggatctgagccaaatgtattctccggtgtttgaatacctctccggcgacagacaggtcgaggaatggcccaaggctacctgcacaggggattgtagcgagcggtgcggatgtacctcctctacgtgcctgcataaagagtggcctcacagccgcaattggagatgtaaccccacctggtgctggggcgtgggcacagggtgtacctgctgtggacttgacgttaaggatctgttcacagactatatgtttgtgaaatggaaggtcgattacatcaaaaccgaagccattgtgtgcgtggagctcacgtcccaggaacggcagtgtagcctggtcgaggctggcacacgcttcaatcttgggcctgttaccatcacactgtctgaacccagaaacattcaacagaagctccctccggagatcattaccctgcatccccggatcgaggaaggatttttcgacctgatgcacgtgcagaaggtgctctccgccagcaccgtctgcaaactgcagtcttgcacacatggcgtgcctggggatcttcaagtttatcacattggaaatctgctcaagggcgacaaagtgaacggccacctgatccataagatcgagccccactttaatacgagctggatgtcctgggatgggtgtgaccttgactactattgcaacatgggagattggccttcttgtacctacacaggcgtcacccagcataatcacgctagcttcgtgaacctgctcaatattgaaacagactacaccaaatcctttcacttccatagcaagcgcgttacggcccacggggatacaccccagctggacctgaaagcgagaccgacctatggagccggcgagatcaccgtgctcgtcgaagtggctgatatggagctgcatacaaagaagattgagatcaccgggcttaaatttgcctctctgacatgcacgggatgttacgcttgctccagcggcatttcttgtaaggtccggatccacgtggacgaacctgatgagctcaccgttcatgtgaaatccgacgatcccgacgtcgtggccgcgagctcctctctgatggcccgcaagctggaatttggcacagatagcacctttaaagccttctccgccatgcctaagacatctctgtgcttctatatcgttgagagagaatactgtaagagctgctccaaagaggacacccagaagtgtgtgaacacgaaactcgagcaaccccagagcattctgatcgaacagaaggggaccattatcggaaaacaaaacaatacatgcaccgctaaggcctcttgctggctggagtccgtcaagagctttttctatggcctcaaaaacatgctgtctgggatttttggaaatgtgttcgtgggcatctttcttttcctggccccctttatcctcctgattctgttctttatgttcgggtggcggatccttttctgtttcaagtgctgtcgcagaacacggggcctctttaaatacaagcacctgaaagacgatgaagagaccggatatagacgcattatcgagcggctgaacaataagaagggcaaaaacaagctcctggacggggaaagacttgctgatcgccggattgcggagctgttctccacgaaaacacacatcgga

SEQ ID NO: 14111 - RNA, 1932 nt, synthetic construct
  misc_feature 1..1932: note = derived and/or modified CDS sequence (opt5) from CCHFV(IbAn7620)__KX013451.1__Gc
  source 1..1932: mol_type = other RNA
ttcctggacagcatcgccaagggcatgaaaaaccccctcaattccacctctctggagacaagcctttccattgaagctccttggggagccatcgatgtgcagtctacgtacaagccgaccgtcagcacagcgaacattgctctgtcctggtctagcgttgagcacagagggaataaaatcctcgtgtccggccggagcgaatctattatgaagctggaggaacgcaccgggatctcctgggaccttggagtggaggatgccagcgagtctaaactgctcacagtctccgtgatggacctgagccaaatgtattctcccgtttttgaatacctgtccggcgatagacaggtggaggaatggcctaaggctacctgcacaggggactgtcccgagcggtgcggatgtaccagctccacgtgcctccataaggagtggcctcactctcgcaactggagatgtaatcccacctggtgctggggcgtcggcacagggtgtacctgctgtggactggatgtgaaagaccttttcacagattatatgtttgttaagtggaaagtggaatacatcaagaccgaggccattgtctgcgtggaactgacgagccaggagcggcagtgttccctcatcgaagccggcacacgcttcaacctggggcctgtgaccattacacttagcgagccgagaaatatccaacagaaactgccccctgagattatcaccctccatccccggattgaagagggatttttcgacctgatgcacgtccagaaggttctgtctgcttccaccgtgtgcaagctccagagctgcacacatggcgtgcctggggatctgcaagtctatcacatcggaaaccttctgaaaggcgacaaggtgaatggccacctcatccataaaattgaaccccactttaacacgtcttggatgagctgggatgggtgtgacctggactactattgcaatatgggagattggccgtcctgtacctacacaggcgttacccagcataaccacgcctctttcgtgaatcttctgaacatcgagacagactacaccaagaattttcacttccatagcaaacgcgtcacggcgcacggggatacacctcagctcgacctgaaggccagacccacctatggagctggcgaaattaccgtgctggttgaggtggccaacatggagctccataccaaaaagatcgaaatttccgggctgaagtttgctagccttacctgcacaggatgttacgcctgttcttccggcatcagctgcaaagtccggatccacgtggatgagcctgacgaactgacggtccatgtgaagtctgatgaccccgatgttgtggcggcctccagctccctcatggctcgcaaactggagttcggcaccgactctacatttaaggccttcagcgctatgcccaaaacctccctttgcttctatattgtcgaaagagagcactgtaagtcttgcagcgaggaagatacaaagaaatgtgtgaacaccaagctggagcagcctcaatccatcctcattgaacacaaagggacgatcattggaaagcagaatagcacatgcacagccaaagcctcttgctggctggagtccgttaagagctttttctacggcctgaagaacatgctctctgggatctttggaaatgtgttcatgggcatctttctgttccttgctccgtttattctgctcatcctgttctttatgttcgggtggcggattctgttttgtttcaaatgctgtcgcagaacccggggcctttttaagtatagacatctcaaagacgacgaggaaacaggataccgccggatcattgagagactgaacaataagaaaggcaagaacaagctgctcgatggggaacgcctggcggaccggagaatcgccgagcttttctccaccaaaacgcacattgga

SEQ ID NO: 14112 - RNA, 1932 nt, synthetic construct
  misc_feature 1..1932: note = derived and/or modified CDS sequence (opt5) from CCHFV(K128_76)__KX013454.1__Gc
  source 1..1932: mol_type = other RNA
ttccaggacagcatcgtgaagggcatgaaaaacctgctcaattccacctctctggagacaagcctttccattgaagccccctggggagctatcaacgtccaatctacgtacaagcctgccgttagcgcggctaatattgccctgtcctggtctagcgtggagcacagagggtccaaaatcctcgtgagcggccggtctgaatccattatgaagctggaggaacgcaccgggatcagctgggatcttggagtcgaggacgcctctgagtccaaactgctcacagtgagcgttatggatctgtctcagatgtattccccggtgtttgaatacctgagcggcgacagacaggtcgaggaatggcccaaggctacctgcacaggggattgtcctgagcggtgcggatgtacctcctctacatgcctccataaggagtggccccacagccgcaactggagatgtaatcctacctggtgctggggcgtgggcacggggtgtacctgctgtggactggacgttaaagatcttttcacagactatatgtttgtgaagtggaaagtcgaatacatcaagaccgaggccattgtgtgcgtggaactgacatcccaggagcggcaatgtagcctcatcgaagctggcacccgcttcaacctggggcccgtcacgattacactttctgagcctagaaatatccagcagaaactgccgcccgagattatcaccctccatcctcggattgaagagggatttttcgatctgatgcacgttcagaaggtgctgtccgccagcacagtgtgcaagctccaatcttgcacccatggcgtccccggggaccttcaggtgtatcacatcggaaacctgctgaaaggcgatcgcgttaatggccacctcatccataagattgaacctcactttaacaccagctggatgtcctgggacgggtgtgatctggactactattgcaatatgggagactggccctcttgtacatacacgggcgtgacccagcataaccacgcgagcttcgtcaatcttctgaacatcgagacagattacaccaaatcctttcacttccatagcaagagagtgacagcccacggggacaccccgcagctcgatctgaaagctcggcctaattatggagccggcgaaattacggttctggtggaggtcgctgacatggagctccatacaaagaaaatcgaaatttctgggctgaagtttgcctcccttacctgcaccggatgttacgcgtgcagctctggcatctcctgtaaggtgcgcatccacgtcgatgagcccgacgaactgacagtgcatgttaaaagcgatgaccctgatgtggtcgccgcttcctctagcctcatggccagaaagctggagttcggcaccgactccacatttaaggctttctctgccatgcccaaaacgagcctttgcttctatattgtggaacgggagtactgtaaatcctgcagcaaggaggatacccaaaagtgtgttaacacaaaactggaacagccccagtctatcctcattgagcacaaggggaccatcattggaaaacaaaacaatacatgcaccgccaagacgtcctgctggctggaaagcgtgaaatcctttttctatggcctgaagaacatgctctctgggatctttggaaatgtcttcgtgggcatctttctgttccttgctccttttattctgctcatcctgttctttatgttcgggtggcgcattctgttttgtttcaagtgctgtagacggaccagaggcctttttcgctacaaacacctcgagaacgacgaggaaacaggatatcggagaatcattgagcgcctgaataacaagaaaggcaagaataaactgctcgacggggaacggctggcggatagacgcatcgccgagcttttcagcaccaagacacatattgga

SEQ ID NO: 14113 - RNA, 1932 nt, synthetic construct
  misc_feature 1..1932: note = derived and/or modified CDS sequence (opt5) from CCHFV(K168_40)__KX013457.1__Gc
  source 1..1932: mol_type = other RNA
ttcctggacggcatcgtgaaggggatgaaaaacctcctgaatagcacctcccttgagacatctctgagcattgaagccccctggggagctatcaacgtccagtccacgtacaagcctaccgtttctgccgcgaatattgctctcagctggtcctctgtggagcacagaggcaacaaaatcctggtgagcgggcggtccgaaagcattatgaaacttgaggaacgcacaggaatctcttgggatctgggcgtcgaggacgcctccgagagcaagctcctgaccgtgtctgttatggatctgtcccaaatgtatagcccggtgtttgaatacctctctggggacagacaggtcgaggaatggcccaaggccacatgcaccggagattgtcctgagcggtgcggctgtacatcctctacctgcctgcataaggagtggccccactcccgcaattggagatgtaaccctacgtggtgctggggcgtggggaccggatgtacatgctgtggccttgacgttaaagatctgttcaccgactatatgtttgtgaagtggaaagtcgaatacatcaagacagaggctattgtgtgcgtggaactcacctctcaggagcggcagtgtagcctgatcgaagccgggacgcgcttcaatcttggacccgtcacaattaccctgtccgagcctagaaacatccaacagaaactcccgcccgagattatcacactgcatcctcggattgaagagggctttttcgatctgatgcacgttcagaaggtgctcagcgcttctaccgtgtgcaagctgcagtcctgcacccatggggtccccggagaccttcaagtgtatcacatcggcaatctgctcaaaggcgataaggttaacgggcacctgatccataaaattgaacctcactttaatacaagctggatgtcttgggacggatgtgatcttgactactattgcaacatgggcgactggcccagctgtacgtacaccggggtgacacagcataatcacgcctccttcatcaacctgctcaatattgagaccgattacacaaagtcttttcacttccatagcaaacgcgtcaccgcgcacggagacacgccgcagctggatctgaaggccagacctaactatggcgctggggaaatcacagtgctcgttgaggtggccgacatggagctgcataccaaaaagattgaaatctccggacttaagtttgctagcctgacctgcacaggctgttacgcctgcagctccggcatcagctgtaaagtccggattcacgtggatgagcccgacgaactcaccgtccatgtgaagtctgatgaccctgatgttgtggcggcctccagctccctgatggctcgcaaacttgagttcgggacagactctacgtttaaggccttcagcgctatgcccaaaacctccctgtgcttctatatcgtcgaaagagagtactgtaagtcttgcagcaaggaggatacacagaaatgtgtgaacaccaagctcgaacacccccaatccattctgatcgagcacaaaggaacaattatcggcaagcagaataatacctgcacggccaaaaccagctgctggctggaatctgttaagtcctttttctatgggctcaagaacatgctgagcggaatctttggcaacgtgttcgtcgggatttttcttttcctggccccttttatcctcctgattctgttctttatgttcggctggcggatcctcttttgtttcaaatgctgtcgcagaacacggggactttttagatacaagcatctggaggacgacgaggaaaccggctatcgccggattatcgagagactgaataacaaaaaggggaaaaataagctcctggatggagaacgccttgctgaccggagaattgcggagctgttctctacaaagacccacatcggc

SEQ ID NO: 14114 - RNA, 1932 nt, synthetic construct
  misc_feature 1..1932: note = derived and/or modified CDS sequence (opt5) from CCHFV(K168_125)__KX013460.1__Gc
  source 1..1932: mol_type = other RNA
ttcctggacagcatcgtgaagggcaaaaagaacctccttaattccacctctcttgagacaagcctgtccattgaagccccctggggagctatcaacgtccagtctacgtacaaacctaccgttagcgccgcgaatattgctctctcctggtctagcgtggagcacagagggaacaagatcctggtgtccggccggagcgaatctattatgaaacttgaggaacgcacagggatctcctgggatctgggagtcgaggacgccagcgagtctaagctcctgaccgtgtccgttatggatctgagccaaatgtattctccggtgtttgaatacctctccggcgacagacaggtcgaggaatggcccaaggccacatgcaccggggattgtcctgagcggtgcggatgtacaagctctacctgcctgcataaagagtggccccactcccgcaattggagatgtaaccctacgtggtgctggggcgtgggcaccgggtgtacatgctgtggacttgacgttaaggatctgttcaccgactatatgtttgtgaaatggaaggtcgaatacatcaaaacagaggctattgtgtgcgtggaactcaccagccaggagcggcagtgttccctgatcgaagccggcacgcgcttcaatcttgggcccgtcacaattaccctgagcgagcctagaaacatccaacagaagctcccgcccgagattatcacactgcatcctcggattgaagagggatttttcgatctgatgcacgttcagaaggtgctctctgcttccaccgtgtgcaaactgcagagctgcacccatggcgtccccggggaccttcaagtgtatcacatcggaaatctgctcaagggcgataaagttaacggccacctgatccataagattgaacctcactttaatacatcttggatgagctgggacgggtgtgatcttgactactattgcaacatgggagactggccctcctgtacgtacaccggcgtgacacagcataatcacgcctctttcatcaacctgctcaatattgagaccgattacacaaagagctttcacttccattccaagcgcgtcaccgcgcacggggacacgccgcagctggatctgaaagccagacctaactatggagctggcgaaatcacagtgctcgttgaggtggccgacatggagctgcataccaagaagattgaaatcagcgggcttaaatttgcttctctgacctgcacaggatgttacgcctgctccagcggcatctcttgtaaggtccggattcacgtggatgagcccgacgaactcaccgtccatgtgaaatccgatgaccctgatgttgtggcggccagctcctctctgatggctcgcaaacttgagttcggcacagacagcacgtttaaagccttctccgctatgcccaagacctctctgtgcttctatatcgtcgaaagagagtactgtaagagctgctccaaagaggatacacagaagtgtgtgaacaccaaactcgaacacccccaaagcattctgatcgagcacaaggggacaattatcggaaaacagaataatacctgcacggccaagacctcttgctggctggaatccgttaagagctttttctatggcctcaaaaacatgctgtctgggatctttggaaacgtgttcgtcggcatttttcttttcctggccccttttatcctcctgattctgttctttatgttcgggtggcggatcctgttttgtttcaagtgctgtcgcagaacacggggcctctttagatacaaacatctggaggacgacgaggaaaccggatatcgccggattatcgagagactgaataacaagaaaggcaagaataagctcctggatggggaacgccttgctgaccggagaattgcggagctgttctccacaaaaacccacatcgga

SEQ ID NO: 14115 - RNA, 1932 nt, synthetic construct
  misc_feature 1..1932: note = derived and/or modified CDS sequence (opt5) from CCHFV(K229_194)__KX013463.1__Gc
  source 1..1932: mol_type = other RNA
ttcctggacagcatcgtgaagggcaaaaagaacctccttaattccacctctcttgagacaagcctgtccattgaagccccctggggagctatcaacgtccagtctacgtttaaacctaccgttagcacagccaatattgcgctctcctggtctagcgtggagcacagagggaacaagatcctggtgaccggccggtccgaaagcattatgaaacttgaggaacgcacaggggtctcttgggatctgggagtggaggacgcttccgagagcaagctcctgaccgtttctatcatggatctgtcccaaatgtacagcccggtgttcgaatatctctctggcgacagacaggtcgaggaatggcccaaggccacatgcaccggggattgtcctgagcggtgcggatgtacgtccagcacatgcctgcataaagagtggccccactcccgcaattggagatgtaaccctacctggtgctggggcgtgggcaccgggtgtacatgctgtggagttgacgtgaaggatctttttaccgaccatatgttcatcaaatggaaggtcgaatacattaaaacggaggccatcgtgtgcgtggaactgacatctcaggagcggcagtgtagcctcattgaagctggcacccgctttaatctggggcccgtcacaatcaccctttccgagcctagaaacattcaacagaagctgccgcccgagatcattaccctccaccctaagatcgaagagggattctttgatctgatgcatgttcagaaagtgctgagcgcctctacagtgtgcaagctccagtcctgcacgcacggcatccccggggacctgcaaatttatcacatcggaaatcttctgaaaggcgatcggctcaacggccatctgattcacaagatcgaacctcatttcaataccagctggatgtcttgggacgggtgtgatcttgactactattgcaacatgggagactggcccagctgtacatacaccggcgtcacacagcacaatcacgctgcctttgtgaacctgctcaatattgagaccgattatacgaaaacattccattttcactccaagcgcgttaccgcgcatggggacaccccgcagctggatctgaaagccagacctacatacggagctggcgaaatcaccgtgctcgtcgaggtggccgacatggagctgcacacaaagaaggttgaaatctctgggcttaaattcgctagcctggcctgcacgggatgttactcctgcagctctggcatttcctgtaaggtgcggatccatgtcgatgagcccgacgaactcaccgtgcacgtcaaaagctctgatcctgacgtggttgcggcctccacaagcctgatggctcgcaaacttgagtttggcaccgattccacattcaaggccttctctgctatgcccaagaccagcctgtgcttttatattgtggaaagagagtactgtaagtcctgctctgaggacgatacgaaaaagtgtgtcgacaccaaactcgaacagccccaaagcatcctgattgagcacaaggggacaatcatcggaaaacagaacgatacctgcacagccaaggcctcctgctggctggaaagcgtgaagtctttcttttatggcctcaaaaacatgctggggtccgttttcggaaactttttcgtgggcattcttctgtttctcgctcctttcgtcctgctggtgctgtttttcatgtttgggtggaagatcctcttctgttttaaatgctgtcggcgcaccagaggcctgttcaagtaccggcatctgaaagacgacgaggagacgggatatagaaagattatcgaacgcctcaatagcaagaaaggcaagaatcggctgcttgatggggagagactggcggaccgcaaaattgccgaactcttctctacaaagacccacatcgga

SEQ ID NO: 14116 - RNA, 1932 nt, synthetic construct
  misc_feature 1..1932: note = derived and/or modified CDS sequence (opt5) from CCHFV(K229_243)__KX013466.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtttaagcctaccgttagcacagccaatattgcgctctcctggtctagcgtggagcacagagggaacaaaatcctggtgaccggccggtccgaaagcattatgaagctggaggaacgcacaggggtctcttgggatctgggagtggaggacgcttccgagagcaaactcctgaccgtttctatcatggatctgtcccaaatgtacagcccggtgttcgaatatctctctggcgacagacaggtcgaggaatggcccaaggccacatgcaccggggattgtcctgagcggtgcggatgtacgtccagcacatgcctgcataaggagtggccccactcccgcaattggagatgtaaccctacatggtgctggggcgtgggcaccgggtgtacatgctgtggagttgacgtgaaagatctttttaccgaccatatgttcgtcaagtggaaagtggaatacatcaagacggaggccattgtgtgcgtcgaactgacatctcaggagcggcagtgtagcctcatcgaagctggcacccgctttaatctggggcccgttacaattaccctttccgagcctagaaacatccaacagaaactgccgcccgagattatcaccctccaccctaaggtggaagagggattctttgatctgatgcatgtgcagaaggtcctgagcgcctctacagtgtgcaaactccagtcctgcacgcacggcattcccggggacctgcaagtttatcacatcggaaatcttctgaagggcgatcgggtgaacggccatctcatccacaaaattgaacctcatttcaataccagctggatgtcttgggacgggtgtgatctggactactattgcaacatgggagactggcccagctgtacatacaccggcgtcacacagcacaatcacgctgcctttgtgaaccttctgaatatcgagaccgattatacgaagacattccattttcactccaaacgcgttaccgcgcatggggacaccccgcagctcgatctgaaggccagacctacatacggagctggcgaaattaccgtgctggtcgaggtggccgacatggagctccacaccaaaaaggtcgaaatctctgggctgaagttcgctagccttgcctgcacgggatgttacgcgtgctccagcggcatttcttgtaaagtgcggatccatgttgatgagcccgacgaactgaccgtgcacgtcaagtccagcgatcctgacgtggttgccgcttctacatccctcatggcccgcaaactggagtttggcaccgatagcacattcaaggctttctccgccatgcccaaaacctctctttgcttttatatcgtggaaaaggagtactgtaagagctgctccgaggaagacacgcagaaatgtgtcgataccaagctggagcaaccccagtctattctcatcgaacacaaagggacaattatcggaaagcagaacgatacctgcacagccaaagctagctgctggctggagtccgttaagagcttcttttatggcctgaagaacatgctcgggtctgtgttcggaaatttcttcattggcatcctgctttttctgacccctttcgtgctcctggtcctgtttttcatgtttgggtggaaaatccttttctgttttaagtgctgtagacggacgcgcggcctcctgaaatacagacatctgaaggacgacgaggaaacaggatatcggagaattatcgagcgcctcaacaataaaaagggcaagaaccggctgcttgacggggaaagactggcggatcgcaaaattgccgagctcttttccaccaagacacacatcgga

SEQ ID NO: 14117 - RNA, 1932 nt, synthetic construct
  misc_feature 1..1932: note = derived and/or modified CDS sequence (opt5) from CCHFV(K315_14)__KX013469.1__Gc
  source 1..1932: mol_type = other RNA
ttcctggacagcatcgtgaagggcatgaaaaagctcctgaactccacctctcttgagacaagcctgtccattgaagccccctggggagctatcaatgtccagtctacgtttaaacctaccgttagcacagccaacattgcgctctcctggtctagcgtggagcacagagggaataagatcctggtgaccggccggtccgaaagcattatgaaacttgaggaacgcacaggggtctcttgggatctgggagtggaggacgcttccgagagcaagctcctgaccgtttctatcatggatctgtcccaaatgtacagcccggtgttcgaatatctctctggcgacagacaggtcgaggaatggcccaaggccacatgcaccggggattgtcctgagcggtgcggatgtacgtccagcacatgcctgcataaagagtggccccactcccgcaactggagatgtaatcctacctggtgctggggcgtgggcaccgggtgtacatgctgtggagttgacgtgaaggatctttttaccgaccatatgttcatcaaatggaaggtcgaatacattaaaacggaggccatcgtgtgcgtggaactgacatctcaggagcggcagtgtagcctcattgaagctggcacccgctttaacctggggcccgtcacaatcaccctttccgagcctagaaatattcaacagaagctgccgcccgagatcattaccctccaccctaagatcgaagagggattctttgatctgatgcatgttcagaaagtgctgagcgcctctacagtgtgcaagctccagtcctgcacgcacggcatccccggggacctgcaaatttatcacatcggaaaccttctgaaaggcgatcgggtcaatggccatctcattcacaagatcgaacctcatttcaacaccagctggatgtcttgggacgggtgtgatctggactactattgcaatatgggagactggcccagctgtacatacaccggcgtgacacagcacaaccacgctgcctttgttaatcttctgaacattgagaccgattatacgaaaacattccattttcactccaagcgcgtgaccgcgcatggggacaccccgcagctcgatctgaaagccagacctacatacggagctggcgaaatcaccgtcctggtggaggttgccgacatggagctccacacaaagaaggtggaaatctctgggctgaaattcgctagccttacgtgcaccggatgttacgcctgctccagcggcatttcttgtaaggtccggatccatgtggatgagcccgacgaactgacagtccacgtgaaatccagcgatcctgacgttgtggcggcctctacctccctcatggctcgcaagctggagtttggcacagatagcaccttcaaagccttctccgctatgcccaagacgtctctttgcttttatattgtcgaaagagagtactgtaagagctgctccgaggacgataccaaaaagtgtgtggacacaaaactggaacagccccaatctatcctcattgagcacaaggggaccatcatcggaaaacagaatgacacatgcaccgccaaggccagctgctggctggaatccgttaagagcttcttttatggcctgaaaaacatgctcgggtctgtgttcggatcctttttcgtcggcattctgctttttctggctcctttcgtgctcctggtgctgtttttcatgtttgggtggaagatccttttctgttttaaatgctgtcggcgcacgagaggcctcttcaagtaccggcatctgaaagatgacgaggagacaggatatagacgcattatcgaacggctgaacagcaagaagggcaaaaatagactcctggatggggagcgccttgcggaccggaagattgccgaactgttctctaccaaaacacacatcgga

SEQ ID NO: 14118 - RNA, 1932 nt, synthetic construct
  misc_feature 1..1932: note = derived and/or modified CDS sequence (opt5) from CCHFV(K323_27)__KX013472.1__Gc
  source 1..1932: mol_type = other RNA
ttcctggacagcatcgccaagggcatgaaaaacctccttaattccacctctctggagacaagcctgtccattgaagctccctggggagccatcaacgtgcagtctacgtttaagcctaccgtcagcacagcgaatattgctctctcctggtctagcgttgagcacagagggaacaaaatcctggtgaccggccggtccgaaagcattatgaaacttgaggaacgcacaggggtgtcttgggatctgggagtcgaggacgcctccgagagcaaactcctgaccgtgtctatcatggatctgtcccaaatgtacagcccggttttcgaatatctctctggcgacagacaggtggaggaatggcccaaggccacatgcaccggggattgtcctgagcggtgcggatgtacgtcctctacctgcctgcataaggagtggccccactcccgcaattggagatgtaaccctacatggtgctggggcgtcggcaccgggtgtacatgctgtggagtggacgttaaagatctttttaccgaccatatgttcatcaagtggaaagtggaatacattaagacggaggctatcgtctgcgtggaactgacaggccaggagcggcagtgttctctcattgaagccgggacccgctttaatctgggacccgtgacaatcacccttagcgagcctagaaacattcaacagaaactgccgcccgagatcattaccctccaccctaagatcgaagagggcttctttgatctgatgcatgtccagaaggttctgtccgctagcacagtgtgcaaactccagtcttgcacgcacgggatccccggagacctgcaaatttatcacatcggcaatcttctgaagggcgatcgggtgaacgggcatctcattcacaaaatcgaacctcatttcaatacctcctggatgagctgggacggatgtgatctggactactattgcaacatgggcgactggccctcttgtacatacaccggggtcacacagcacaatcacgccgcgtttgtgaaccttctgaatattgagaccgattatacgaagacattccattttcacagcaaacgcgttaccgcccatggagacaccccgcagctcgatctgaaggctagacctacatacggcgccggggaaatcaccgtgctggtcgaggtggctgacatggagctccacacgaaaaaggttgaaatctccggactgaagttcgcctctcttacatgcaccggctgttacgcgtgcagctccggcattagctgtaaagtgcggatccatgtcgatgagcccgacgaactgacagtgcacgtcaagtcttccgatcctgacgtggttgccgctagcacctctctcatggcccgcaaactggagtttgggacagattccaccttcaaggctttcagcgccatgcccaaaacgtccctttgcttttatattgtggaaagagagtactgtaagtcttgcagcgaggacgataccaagaaatgtgtcgacacaaagctggaacagccccaatccatcctcattgagcacaaaggaaccatcatcggcaagcagaacgacacatgcaccgccaaggcttcttgctggctggaaagcgtgaagtccttcttttatgggctgaagaacatgctcggaagcgttttcggcagctttttcgtggggattctgctttttctggcgcctttcgtcctcctggtgctgtttttcatgtttggctggaaaatccttttctgttttaagtgctgtcggcgcacgagaggactcttcaaataccggcatctgaatgatgacgaggagacaggctatagacgcattatcgaacggctgaactccaagaaagggaagaatagactcctggatggagagcgccttgccgaccggaagattgctgaactgttcagcaccaaaacacacatcggc

SEQ ID NO: 14119 - RNA, 1932 nt, synthetic construct
  misc_feature 1..1932: note = derived and/or modified CDS sequence (opt5) from CCHFV(K340_6)__KX013475.1__Gc
  source 1..1932: mol_type = other RNA
agcctggactccatcgtgaagggcatgaaaaacctccttaattctaccagccttgagacatccctgtctattgaagccccctggggagctatcaacgtccagagcacgttcaagcctaccgtttccacagccaatattgcgctctcttggagctccgtggagcacagaggaaacaaaatcctggtgaccggccggagcgaatctattatgaagctggaggaacgcacaggggtctcctgggatctgggagtggaggacgctagcgagtctaaactcctgaccgtttccatcatggatctgagccaaatgtactctccggtgtttgaatatctctccggcgacagacaggtcgaggaatggcccaaggccacatgcaccggggattgtcctgagcggtgcggatgtacgagctctacctgcctgcataaggagtggccccactctcgcaattggagatgtaaccctacatggtgctggggcgtgggcaccgggtgtacatgctgtggagttgacgtgaaagatcttttcaccgaccatatgtttatcaagtggaaagtcgaatacattaagacggaggccatcgtgtgcgtggaactgacaagccaggagcggcagtgttccctcattgaagctggcacccgcttcaatctggggcccgtcacaatcacccttagcgagcctagaaacattcaacagaaactgccgcccgagatcattaccctccaccctaagatcgaagagggatttttcgatctgatgcatgttcagaaggtgctgtctgcctccacagtgtgcaaactccagagctgcacgcacggcatccccggggacctgcaaatttatcacatcggaaatcttctgaagggcgatcgggtcaacggccatctcattcacaaaatcgaacctcattttaatacctcttggatgagctgggacgggtgtgatctggactactattgcaacatgggagactggccctcctgtacatacaccggcgtgacacagcacaatcacgctgccttcgttaaccttctgaatattgagaccgattatacgaagacatttcatttccactctaaacgcgtgaccgcgcatggggacaccccgcagctcgatctgaaggccagacctacatacggagctggcgaaatcaccgtcctggtggaggttacagacatggagctccacacgaaaaaggtggaaatcagcgggctgaagtttgcctcccttacctgcacaggatgttacgcttgcagctctggcatttcctgtaaagtccggatccatgtggatgagcccgacgaactgaccgtccacgttaagagctctgatcctgacgtggtggccgcgtccacaagcctcatggcccgcaaactggagttcggcaccgattccacgtttaaggctttctctgccatgcccaaaaccagcctttgcttctatattgtcgaaagagagtactgtaagtcctgctctgaggacgatacaaagaaatgtgtggacaccaagctggaacagccccaaagcatcctcattgagcacaaagggacaatcatcggaaagcagaacgatacctgcacggctaaagcctcctgctggctggaaagcgttaagtcctttttctatggcctgaagaacatgctcgggtccgtgtttgggagcttctttgtcggcattctgcttttcctggccccttttgtgctcctggtgctgttctttatgttcgggtggaaaatcctgttttgtttcaagtgctgtcggcgcacaagaggcctctttaaataccggcatttcaaggacgacgaggagaccggatatagacgcattatcgaacggcttaattctaaaaagggcaagaacagactgctcgatggggagcgcctggctgaccggaaaattgcggaacttttctccacaaagacccacatcgga

SEQ ID NO: 14120 - RNA, 1932 nt, synthetic construct
  misc_feature 1..1932: note = derived and/or modified CDS sequence (opt5) from CCHFV(Mamon)__KX013478.1__Gc
  source 1..1932: mol_type = other RNA
ttcctggacagcatcgtgaagggcatgaaaaacctcctgaatagcacctctcttgagacaagcctgtccattgaagccccctggggagctatcaacgtccagtctacgtttaagcctaccgttagcacagccaatattgcgctctcctggtctagcgtggagcacagagggaacaaaatcctggtgaccggccggtccgaaagcattatgaagctcgaggaacgcacaggggtctcttgggatctgggagtggaggacgcttccgagagcaaactcctgaccgtttctatcatggatctgtcccaaatgtacagcccggtgttcgaatatctctctggcgacagacaggtcgaggaatggcccaaggccacatgcaccggggattgtcctgagcggtgcggatgtacgtccagcacatgcctgcataaggagtggccccactcccgcaattggagatgtaaccctacatggtgctggggcgtgggcaccgggtgtacatgctgtggagttgacgtgaaagatctttttaccgaccatatgttcgtcaagtggaaagtggaatacatcaagacggaggccattgtgtgcgtcgaactgacatctcaggagcggcagtgtagcctcatcgaagctggcacccgctttaatctggggcccgttacaattaccctttccgagcctagaaacatccaacagaaactgccgcccgagattatcaccctccaccctaaggtggaagagggattctttgatctgatgcatgtgcagaaggtcctgagcgcctctacagtgtgcaaactccagtcctgcacgcacggcattcccggggacctgcaagtttatcacatcggaaatcttctgaagggcgatcgggtgaacggccatctcatccacaaaattgaacctcatttcaataccagctggatgtcttgggacgggtgtgatctggactactattgcaacatgggagactggcccagctgtacatacaccggcgtcacacagcacaatcacgctgcctttgtgaaccttctgaatatcgagaccgattatacgaagacattccattttcactccaaacgcgttaccgcgcatggggacaccccgcagctcgatctgaaggccagacctacatacggagctggcgaaattaccgtgctggtcgaggtggccgacatggagctccacaccaaaaaggtcgaaatctctgggctgaagttcgctagccttgcctgcacgggatgttacgcgtgctccagcggcatttcttgtaaagtgcggatccatgttgatgagcccgacgaactgaccgtgcacgtcaagtccagcgatcctgacgtggttgccgcttctacatccctcatggcccgcaaactggagtttggcaccgatagcacattcaaggctttctccgccatgcccaaaacctctctttgcttttatatcgtggaaagagagtactgtaagagctgctccgaggaagacacgcagaagtgtgtcgataccaaactggagcaaccccagtctattctcatcgaacacaaggggacaattatcggaaaacagaacgatacctgcacagccaagaccagctgctggctggagtccgtgaaatccttcttttatggcctgaagaacatgctcgggtctgtgttcggaaactttttcattggcatcctgctttttctggctcctttcgttctcctggtcctgtttttcatgtttgggtggaagatccttttctgttttaaatgctgtcggcgcacgagaggcctcctgaagtaccggcatctgaaagacgacgaggaaacaggatatagacgcattatcgagcggctcaataataagaaaggcaagaacagactgcttgacggggaacgcctggcggatcggaagattgccgagcttttctccaccaaaacacacatcgga

SEQ ID NO: 14121 - RNA, 1932 nt, synthetic construct
  misc_feature 1..1932: note = derived and/or modified CDS sequence (opt5) from CCHFV(Min)__KX013481.1__Gc
  source 1..1932: mol_type = other RNA
ttcctggacagcatcgtgaagggcaccaaaaacctcctcaattccacatctcttgagacgagcctgtccattgaagccccctggggagctatcaacgtccagtctacctttaagcctacagttagcaccgccaatattgcgctctcctggtctagcgtggagcacagagggaacaaaatcctggtgacaggccggtccgaaagcattatgaaacttgaggaacgcaccggggtctcttgggatctgggagtggaggacgcttccgagagcaaactcctgacagtttctatcatggatctgtcccaaatgtacagcccggtgttcgaatatctctctggcgacagacaggtcgaggaatggcccaaggctacctgcacgggggattgtcctgagcggtgcggatgtacctccagcacatgcctgcataaggagtggccccactcccgcaattggagatgtaaccctacctggtgctggggcgtgggcacagggtgtacctgctgtggagttgacgtgaaagatctttttacggaccatatgttcgtcaagtggaaagtggaatacatcaagacagaggccattgtgtgcgtcgaactgacctctcaggagcggcagtgtagcctcatcgaagccggcacacgctttaatctggggcccgttaccattaccctttccgagcctagaaacatccaacagaaactgccgcccgagattatcacactccaccctaaggtggaagagggattctttgatctgatgcatgtgcagaaggtcctgagcgcctctacggtgtgcaaactccagtcctgcacccacggcattcccggggacctgcaagtttatcacatcggaaatcttctgaagggcgatcggatcaacggccatctcattcacaaaatcgaacctcatttcaatacaagctggatgtcttgggacgggtgtgatctggactactattgcaacatgggagactggcccagctgtacctacacaggcgtgacccagcacaatcacgctgcctttgtcaaccttctgaatattgagacggattatacaaagaccttccattttcactccaaacgcgtgaccgcgcatggggacacaccgcagctcgatctgaaggccagacctacctacggagctggcgaaatcacagttctggtggaggtcgccgacatggagctccacacgaaaaaggtggaaatttctgggctgaagttcgctagccttgcctgcaccggatgttacgcgtgctccagcggcatctcttgtaaagtccggatccatgtggatgagcccgacgaactgacagttcacgtgaagtccagcgatcctgacgtcgtggccgcttctacctccctcatggcccgcaaactggagtttggcacagatagcaccttcaaggctttctccgccatgcccaaaacgtctctttgcttttatattgttgaaagagagtactgtaagagctgctccgaggaagacacccagaagtgtgtggatacaaaactggagcaaccccagtctatcctcattgaacacaaggggaccatcattggaaaacagaacgacacatgcaccgccaaggctagctgctggctggagtccgtcaagagcttcttttatggcctgaagaacatgctcgggtctgtgttcggaaactttttcatcggcatcctgctttttctggcgcctttcgtgctcctggttctgtttttcatgtttgggtggaagattcttttctgttttaaatgctgtcggcgcacgagaggcctcctgaagtaccggcatctgaaagacgatgaggaaacaggatatagacgcatcattgagcggctcaataataagaaaggcaagaacagactgcttgacggggaacgcctggccgatcggaagatcgctgagctgttctccaccaaaacacacattgga

SEQ ID NO: 14122 - RNA, 1932 nt, synthetic construct
  misc_feature 1..1932: note = derived and/or modified CDS sequence (opt5) from CCHFV(Nakiwogo)__KX013484.1__Gc
  source 1..1932: mol_type = other RNA
tacctggacagcatcgccaagggcatgaaatccctcctgaactctaccaatcttgagacaagcctgtccattgaagctccctggggagccatcaacgtgcagtctacgttcaagcctaccgtcagcgcggctaatattgccctctcctggtctagcgttgagcacagagggaacaaaatcctggtgtccggccggagcgaatctattatgaaacttgaggaacgcacagggatctcctggagcctgggagtggaggatgcctctgagtccaagaccctcacagtcagcgtgatggacctgtctcaaatgtattccccggtttttgaatacctgagcggcgatagacaggtggaggaatggcccaaggctacctgcacaggggactgtcctgagcggtgcggatgtacctcctctacgtgcctccataaggagtggccccacagccgcaattggagatgtaaccctacctggtgctggggcgtcggcacagggtgtacctgctgtggactggatgtgcgggaccttttcacagattatatgatggttaaatggaaggtggaatacgtcaaaaccgaggccatcatgtgcgtggaactgacgtcccaggagcgccagtgtagcctcattgaagctggcacaagatttaatctggggcccgtgaccatcacactttctgagcctcggaacgtccaacagcgcctgccgtccgagattgttaccctccatcccaagatcgaagagggattctttgacctgatgcacgtgcagaaagtgctgttctgcaagcatagcctccaggccacctcttgcacacacggcgtccctggggatctgcaagtgtatcacgttggaaatcttctgaagggcgacaaagtgaacggccatagcattcacaagatcgaatcccattttaatacgtcttggatgagctgggatgggtgtgacctcgattacttctgcaacatgggagactggccctcctgtacctatacaggcgtcacccagcacaatagagcggcctttgtgaacatgctgaatattgagacagactacaccaaaacgttccactttcatagcaagcgggttacagctcacggggatacccctcagcttgacctgaaagcccgccccacctacggagctggcgaagtgacagtcctcgtggaggtcgccgatctggagctgcataccaagaaaatcgaagtgtctgggctcaagttcgcgtccctgacatgcagcggatgttatgcctgttcttccggcatcagctgcaaggttcggattcacgtgaacgagccggacgaatttacggtccatgtgaaatccaacgatcctgacgttgtggctgccggctctagccttatggctagaaagatcgagctgggggccgattccaccttcaaagccttctctagcatgcccaaaaattccctctgcttttacattgtcgaacgcgactattgtagctcttgcacagatgacgatacccagaagtgtgtgaacacaaagctggagcaccctcaatccatccttattgagcacaagggaaccatcatcggcaaacagaatgacacgtgccccaccaagacaagctgctggctggaatctgtgaaatccttcttttacgggctcaagaacatgctgggaggcattttcgggaatgtttttctgggcatcttcctctttctggctcccttcgcgcttctgattctctttttctttttcggatggagactgctgttttgtcttaaatgctgtcggagaacccgcggcctcctgaagtataagcagctgaaagacgaggaagaggccgggtacaagaaaatcattgagcggctcaacgataagaaaggaaagagcagactgttcgacggcgaacgccttgctgatcggaagatcgccgagctgttctctacaaaaacccatatcggg

SEQ ID NO: 14123 - RNA, 1932 nt, synthetic construct
  misc_feature 1..1932: note = derived and/or modified CDS sequence (opt5) from CCHFV(Saf)__KX013487.1__Gc
  source 1..1932: mol_type = other RNA
ttcagcgactccatcgtgaagggcatgaaaaacctgctcaattctaccagcctggagacatccctttctattgaagccccctggggagctatcaacgtccagagcacgtttaagcctaccgtttccacagccaatattgcgctgtcttggagctccgtggagcacagagggaacaaaatcctcgtgaccggccggagcgaatctattatgaagctggaggaacgcacaggggtctcctgggatcttggagtggaggacgctagcgagtctaaactgctcaccgtttccatcatggatctgagccaaatgtactctccggtgttcgaatatctgtccggcgacagacaggtcgaggaatggcccaaggccacatgcaccggggattgtcctgagcggtgcggatgtacgagctctacctgcctccataaggagtggccccactcccgcaattggagatgtaaccctacatggtgctggggcgtgggcaccgggtgtacatgctgtggagttgacgtgaaagatctgtttaccgaccatatgttcgtcaagtggaaagtggaatacatcaagacggaggccattgtgtgcgtcgaacttacaagccaggagcggcagtgttccctgatcgaagctggcacccgctttaatctcgggcccgttacaattaccctgagcgagcctagaaacatccaacagaaacttccgcccgagattatcaccctgcaccctaaggtggaagagggattctttgatctcatgcatgtgcagaaggtcctgtctgcctccacagtgtgcaaactgcagagctgcacgcacggcattcccggggacctccaagtttatcacatcggaaatctgcttaagggcgatcgggtgaacggccatctgatccacaaaattgaacctcatttcaatacctcttggatgagctgggacgggtgtgatctcgactactattgcaacatgggagactggccctcctgtacatacaccggcgtcacacagcacaatcacgctgcctttgtgaacctgcttaatatcgagaccgattatatgaagacgttccattttcactctaaacgcgttacagcgcatggggacaccccgcagctggatctcaaggccagacctacctacggagctggcgaaattacagtgctggtcgaggtggccgacatggagctgcacaccaaaaaggtcgaaatcagcgggctcaagttcgtgtccctggcttgcacaggatgttacgcctgcagctctggcatttcctgtaaagttcggatccatgtggatgagcccgacgaacttacggtccacgttaagagctctgatcctgacgtggtggcggcctccaccagcctgatggctcgcaaactcgagtttggcacagattccaccttcaaggccttctctgctatgcccaaaacaagcctgtgcttttatatcgtcgaaagagagtactgtaagtcctgctctgaggaagacacccagaagtgtgtggatacgaaacttgagcaaccccagagcattctgatcgaacacaaggggaccattatcggaaaacagaacgacacatgcaccgccaaggcctcctgctggctcgagagcgtgaaatctttcttttatggcctgaagaacatgctggggtccgttttcggaaactttttcattggcatcctcctgtttcttgctcctttcgtcctgctcgtgctgtttttcatgtttgggtggaagatcctgttctgttttaaatgctgtcggcgcacaagaggccttctcaagtaccggcatctgaaagacgatgaggaaaccggatatagacgcattatcgagcggctgaataataagaaaggcaagaacagactcctggacggggaacgccttgcggatcggaagattgccgagctgttcagcacgaaaacacacatcgga

SEQ ID NO: 14124 - RNA, 1932 nt, synthetic construct
  misc_feature 1..1932: note = derived and/or modified CDS sequence (opt5) from CCHFV(Ast199)__KX056051.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtttaagcctaccgttagcacagccaatattgcgctctcctggtctagcgtggagcacagagggaacaaaatcctggtgaccggccggtccgaaagcattatgaaacttgaggaacgcacaggggtctcttgggatctgggagtggaggacgcttccgagagcaagctcctgaccgtttctatcatggatctgtcccaaatgtacagcccggtgttcgaatatctctctggcgacagacaggtcgaggaatggcccaaggccacatgcaccggggattgtcctgagcggtgcggatgtacgtccagcacatgcctgcataaggagtggccccactcccgcaattggagatgtaaccctacatggtgctggggcgtgggcaccgggtgtacatgctgtggagttgacgtgaaagatctttttaccgaccatatgttcatcaagtggaaagtcgaatacattaagacggaggccatcgtgtgcgtggaactgacatctcaggagcggcagtgtagcctcattgaagctggcacccgctttaatctggggcccgtcacaatcaccctttccgagcctagaaacattcaacagaaactgccgcccgagatcattaccctccaccctaagatcgaagagggattctttgatctgatgcatgttcagaaggtgctgagcgcctctacagtgtgcaaactccagtcctgcacgcacggcatccccggggacctgcaaatttatcacatcggaaatcttctgaagggcgatcggctcaacggccatctgattcacaaaatcgaacctcatttcaataccagctggatgtcttgggacgggtgtgatcttgactactattgcaacatgggagactggcccagctgtacatacaccggcgtcacacagcacaatcacgctgcctttgtgaacctgctcaatattgagaccgattatacgaagacattccattttcactccaaacgcgttaccgcgcatggggacaccccgcagctggatctgaaggccagacctacatacggagctggcgaaatcaccgtgctcgtcgaggtggccgacatggagctgcacaccaaaaaggttgaagtgtctgggcttaagttcgctagcctggcctgcacgggatgttacgcgtgctccagcggcatctcttgtaaagtccggattcatgtggatgagcccgacgaactcaccgtccacgtgaagtccagcgatcctgacgttgtggccgcttctacatccctgatggcccgcaaacttgagtttggcaccgatagcacattcaaggctttctccgccatgcccaaaacctctctgtgcttttatatcgtcgaaagagagtactgtaagagctgctccgaggacgatacgaagaaatgtgtggacaccaagctcgaacagccccaatctattctgatcgagcacaaagggacaattatcggaaagcagaacgatacctgcacagccaaagctagctgctggctggaatccgttaagagcttcttttatggcctcaagaacatgctggggtctgtgttcggaaactttttcgtcggcatccttctgtttctcgcgcctttcgtgctgctggtgctgtttttcatttttgggtggaaaatcctcttctgttttaagtgctgtcggcgcaccagaggcctgttcaaataccggcatctgaaggacgacgaggagacgggatatagaaaaattatcgaacgcctcaattccaagaagggcaaaaatcggctgcttgatggggagagactggccgaccgcaagattgctgaactcttcagcacaaaaacccacatcgga

SEQ ID NO: 14125 - RNA, 1932 nt, synthetic construct
  misc_feature 1..1932: note = derived and/or modified CDS sequence (opt5) from CCHFV(Ast149)__KX056054.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtttaagcctaccgttagcacagccaatattgcgctctcctggtctagcgtggagcacagagggaacaaaatcctggtgaccggccggtccgaaagcattatgaaacttgaggaacgcacaggggtctcttgggatctgggagtggaggacgcttccgagagcaagctcctgaccgtttctatcatggatctgtcccaaatgtacagcccggtgttcgaatatctctctggcgacagacaggtcgaggaatggcccaaggccacatgcaccggggattgtcctgagcggtgcggatgtacgtccagcacatgcctgcataaggagtggccccactcccgcaattggagatgtaaccctacatggtgctggggcgtgggcaccgggtgtacatgctgtggagttgacgtgaaagatctttttaccgaccatatgttcatcaagtggaaagtcgaatacattaagacggaggccatcgtgtgcgtggaactgacatctcaggagcggcagtgtagcctcattgaagctggcacccgctttaatctggggcccgtcacaatcaccctttccgagcctagaaacattcaacagaaactgccgcccgagatcattaccctccaccctaagatcgaagagggattctttgatctgatgcatgttcagaaggtgctgagcgcctctacagtgtgcaaactccagtcctgcacgcacggcatccccggggacctgcaaatttatcacatcggaaatcttctgaagggcgatcggctcaacggccatctgattcacaaaatcgaacctcatttcaataccagctggatgtcttgggacgggtgtgatcttgactactattgcaacatgggagactggcccagctgtacatacaccggcgtcacacagcacaatcacgctgcctttgtgaacctgctcaatattgagaccgattatacgaagacattccattttcactccaaacgcgttaccgcgcatggggacaccccgcagctggatctgaaggccagacctacatacggagctggcgaaatcaccgtgctcgtcgaggtggccgacatggagctgcacaccaaaaaggttgaagtgtctgggcttaagttcgctagcctggcctgcacgggatgttacgcgtgctccagcggcatctcttgtaaagtccggattcatgtggatgagcccgacgaactcaccgtccacgtgaagtccagcgatcctgacgttgtggccgcttctacatccctgatggcccgcaaacttgagtttggcaccgatagcacattcaaggctttctccgccatgcccaaaacctctctgtgcttttatatcgtcgaaagagagtactgtaagagctgctccgaggacgatacgaagaaatgtgtggacaccaagctcgaacagccccaatctattctgatcgagcacaaagggacaattatcggaaagcagaacgatacctgcacagccaaagctagctgctggctggaatccgttaagagcttcttttatggcctcaagaacatgctggggtctgtgttcggaaactttttcgtcggcatccttctgtttctcgcgcctttcgtgctgctggccctgtttttcatttttgggtggaaaatcctcttctgttttaagtgctgtcggcgcaccagaggcctgttcaaataccggcatctgaaggacgacgaggagacgggatatagaaaaattatcgaacgcctcaattccaagaagggcaaaaatcggctgcttgatggggagagactggctgaccgcaagattgccgaactcttcagcacaaaaacccacatcgga

SEQ ID NO: 14126 - RNA, 1932 nt, synthetic construct
  misc_feature 1..1932: note = derived and/or modified CDS sequence (opt5) from CCHFV(Ast137)__KX056057.1__Gc
  source 1..1932: mol_type = other RNA
ttcctggacagcatcgtgaagggcaccaaaaacctccttaattccacatctcttgagacgagcctgtccattgaagccccctggggagctatcaacgtccagtctacctttaagcctacagttagcaccgccaatattgcgctctcctggtctagcgtggagcacagagggaacaaaatcctggtgacaggccggtccgaaagcattatgaaacttgaggaacgcaccggggtctcttgggatctgggagtggaggacgcttccgagagcaagctcctgacagtttctatcatggatctgtcccaaatgtacagcccggtgttcgaatatctctctggcgacagacaggtcgaggaatggcccaaggctacctgcacgggggattgtcctgagcggtgcggatgtacctccagcacatgcctgcataaggagtggccccactcccgcaattggagatgtaaccctacctggtgctggggcgtgggcacagggtgtacctgctgtggagttgacgtgaaagatctttttacggaccatatgttcatcaagtggaaagtcgaatacattaagacagaggccatcgtgtgcgtggaactgacctctcaggagcggcagtgtagcctcattgaagccggcacacgctttaatctggggcccgtcaccatcaccctttccgagcctagaaacattcaacagaaactgccgcccgagatcattacactccaccctaagatcgaagagggattctttgatctgatgcatgttcagaaggtgctgagcgcctctacggtgtgcaaactccagtcctgcacccacggcatccccggggacctgcaaatttatcacatcggaaatcttctgaagggcgatcggctcaacggccatctgattcacaaaatcgaacctcatttcaatacaagctggatgtcttgggacgggtgtgatcttgactactattgcaacatgggagactggcccagctgtacctacacaggcgtcacccagcacaatcacgctgcctttgtgaacctgctcaatattgagacggattatacaaagaccttccattttcactccaaacgcgttaccgcgcatggggacacaccgcagctggatctgaaggccagacctacctacggagctggcgaaatcacagtgctcgtcgaggtggccgacatggagctgcacacgaaaaaggttgaagtgtctgggcttaagttcgctagcctggcctgcaccggatgttacgcgtgctccagcggcatctcttgtaaagtccggattcatgtggatgagcccgacgaactcacagtccacgtgaagtccagcgatcctgacgttgtggccgcttctacctccctgatggcccgcaaacttgagtttggcacagatagcaccttcaaggctttctccgccatgcccaaaacgtctctgtgcttttatatcgtcgaaagagagtactgtaagagctgctccgaggacgataccaagaaatgtgtggacacaaagctcgaacagccccaatctattctgatcgagcacaaagggaccattatcggaaagcagaacgacacatgcaccgccaaagctagctgctggctggaatccgttaagagcttcttttatggcctcaagaacatgctggggtctgtgttcggaaactttttcgtcggcatccttctgtttctcgcgcctttcgtgctgctggtgctgtttttcatttttgggtggaaaatcctcttctgttttaagtgctgtcggcgcacgagaggcctgttcaaataccggcatctgaaggatgacgaggagacaggatatagaaaaattatcgaacgcctcaattccaagaagggcaaaaatcggctgcttgatggggagagactggccgaccgcaagattgctgaactcttcagcaccaaaacacacatcgga

SEQ ID NO: 14127 - RNA, 1932 nt, synthetic construct
  misc_feature 1..1932: note = derived and/or modified CDS sequence (opt5) from CCHFV(Ast133)__KX056060.1__Gc
  source 1..1932: mol_type = other RNA
ttcagcgactccatcgtgaagggcatgaaaaacctgctcaattctaccagcctggagacatccctttctattgaagccccctggggagctatcaacgtccagagcacgtttaagcctaccgtttccacagccaatattgcgctgtcttggagctccgtggagcacagaggaaacaaaatcctcgtgaccggccggagcgaatctattatgaagctggaggaacgcacaggggtctcctgggatcttggagtggaggacgctagcgagtctaaactgctcaccgtttccatcatggatctgagccaaatgtactctccggtgttcgaatatctgtccggcgacagacaggtcgaggaatggcccaaggccacatgcaccggggattgtcctgagcggtgcggatgtacgagctctacctgcctccataaggagtggccccactcccgcaattggagatgtaaccctacatggtgctggggcgtgggcaccgggtgtacatgctgtggagttgacgtgaaagatctgtttaccgaccatatgttcatcaagtggaaagtcgaatacattaagacggaggccatcgtgtgcgtggaacttacaagccaggagcggcagtgttccctgattgaagctggcacccgctttaatctcgggcccgtcacaatcaccctgagcgagcctagaaacattcaacagaaacttccgcccgagatcattaccctgcaccctaagatcgaagagggattctttgatctcatgcatgttcagaaggtgctgtctgcctccacagtgtgcaaactgcagagctgcacgcacggcatccccggggacctccaaatttatcacatcggaaatctgcttaagggcgatcgggtcaacggccatctgattcacaaaatcgaacctcatttcaatacctcttggatgagctgggacgggtgtgatctcgactactattgcaacatgggagactggccctcctgtacatacaccggcgtgacacagcacaatcacgctgcctttgttaacctgcttaatattgagaccgattatacgaagacattccattttcactctaaacgcgtgaccgcgcatggggacaccccgcagctggatctcaaggccagacctacatacggagctggcgaaatcaccgtcctggtggaggttgccgacatggagctgcacacaaagaaggtggaaatcagcgggctcaagttcgcttccctgacgtgcaccggatgttacgcctgcagctctggcatttcctgtaaagtccggatccatgtggatgagcccgacgaacttacagtccacgtgaaaagctctgatcctgacgttgtggcggcctccaccagcctgatggctcgcaaactcgagtttggcacagattccaccttcaaggccttctctgctatgcccaaaacgagcctgtgcttttatattgtcgaaagagagtactgtaagtcctgctctgaggacgataccaagaaatgtgtggacacaaagctggaacagccccaaagcatcctgattgagcacaaagggaccatcatcggaaagcagaacgacacatgcaccgccaaagcctcctgctggctcgaaagcgttaagtctttcttttatggcctgaagaacatgctggggtccgtgttcgggagctttttcgtcggcattctcctgtttcttgctcctttcgtgctgctcgtgctgtttttcatgtttgggtggaaaatcctgttctgttttaagtgctgtcggcgcacgagaggccttttcaaataccggcatctcaaggatgacgaggagacaggatatagacgcattatcgaacggcttaattctaaaaagggcaagaacagactgctcgatggggagcgcctggcggaccggaaaattgccgaacttttctccagcaagacccacatcgga

SEQ ID NO: 14128 - RNA, 1932 nt, synthetic construct
  misc_feature 1..1932: note = derived and/or modified CDS sequence (opt5) from CCHFV(SK/2015/human)__KX458183.1__Gc
  source 1..1932: mol_type = other RNA
ttcctggacagcatcgtgagaggcatgaagaacctccttaattccacctctcttgagacaagcctgtccattgaagccccctggggagctatcaacgtccagtctacgtacaaacctaccgttagcacagccaatattgcgctctcctggtctagcgtggagcaccgggggaacaagatcctggtgtccggccgcagcgaatctattatgaaacttgaggaaagaaccggggtctcctgggatctgggagtggaggacgctagcgagtctaagctcctgacagtttccgtgatggatctgagccaaatgtattctccggtctttgaatacctctccggcgacagacaggtggaggaatggcccaaagctacctgcacaggggattgtcctgagcgctgcggatgtaccacgtctacctgcctgcataaggagtggccccactccagaaattggcggtgtaaccctacatggtgctggggcgttggcaccgggtgtacatgctgtggacttgacgtgaaggatctgttcaccgactatatgtttgtcaaatggaaggtggaatacatcaaaacggaggccatcgtgtgcgtcgaactcacatctcagggccgccagtgtagcctgattgaggctgggaccagattcaatcttggatccgttacaatcaccctgagcgaaccccggaacattcaacataagctccctccggagatcattaccctgcacccccgcatcgaggaaggctttttcgatctgatgcatgtgcagaaagtgctctctgcctccacagtctgcaagctgcagagctgcacgcacggggtgcctggagaccttcaggtttatcacattggcaatctgctcaagggcgataaagtgaacgggcatctgatccacaagatcgagccccattttaatacctcttggatgagctgggacggatgtgatcttgactactattgcaacatgggcgactggccttcctgtacatacaccggggtcacacaacacaatcacgcttctttcgtgaacctgctcaatattgaaaccgattacacgaaaaactttcatttccacagcaagagagttacagcccatggagacacaccccagctggatctgaaagcgcggccgacctatggcgccggggagatcaccgtgctcgtcgaagtggctgacatggagctgcacaccaagaaaattgagatctccggacttaagtttgccagcctgacatgcacgggctgttacgcttgcagctccggcattagctgtaaggtccgcatccatgtggatgaacctgacgagctcaccgttcacgtgaaatctgatgaccccgatgtcgtggccgcgtccagctccctgatggccagaaagctggagttcgggacagactctacctttaaagccttcagcgccatgcctaagacatccctgtgcttctatatcgttgaacgggaatactgtaaatcttgcagcaaggaggatacccagaagtgtgtgaacacgaaactcgagcagccccaatccattctgatcgaacaccgcggaaccattatcggcaagcagaataacacatgcattgctaaagccagctgctggctggagtctgtcaagtcctttttctatgggctcaaaaatatgctgagcggaatctttggcaaccttttcctggggatctttctcttcctggccccctttattctgcttatcctcttctttatgttcggctggcggattctgttttgtttcaagtgctgtcggagaacccgcggactgtttaagtaccggcatctcaaagacgacgaagagacaggctatagacgcatcattgagcggctgaataacaagaaagggaagaataaacttctggatggagaaagactcgctgaccgccggatcgcggagctgttctctaccaagacgcacattggc

SEQ ID NO: 14129 - RNA, 1932 nt, synthetic construct
  misc_feature 1..1932: note = derived and/or modified CDS sequence (opt5) from CCHFV(YL16070)__KY354081.1__Gc
  source 1..1932: mol_type = other RNA
ttcctggacagcatcgccaagggcatgaaatccctcctgaactctaccagccttgagacatccctgtctattgaagctccctggggagccatcaatgtgcagagcacgtttaagcctaccgtctccgcggctaacattgccctctcttggagctccgttgagcacagagggaataaaatcctggtgagcggccggtctgaatccattatgaagctcgaggaacgcacaggggtgagctggaacctgggagtcgaggatgcctctgagtccaaaaccctcacagtgagcgttatggacctgtctcaaatgtactccccggtgttcgaatatctgagcggcgatagacaggtcgaggaatggcccaaggctacctgcacaggggactgtcctgagcggtgcggatgtacctcctctacgtgcctccataaggagtggccccacagccgcaattggagatgtaaccctacctggtgctggggcgtgggcacagggtgtacctgctgtggactggatgttaaagactttttcacagattacatgcttgtgaagtggaaagtcgaatatatcaagaccgaggccatcgtgtgcgtggaactgacgtcccaggagcggcagtgtagcctcattgaagctggcacacgctttaatctggggcccgtcaccatcacactttctgagcctagaaacgttcaacagcggctgccgcccgagattgtgaccctccatcctaaaatcgaagagggattctttgacctgatgcacgtgcagaagattctgtccgccagcaccgtctgcaagctccagtcttgcacacatggcgtgcccggggatttccaagtttaccacgtgggaaatctgcttcgcggcgacaaagtcaacggccacagcatccataagattgaacctcactttaatacgtcctggatgtcttgggatgggtgtgacctggattatttctgcaacatgggagactggcccagctgtacctacacaggcgtgacccagcataatagagcggcctttatcaacatgctcaatatcgagacagactataccaaaacgttccactttcactccaagcgggttacagctcatggggataccccgcagctggaccttaaagcccgccctgcttacggagccggcgaagtgaccgtcctggtggaggtcgcggatctcgagctgcacacaaagaaactggaagtgagcgggctcaagattgcctctctgacctgctccggatgttacgcttgcagctctggcatctcctgtaaggttcggattcatgtgaacgagcccgacgaatttacagtccacgtgagaagctccgatcctgacgttgtggccgctggctctagccttatggcccgcaaaatcgagttcggggccgattccacgtttaaggctttctctagcatgcccaaagactccctgtgcttttatattgtcgaaaaggattactgtagctcttgcaccgacgatgacacacagaaatgtgtgaacaccaagctcgaccatccccaatccatcctgatcgagcacaagggaacaattatcggcaaacagaatgatacctgcagcacgaagacctcttgctggcttaaatccttcaaggggtttttctatggactgaaaaacatgctcagcggcatttttgggaatgtgttcctgggcatcctgctctttctggcgcctttcgttcttctgattttcttctttttcttcggatggagactcctgttttgtctgaagtgctgtaagaaaacaaagggccttctcaaatacaagcacctgaaagacaaggaggaagccgggtataagaaaatcatcgagcggctgaacggaaagaaaggcaagtctcagcttttcgatggggaaagactggctaatcgcaaaattgccgagctttttagcaccaagatccatattgga

SEQ ID NO: 14130 - RNA, 1932 nt, synthetic construct
  misc_feature 1..1932: note = derived and/or modified CDS sequence (opt5) from CCHFV(Oman_812956)__KY362518.1__Gc
  source 1..1932: mol_type = other RNA
ttctttgacagcatcgccaagggcatgaaaaacctgctcaattccacctctctggagacaagcctttccattgaagctccctggggagccatcaacgtgcagtctacgttcaagcctaccgtcagcacagcgaatattgctctgtcctggtctagcgttgagcacagagggaacaaaatcctcgtgtccggccggagcgaatctattatgaagctggaggaacgcaccgggatctcctgggatcttggagtggaggacgccagcgagtctaaactgctcacagtctccgtgatggatctgagccaaatgtactctccggtttttgaatatctgtccggcgacagacaggtggaggaatggcccaaggctacctgcacaggggattgtcctgagcggtgcggatgtaccagctccacgtgcctccataaggagtggccccactctcgcaattggagatgtaaccctacctggtgctggggcgtcggcacagggtgtacctgctgtggactggacgtgaaagatcttttcacagactacatgtttgttaagtggaaagtggaatatatcaagaccgaggccattgtctgcgtggaactgacgagccaggagcggcagtgttccctcatcgaagccggcacacgcttcaatctggggcccgtgaccattacacttagcgagcctagaaacatccaacagaaactgccgcccgagattgtcaccctccatcctcggatcgaagagggatttttcgatctgatgcacgttcagaaggtgctgtctgcttccaccgtgtgcaagctccagagctgcacacatggcgtccccggggacctgcaagtgtaccacattggaaatcttctgaaaggcgataaggttaacggccacctcatccataaagtggaacctcactttaatacgtcttggatgagctgggacgggtgtgatctggactattactgcaacatgggagactggccctcctgtacctatacaggcgtcacccagcataatcacgccgcgttcgtgaaccttctgaatatcgagacagattacaccaagaactttcacttccattctaaacgcgttacggcccacggggacacaccgcagctcgatctgaaggctagacctaactacggagccggcgaaattaccgtgctggtcgaggtggctgacatggagctccataccaaaaagatcgaaattagcgggctgaagtttgcctcccttacatgcaccggatgttatgcgtgcagctctggcatctcctgtaaagtccggattcacgtggatgagcccgacgaactgacagttcatgtcaagagcgaggatcctgacatcgtggccgcttcttccagcctcatggcccgcaaactggaatttggcacggattccaccttcaaggctttttctgccatgcccaaaacaagcctttgcttctacatcgtggagagagagtattgtaagtcctgctctaaggaagacacccagaaatgtgttaatgccaagctggagcggccccaaagcattctcatcgaacacaaagggacaattatcggaaagcagaacgatacctgcacggctaaagcgtcctgctggctggagagcgtgaagtctttcttctacggcctgaagaatatgctctccgggatttttggaaacgtcttcatcggcatctttctgttccttgccccttttattctgctcatcctgttctttatgttcgggtggcgcattctgttttgtttcaaatgctgtagacggaccagaggccttttcaagtatcgccacctcaaagacgacgaggaaacaggataccggaagatcattgagagactgaataacaaaaagggcaagaataaactgctcgatggggaacgcctggctgaccggaagatcgccgagctttttagcaccaaaacacatattgga

SEQ ID NO: 14131 - RNA, 1932 nt, synthetic construct
  misc_feature 1..1932: note = derived and/or modified CDS sequence (opt5) from CCHFV(UCCR4405)__KY484029.1__Gc
  source 1..1932: mol_type = other RNA
ttcctggacagcaccgtgaagggcatgaaaaacctccttaattccacatctcttgagacgagcctgtccatcgaagccccctggggagctattaacgtccagtctacctttaagcctacagttagcaccgccaatatcgcgctctcctggtctagcgtggagcacagagggaacaaaattctggtgacaggccggtccgaaagcatcatgaagctggaggaacgcaccggggtctcttgggatctgggagtggaggacgcttccgagagcaaactcctgacagtttctattatggatctgtcccaaatgtacagcccggtgttcgaatatctctctggcgacagacaggtcgaggaatggcccaaggctacctgcacgggggattgtcctgagcggtgcggatgtacctccagcacatgcctgcataaggagtggccccactcccgcaattggagatgtaaccctacctggtgctggggcgtgggcacagggtgtacctgctgtggagttgacgtgaaagatctttttacggaccatatgttcgtcaagtggaaagtggaatacatcaagacagaggccatcgtgtgcgtcgaactgacctctcaggagcggcagtgtagcctcattgaagccggcacacgctttaatctggggcccgttaccatcaccctttccgagcctagaaacattcaacagaaactgccgcccgagatcattacactccaccctaagatcgaagagggattctttgatctgatgcatgtgcagaaggtgctgagcgcctctacggtctgcaaactccagtcctgcacccacggcattcccggggacctgcaaatctatcacatcggaaatcttctgaagggcgatcgggtgaacggccatctcattcacaaaatcgaacctcatttcaatacaagctggatgtcttgggacgggtgtgatctggactactattgcaacatgggaaattggcccagctgtacctacacaggcgttacccagcacaaccacgctgcctttgtgaatcttctgaacattgagacggactatacaaagaccttccattttcactccaaacgcgtcaccgcgcatggggatacaccgcagctcgacctgaaggccagacctacctacggagctggcgaaatcacagtgctggttgaggtggccgatatggagctccacacgaaaaaggtcgaaatttctgggctgaagttcgctagccttgtgtgcaccggatgttacgcctgctccagcggcatctcttgtaaagtccggatccatgtggacgagcccgatgaactgacagttcacgtgaagtccagcgaccctgatgtcgtggcggcctctacctccctcatggctcgcaaactggagtttggcacagacagcattttcaaggccttctccgctatgcccaaaacctctctttgcttttatatcgttgaaagagagtactgtaagagctgctccgaggatgacacgaagaaatgtgtggataccaagctggaacagccccaatctattctcatcgagcacaaagggacaattatcggaaagcagaacgatacctgcacagccaaagccagctgctggctggaatccgtcaagagcttcttttatggcctgaagaatatgctcgggtctgtgttcggaaactttttcgtgggcatcctgctttttctggctcctttcgttctcctggtcctgtttttcatgtttgggtggaaaattcttttctgttttaagtgctgtcggcgcaccagaggcctcttcaaataccggcatctgaaggacgacgaggagacgggatatagacgcatcattgaacggctcaattccaaaaagggcaagaacagactgctggacggggagcgccttgcggatcggaaaatcgccgaactgttcagcacaaagacccacattgga

SEQ ID NO: 14132 - RNA, 1932 nt, synthetic construct
  misc_feature 1..1932: note = derived and/or modified CDS sequence (opt5) from CCHFV(UCCR4401)__KY484035.1__Gc
  source 1..1932: mol_type = other RNA
ttcctggacagcaccgccaagggcatgaaaaacctccttaattccacatctcttgagacgagcctgtccatcgaagctccctggggagccattaacgtgcagtctacctacaagcctacagtcagcaccgcgaatatcgctctctcctggtctagcgttgagcacagagggaacaaaattctggtgtccggccggagcgaatctatcatgaaacttgaggaacgcacagggatttcctgggatctgggagtggaggacgccagcgagtctaaactcctgaccgtctccgtgatggatctgagccaaatgtattctccggtttttgaatacctctccggcgacagacaggtggaggaatggcccaaggccacatgcaccggggattgtcctgagcggtgcggatgtacgagctctacctgcctgcataaggagtggccccactctcgcaattggagatgtaaccctacatggtgctggggcgtcggcaccgggtgtacatgctgtggacttgacgtgaaagatctgttcaccgactatatgtttgttaagtggaaagtggaatacatcaagacggaggctatcgtctgcgtggaactcacaagccaggagcggcagtgttccctgattgaagccggcacccgcttcaatcttgggcccgtgacaatcaccctgagcgagcctagaaacattcaacagaaactcccgcccgagatcattaccctgcatcctcggatcgaagagggatttttcgatctgatgcacgtccagaaggttctctctgcttccacagtgtgcaagctgcagagctgcacgcatggcgtgcccggggaccttcaagtctatcacattggaaatctgctcaaaggcgataaggtgaacggccacctgatccataaaatcgaacctcactttaatacctcttggatgagctgggacgggtgtgatcttgactactattgcaacatgggagactggccctcctgtacatacaccggcgttacacagcataatcacgcctctttcgtgaacctgctcaatattgagaccgattacacgaagaactttcacttccatagcaaacgcgtcacagcgcacggggacaccccgcagctggatctgaaggccagacctacctatggagctggcgaaatcacagtgctcgttgaggtggccgacatggagctgcataccaaaaagattgaaatctccgggcttaagtttgctagcctggcctgcacaggatgttacgcgtgctcctccggcattagctgtaaagtccggatccacgtggatgagcccgacgaactcacggtccatgtgaagtctgatgaccctgatgttgtggccgcttccagctccctgatggcccgcaaacttgagttcggcaccgactctacatttaaggctttcagcgccatgcccaaaacctccctgtgcttctatatcgtcgaaagagagcactgtaagtcttgcagcgaggaagatacaaagaaatgtgtgaacaccaagctcgagcagccccaatccattctgatcgaacacaaagggacgattatcggaaagcagaatagcacatgcaccgccaaggcttcttgctggctggagtccgttaagagctttttctacggcctcaagaacatgctgtctgggatttttggaaatgtgttcatgggcatctttcttttcctggcgccttttatcctcctgattctgttctttatgttcgggtggcggatcctgttttgtttcaaatgctgtcgcagaacccggggcctctttaagtatagacatctgaaagacgacgaggaaacaggataccgccggattatcgagaagctgaacaataaaaagggcaagaacaaactcctggatggggaaagacttgccgaccgccggattgctgagctgttctccaccaagacgcacatcgga

SEQ ID NO: 14133 - RNA, 1932 nt, synthetic construct
  misc_feature 1..1932: note = derived and/or modified CDS sequence (opt5) from CCHFV(UCCR4448)__KY484042.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtacaagcctaccgttagcacagccaatattgcgctctcctggtctagcgtggagcacagagggaacaaaatcctggtgtccggccggagcgaatctattatgaaacttgaggaaaagaccgggatctcctgggatctgggagtcgaggacgctagcgagtctaagctcctgacagtgtccgttatggatctgagccaaatgtattctccggtgtttgaatacctctccggcgaccgccaggtcgaggaatggcccaaggctacctgcacaggggattgtcctgagagatgcggatgtaccagctccacgtgcctgcataaagagtggccccactctcggaattggcgctgtaaccctacctggtgctggggcgtgggcacagggtgtacctgctgtggacttgacgttaaggatctgttcacagactatatgtttgtgaaatggaaggtcgaatacatcaaaaccgaggccattgtgtgcgtggaactcacgagccaggagagacagtgttccctgatcgaagccggcacacggttcaatcttgggcccgtcaccattacactgagcgagcctcgcaacatccaacagaagctcccgcccgagattatcaccctgcatcctagaattgaagagggatttttcgatctgatgcacgttcagaaggtgctctctgcctccaccgtgtgcaaactgcagagctgcacacatggcgtccccggggaccttcaagtgtatcacatcggaaatctgctcaagggcgataaagttaacggccacctgatccataagattgaacctcactttaatacgtcttggatgagctgggacgggtgtgatcttgactactattgcaacatgggagactggccctcctgtacctacacaggcgtgacccagcataatcacgcttctttcgtcaacctgctcaatatcgagacagattacaccaaaaactttcacttccatagcaagcgggtgacggcccacggggacacaccgcagctggatctgaaagcgcgccctacctatggagccggcgaaattaccgttctcgtggaggtcgctgacatggagctgcatacaaagaagatcgaaatttccgggcttaaatttgccagcctgacctgcacaggatgttacgcttgttcttccggcatcagctgcaaggtgagaatccacgtcgatgagcccgacgaactcacggtgcatgttaaatctgatgaccctgatgtggtcgccgcgtccagctccctgatggcccggaaacttgagttcggcaccgactctacatttaaggctttcagcgccatgcccaagacctccctgtgcttctatattgtggaacgcgagcactgtaagtcttgcagcgaggaagataccaaaaagtgtgttaacaccaaactcgagcagccccaatccatcctgattgaacacaaggggacgatcattggaaaacagaatagcacatgcacagctaaggcctcttgctggctggagtccgtcaagagctttttctacggcctcaaaaacatgctgtctgggatctttggaaatgtgttcatcggcatttttcttttcctggccccttttatcctcctgattctgttctttatgttcgggtggaagatcctgttttgtttcaaatgctgtagacggacccgcggcctctttaagtatagacatctgaaagacgacgaggaaacaggataccggagaattatcgagcgcctgaacaataagaagggcaaaaacaagctcctggatggggaaattcttgctgaccggagaatcgcggagctgttctccaccaaaacgcacatcgga

SEQ ID NO: 14134 - RNA, 1932 nt, synthetic construct
  misc_feature 1..1932: note = derived and/or modified CDS sequence (opt5) from CCHFV(U2-2-002/U-6415)__AY900144.1__Gc
  source 1..1932: mol_type = other RNA
ttccaggacagcatcgtgaagggcatgaaaaacctgctcaattccacctctctggagacaagcctttccattgaagccccctggggagctatcaacgtccaatctacgtacaagcctaccgttagcgccgcgaatattgctctgtcctggtctagcgtggagcacagagggaacaaaatcctcgtgtccggccggagcgaatctattatgaagctggaggaacgcacagggatctcctgggatcttggagtcgaggacgccagcgagtctaaactgctcaccgtgtccgttatggatctgagccagatgtattctccggtgtttgaatacctgtccggcgacagacaggtcgaggaatggcccaaggccacatgcaccggggattgtcctgagcggtgcggatgtacaagctctacctgcctccataaggagtggccccactcccgcaattggagatgtaaccctacgtggtgctggggcgtgggcaccgggtgtacatgctgtggactggacgttaaagatcttttcaccgactatatgtttgtgaagtggaaagtcgaatacatcaagacagaggctattgtgtgcgtggaactgaccagccaggagcggcaatgttccctcatcgaagccggcacgcgcttcaatctggggcccgtcacaattacccttagcgagcctagaaacatccagcagaaactgccgcccgagattatcacactccatcctcggattgaagagggatttttcgatctgatgcacgttcagaaggtgctgtctgcttccaccgtgtgcaagctccaaagctgcacccatggcgtccccggggaccttcaggtgtatcacatcggaaatctgctgaaaggcgataaggttaacggccacctcatccataaaattgaacctcactttaatacatcttggatgagctgggacgggtgtgatctggactactattgcaacatgggagactggccctcctgtacgtacaccggcgtgacacagcataatcacgcctctttcgtcaaccttctgaatatcgagaccgattacacaaagagctttcacttccattccaaacgcgtgaccgcgcacggggacacgccgcagctcgatctgaaggccagacctagctatggagctggcgaaattacagttctggtggaggtcgccgacatggagctccataccaaaaagatcgaaatttctgggctgaagtttgcttcccttacctgcacaggatgttacgcctgcagctctggcatctcctgtaaagtgcggatccacgtcgatgagcccgacgagttcaccgtgcatgttaagagcgatgaccctgatgtggtcgcggcctcctctagcctgatggctcgcaaactcgaatttggcacagactccacgttcaaggccttctctgctatgcccaaaaccagcctgtgcttttatattgtggaaagagagtactgtaagtcctgcagcgaggaagatacacaaaagtgtgttaacaccaaacttgagcagccccagtctatcctgattgaacacaaggggacaatcattggaaaacaaaacaatacctgcacggccaaggcctcctgctggctcgagagcgtgaaatctttcttttatggcctgaagaacatgctgtccgggatcttcggaaatgtctttgtgggcatcttcctctttctggctcctttcattcttctgatcctctttttcatgtttgggtggcggattctgttctgttttaagtgctgtcgcagaacccggggcctgttcagatacaaacaccttgagaacgacgaagagacaggatatcgccggatcattgaaagactcaataacaagaaaggcaagaataaactgctggacggggagcgcctcgcggatcggagaatcgccgaactgttcagcaccaagacacatattgga

SEQ ID NO: 14135 - RNA, 1932 nt, synthetic construct
  misc_feature 1..1932: note = derived and/or modified CDS sequence (opt5) from CCHFV(SPU 45/88)__KJ682809.1__Gc
  source 1..1932: mol_type = other RNA
ttcctggacagcatcgtgaagggcaaaaagaacctccttaattccacctctctggagacaagcctgtccattgaagccccctggggagctatcaacgtccagtctacgtttaaacctaccgttagcgccgcgaatattgctctctcctggtctagcgtggagcacagagggaacaagatcctggtgtccggccggagcgaatctattatgaaacttgaggaacgcacagggatctcctgggatctgggagtcgaggacgccagcgagtctaagctcctgaccgtgtccgttatggatctgagccaaatgtactctccggtgttcgaatatctctccggcgacagacaggtcgaggaatggcccaaggccacatgcaccggggattgtcctgagcggtgcggatgtacaagctctacctgcctgcataaagagtggccccactctcgcaattggagatgtaaccctacgtggtgctggggcgtgggcaccgggtgtacatgctgtggacttgacgttaaggatctgtttaccgactacatgttcgtgaaatggaaggtcgattatatcaaaacagaagctattgtgtgcgtggagctcaccagccaggaacggcagtgttccctgatcgaggccggcacgcgctttaatcttgggcccgtcacaattaccctgagcgaacctagaaacatccaacagaagctcccgcccgagattgttacactgcatcctcggatcgaggaaggattctttgacctgatgcacgtgcagaatgtgctctctgcttccaccgtctgcaagctgcagagctgcacccatggcgtgcccggggatcttcaaatttaccacatcggaaacctgctcaaaggcgacaaggttaatggccacctgatccataaaattgagcctcacttcaacacatcttggatgagctgggatgggtgtgaccttgactattactgcaatatgggagattggccctcctgttcttatacgggcgtgacccagcataaccacgccgcgtttgtcaatatgctgaacatcgaaacagactacaccaagaacttccactttcatagcaaacgcgtgacagcccacggggataccccgcagctcgacctgaaggctagacctacgtacggagccggcgagattacagttctggtggaagtcgctgatatggagctccataccaaaaagatcgagatttccgggctgaagttcgccagccttacctgcacaggatgttatgcgtgctcctccggcatcagctgtaaagtgcggatccacgtcgacgaacccgatgagctgaccgtgcatgttaagtctgaagaccctgatattgtggccgcttccagctccctcatggcccgcaaactggagtttggcacagactctacgttcaaggctttcagcgccatgcccaaaacctccctttgcttttacatcgtcgaaagagagtattgtaagtcttgcagcaaggaggatacacagaaatgtgtgaataccaagctggaacaaccccagtccattctcatcgagcacaaagggacaattatcggaaagcagaacgatacctgcacggccaaagctagctgctggctggaatctgttaagtccttcttttacggcctgaagaatatgctcagcgggatcttcggaaacgtgtttattggcatcctgcttttcctggcgccttttattatgctcatcctgttctttatgttcgggtggcggattctgttttgtttcaaatgctgtcgcagaacccggggcctttttaagtatagacacctcaaagacgacgaggagatcggataccgcaagattatcgaacggctgaataacaaaaagggcaagaataaactgctcgacggggagagactggccgatcgcaagatcgctgaacttttctctacaaaaacccatattgga

SEQ ID NO: 14136 - RNA, 1932 nt, synthetic construct
  misc_feature 1..1932: note = derived and/or modified CDS sequence (opt5) from CCHFV(SR3)__AJ538199.1__Gc
  source 1..1932: mol_type = other RNA
ttcctggacagcatcgtgaagggcatgaaaaacctccttaattccacctctcttgagacaagcctgtccattgaagccccctggggagctatcaacgtccagtctacgtacaagcctaccgttagcacagccaatattgcgctctcctggtctagcgtggagcacagagggaacaaagtgctggtctccggccggagcgaatctatcatgaagctggaggaacgcaccgggatttcctgggatctgggagtggaggacgctagcgagtctaaactcctgacagtttccgtgatggatctgagccaaatgtattctccggtctttgaatacctctccggcgacagacaggtggaggaatggcccaaggctacctgcacaggggattgtcctgagcggtgcggatgtaccagctccacgtgcctgcataaggagtggccccactctcgcaattggagatgtaaccctacctggtgctggggcgttggcacagggtgtacctgctgtggacttgacgtgaaagatctgttcacagactatatgtttgtcaagtggaaagtggaatacatcaagaccgaggccatcgtgtgcgtcgaactcacgagccaggagcggcagtgttccctgattgaagccggcacacgcttcaatcttgggagcgttaccatcacactgtctgagcccagaaacattcaacagaaactccctccggagatcattaccctgcatcccaagatcgaagagggatttttcgatctgatgcacgtgcagaaggtgctctccgccagcaccgtctgcaaactgcagtcttgcacacatggcgtgcctggggaccttcaagtttatcacattggaaatctgctcaagggcgatcgggtgaacggccacctgatccataaaatcgaacagcactttaatacgagctggatgtcctgggacgggtgtgatcttgactactattgcaacatgggagactggccctcttgtacctacacaggcgtcacccagcataatcacgctagcttcgtgaacctgctcaatattgagacagattacaccaagacgtttcacttccattccaaacgcgttacagcccacggggacacccctcagctggatctgaaggcgagacccacctatggagccggcgaaatcacagtgctcgtcgaggtggctgacatggagctgcataccaaaaagattgaaatcagcgggcttaagtttgccggactgacatgcacgggctgttacgcttgttcttccggcattagctgcaaagtccggatccacgtggatgagccggacgaactcaccgttcatgtgaagtctgatgaccctgatgtcgtggccgcgtccagctccctgatggcccgcaaacttgagttcgggacagactctacctttaaggctttcagcgccatgcccaaaacatccctgtgcttctatatcgttgaaagagagtactgtaagtcttgcaacaaggaggatacccaaaaatgtgtgaacacgaagctcgaacagcctcagagcattctgatcgagcacaaaggaaccattatcggcaagcaaaataacacatgcaccgctaaagcctcctgctggctggaaagcgtcaagtcctttttctatgggctcaagaatatgctgggaggcatttttgggaacgtgttcatcggcatctttacattccttaccccctttattctgctcatcctgttctttatgttcggatggcggattctgttttgtttcaaatgctgtcgcagaacgcggggcctttttaagtacagacacctcaaagacgacgaggagacagggtatcgcaagatcattgaacggctgaataacaaaaagggaaagaatagactgctcgatggcgagcgcctggccgaccggaaaatcgctgaacttttctctaccaagacacatattggg

SEQ ID NO: 14137 - RNA, 4656 nt, synthetic construct
  misc_feature 1..4656: note = derived and/or modified CDS sequence (opt5) from DUGV(ArD44313)__NC_004158.1__GP
  source 1..4656: mol_type = other RNA
atgagcaagagagtgctgatcattgccgtcgttgtgtacctcgtgttcaccacacagaaccaaatcacgggcaatcacaccacaattaactcctctagcccctccaccacagaggcttctagcacccctacagtctcccggaccccgcagacgaccacaacctctacagccgtgagcaccacgatcacagcgaccacaacccccaccgcttcctggacaacgcagagccagtattttaataaaaccacacaacatcactggcgcgaagagaccatgatttctagaaaccctacagttctggaccggcagtcccgcgccagctctgtgagagaacttctgaataccaagttcctcatgctgcttgggtttatccccaaaggagaggtcaaccatctggaaaatgcctgcaaccgggagggcaagaattgtacggagctcatcctgaaagaacgcattgctagattcttttccgagacagaaaaggagagctgctacaacacctatctggagaagcacctccggtctgtgtcccctgaagttagcctgaccccctaccgcgtgcttgggctgagagaggatatcctcctgaaagaaattgaccggcgcatcattagattcgagacagattcccagcgggtcacctgtctttctgccagcctgctcaagcctgacgtgtttatccgcgaacagagaattgatgctaaaccgtccaatggacccaagatcgtgcctgtcgacagcgttgcctgcatgaacctggaggcgaatgtggatgtgcggtctaacaaactggtcatccaatccctcatgacaacggtgaagattagcctgaagaattgtaaagttgtggtcaactctagacagtgcatccatcagcagaccggcagcggggtgattaaggttcccaaattcgagaagcaacagggaggcacatggtcctcttatatcgccggcgtgtacaccgctacaattgaccttctggatgaaaacaatcagaactgtaaactctttaccgagtgcatcgtcaaggggcgcgaactggtgaaaggacaaagcgagcttaagtccttcaatatcgaagtcctgctccctcgggtgatgaagacgagacgcaaactgctggccgttaccgacggcagcacagagtgtaactctgggacccagctcattgagggaaagtccatcgaagtgcacaaacaggatattggcgggcccggaaagaaactgacaatctgcaatggcaccagcgtccttgacgtgccgctggatgagggccacgggtgttatacgattaacgttatcacatctaagcgggcttgcagacctaaaaattccaaactccagtgcagcatcgacaaggaactgaaaccctgtgactccggaaagtgcctttctattagccaaaaaggcgccgggcatatcaaggtgtcccgcggaaagaccattctgatcacagagtgtaaagaacactgccagattcctgtccccaccggcaagggggatatcatggtggactgttctggaggccggcagcattacctcgaggtgaacattgttgatatccactgccccaataccaaatttctgggcgggatcatgctgtacttctgtagaatgagctcccgccctacagtcgcgctcctgcttggaatttggatcggctgcgggtatattctgacgtgtatctttagcttcctcctgtaccacctgattcttttctttgccaactgcatcaagcagtgtcggaaaaagggagagagactcggcgaaatctgcgtgaagtgcgagcaacagaccgtgaatctgatggaccaggaactgcatgatctcaactgtaatttcaacctgtgcccgtattgttgcaatcgcatgtctgacgaggggatgtcccggcacgtcggcaaatgtcccaagagacttgagcggctgaacgaaattgagctctacctgacaaccagcgaatgcctgtgtctttctgtgtgctatcagctcctgatctccgttggaatttttctgaaacgcacaacctggctcgtggtcctgcttgtgctgctcggcctggctatcagccctgttcaaggggcccccacggaggtgtctaacgtcaagcaggatggagactacagcatttgttatttcatctttggctgcctggtgacagctgcccttctcctgaaagttaagagaaccaattccaacgggatcgtggtcgtggtggatagcttcggacggtgtccttactgcaatgaatttaccgactctctgttcgaggaggtcctccatgatacactgtgctccctttgtgtttgccccttttgtgaaaaacaggccctggacctcgtgaccctggaggaacacgtgaaggagtgctacaaggtcgctacaagaaaagacattttcaagatcctgggccgcaaatttacgaacgcgcttgtgcggagagaaaaactcttcaccacagggctgcagctgtttattaataaaaccaacgttgtggtcttcgccctcatcatgtgtttcctgcttctgctcacaggccataatgctagcgcctttgattccggagacctgccggatggcgtgtgggaggagtctagccaactggttaagtcctgcacccagttctgttatattgaagaggacgtgtgctactgtcctgccgaagatggggtcggacgcaaacttctgtttttcaacggcctccaaaattctgtgaagagactgagcgactcccacaagctcctgacgtctgttagcatcgatgctccctgggggcggatcaacgtggagtccacctggaaacctacacttgccgcgagcaatattgctatgtcttggtccagcaccgacatcaagggagaaaaagtcattctgtctggccgctccacaagcatcattaagctcaaggagaaaaccggggtgatgtggaagctggtgggctctggactggcctccgagaaaaagaaaccctttagattccctatcatggattttgcccaggtctataacagcgttttccagtacattacaggcgaccggcttctgtccgaatggcccaaggctgtgtgcaccggggattgtccgcaccgctgcggatgccagacgagcacatgtatggccaaggagtgccatacccaggaatgtgtgtctacccacatggtcctcggcatcgggacaggatgcacctgttgcggcatggacgtggagagaccttttaataaatatctgggggttaagtggagcacggagtacctccggacagaagtgctggtctgtgtggaggttaccgaagaggaacgccattgcgagatcgtggaggctggcacaagattcaacattggacccatcaccattacaatctccgatccccaaaatattggctctaaacttcctgaaagcctgatgaccgtccaggagatcgacgactccaactttgtggatatcatgcacgtcgggaacgtgatttctgccgacaatagctgtcggctccagtcctgcacgcacggatctgcggttaccacacgcttcaccgccctgacagctctgatcaaggatgaccatagctccggccttaacctggccgtgctcgatccgaaagtcaatagctcttggctgtcctgggaagggtgtgacatggattattactgcaacgtgggagactggcctacctgcacgtacacaggcgttgtgacccagaagctcagagagtttctgaaacttgatcaacaccggaagagactgcatacaaccctgagcttctctctcaagaaaaatctgtccaagcgcagccacacctccgtccggcttgaaggcaaaacagtgacgagaatggaggtgaaggttaccgctctgattgaggtcgacgggatggaactccattctaaaacaatccgcctgagcggcattcggctcaccggactgaagtgttccgggtgcttcagctgtacatctggaatctcctgcagcgtgaacgccaaacttacctctcccgatgagtttacgctgcacctgagaagcacatcccccaatgtggtcgtggcggaaacctctatcattgcccgcaagggccctagcgctaccacatcccggttcaaggtgttttctgttagagacaccaaaaagatctgtttcgaggtcgtggaacgcgagtattgcaaagattgtacacccgacgagctcacgacctgcacaggggttgaactggagcctaccaaggacattcttctggaacaccggggaacaatcgtgcagcatcagaacgatacctgtaagagcaaaattgactgctggtccaatagcatctcttcctttgccagcggcattggcgatttctttaagcactacatcgggtccatcgctgtcggagtgctcggcacggttctgcccttcgccctcctgattctgtttttcatctatggggacaaaatgctttggccgtttaaggtgttctgtagaccttgccggcgctgctgtagaaagaacgagggatacaataagctggccgaggaagaggaactccgggatattatccgcaagttctctaaaagcggcgagctgattaacaaggacgctaaagataagagaacccttgcgcggctgtttatgtccgacaatcccaaactcaagaaggaaaagaagctgtctgagatcgcctga

SEQ ID NO: 14138 - RNA, 4656 nt, synthetic construct
  misc_feature 1..4656: note = derived and/or modified CDS sequence (opt5) from DUGV(IbAr1792)__KU925456.1__GP
  source 1..4656: mol_type = other RNA
atgagcaagagagtgctgatcattgccgtcgttgtgtgcctcgtgttcaccacacagaaccaaatcgctggcaatcacacgaccgccaactccgggtctcccagcacaaaagaggcgtcctctatgcctaccgtcagcgacacaccgcagaccacaaccacgtccaccgctgtgtctacaaccattacagccaccacgacacccaccgccagctggacaacccagtcccagtactttaataagaccacacaacatcactggcgggaagagacgatggttagccgcaaccctaccgtgctgaatagacagcggcgcgcttcttccgtcaaagaacttctgaacacaaagttcctcatgctgcttggatttatccccaaaggcgaggtgaatcatctggaaaacgcctgtaatagagaggggaagaactgcaccgagctcattctgaaggaacggatcgctcgcttctttagcgagacagaaaaagagtcttgttataatacctacctggagaagcacctctgctccgttagccctgaagtgtctctgacgccctatagagtccttggactgcgggaggatatcctcctgaaaaagattgaccgcagaatcattcggttcgaagccgattcccagcgcgtgacatgtcttagcgcgtccctgctcaaacctgacgtgtttatcagagagcagcggattgatgccaagccgtctaacggccccaagatcgtccctgttgacagcgtgcgctgcattaatctggaagctaacgtggatgtcagatccaataaactggtgatccaaagcctcatgaccaccgttaagatctctctgaaaaactgtaaggtggtcgtgaactcccggcagtgcattcatcagcagacagggagcggagttatcaaagtgcccaagttcgagaaacaacagggcggcacctggtctagctacattgccggggtctatacagctacgatcgaccttctggatgagaagaatcagaactgtaagctctttaccgaatgcattgtgaaaggaagagagctggtcaagggccaatccgaacttaaatctttcaatatcgaggtgctgctccctcgcgttatgaagacacggagaaaactgctggccgtgaccgacgggagcacagaatgtaactccggaacccagctcatcgagggcaagagcattgaggtccacaagcaggatatcgggggacccggcaaaaagctgacgatttgcaatggcacctctgtgcttgacgttccgctggatgaagggcacggatgctacacaatcaacgtgattacctccaaacgcgcgtgtcggcctaagaatagcaaactccagtgctctatcgacaaggagctgaagccctgtgactccggcaaatgccttagcatctcccaaaagggggccggacatattaaagtctctagaggcaagacaatcctgattaccgaatgtaaagagcactgccagatccctgtgcccacggggaagggagatattatggtggactgtagcggcggccgccagcattatctcgaagttaacatcgtcgatattcactgccccaatacaaagtttcttgggggaatcatgctgtacttctgtcggatgtcctctagacctaccgtggctctcctgcttggcatctggattgggtgcggatacatcctgacatgtatttttagcttcctcctgtatcacctgatccttttctttgccaactgcattaaacagtgccgcaagaaaggcgagcggctcggggagatctgtgtgaagtgcgaacaacagaccgtcaatctgatggaccaggagctgcatgatctcaactgtaatttcaacctgtgcccgtactgttgcaatagaatgtccgacgaaggcatgagccgccacgtgggaaaatgtcccaagcggcttgagagactgaacgagatcgaactctatctgaactacaaacgggttccttcttgcctgcgctgtatgctttccaccagcatttctgtgggcatctttctcaagagaacaacgtggctggtcgtgctgctcgttctgcttgggctggctatttcccccgtgcagggagcccctgccgaggtcagcaatgtgaagcaagatggcgactattctatctgctacttcatttttgggtgtctcgttaccgctgcgctgctgcttaaagtgaagcggacaaacagcaatggaatcgtcgtggtggtcgattccttcggcagatgcccctattgcaacgaatttaccgacagcctcttcgaggaagttctgcatgatacactgtgttctctctgcgtgtgtccgttttgcgagaaacaggccctggaccttgtgaccctggaggaacacgtcaaggagtgttacaaagtgacgacacgcaaggacatcttcaagattctcgggcggaaatttaccaatgctctggttagacgcgaaaagctgttcaccacaggccttcagctctttatcaacaaaaccaatgtggtcgtgttcgccctgattatgtgcttcctgctcctgcttacaggacataacgcctccgcttttgatagcggcgacctgcctgatgggatctgggaggaatcctctcagctcgttaagagctgtacgcaattctgctacattgaggaggacgtgtgttattgccccgccgaaaatggagtcggcagaaaactgctgtttttcaacgggcttcaaaattccgtgaagcggctgtctgatagccacaagctcctgacctccgtttctatcgacgcgccttggggagctatcaacgtggagagcacatggaaacccaccctcgccgcctccaatattgctatgagctggtcttccacagatatcaagggcgaaaaagtcattctgagcgggcgctctacctccatcattaaacttaaggagaagacgggcgtgatgtgggaactgggaagcgagctcgcctctgagaagaaaaagctgctggtgtccatcatggactttgctcaggtctacaacagcgttttccagtatattaccggcgatagacttctgtccgaatggcctaaagccgtgtgtacaggggactgcccccaccggtgcggatgtcagaccagcacatgcatggcgaaggagtggccgcatacccgcaattggagatgtaaccctacatggtgctggggcatcgggaccggatgtacgtgctgtggcatggatgtggaacggccctttaacaaatacctcggggtcaagtggtctacagagtatctgcgcaccgaggtgctcgtttgcgtggaagtcaccgacgaggaaagacactgtgagatcgtggaagccggcacacggttcaatattggacccatcaccattacgatcagcgatcctcagaacattggctccaaactgccggagtctcttatgacagttcaggagatcgacgacagcaattttgtggatatcatgcatgtcgggaacgtgatttccgctgacaattcttgccgcctgcaaagctgtacccacggatccgccggcgattaccagatctattctacagacagcctcattaaggatgaccactccagcgggctgaacctggctgtccttgatcccaaggttaattcttcctggctgagctgggaaggatgcgacatggattactactgcaacgtgggcgactggcctacctgtacatataccggcgtggtcacgcaaaattctgagtccttcagcaacctcatcaatattgaaaaagattacacccagagatttcatttccactccaagcggatctctgccaaagggcatacactgcagctcgacctgaaggcgagacccaaccaggatggaggcgaggtgaccgcccttatcgaagttgacgggatggagctgcacagcaaaacaattcgcctgtccggaatccggctcaccggcctgaagtgcagcgggtgtttttcttgcacgtccggaattagctgttctgtgaatgctaaacttacaagccctgacgagttcaccctgcatctcagatccacatctcccaacgtcgtggtggccgaaaccagcatcattgctcgcaagggcccttccgccaccacatctaagttcaaagtttttagcgtccgggatacgaagaaaatctgcttcgaggtggtggaaagagagtattgtaaggactgctcccccgatgaactgaccacatgtaccggcgtcgagctcgagccgcctaaggacattctgcttgaacaccgcgggacaatcgtgcagcaccagaatgatacctgcaaaagcaagatcgactgttggtctaactccattagctcctttgcctctggaatcggcgatttctttaaacattacattgggagcatcgctgttggcattctgggaacggtgctgcccttcgcgctcctgatcctgtttttcatctatggggacaagatgctgtggccttttaaagtcttctgccggccctgcagacgctgttgccggaagaacgagggatacaataagctcgccgaagaggaggaactgagagatattatccggaaattttccaagtctggcgagctcattaacaaagacgctaaggataaacgcacactggccagacttttcatgagcgacaatccgaagctgaagaaagaaaagaaactgtccgagatcgcctga

SEQ ID NO: 14139 - RNA, 4884 nt, synthetic construct
  misc_feature 1..4884: note = derived and/or modified CDS sequence (opt5) from NSDV(Jilin)__NC_034391.1__GP
  source 1..4884: mol_type = other RNA
atggtgagcctggagaagggcctcatcctgcttctgctcatgcacattgccatcgcttccaccgggggatctctgggccttcccgggctgaacggagaagaccatacagatgaccctgaggtcggcggggatggaccgacggaagagtacaccgaagacgatcccgagagcacaaccgtttccattcctacaacaccccctgtgctcggccagggcacagaggaagtgcccgccacctctggggaggcggaagctggatatagcacgaccgacgtccctgatacagtgtccgagaaagttgaggacgaacaagataccacaccgtctacccaggtgacgcccgaccagcctgagcagagcacaacctccctgcccgatccttggacagccatcagcaccagaattggccgggaactgctctctgtcgagtccgacaccacaaagagctctctggtgacggttgggcacccccaacagccgatcttccttgatggacagcctgtggaagaggtcacccatcccgtgaatgagcgcgacgtgacagaagccctgagaaaatacgacaagatgaaaaagctcctgtcccagcggatccttagcaagatgggcatggctcgcgattttaccgacgaggaactggatgtctggtgccacgagagattcgacaactgttcttccaatgatattgaaaaccggatccgcgactttttcctcattagcgatcaaacagagtgctttgacgaggttctggtgaaaagactgtgtgaatccaccaatcctatcgtgggggagccctggcaggtcgccggaattaaggaagagatcgtgcggcgcgaaatgggcagacggattttccgctttttcacgcccacactcaaagttacctgcgtgtctggcagcctgaacccttccgatcagtttgtcagattctatgacccggtgatcgagcggaccagcgggcccacaatccagaattacgattctatgcattgtcttaacattgagaatggactggctaagccttccaaaatggttgtgctcaacgtcctgatgaccacagtggaagtccgccttgagagctgcagagcctttatcaatgcgcaccaatgtatttatacgcagcacgccgacggccaggtgatggttcccaccttcgtggaccattctgggacacggagaaccatcggagcttacacaatgagctttaacctgaccgatgaacgcaatcgggcctgcattatcagaacgacctgtgtcgtgaagggcaaggaggttaaaaaggggcaatcccagctccgcggattccctacatctatccggctgttcaaaagcgtgaccggcaagagacgcctgatggctgaggaaggcgactggacagattgcgggtccggaacccagctcgacatgacgatggccgtcagcgtgcacaacgataaaaagggcgggcccggaaagaagctgacaatttgtaatggcaccacagtgtctgactccacccttaacgaggggctgggctgctataccatcaacaaggttattacaggaaaagcgtgcaaggtcggcaatagcacggggtcttgtgaagtgcagaccgagctccaaaaatgcgaaacaggaaagtgtatcctggtgaaacagaagtccaagggcgtcgtgaaacttaagcgggggaaaaccgttattatcacagagtgccagggaagctgtctgtttgccatcccgcaggataccggcgacattacgatcgattgctccgggggcagacaacattacctcgagattaacatcgtggacattcactgtcctggaaaggataaatggaagggcttcatgctgtacatctgccgcgtctctagccggcccctgattgctctcacatttgggctgtggcttgccgctggatatctgatcacctgtctcgtgtccttcatcatttacaatgccgttctgctgctttctatcgccattaagaaagtgagacagggccgcgaaaagaaaggggacctctgcatcaagtgtgagcagcactgcatgaacctgtatgatcaggaactgcatgagctcaattgcagctttaacctgtgtccttactgcgctaatcggctttccgacgaaggactgcccagacacgtccctcggtgtcccaaaaagagcgagcgcctcgaggaaattgagctgtatatcaactacaccagagtgccgtgcatcctgcggtggattctttctacatccgttcaagtgggcaccgcggtcaagagactcagctggttctctgtgctggtgacactgtttatcctcacgatttcccctgtccaggggttccccctggaatctccccctatcggcgccgctaccgacagccgcattatgtatggagttgtgggctttatgttcgcccttatcatgatgctgaatctcaaaaagagccattacgggtccatctttcacgtgattgatggattcggccggtgtaacctgtgcgacacaagaatcgatagcctgatggaggaaaccgcccatgacctttgttgcatgtttgattgttgcccgtactgtcaccgcgtctctgagtccaatgggagccactgcttccatgtgagaatttgcgttgctaaagagatctccaagaaaatgctcaaggccggaggccggctgttcacaaacaaactggtgtctcgcgaagggacctttgcgaatcggattcagctcctgtatagacgcagcaaggtcgtgtccacgcttgttgtgaccgtcctgctcctgctggtgcttctcaagcccacaaccgctttcgactctggccctctgcccgatggaacatgggaggaagaggagaaactggttagaaactgtggccaggaatgcatcctcgaccaaggggagtgtctgtgccctggagaacaccgggccggccgcaaacttctgtttctcaatgggctgcaggatgccgctagacggatgaccgagagccatcgcctgcttacatccgtgtctatcgacgccccctggggagctattaacatcgaaagcaccttcaaacctgtcctggccgcgtccaacattgatctcagctggaactctgccgaggagcagggcgacaagatcattctgtccggcagaagcacggggatcattaaactccaagaacggacaggactgatgtggaagatgtcttccgagaaggctagcgaatctaaaaatcttctggtgtccgtgatggattttagccagctctacaattccatcttccagtatatcaccggcgacagaagcctgtctgagtggcccaaggccgtctgtaccggggactgcccggatcgctgtggatgccagacaagcacctgttaccacaaagaatggcctcacacgcggaactggagatgcaatcccacatggtgttggggcattgggaccggatgcacatgctgtggcatggacgttgagcgctattttaacaagtacttcggcgtgaaatgggctctggagtatgtgcggaccgatgtcgtggtttgcgtggaacttacaaatgaggaaagacattgtgacctggtccaagccgggtcccgcttttctatcggacctgtgagcgttaccctctccgatccccagaacgtggtcaatcggctgtctagcaacattatgacgatccaggagattgcggacaatggcatcctcgatctgatgcacgtgtccaaggtcatctctgccgaaaacgcttgcaaacttcagagctgtacccatgggtccccgggagacctgcaaattctccacacagataatctgatcaagggcgacatgagcgggggaattaacctggcccatcttgatcctcaggtgaatacctcttggatgtcctgggagggctgcgacctggactactactgtacagttggcgattggcccagctgcacctatacgggggtgaactctatcaacacagactccttcaccaatctcattaacacagagaccgattacaccggaaagtttcacttccacagcaaaagaatctccgctcgcgacgatacactgcagatggacctcaaggcccggcctaattctggcgggggagaaatgacggtcctggtggaggttaacggccttgaactgcatagcaaaagaatctccctgaaggggctccggctgaccaatcttaagtgtgatggatgctttgcctgtagccagggcctgacatgcaccattacagctaaactcgagtctcccgacgagttcaccatccatctgcgctccacgagcagagatgtggtcgtggcggaaacatctgtgaccgcccggaaggttgagaccggcgctcgcagcgggttcagagcctttgccgtccgggacgtgaaaaagctctgcctggaagtggtcgagaaagattattgtccctcctgcacagtggaagaccttaagatttgtgttgatgtgtctctggagcctccgaaagacatcctgattgagcacaagggaaccatcattcaacactacaacaagagctgcgacgaaggctataattgttgggtcgggtccgtgtctggattctttgttggcgtgaaagatttctttgagaagaacctcgggggagtcctgatcggccttgtgagcacaatcctgcccctcgttctgacggtcctcttctttatttacggcaaaaagctgttctgcctttgtagactgtgccataaaaagtgttgccgcgggtccggacggggcagagacgggtatagccgcctgtctcaggaagaggaaatcaaggagattatcaaaaagttttcccggaatggagagctcctgggcaaaggggaaaacgataagagaaccgtggctcgcatgttcatggacggacagagcaccaaaaaggccattaaggaggtggcgtga

SEQ ID NO: 14140 - RNA, 4884 nt, synthetic construct
  misc_feature 1..4884: note = derived and/or modified CDS sequence (opt5) from NSDV(708)__EU697952.1__GP
  source 1..4884: mol_type = other RNA
atggtgagcctggagaagggcttctttttcctcctgcttctgcacatcgtcaccgcctccacagggggaccccctggcctcccggggcccaacggaaaagaccagacggatggccctgaagggggaggcgacggccccaccgaggaatacacagaggatgactttgaatctaccacattcagcattcctaccacaccccctgtttccgagcaagatgctaaggaggtgtctgccaccagcgaagaggcggaagtggaggactccacgctgatcgtcccgaaaaccatgtctgagaaggtgggggatgaacagagcacaacctccaatatgcaggttacaaccagccagcccgagcaatctacgacaggaatgcctggcccctggatggcttccagcattaaaatcgggagagaacttctgtctgtggagtccgacaccacaaagagctctctcgtcaccgtgggatatcctcagcagcccatttttctggatggccagccggttgaagaggtgacccatcctgtctccgagcgggacgtggccgaagccctgcgcaagtacgataaaatgaagaaactcctgagccaaagaatcctttccaagatggggatggctcgggacttcacagatgacgagctggacgcctggtgccacgaacgctttgataactgttctagcaatgacatcgagaacagaattaaagatttctttctcatctccgaccagacggaatgcttcgatgaggtgctggtcaagcggctttgtgagagcaccaatcccattatcggagaaccttggcaggttgctggcattaaggaggaagtggtgcgcagagagatgggccggcgcatctttagattctttacacccaccctgaaagtcacatgcgtgtctgggtccctcaaccccagcgaccagttcgttcggttctataatcctgtgattgaacgcacctctggaccgacgatccaaaactacgatagcatgcattgtctgaatatcgagaacggcctgattaagccctccaaagtcgtgatcctcaatgttctgatgacaaccgtggaggtcagacttgaatcttgccgggcctttgtgaacgcgcaccagtgtatttatacccagcatgccgacgggcaagtccgcgtgcctacattcgttgatcacagcggaaccaagagaacaatcggcgcttacacgatgtcctttaatctgaccgacgagcggaacaaagcctgcattatcagaacaacctgtgtggtcaaggggaaagaagtgaagaagggacagagccagctccgcggcttccccacatctatccggctgtttaaatccgttaccggcaagagacgccttatggctgaggagggggattggacggactgcggaagcggcacccagctggacatgacaaccgccgtgtctgtccacaatgatcggaaagggggacctggcaagaaactcacaatttgtaacgggaccacggtgtccgacagcacactgaacgaaggcctgggatgctataccatcaataaggtgatgacaggcaaggcgtgcaaagttgggaactccaccggatcttgtgaggtccaacccgaactccagaagtgcgagaccggcaaatgtattctggtgaagcagaaaaataagggggtggtcaagctgaaaagaggaaagacagtgatcattacggaatgccagggcagctgtctgttcgccatcccgcaagataccggggacatcacaattgattgctccggcggacgccagcattacctcgaggttaacatcgtggacattcactgtcctggcaaagataagtggaaagggtttatgctgtacatgtgccgggtctctagcagaccccttatcgctctgaccttcggactctggctggccgctggctatctgattacatgtctcgtgtcctttatcatttacaatgccgttctgcttctgagcatcgccatcaagaaggtgcgccaggggcgggagagaaaaggagacctctgcattaagtgtgaacagcattgcatgaacctgtatgatcaagagctgcacgaacttaattgctctttcaacctctgtccttactgcgctaatcgcctgtccgacgagggcctgccccggcacgtccctagatgtcccaaaaagaccgaacggctcgaggagatcgaactgtatattaactacacgcgcgtgccgtgcatccttagatggattctgagcacatctgttcaggtggggaccgcggtcaaacggctctcctggtttagcgtgctggtgatcctgttcgtccttaccatctctcctgttcagggctttcccctcgagaatacacccattggaagcaccacagattccagaatcatttatggcgtggtggggttcatcttcgccctgattatgatgctgaacctcaagaaaagccattacggatctatctttcacgtcatcgacggcttcgggcgctgtaatctgtgcgatacgcggattgactcccttatggaagagaccgctcatgacctgtgttgcatctttgattgttgcccttactgtcacagagtgagcgaatccaacggatctcattgcttccacgttcgcatgtgcgtggccaaggagattagcaagaaaatgctcaaggccgctggcagactgtttacaaataaactggtctcccgggaggggatcttcgccaaccgcgtgcagcttctctatagacggtctaaggttgtgagcacctttgtcgtgacagttctgctgctcctggtgttccttcgcccggcgaccgcttttgactccggccccctgcctgatggaacgtgggaagaggaagagagactcgtccggaactgtggccaagagtgcgtgctggaccaggatgaatgtctgtgccccggggagaatcgcgccggaagacggcttctcttcctgaacggcctgcaggacgccgtgcgcagaatgaccgaatctcaccggctcctgacaagcgtctccattgatgctccttggggagccatcaatatcgagagcacctttaaacccgttcttgctgcctctaacattgacctgtcctggaatagcgcggaagaacaaggagataagatcattctctctggcagatccacaggcatcattaagctgcaggagcgcaccgggctgatgtggcggatgagctctgaaaaagcctccgagagcaagaaccttctggtgtccgtgatggacttcagccagctctacaattctatctttcagtatattacaggagatagaagcctgtccgaatggcctaaagctgtctgtaccggcgactgccccgatcgctgtgggtgccaaacgtctacatgttaccataaggagtggccgcacacccggaactggagatgcaatcctacctggtgttggggaatcggcacagggtgtacctgctgcggaatggacgtggaaaaatatttcaacaagtacttcggcgttaagtgggccctcgagtatgtgcgcacggacgtcgtggtttgcgtggagctgacaaatgaggagcggcattgtgatcttgtccaggctggcagcagattttccatcgggcccgtgtctgtcaccctgagcgaccctcagaacgtggttaatcgcctctcctctaacattatgacaatccaggaaattgccgataatggaatcctggacctgatgcacgtgagcaaagtcatttccgcggagaacgcctgcaaacttcaaagctgtacccacggctctcccggggatctgcagatcctccatacagacaacctgatcaagggagatatgtccggcgggattaatctcgctcacctggaccctcaggtgaacaccagctggatgtcttgggaaggatgcgatcttgactactactgtacggttggcgattggccgtcctgcacctatacaggcgtgaatagcatcaacaccgactccttcacaaatctgattaacaccgagacggactacacatctaagtttcatttccacagcaaacggatctccgccagagatgacaccctccagatggatctgaaggctcggcccaatacagggggaggcgagatgaccgtcctggtggaagtgaacgggcttgagctgcatagcaagcgcattaatctcaaaggactgagactcaccaacctgaagtgtgacggctgctttgcctgttctcaagggcttacatgcacggttatcgccaaactggtctcccctgatgagttcaccatccatctgcggagcacatctcgcgacgtggtggtcgctgaaaccagcattacagcgagaaaggtggataccggagcccggtcctcttttagagctttcgccgttcgcgacgtgaaaaagctctgcctggaggtcgtggaaaaagattattgtcccagctgcacggttgacgatcttaagatgtgtgtggacgtctccctggagccccctaaggatatcctcattgaacacaaaggcacaatcattcagcactacaataagtcttgcgacgagggctataactgttgggtggggagcgtttccggatttttcgtgggcgtcaaagactttttcgaaaagaatcttgggggagtgctcatcggcctggtggggaccattcttccgctggtcctgaccatcctcttctttatctacgggaaaaagctgttctatctttgccggctgtgtcacaagaaatgctgtaagggcagcggcagagggcgcgatggatactctcggatttccagagaggaggaaatcaaagagattatcaagaaatttagccgcaacggcgaactcctggggaagggagagaatgacaagcggacagttgccagaatgttcatggatggccagtccaccaaaaaggctattaaagaagtggcctga

SEQ ID NO: 14141 - RNA, 4875 nt, synthetic construct
  misc_feature 1..4875: note = derived and/or modified CDS sequence (opt5) from NSDV(779)__HQ286599.1__GP
  source 1..4875: mol_type = other RNA
atggccctggtggctaagggcctcatcctgatgcttctgctctacatgttcaaagccagcgaggtcaacctggaacttccctcctggaactctaccgaggggacagaatatgcggacgagctgcctacggaaccgcccagcgaggaggaacctaagctcgctgccgtttccaccgtgacaacccccgcccctcccaaagagtctacagaagataccattgagagccctgacggaggcgagacaatggctccgaccacgcccgcccctgtgaccgattccgcttctaagctggaagaggaacccgggacaacccagcaagcccagagcacacagatgcagaactcccaagcgcctatcggaatgcccgaggcctggagcacctctccgtccagagtcggccggaaacctctgagcgcttctcccgacgtgtccgaacctgatcagaatacggaggcccagacacaccctcccgtttttctcgacgggcgccccgtggaggaagaggaacatagcgtcggaaccagagatgtggcttctgacctgcgggagtacaaccagatgaagcaacttctgtcccagcgcattctcgccaagatgggcatggcggttgatttcacagacgatgaactggacacctggtgctatagacggtacagcaattgttcctctaacgatatcgagagccgcattagagactttttccttatcaccgaccggtccgagtgctttgatgaagtgctggtcaaacgcctctgtgagacaacgagcccgatcattgacagagcctggaagatcgctggcctgaaagaagaggtggtgctgcgggaaatggggcgcagaattttccggtttttcacccccgccctcaaggtcacatgcatgtctggatccctgaatcctagcaaccagtttgttcgcttctataatcccacccttgagagaacatctggccctaccatccagaactacgatgggatgcactgtctgaatattgagaacggactcatcaaacccagcaaggtggtggtcattaatgtgctgatgacgacagttgacatccggcttgaatcctgcagagcttttatcaacgcccaacagtgtacctatacccagcatgccgatggcctggtgcgcgtcccgacattcgtggggcctcacggagagaagcggattatcggcgcttacaccatgtcttttaatctcacagacgaaaagaataaggcgtgcacgattaaaaccacatgtgttgtgaagggcaaagaggtcaagaaagggcaaagccagctgagaggattccccaccacaatccgcctgttcaagtccgtgaccggcaagcggagactcatgagcaacgaggaagagtggacggaatgcgggtctggaacccagctgaatatggccacagctgtctccgtgcataacgataaacttggcgggcctggaaagaaactgaccatttgtaatggcacaaccgttagcgacatcgccctcaacgagggcctggggtgctacacgatcaataagattatcacaggaaaagtgtgcaagaccggcaacacaaccgggtcttgtgaagtccagcccgagcttcaaaagtgcgagaccggaaaatgtattctgatcaagcagaaaaataagggcgtggttaaactcaagcgcgggaagacagtgattatcacggaatgccagggctcctgtctgtttgccatccctcaggataccggagacattacaatcgattgcagcggcgggcggcaacactatctggagattaacatcgtcgacattcactgtcccggaaaagacaagtggaaaggcttcatgctctacatctgcagagtgtcctctcgcccgctggtggctcttacctttgggatttggctgacagccggatatctcatcacctgtctggcgagcttcatcctgtacaatgctattcttctcatctccattgccatcaagaaactgaagcagaagcgggagaaaaagggcgatctgtgcattaaatgtgaacagcattgcatgaacctctatgaccaggaactgcacgagcttaattgctcttttaacctgtgtccttactgcgccaatagactcagcgatgacgggctgccccgccatgttccccggtgtcctaagagaggcgagcggctggaagagatcgaactttatatcaactacacgcgcgtcccgtgcctcctgagatgggctctgtccacaagcgtgcaagtgggaaccgtcattaaacggctctcttggttcggcgtgctgcttaccctgtttttcctcacaatctcccccgttcaggggtttcctctggagaatccccctattggaaccgccacagatagcaacatcatttacggcctggctgggttcatctttgcccttgtgctcatgctgaacctgaagaaaacgcactatggatctgtcttccacgtgatcgacggcctcgggctgtgttccctttgcgataccagaattgacagcctgatggaagagacagcgcatgagctctgttgcgcctttgattgttgcccctactgtcaccaggtttctgaaagcaatggctcccattgcttccacatgcgcatctgcgtgagcaaggagatttctaagaaaatgctgaaggctgccggaaaactgttcaccaacaaacttgtctcccgggaaggctttttcgctaataaaatccagctcctgtatcaaagaagcaaggtggtttccacactgattctcaccgtgctgcttctgctcatcatcctgaagcctgccgcggcctttgactctgggcccctgccggatggaacgtgggaggaggaagagagccttattcgctcctgtgaccaggaatgcgtcctggagcaggatgaatgtctctgccctggcgagcatagagctgggcggcgcctcctgttcctgtctggacttcaagacgccgctagacggatgaccgagagccaccgcctgctcacatccgtgtctatcgacgccccctggggcgccattaacatcgaaagcacctttaaacctctgctggctgcgtccaatattgatcttagctggaactctgccgaggaacagggggacaagatcgtgctgtccggcagaagcacaggaattatcaaactccaggagcggaccggcctgatgtggaagatgtcttccgaaaaagctagcgagtctaagaatctcctggtctccatcatggatttcagccagctttacaactccatttttcaatatatcacaggggaccgcagcctgtctgagtggcccaaggccgtttgtaccggagaatgcccggatagatgtggctgccagacgagcacatgttaccacaaagagtggcctcatacccggaattggcgctgcaaccccacctggtgttgggggattggaacaggctgtacctgctgcggcatggacgtggaaagatatttcaataagtactttggggtgaaatgggccctcgagtacgtccggacggatgtggttgtgtgcgtcgaactgacaaacgaggagagacactgtgacctggtgcaggctggatcccgcttctctatcggccctgttagcgtgaccctttccgatccccagaatgtcgtgaaccggctgtctagctccattatgacaatccaagaaatctctgacaatgggattctcgatgttatgcatgtgagcaaggtcatctccgccgagaacgcgtgcaaactgcagagctgtacccacggatctcccggcgacctccagattctgcacacagataaccttatcaagggggaaatgtccagcggaattaatctggctcatctggaccctcaggtgaacacctcttggatgtcctgggagggctgcgacctcgattatttttgtacggtgggcgactggccgagctgcacctacacaggggtcaattccatcaacaccgattctttcacaaatctgatcaacaccgagacggactatacaagcaagtttcacttccattccaaaagaattagcgcccgcggagatacccttcaaatggacctgaaggcccggcccaatgttggcgggggagaaatgacagtgctcgtggaggtcaacggcctggaactccactctaaaaagatctccctgaaagggcttaagctgagcaatctgaaatgttctggatgcttcgcttgtagccctggcctctcctgcaccgtgattgccagactggagtctcccgatgaatttaccatccatcttcgcagcacatcccgggacgttgtggtcgcggagacgtctgtgaccgctagaaaggccgagacaggcgccaagagctccttccgcgcttttgccgttaaagatgtgaaggaaatttgcctggaggtcgtggaaaaagagtactgtcctagctgctctatcgaagacctcaagatttgtatctccgtcaccctggagccccctaaagatatcctcattgagcacaaggggacaatcgtgcagcactataacaagagctgcgacgaaggatacaattgttggattggctccgtttctgggttctttgtgggagtcaaagacttctttgagaagaacttcggcagcgtgatcattgggatcgtttccaccgtgctgccgcttatcctgacggtcctgtttttcgtgtatggacggagactcttttgcctgtgtcggctttgccataaaaagtgttgccgcggctctagcagaggccgggatgggtactcccgcctgagccaggaagaggaaattaaagagatcattaagaagttcaatagaaacggagagctcctgggcagaggggaaaatgacaaacggacagtggctcgcatgttcatggattctcaatccgcccggaaggcggttaaagaggtcgcctga

SEQ ID NO: 14142 - RNA, 4302 nt, synthetic construct
  misc_feature 1..4302: note = derived and/or modified CDS sequence (opt5) from BUNV__NC_001926.1__GP
  source 1..4302: mol_type = other RNA
atgagaatcctgattctcctgcttgccgtgacccagctggctgtcagctcccccgttatcacacggtgcttccacggcgggcaactcattgccgagcgcaagtctcagacgagcatctccgaattttgtattaaagacgatgtgtctatgcttaagagcgagatcgtgtacaccaaaaacgacacaggaatcttcggccattccaaggtctttagacactggaccattacagattggaaagcgtgcaatcctgtggttaccgctgggggatctatcaacgtgattgaagtcgacaagaatctgaacctggtgacacggaattatgtttgtaccggcgattgcacgatcaccgtggaccgcaagaacgcccagattatcttccagacagataaactcaatcattttgaggtcaccgggacaaccattagcacgggatggttcaagtccaaagccagcgtgacactggacagaacctgtgaacacatcaaggtgtcttgcggcaaaaagacactgcaatttcatgcttgtttcaagcagcacatgtcctgcgtccggtttctccaccgcagcatcctgccgggctctatggccatttccatctgtcagaacattgagcttatcattatcaccatcctggctctctgcattttcatcattatgatcattctgaccaaaacatacatctgttatgttcttatccccgtgtttatgcctattgccttcgcgtacgggtgggcctataatagaagctgcaagaaatgcacgtgttgcggactggcttaccatccctttaccaactgtggctcttattgcgtgtgtgggtccaagttcgagacaagcgatcggatgcgcatgcacagagaatccggactctgccagggcttcaaatctctgcgggtcgcccgcagactgtgtaagagcaaagggtccagcctcatcatttctatcctgctttccgtgctgattctcagctttgttacccctatcgagggaacactgaccaattaccccacggaccaaaagtacacacttgatgaaattgctgacgtgctgcaggccaagacccatgaggattctaccaaatattacatcatcctctatacaagcctgttcggcgcgggcctgaccattatctttgccggggtcgctctcggactgacaattatccttgaggtgctgacgaagattaacgttatcttctgcaatgaatgtaacatgtaccactccaaaaagtctatcaaatatgtgggcgactttaccaataagtgcgggttctgtacatgcggactcctggaggaccctgaaggcgtcgtggtccacaaggccaaaaagagctgcacctactcctatcagattaactgggtgcgggggatcatgatttttgttgctttcctttttgtgatccagaacacaattatcatggtcgccgccgaggaagattgttggaaaaatgaggagctgaaggaagactgcgtgggaccgctcatcgctcccaaagattgtaccgacaaggatcataagacgtacctgagcgaggcgtctctgctcgccaccgctaaaaagattacacaagttgacgccgaaaacgtggagatcctgggcaaaaccatggaatccgccattcgcgtcatcgagagacagaagacataccaccggatgcatcttctggaggctgtgttcctcaataaacactgcgattattacaagatgtttgaacataacagcggctattctcaggtgaagtggagaatgatgattaaaacccaacacttcgacatctgtgccctgcaggccaattcccctttttgcgctcagtgtatcgccgataacagctgcgcccaggggtcctgggagttcgacacgcacatgaactctacatacagctccaaggttgataatttcaaacatgacttttctctgttccttcgcatttttgaagctgccttccccggaaccgcttatgtccacctcctgacaaatatcaaggagaaaaagccttaccaagccgtgagcatgattgaaaagatcaagaagaaatttcccaacaataagctgctcattggctatctggacttcgggaaataccttctgggactctcccatgcgagcacctacgagctgcagcagcggcagctggataaactttatcaaccgaccgagctcacaagatctggcgggcagcagacgtccctggccaacagcgtggtcggccaggctaccaaagaatgtaagaagtacaaagacgtgtcttgcctgtcccctcgctttggaatccccctcgaggatctgattagctgttgcgaccaacctaattataacatctacaagaaacccaagaaagtttataaggcccacgataaggaagagacatggtgcatcaatgaccagcactgtcttgtggatttcgtccccgctgaggccgacaccgtggaaaaactgaagcctatgaaatgctggctcgttgatccgggcaagaacgacgatgtgtactctattgcgatcaaaacatgtcgggtcgtggacaagggggtttgcaccgtgaacagccagaagtggaatattatcaaatgtgattccggacccctgtattacagcgaccatattcctggcgaggacacggggaacgatatcggacactactgcgtctctgccggctgtaagacagacagatatcccatcaatcctgatgtggtgaccgactgcgtctgggaatttacctcccgcaaaagccagtacattgggaagatctccatgcaatctctggaggattatgaaaaagctcttacagaccggctcacccatacactggagacgtacagcttcgcgcccctggagaacctcccgcacattaagcctgtttataaatacatcaccgctcagggcgtggaaaattccgatggaattgagggcgcctttatcacagcctctatccccgctgccgggggaaccagcattggctataacgtgagatccaaggacgggttccctctgcttgatctgatcgtctttgtgaagtctgcggttattaaaagcacatacaatcatatctacgacaccggacccacgatttccatcaacaccaagcacgatgaacactgtacaggccagtgccctagcaatattgagcatgaagctaactggctcaccttctctcaagagcgcacatcccggtgggggtgtgaggagttcggctgcctggccgtgaataccggatgcgtctttggcagctgtcaggacgtgatcagacccgaaacaaaagtttatcgcaaggccgtggatgaagtcgtgatcctgaccgtttgcattacgtacccggggcacacattctgtaccgagatcaacgctattgaacctaaaatcaccgaggagattgaacttcagtttaagacagtggacaccaagacgctcccctatatcgtcgccgtgaataaccataaactgtactctggacagatcaatgacctgggcacattcgggcaaatgtgcggaaacgtgcagaagaccaactccagcattctcggcacagggacccccaaatttgattatacatgtcacggcgcgtctcggaaggacatcattgtcagacggtgctacaataacaatttcgattcctgtaaactgcttaaggaggaaacccagctgatctttaacgacgatcatgacacgattaccgtttataatacaaaccacctcatcggagagctggctatcaagctgattcttggcgatatccagtacaaactgttcaccgagacactcgacctgcaaattgatgccaagtgcgtggggtgtcctgactgctttgaaagctactcctgtaatttccagatcgtgagcaacattgataccatctgctctctcgagggaccgtgcgacacgtttcacaatcgcattagcatcaaagccatgcagcagaactatgctgtcaagctgtcctgtcaaaaagaccccagaccttctggcacattcaagatctgcaatcgggaatacaccgtggttttccatacagtggccaaggatgacaaaattgagatcaacgtcggggatcagaccagctttattaaggaaaaagacgatagatgtaagacctggctttgccgcgtgcgggacgagggaatctccgttattttcgagcccatcaaagcgtttttcggctcttattttagcatcttcttttacattatcgtggtcgtggtcgtgggcttcctgattatctatatttttatgcctatgttcatgaagctcaaggaagttctgaaagctaatgagaagctgtaccttcaggaaatcaaacaaaagtga

SEQ ID NO: 14143 - RNA, 4311 nt, synthetic construct
  misc_feature 1..4311: note = derived and/or modified CDS sequence (opt5) from BUNV(SFCrEq231)__KP063893.1__GP
  source 1..4311: mol_type = other RNA
atgaagatgatcctgctcattatcattctgtgcgtgaaccttgccgctgccaatcccgtcgcgaccagatgtttccacggcgggcagctgatcgctgagacacggagcgccacgtccatttctgaattttgcctcaaagacgatgttagcatgatcaagtccgagatcacctacacaaagaacgacaccggaattttcggccattctaagatctataaaagctggctgattaaggattggaaactttgtaatcctgtgccgacagccgggggatccatcaacgtgattgaagtcaattctgacctgagcctcaccacaaaggcttacgtgtgctcccgcgattgtaccatcacgattgacaaggaggaagcccaaatcatctttcagaccgataaactgaaccacttcgaggttagcggcacaaccctgtcttccgggtggtttaagacaaaagctagcgtgaccctcgacagaacgtgcgagcatattaaggtcacatgtggaaagaaaaccctgcagttccacgcctgctttcggcatcacatgtcttgtgtgcgcttctttcacaatacaatccttcccggcaccatggttaactccatgtgccagaatattgaactgatcattatcctcggcctgacccttatcattttcacactgatggtgatcctcacgaagacctatatttgttacatcctgatgcctctgtttatgcccattgcgtatgcctacgggtgggcttataacaaaagctgcaagaaatgcaattgttgcggactcgcctaccatcctttcacaaactgtggctctcactgcgtctgtgggctgaagtttgaggcttccgatagaatgcggatccatcgcgaaagcggactttgccaaggctacaaatccctgagaatcgcccggctcctgtgtaagtctaaggggagctcccttattatcagcaccctgctctctatgctgctgctctccttcattacacccatcgagggaaccatgacgaattatcctgagacacgccagtacagcctggaagagattgcggacgtggtggaaggccttctgtctgagcagaacatcaaagaatatgtcgttttctacaccagcctctttggctccctgattcttctgctcgccttcatcctgtctatcaccctgacaaaggtgaccaatgctctcgccagaacaaacgtgatttattgcgaggagtgtagcatgtaccacgctaaaaaggggatcaaatataacggagattttacgaataagtgcggcttctgtacctgcgacgaacaggaggatgaagaggggattatcattcacaaggtctccaaaaagtgcacataccggtaccaactgcagtgggccaaaatcatcatgattatccttgtgatgctgctcatgatgcagaacaccattctgatcgttgccgctgaaacagactgttggaccaagaatagcctggagcttgactgcattggaccgctcctgacgatctctgattgttccaacaaagagagcaagaattatgaagaggaagcggccaagctggtgtctcagtccaaaatcacccaagctgacgccgagcaggtcacaattctcggcaacaccatcgatacagccctgaaggctattcgcagccagaaaacctaccaaacgatgcatcttctggaatccgtgtttctcatgaagaattgcgactattactctagcttcgagcccaactccgggtattctcaggccaaatggagactgatcgcgaagacaagccactttgatatttgttcccggcatagcatgcaccatttctgccgctgtgttgctgacggaaccaagtgccagaatggcgattgggactttgccggcgagatgaacaatatctactctaccaaaaacgatttctatctgcacgaccttaatctctttttcacactgcacgaaaccgcctttcctgggacaacggagtccctgttctaccagctcatcgctaagaaaaacaccacaggagccagcaagctgcttggcaaactgattaccaagtacgggaataacaaactcttcgtgggaatctggaagtttggccaatatctgctgacacttccctacgtcaacaccacggaactctctaagacaagacgggagaccattctgaaaacccatcagatcctgacaagatcccagggaggccgcagcgagtctatgagctccgctgaagtgggacagattgccaaggagtgtgcgaatgccaaaaacgtcggctgcatcagccctcggttcgggattcccatcggaaatctcaccgcttgtggcaactctccgaattataagatctacaaaacacctaacaagatttataagtccaataacagaggggaagtgtggtgcagcgaggatgttcactgcctggccgactttgaacccgctgacacggaggtggtcaataaagtgaagaaaatgacctgtttcctttccgatgttaacacacgcgccgacatcttttctattgcgatcagcgcctgccggatggtggataagggagtctgtaccgtgaatggcgctaaatggaacattctgaagtgcgagtccgggctctactatttcacagaccatagagaaggccaagataccggaaatgactttggcgagtactgtatctctcacagctgcaacacggaacgctaccctatcaatcccgatattctgaaggagtgtatctgggaatatcactcccggaaatctaagtacattagcaccatcaacctggagtcccttgaggagttcaaaagagccatgagcgacaagctctctcatacactgatggtgtataactttaaacccaccgctaatctgcctcacattaagccgtcctacaagttcatcacagccaacgggatcgaaaatagcgatggactcgaatctgcctatattctgtccagcatccccgctattggcgggatgtctatcggatacaacattcagaccaaagacaattttcctcttctggatctcatcgttttcgtcaagtccgcggtgattaaaacaacctataaccatatctacgacacgggccccacaatcgggattaataccaaccacgatgagcattgcaccggcccttgtcccacaatcattccgcacaaggaaaattggctgacctttagccaggagcgcacgtcccggtggggatgcgaggagttcggctgtctggccatcaacacagggtgcgtgttcggaagctgccaggacgtcattcaccctgaaaccaaaatctacagaaaggctgtggaagaggaggttgtgcttacagtctgtatcaattttcccggcaacaccttctgcacagaaattaatgccatcgagcctaaaattaccgacgaaatcgagctgcaatttaagacggtggataccaagacactccccaacctgctcgccgttcagaatcataaactgtattctgggcagattaacgaccttgggagcttctcccagggctgtgggaacgtgcaaaagaccaatcagtctatcctgggcgctggaacagtcaaatttgattacgtgtgccacggcgccagccgcaaggacatcattgttcggagatgttataccaacaattacgattcctgcaaactcctgaaggaggaacggtctctgatcttcgcggacaaccatgagacgcttgaagtggctaatacacgccacctgattggggagctccagtttaagatcatgctgggagatattagatataaagccttcgccgaaaagcctgagctcgaaatcgacgctaaatgtgtcggctgccccagctgttttgagtcctactcttgcaacttccaaattgtgaccagcatcgatacagtgtgttccgtcgaggggccgtgcaccctgtttcataatcggatcattatcaccgccgcgaagcagagctatggagttaaaatgtcttgcaagacaaagcctggccccgtggaagagttcacgatttgtaacagaaattaccgcgtgtccttcgctaccatcgacaaaaacgataagattgaaatcaatacaggcgaccagaccagctacatcgtcgagaaagattctcggtgcaagacatggctttgtagagtgcgcgacgaagggatttccgttatctttgagcccctgaaagccttctttggaagctatttctccattgccttttacatcattatcggcatcgctgccctcttcctgattatctatatttttctgcctatgttctttaaacttagagacgtgctgaagaaaaacgagtacctctatctgcaggaactcaagcacaaatga

SEQ ID NO: 14144 - RNA, 4302 nt, synthetic construct
  misc_feature 1..4302: note = derived and/or modified CDS sequence (opt5) from BUNV(GSA/S4/11232/WT)__KM507339.1__GP
  source 1..4302: mol_type = other RNA
atgagaatcctgattctcctgcttgccgtgaccaagctggctgtcggcagccccgttgtgacacggtgcttccacgggggacagctcatcgccgagcgcaaatcccaaacgtctattagcgaattttgtatcaaggacgatgtgtccatgctgaaatctgagattgtctacaccaagaacgacacaggcatcttcgggcatagcaaagtgtttagacactggaccatcacagattggaaggcgtgcaatcctgttgtgaccgctggaggctccattaacgtcatcgaagtggacaagaatcttaacctggttacacggaattatgtgtgtaccggggattgcacgattaccgtcgacaaagagaacgcccagatcattttccagacagatcgcctcaatcattttgaagtgaccggaacaaccatctctacgggctggttcaagagcaaagcctccgtgacactggacagaacctgtgagcacattaaggtcagctgcggcaaaaagacactgcagtttcatgcttgtttcaagcaacacatgtcttgcgttcggtttctccaccgctccatcctgccggggagcatggccatctctatttgtcagaacatcgagcttattatcattaccatcctggctctctgcatcttcattatcatgattatcctgaccaaaacatacatttgttatgtgcttatccccgtgtttatgcctatcgccttcgcgtacggatgggcctataatagatcctgcaagaaatgcacgtgttgcggcctggcttaccatccctttaccaactgtgggagctattgcgtctgtggatctaagttcgaaacatccgatcggatgcgcatgcacagagagagcggcctctgccaggggttcaaatccctgcgggtggcccgcagactgtgtaagtctaaaggaagctccctcattatcagcattctgctttctgttctgatcctctcctttgtgacccctattgaaggcacactgaccaattaccccacggaccagaagtacacacttgatgagatcgctgacgtcctgcaagccaagacccatgaggatagcaccaaatattacattatcctctatacatctctgttcggcgcggggctgaccatcatttttgccggagtggctctcggcctgacaatcattcttgaagttctgacgaagatcaacgtgattttctgcaatgagtgtaacatgtaccacagcaaaaagtccatcaaatatgtcggggactttaccaataagtgcggattctgtacatgcggcctcctggaagaccctgagggggtggtcgtgcacaaggccaaaaagtcttgcacctacagctatcagatctcctgggttaaaggaattatgatctttgtggctttcctttttgtcattcagaacacaatcattatggtggccgccgaagaggattgttggaagaacgaggaactgaaagaggactgcgttggcccgctcatcgctcccaaggattgtaccgacaaggatcggaaaacgtacctgagcgaagcgtctctgctcgccaccgctaagaaaatcacacaggtggacgccgagaatgtcgaaattctgggcaagaccatggagtccgccatccgcgtgattgagagacaaaagacataccatcggatgcaccttctggaagctgtgttcctcaacaagcattgcgattattacaagatgtttgagcacaatagcgggtattctcaggttaaatggagaatgatgatcaagacccagcatttcgacatttgtgccctgcaagcgtccagccctttttgcgctcagtgtatcgccgataactcctgcgcccagggatcttgggagttcgacacgcacatgaatagcacatactcctctaaagtcgataacttcaagcacgactttagcctgttccttcgcatctttgaagctgccttccccggcaccgcttatgtgcatctcctgacaaatattaaagaaaagaaaccttaccaggccgtgtccatgatcgagaagattaagaaaaagtttcccaacaataaactgctcatcgggtatctggacttcggaaagtaccttctgggcctcagccacgcgtctacctacgagctgcaacagtcccagctggataaactttatcagccgaccgaactcacacggagcgggggccaacagacgtctctggcctccagcgtcgtgggacaggctaccaaggagtgtaagaaatacaaggacgtttcttgcctgagccctagatttggcattcccctcgaagatctgatctcctgtggggaccagcctaactataatatttacaaaaagcccaaaaaggtgtataaggcccataacaaagaggagacatggtgcatcaatgatcaacactgccttgtcgacttcgtgcccgctgaagccgataccgttgagaagctgaaacctatgaagtgttggctcgtggacccgggaaagaacgatgacgtctacagcatcgcgattaagacatgccgcgtgatcgataagggcgtttgtaccgtcaattctcagaaatggaacattatcaagtgcgactccgatctgctgtattacagcgaccacgtgcccggggaagacacgggaaacgatattggccattactgtgtgtccgccgggtgcaaaacagaccggtatcctatcaatcccgatgtggtcaccgactgtgtttgggagtttacctctagacgcagccagtacatcggcaagatttccatgcagtctcttgaagattataaaaaggctctcacagaccggctgacccacacactggagacgtacagcttcgcccctctcgagaacctgccccatatcaaaccggtgtataagtacattaccgctcaaggagtggaaaattccgatggcatcgagggggcctttattacagcctctatccctgctgcgggaggcaccagcatcgggtataacgtcagatccaaggacggattcccccttctggatctcattgtgtttgttaaaagcgccgtgatcaagtctacatacaatcacatttacgacaccggccctacgatctccattaacaccaaacatgatgaacactgcacagggcagtgtcccagcaatatcgagcacgaagctaactggctgaccttctctcaggagcgcacatcccggtggggctgcgaggagttcggatgtctggccgtcaataccggctgcgtgtttgggagctgccaagacgttattagacctgaaacaaaggtgtatcgcaaagccgtcgatgaaatcgtgatccttaccgtttgtattacgtaccccggacatacattctgcaccgagatcaacgctattgaaccgaagatcaccgaggagattgaactccagtttaagacagtggacaccaaaacgctgccttatatcgtcgccgtgaataaccacaagctgtactctggccagatcaatgacctcgggacattcggacagatgtgtggcaacgtgcagaaaaccaattccagcattctggggacaggcacccccaagtttgattatacatgccatggagcgtcccggaaagacatcattgtcagacggtgttacaacaacaatttcgatagctgcaaacttctgaaggaggaaacccaactcatctttaacgacgatcacgacacgattaccgtttataatacaaaccatctgatcggcgagctggctatcaaacttattctgggggatatccagtacaaactcttcaccgagacactggacctccagattgatgccaaatgtgtgggatgccccgactgttttgaatcttacagctgcaatttccaaatcgtgtccaacattgataccatctgtaatctggagggcccttgcgacacgtttcacaaccgcatttctatcaaggccatgcagcagaattatgctgtcaaacttagctgccagaaggacccggggccctccggaacattcaagatctgtaacagagaatacaccgtggttttccacacagtggccaaagatgacaagattgagatcaatgtcggcgatcaaacctcttttattaaagaaaaggacgatcggtgcaaaacctggctgtgtagagtgcgcgacgagggcatcagcgttattttcgagcctatcaaggcgtttttcgggtcctatttttctatcttcttttacattatcattatcgtggtcgtgggattcctcattatctatatctttatgcccatgttcatgaagctgaaagaagtcctgaaggctaacgagaaactttacctgcaggaaattaagcagaaatga

SEQ ID NO: 14145 - RNA, 4302 nt, synthetic construct
  misc_feature 1..4302: note = derived and/or modified CDS sequence (opt5) from BUNV(MGD/S1/12060/WT)__KM507340.1__GP
  source 1..4302: mol_type = other RNA
atgagaatcctgattctcctgcttgccgtgaccaagctggctgtcggcagccccgttgtgacacggtgcttccacgggggacagctcatcgccgagcgcaaatcccaaacgtctattagcgaattttgtatcaaggacgatgtgtccatgctgaaatctgagattgtctacaccaagaacgacacaggcatcttcgggcatagcaaagtgtttagacactggaccatcacagattggaaggcgtgcaatcctgttgtgaccgctggaggctccattaacgtcatcgaagtggacaagaatcttaacctggttacacggaattatgtgtgtaccggggattgcacgattaccgtcgacaaagagaacgcccagatcattttccagacagatcgcctcaatcattttgaagtgaccggaacaaccatctctacgggctggttcaagagcaaagcctccgtgacactggacagaacctgtgagcacattaaggtcagctgcggcaaaaagacactgcagtttcatgcttgtttcaagcaacacatgtcttgcgttcggtttctccaccgctccatcctgccggggagcatggccatctctatttgtcagaacatcgagcttattatcattaccatcctggctctctgcatcttcattatcatgattatcctgaccaaaacatacatttgttatgtgcttatccccgtgtttatgcctatcgccttcgcgtacggatgggcctataatagatcctgcaagaaatgcacgtgttgcggcctggcttaccatccctttaccaactgtgggagctattgcgtctgtggatctaagttcgaaacatccgatcggatgcgcatgcacagagagagcggcctctgccaggggttcaaatccctgcgggtggcccgcagactgtgtaagtctaaaggaagctccctcattatcagcattctgctttctgttctgatcctctcctttgtgacccctattgaaggcacactgaccaattaccccacggaccagaagtacacacttgatgagatcgctgacgtcctgcaagccaagacccatgaggatagcaccaaatattacattatcctctatacatctctgttcggcgcggggctgaccatcatttttgccggagtggctctcggcctgacaatcattcttgaagttctgacgaagatcaacgtgattttctgcaatgagtgtaacatgtaccacagcaaaaagtccatcaaatatgtcggggactttaccaataagtgcggattctgtacatgcggcctcctggaagaccctgagggggtggtcgtgcacaaggccaaaaagtcttgcacctacagctatcagatctcctgggttaaaggaattatgatctttgtggctttcctttttgtcattcagaacacaatcattatggtggccgccgaagaggattgttgggagaacgaggagctgaaggaagactgcgttggcccgctcatcgctcccaaagattgtaccgacaaggatcggaagacgtacctgagcgaggcgtctctgctcgccaccgctaaaaagatcacacaggtggacgccgaaaatgtcgagattctgggcaaaaccatggagtccgccatccgcgtgattgaaagacaaaagacataccatcggatgcaccttctggaggctgtgttcctcaacaaacattgcgattattacaagatgtttgaacacaatagcgggtattctcaggttaagtggagaatgatgatcaaaacccagcatttcgacatttgtgccctgcaagcgtccagccctttttgcgctcagtgtatcgccgataactcctgcgcccagggatcttgggagttcgacacgcacatgaatagcacatactcctctaaggtcgataacttcaaacacgactttagcctgttccttcgcatctttgaagctgccttccccggcaccgcttatgtgcatctcctgacaaatattaaggagaaaaagccttaccaggccgtgtccatgatcgagaaaattaagaagaaatttcccaacaataagctgctcatcgggtatctggacttcggaaaataccttctgggcctcagccacgcgtctacctacgaactgcaacagtcccagctggataaactttatcagccgaccgagctcacacggagcgggggccaacagacgtctctggcctccagcgtcgtgggacaggctaccaaggaatgtaagaagtacaaagacgtttcttgcctgagccctagatttggcattcccctcgaggatctgatctcctgtggggaccagcctaactataatatttacaagaaacccaagaaagtgtataaggcccataacaaggaggaaacatggtgcatcaatgatcaacactgccttgtcgacttcgtgcccgctgaggccgataccgttgaaaaactgaagcctatgaaatgttggctcgtggacccgggaaagaacgatgacgtctacagcatcgcgattaaaacatgccgcgtgatcgataagggcgtttgtaccgtcaattctcagaagtggaacattatcaaatgcgactccgatctgctgtattacagcgaccacgtgcccggggaggacacgggaaacgatattggccattactgtgtgtccgccgggtgcaagacagaccggtatcctatcaatcccgatgtggtcaccgactgtgtttgggaatttacctctagacgcagccagtacatcggcaaaatttccatgcagtctcttgaggattataagaaagctctcacagaccggctgacccacacactggagacgtacagcttcgcccctctcgaaaacctgccccatatcaagccggtgtataaatacattaccgctcaaggagtggaaaattccgatggcatcgaaggggcctttattacagcctctatccctgctgcgggaggcaccagcatcgggtataacgtcagatccaaggacggattcccccttctggatctcattgtgtttgttaagagcgccgtgatcaaatctacatacaatcacatttacgacaccggccctacgatctccattaacaccaagcatgatgagcactgcacagggcagtgtcccagcaatatcgaacacgaggctaactggctgaccttctctcaggagcgcacatcccggtggggctgcgaagagttcggatgtctggccgtcaataccggctgcgtgtttgggagctgccaagacgttattagacctgaaacaaaagtgtatcgcaaggccgtcgatgagatcgtgatccttaccgtttgtattacgtaccccggacatacattctgcaccgaaatcaacgctattgagccgaaaatcaccgaggaaattgagctccagtttaagacagtggacaccaagacgctgccttatatcgtcgccgtgaataaccacaaactgtactctggccagatcaatgacctcgggacattcggacagatgtgtggcaacgtgcaaaagaccaattccagcattctggggacaggcacccccaaatttgattatacatgccatggagcgtcccggaaggacatcattgtcagacggtgttacaacaacaatttcgatagctgcaaacttctgaaggaagagacccagctcatctttaacgacgatcacgacacgattaccgtttataatacaaaccatctgatcggcgagctggctatcaagctgattcttggggatatccagtacaaactcttcaccgaaacactggacctccagattgatgccaagtgtgtgggatgccccgactgttttgagtcttacagctgcaatttccaaatcgtgtccaacattgataccatctgtaatctggaaggcccttgcgacacgtttcacaaccgcatttctatcaaagccatgcagcagaattatgctgtcaaacttagctgccagaaggacccggggccctccggaacattcaagatctgtaacagagagtacaccgtggttttccacacagtggccaaggatgacaaaattgaaatcaatgtcggcgatcaaacctcttttattaaggagaaagacgatcggtgcaagacctggctgtgtagagtgcgcgacgagggcatcagcgttattttcgaacctatcaaagcgtttttcgggtcctatttttctatcttcttttacattatcattatcgtggtcgtgggattcctcattatctatatctttatgcccatgttcatgaagctgaaggaggtcctgaaagctaacgaaaaactttacctgcaggagattaagcagaagtga

SEQ ID NO: 14146 - RNA, 4308 nt, synthetic construct
  misc_feature 1..4308: note = derived and/or modified CDS sequence (opt5) from Ab-BUNV(Cu20-XJ)__KJ710423.1__GP
  source 1..4308: mol_type = other RNA
atggccatcagcattgtgctgatgatcattttctccaccacatcttgcctcgctagagccgcgcccagcatctccaagtgttttcaggacggcgtcctgattgctgagaaaaagtctagctccgggatctctgagttctgcatcaaagatgacattagcatccttaagtccgaaattaactacagcaaaaatgatacgggaatctttatgcactctaaggttttccggcattggaccgtggccgactggaagcaatgtcagcctattccgtccgccggcgggagcatcaacgtgctggaagtcgataaaaatctcaacctggtggctaagaattatatgtgcacacgcccctgtgttattaccatcgacaaagagaacgcccagcttctgtttcagacagaacaactcaatcagttcgaggtgaccggaacaaccatctctacgggctggtttaagtccaaaaccagcgtctctctggataacacatgcgagcacattaaggtgacctgtgggaagaaatccctgcagttccatgcttgctttaagcagcacatgagctgtgttagattcctccatcggtccgtgctgcctggatacatggccaattctatctgccaaaacattgaacttatcattatcatcacactgaccctcgcgatttttatcttcatgtgtattatcacgcgcacatatatttgctacatcatgctgcccctttttgcccctatcgcttatatttacggctggctgtataatagaagctgcaaaaagtgtatctgctgtggcctcgcctaccaccccttcaccaactgcgggtcctactgtgtctgcggaagccggttcgagacatctgaccgcatgagactgcaccgggaatccggcctgtgtcaggggtttaaaagcctccgcgtggctagaaccctgtgcaagtctaaaggaagctcccttgtgatttctgtcctgaccgccatgctcatcctgagcttcgttacacctcttgaggcgatttccacgaattatccgaccgatcggaagtacacactgaacgaggtgaatgacatcgtgctcggcaaggggaccgaaaacgagctgaaaacaagcattctggccctcgtctctatctgtggaatcggcattatcattatctttattgctctgaccatgcttctggatatcgtgctcgaagccatcgctaagcgctccacgattttctgcacagagtgtaacctgatccatgacaaaaaggccatgaaatttgttggcgatttcaccaataagtgcgggttttgcccctgtggagaacttgaggaccctgagggcctggtgattcacaccacaagaaagagctgcacctattacatcaaaattcggaacctcaagctgatcatgctggtcttctctatcgccattctcatgcagaatacagctatgctggtggttgcggacgaaaactgttggacgaataccgagatcaaagccgattgcgtggggccccttattggacctacaacctgtacaaacaagggctccaaaacctataaggctgtcgcccaggaactggtgacgagcaataagatcacccaactcgacgccgataaatacacactgctgggggacaccattgagtccgctctttctgccatcacagaacagaagcattatagcgcgatccacctcctggagaccatttttctgatgaaacactgcgattactacaaggtctatgagcataactccggatactctcagacgaaatggcgcctcatcgctaagacaaatagcttcgacatttgttccatccccagcaccccgaacttttgcaagtgtctgtctgattccagctgctctacatccacccttaatttcgccaccagcatgaactctacatatacgagcaaagccgaatactttaatcacgacttcaccctgttcctcaacatttttgaggctgccttccctggctccgctacagcctttctgttcaagaaaatcaaggaaaaagcgccctatcaagcctttgagatgatgggcaagattgctaataaataccctaacaacaagctgcttgtggttctcctgaagtatgggcagtacatggtgggactgagccatgcctctacctaccagctcaaacaggaatggatcgctaagtccctgagccttgtcagatccacaaaaaccggcctgaagatggccatgacgaatgcggagcccgggcccgccacaaaagagtgttctgatgctaagaccatcgcctgcctcacccctaagttccaagtggaagttaacaatctgatgagctgcggagcttccccgaactttaaaatttatatgaagtctggcgagctgtacaaagcccacgaccggaatagcgtgtggtgtcttaacgatatgcattgcctcacaccctatacccctgccaatgctgaactggtcgcgacaatgaagaaaatggagtgttggcaggacaaccccaagcagcctacgaatgactacgccacccccagacgctcctgccagatgaaggatcgggggctgtgtaacgtgggcgctgacaaatggaaggtgatcaaatgcgatgacgatctcatgttctatacagacgccctggagtctccggatcctgccgctgacattggacaatactgttttagcgaaaagtgccagatcgagagatatcccattaatcctacctcccttacaaactgtgaatggctgtaccgcgccgttaaaccccagtacatcaagcggctcagcctgcagaccatcgaggaatataagaaagcgattacggataagctgacccacacacttcaactctaccacttcgctcctctggagaatctgccccatatcagaccgacctatgagtacattacagcccagggcacctatacagccgacgggatcgaaggagcttctattatcacctccatccctgccctcagcggcacgtctgtcgggtttaaaattaacgcgaaggatggaacagctctgcttgacatcgtggtgtacattaaatccagcgtcgtgaagtctgtttataatcacatctacgataccggccccaccattaacatcaactccaaacatgacgagctgtgcacagggcagtgtcccaagcgcattcctgccgacccgaattggctcaccttcagccaggaacggacgtccagatggggctgcgaggaatttggatgcctggccatcaacacaggctgtgtgtacgggagctgccaagatgtcatccgcaccgagacaaaggtgtatcggaaagctaatgaggaaaccgttatgctgacagtgtgtattacctaccccggacacacgttctgcaccgacgtcaacgcccttgagcctaagatcacagatgaactggagctccagttcaaaaccattgacatcaagtctctgcccaatctcgtggctattacaaaccacaaactgtataccggccagatcaatgatcttgggacgtttggacaaatgtgtggcaacgttcagaagacaaataccagcatcctgggggccggcacacctaagttcgactacacatgctattccgcgtctagaaaagatattatcattcgccggtgttacaacaataactatgacagctgcagactcctgaagcaggaaggagatctgctttttgacgataatcatgagaccctgatcgtgtacaacaataaacggctcaacggcgagctgacaatgaagctcctgcttggggacattcagtacaaactgtatacggaaaacatggagctcgaactggaggccaagtgtgtcggatgcgtgggctgtttcgagtcctaccaatgcaatctgcagatcacctctagccttgatgggaactgcgctatctccggaccctgtgaaacatttcacgaccgcattcagatcaagaccaccaaaaaggactatgccctgaaactcgcttgcaccaaggatcctggcgacaaagccacgttcagagtgtgtgggaaggattacgactttaatttccatacagtcgttaagaacgataaaattgaggtgaatgtgggcgacgaaacctcttatatcaaggagaaagatgcccggtgcggaacctggctgtgtagagtccgcgacgaaggcctcagcgtgatttttgagcccctgaagaacttctttgggaattaccttaacatgttcctgtatatcctgggaggcgttctcctgcttttcctgtccctctacattatcatgccggtgtgcgctcggctgagagatgagctcaaaaagaatgaaaagctgcaccagatggagatgaaaaagcgctga

SEQ ID NO: 14147 - RNA, 4305 nt, synthetic construct
  misc_feature 1..4305: note = derived and/or modified CDS sequence (opt5) from ANADV(EIV-13128Kam)__KT313718.1__GP
  source 1..4305: mol_type = other RNA
atgttcctgatcctcgtgctgcttattcccttttacatcaccgccacacctgtcacgaccagatgcttccacggcgggcagctgattgctgagagcaagtccctcacagccatctctgaattttgtctgaaagacgatgttagcaccgtgaagtccgagattacatatcttaaaaacgacaccggaatcttcgcgcattctaaggtgctgcggaattggatcattaaagattggaagaactgcaatccggtccccacagctggcgggagcatcaacgtgattgaagttaataccgacctctccctgtctacgaagacctacgtgtgtagccgcgattgcacaatcaccgtcgacaaagaggatgcccaaattatctttcagacagacaagctgaaccacttcgaagtgtccggaaccacgctcagctctggctggtttaaaacaaaggcctccgttaccctggatagaacatgtgagcatattaaagtgacctgcgggaagaagacccttcagttccacgcttgttttaaacatcacatgagctgcatccggttctttcacaatacaatcctgcctggaacgatggccgtctctatttgtcagaacatcgagctcattatcattacctccctgacacttatcatcttcattctgatggtgatcctcaccaagacatatatttgctacgtgctgatgcccctgtttatgcctgtcgcttatctctacggctgggcctataatcgcagctgtaaaaagtgctcttgctgtggcctggcgtaccatcccttcaccaactgcgggtcccactgtgtttgcggacttaaattcgaagccagcgacagaatgcggatccatcgcgagtccggcctgtgtcaagggtacaagtctctcagagtggctcggctgctttgcaaaagcaagggatccagcctgattatctctatcctcctgtccgtgctgattctcagctttgtcacgcctatcgaaggcacactgaccaattatccggagtctaagaaatacagccttgaggaaattgccgatgtgatcgaggggttcattgctgaaaagggaatcaaagagtatattgttctgtacacctccatctttggcgccctcctgcttctgatcgcgctcattatcacagtgtctctgaaccgcattaccgaatatctgacaaatctcaacgtcatctactgtcacgagtgcagcatgtatcactccaagaaaaatattaagtacatcggcgacttcacgaacaagtgtgggttttgcacctgtggagagctggaagatcaggagggccttaacatgcataaagtgagcaagaaatgcatctacagatatcagctgacatggtctaaggttattatgaccatcctcgtgtgcctgctgattgcccagaatacagtccttatcgtggctgccaacgacgactgttgggctaaacaatccctcgaaattgagtgcgtcgggcccctgcaacaggtggatgcctgtgaagacaagagctctcggtcctacaatggagaggccaagaaactggttggcaccagcaaggtgacggagctcgatgctgggcaggtcaacctgcttggacagaccatcgaatccgcgatcattgccatccgcaaacagagaacatatgctaccatgcacttcctggagtctgtgtttctcggccggcattgcgactactataaggttttcgaacacaatagcggctactcccaggccaaatggcgcctgctggccaagacaaaccattttgatatttgttctagacacagcacccaccatttctgccggtgtatgtccgacgggacgaagtgcgagaatggaaactgggattttgctggcgaaatgaatacaacctatcacagcaaaagagacttctttaagcatgatttcaaccttttctgtacactcctggagaatgcctttcctgggaccaccgagtctctgtactaccaactcctgtccaaacgcaacacaacgggagcgagcaaacttctgggcaagctcatcaccaagttcgggaataacaatctgtttgtgggcatttggaaattcggacagtttctgctttctctcccctatgtcaacaacacagaactgtccgctctgcagagctctaagatcctcgagagccctgaacccctgcttcggtccgccagcggcagacaggagtctctgtccagcaccacaccgggggaggcctccaaggaatgccgcaatgctaaaaagatctcttgtattagccctcggttcggagtgcccatggagaacctcaccgcctgcggcgaatcccctaattacaaaatctataagacgcccacaagaatttacaaatctaacaataagggggagatctggtgcgctggagacgtgcactgttttcaagaatttacccccgttctgcaggaggtcgtggataagctgaaaaagatgacctgctttcttacagagcctgaagccgaggaagacgcgttcagcattgccatcgctatgtgtaaaattctcgacaagggcgtgtgcaccatcaactccgagcgctggaatatcattaaatgtgattctgggctgatgtattacacagaccagcgggatggccaggacacgggaaacgattttggcgaatattgcatcagccacaattgtaagaccgagagattcccgattaacccctccatcattagcgactgcatctgggagtaccattctcgcaagtcccggtacatcagcacactgaatctcgaatctctggaggaatttaaaagagccatttccgagaaacttagccacaccctggtcgtgtatcaattcaagcctacatctaacctcccccatatgaagcctgtttacaaatatatcaccgctcagggggtggaaaattccgatggaattgacagcgccttcatcacggcgtccatgcccgccctgagcggcacctctattgggtacaacgtcatgagcaaggataattttccgctgttcgacatcatcatttttatcaagtccgctgtgattaaaacaacctataaccacatctacgatacaggacctaccattggcatcaacgttatgcatgacgagcactgtacagggcagtgccccattgagatccctcacaaggaaaattggcttaccttctctcaggagcgcacgagccggtggggctgtgaagagtttggatgcctggccatcaacacaggctgcgtgttcgggtcctgtcaagatattatcagacccgagaccaaagtctatcggaaggctattgaagagtctgtgctcctgaccgtttgcgtgacataccctggaaataccttttgtacggaaatcaacgccattgagcccaaaatcacagacgaactcgagctgcagttcaagaccgtcgacacaaaaacccttccgaatctgctcgccgtgcagaaccataagctgtacagcggccagatcaatgatctggggtcctttgctcaaggatgcggcaacattcagaagacaaatctttctgtgatcgggaccggcacggcgaaattcgactatatttgtcacggagccagccgcaaggatatcgtcgttagacggtgctacaacaataactatgagtcctgtaaactgctcaaggaggaacctagcctgattttctctgacaatcatgaaaccatcgaggtggctaacatcagacacctcctgggcgaacttcagttcaaactgatgctcggggatctgcgctacaagtccttcgccgagaatcccgagctggaaattgaggccaagtgcgtgggatgtcccagctgcttttcttcctatagctgtaacttccggatctcctctagcattgacacagtctgcgctatcgatggcccttgcaccatttttcataacagacttatcatttccagcacaaaacaagactacgggatcaagatgtcttgtaaagaaaagccgaatcccgtggagaaattcaacatctgcaagcgcatttattccgttctgtttaccacgatcgataagagcgacaaaattgaaatcaatacaggagatcagacctctttcattcaggagaaggacgatagatgtaaaacatggctctgccgggtgcgcgacgagggcatcagcgtcatctttgaacctattaaggccttctttggctcctacttctctatcgcgttttacgtggttattgggatcattgctctgttcatcaccatctatatttttctccccatggtgttcaaactgaaggacatccttaagaaaaacgagctgctgtacctccaggaaatgaagtataaatga

SEQ ID NO: 14148 - RNA, 4305 nt, synthetic construct
  misc_feature 1..4305: note = derived and/or modified CDS sequence (opt5) from ANADV(EIV-13130Kam)__KT313721.1__GP
  source 1..4305: mol_type = other RNA
atgttcctgatcctcgtgctgcttattcccttttacatcaccgccacacctgtcacgaccagatgcttccacggcgggcagctgattgctgagagcaagtccctcacagccatctctgaattttgtctgaaagacgatgttagcaccgtgaagtccgagattacatatcttaaaaacgacaccggaatcttcgcgcattctaaggtgctgcggaattggatcattaaagattggaagaactgcaatccggtccccacagctggcgggagcatcaacgtgattgaagttaatgccgacctctccctgtctaccaagacgtacgtgtgtagccgcgattgcaccatcacagtcgacaaagaggatgcccaaattatctttcagaccgacaagctgaaccacttcgaagtgtccggaacaaccctcagctctggctggtttaaaacgaaggcttccgttacactggatagaacctgtgagcatattaaagtgacatgcgggaagaagacccttcagttccacgcctgttttaaacatcacatgagctgcatccggttctttcacaataccatcctgcctggaacaatggctgtctctatttgtcagaacatcgagctcattatcattacgtccctgacccttatcatcttcattctgatggtgatcctcacaaagacctatatttgctacgtgctgatgcccctgtttatgcctgtcgcctatctctacggctgggcgtataatcgcagctgtaaaaagtgctcttgctgtggcctggcctaccatcccttcacaaactgcgggtcccactgtgtttgcggacttaaattcgaagctagcgacagaatgcggatccatcgcgagtccggcctgtgtcaagggtacaagtctctcagagtggcccggctgctttgcaaaagcaagggatccagcctgattatctctatcctcctgtccgtgctgattctcagctttgtcacccctatcgaaggcacgctgacaaattatccggagtctaagaaatacagccttgaggaaattgctgatgtgatcgaggggttcattgccgaaaagggaatcaaagagtatattgttctgtacacctccatctttggcgcgctcctgcttctgatcgccctcattatcaccgtgtctctgaaccgcattacagaatatctgaccaatctcaacgtcatctactgtcacgagtgcagcatgtatcactccaagaaaaatattaagtacatcggcgacttcacaaacaagtgtgggttttgcacgtgtggagagctggaagatcaggagggccttaacatgcataaagtgagcaagaaatgcatctacagatatcagctgacctggtctaaggttattatgacaatcctcgtgtgcctgctgattgctcagaataccgtccttatcgtggccgctaacgacgactgttgggccaaacaatccctcgaaattgagtgcgtcgggcccctgcaacaggtggatgcctgtgaagacaagagctctcggtcctacaatggagaggctaagaaactggttggcacaagcaaggtgaccgagctcgatgcggggcaggtcaacctgcttggacagacgatcgaatccgccatcattgctatccgcaaacagagaacctatgccacaatgcacttcctggagtctgtgtttctcggccggcattgcgactactataaggttttcgaacacaatagcggctactcccaggccaaatggcgcctgctggctaagaccaaccattttgatatttgttctagacacagcacacaccatttctgccggtgtatgtccgacgggaccaagtgcgagaatggaaactgggattttgccggcgaaatgaatacgacatatcacagcaaaagagacttctttaagcatgatttcaaccttttctgtaccctcctggagaatgcgtttcctgggacaaccgagtctctgtactaccaactcctgtccaaacgcaacaccacaggagctagcaaacttctgggcaagctcatcacgaagttcgggaataacaatctgtttgtgggcatttggaaattcggacagtttctgctttctctcccctatgtcaacaacaccgaactgtccgccctgcagagctctaagatcctcgagagccctgaacccctgcttcggtccgccagcggcagacaggagtctctgtccagcgctacaccgggggaggcctccaaggaatgccgcaatgctaaaaagatctcttgtattagccctcggttcggagtgcccatggagaacctcaccgcctgcggcgaatcccctaattacaaaatctataagacacccaccagaatttacaaatctaacaataagggggagatctggtgcgcgggagacgtgcactgttttcaagagttcacgcccgttctgcaggaggtcgtggataagctgaaaaagatgacatgctttcttaccgagcctgaagccgaggaagacgctttcagcattgccatcgctatgtgtaaaattctcgacaagggcgtgtgcaccatcaactccgagcgctggaatatcattaaatgtgattctgggctgatgtattacacagaccagcgggatggccaggacaccggaaacgattttggcgaatattgcatcagccacaattgtaagacagagagattcccgattaacccctccatcattagcgactgcatctgggagtaccattctcgcaagtcccggtacatcagcacgctgaatctcgaatctctggaggaatttaaaagagccatttccgagaaacttagccacaccctgatcgtctatcaattcaagcctacatctaacctcccccatatgaagcctgtgtacaaatatattaccgcgcagggggttgaaaattccgatggaatcgacagcgccttcattacagcttccatgcccgccctgagcggcacctctatcgggtacaacgtgatgagcaaggataattttccgctgttcgacatcattatctttattaagtccgctgtcatcaaaacgacctataaccacatttacgatacaggacctaccatcggcattaacgtgatgcatgacgagcactgtacagggcagtgccccatcgagatccctcacaaggaaaattggcttaccttctctcaggagcgcacaagccggtggggctgtgaagagtttggatgcctggccattaacaccggctgcgttttcgggtcctgtcaagatatcattagacccgagacgaaagtgtatcggaaggccatcgaagagtctgtcctcctgacagtgtgcgttacctaccctggaaataccttttgtacagaaattaacgctatcgagcccaaaatcaccgacgaactcgagctgcagttcaagacggtggacacaaaaacccttccgaatctgctcgcggtccagaaccataagctgtacagcggccagattaatgatctggggtcctttgcccaaggatgcggcaacatccagaagacaaatctttctgtgattgggaccggcacagctaaattcgactatatctgtcacggagccagccgcaaggatattgtggtcagacggtgctacaacaataactatgagtcctgtaaactgctcaaggaagaacctagcctgatcttttctgacaatcatgaaaccatcgaggttgccaacattagacacctcctgggcgaacttcagttcaaactgatgctcggggatctgcgctacaagtccttcgctgagaatcccgagctggaaatcgaggccaagtgcgtgggatgtcccagctgcttttcttcctatagctgtaacttccggatttcctctagcatcgacacggtgtgcgcgattgatggcccttgcaccatctttcataacagacttattatctccagcacaaaacaagactacgggatcaagatgtcttgtaaagaaaagccgaatcccgtcgagaaattcaacatttgcaagcgcgtgtattccgttctgtttaccacaatcgataagaatgacaaaattgaaatcaacaccggagatcagacgagcttcattcaggagaaggacgatagatgtaaaacatggctctgccgggtgcgcgacgagggcatctctgtcatctttgaacctattaaggctttctttggcagctacttctccatcgccttttacgtggttattgggatcattgccctgttcatcaccatctatatttttctccccatggtgttcaaactgaaggacatccttaagaaaaatgagctgctgtacctccaggaaatgaagtataaatga

SEQ ID NO: 14149 - RNA, 4305 nt, synthetic construct
  misc_feature 1..4305: note = derived and/or modified CDS sequence (opt5) from ANADV(EIV-13395Mg)__KU159765.1__GP
  source 1..4305: mol_type = other RNA
atgttcctgatcctcgtgctgcttattcccttttacatcaccgccacacctgtcacgaccagatgcttccacggcgggcagctgattgctgagagcaagtccctcacagccatctctgaattttgtctgaaagacgatgttagcaccgtgaagtccgagattacatatcttaaaaacgacaccggaatcttcgcgcattctaaggtgctgcggaattggatcattaaagattggaagaactgcaatccggtccccacagctggcgggagcatcaacgtgattgaagttaatgccgacctctccctgtctaccaagacgtacgtgtgtagccgcgattgcaccatcacagtcgacaaagaggatgcccaaattatctttcagaccgacaagctgaaccacttcgaagtgtccggaacaaccctcagctctggctggtttaaaacgaaggcttccgttacactggatagaacctgtgagcatattaaagtgacatgcgggaagaagacccttcagttccacgcctgttttaaacatcacatgagctgcatccggttctttcacaataccatcctgcctggaacaatggctgtctctatttgtcagaacatcgagctcattatcattacgtccctgacccttatcatcttcattctgatggtgatcctcacaaagacctatatttgctacgtgctgatgcccctgtttatgcctgtcgcctatctctacggctgggcgtataatcgcagctgtaaaaagtgctcttgctgtggcctggcctaccatcccttcacaaactgcgggtcccactgtgtttgcggacttaaattcgaagctagcgacagaatgcggatccatcgcgagtccggcctgtgtcaagggtacaagtctctcagagtggcccggctgctttgcaaaagcaagggatccagcctgattatctctatcctcctgtccgtgctgattctcagctttgtcacccctatcgaaggcacgctgacaaattatccggagtctaagaaatacagccttgaggaaattgctgatgtgatcgaggggttcattgccgaaaagggaatcaaagagtatattgttctgtacacctccatctttggcgcgctcctgcttctgatcgccctcattatcaccgtgtctctgaaccgcattacagaatatctgaccaatctcaacgtcatctactgtcacgagtgcagcatgtatcactccaagaaaaatattaagtacatcggcgacttcacaaacaagtgtgggttttgcacgtgtggagagctggaagatcaggagggccttaacatgcataaagtgagcaagaaatgcatctacagatatcagctgacctggtctaaggttattatgacaatcctcgtgtgcctgctgattgctcagaataccgtccttatcgtggccgctaacgacgactgttgggccaaacaatccctcgaaattgagtgcgtcgggcccctgcaacaggtggatgcctgtgaagacaagagctctcggtcctacaatggagaggctaagaaactggttggcacaagcaaggtgaccgagctcgatgcggggcaggtcaacctgcttggacagacgatcgaatccgccatcattgctatccgcaaacagagaacctatgccacaatgcacttcctggagtctgtgtttctcggccggcattgcgactactataaggttttcgaacacaatagcggctactcccaggccaaatggcgcctgctggctaagaccaaccattttgatatttgttctagacacagcacacaccatttctgccggtgtatgtccgacgggaccaagtgcgagaatggaaacagagattttgccggcgaaatgaatacgacatatcacagcaaacgcgacttctttaagcatgatttcaaccttttctgtaccctcctggagaatgcgtttcctgggacaaccgagtctctgtactaccaactcctgtccaaacggaacaccacaggagctagcaaacttctgggcaagctcatcacgaagttcgggaataacaatctgtttgtgggcatttggaaattcggacagtttctgctttctctcccctatgtcaacaacaccgaactgtccgccctgcagagctctaagatcctcgagagccctgaacccctgcttagatccgccagcggccgccaggagtctctgtccagcgctacaccgggggaggcctccaaggaatgccggaatgctaaaaagatctcttgtattagccctagattcggagtgcccatggagaacctcaccgcctgcggcgaatcccctaattacaaaatctataagacacccacccgcatttacaaatctaacaataagggggagatctggtgcgcgggagacgtgcactgttttcaagaatttacgcccgttctgcaggaggtcgtggataagctgaaaaagatgacatgctttcttaccgagcctgaagccgaggaagacgctttcagcattgccatcgctatgtgtaaaattctcgacaagggcgtgtgcaccatcaactccgagcggtggaatatcattaaatgtgattctgggctgatgtattacacagaccagagagatggccaggacaccggaaacgattttggcgaatattgcatcagccacaattgtaagacagagcgcttcccgattaacccctccatcattagcgactgcatctgggagtaccattctcggaagtccagatacatcagcacgctgaatctcgaatctctggaggaatttaaacgcgccatttccgagaaacttagccacaccctggtcgtgtatcaattcaagcctacatctaacctcccccatatgaagcctgtttacaaatatatcaccgcgcagggggtggaaaattccgatggaattgacagcgccttcatcacagcttccatgcccgccctgagcggcacctctattgggtacaacgtcatgagcaaggataattttccgctgttcgacatcatcatttttatcaagtccgctgtgattaaaacgacctataaccacatctacgatacaggacctaccattggcatcaacgttatgcatgacgagcactgtacagggcagtgccccattgagatccctcacaaggaaaattggcttaccttctctcaggagcggacaagcagatggggctgtgaagagtttggatgcctggccatcaacaccggctgcgtgttcgggtcctgtcaagatattatccggcccgagacgaaagtctatcgcaaggccattgaagagtctgtgctcctgacagtttgcgtgacctaccctggaaataccttttgtacagaaatcaacgctattgagcccaaaatcaccgacgaactcgagctgcagttcaagacggtcgacacaaaaacccttccgaatctgctcgcggtgcagaaccataagctgtacagcggccagatcaatgatctggggtcctttgcccaaggatgcggcaacattcagaagacaaatctttctgtgatcgggaccggcacagctaaattcgactatatttgtcacggagccagcagaaaggatatcgtcgttcggagatgctacaacaataactatgagtcctgtaaactgctcaaggaggaacctagcctgattttctctgacaatcatgaaaccatcgaggtggccaacatccgccacctcctgggcgaacttcagttcaaactgatgctcggggatctgcggtacaagtccttcgctgagaatcccgagctggaaattgaggccaagtgcgtgggatgtcccagctgcttttcttcctatagctgtaacttcagaatctcctctagcattgacacggtctgcgcgatcgatggcccttgcaccatttttcataaccgccttatcatttccagcacaaaacaagactacgggatcaagatgtcttgtaaagaaaagccgaatcccgtggagaaattcaacatctgcaagagagtttattccgtgctgtttaccacaattgataagaatgacaaaatcgaaattaacaccggagatcagacgagcttcatccaggagaaggacgatcggtgtaaaacatggctctgccgcgtcagagacgagggcatttctgtgatctttgaacctatcaaggctttctttggcagctacttctccattgccttttacgttgtgatcgggattatcgccctgttcattaccatctatatctttctccccatggtcttcaaactgaaggacattcttaagaaaaatgagctgctgtacctccaggaaatgaagtataaatga

SEQ ID NO: 14150 - RNA, 4305 nt, synthetic construct
  misc_feature 1..4305: note = derived and/or modified CDS sequence (opt5) from ANADV(EIV-16002Mg)__KT313724.1__GP
  source 1..4305: mol_type = other RNA
atgttcctgatcctcgtgctgcttattcccttttacatcaccgccacacctgtcacgaccagatgcttccacggcgggcagctgattgctgagagcaagtccctcacagccatctctgaattttgtctgaaagacgatgttagcaccgtgaagtccgagattacatatcttaaaaacgacaccggaatcttcgcgcattctaaggtgctgcggaattggatcattaaagattggaagaactgcaatccggtccccacagctggcgggagcatcaacgtgattgaagttaatgccgacctctccctgtctaccaagacgtacgtgtgtagccgcgattgcaccatcacagtcgacaaagaggatgcccaaattatctttcagaccgacaagctgaaccacttcgaagtgtccggaacaaccctcagctctggctggtttaaaacgaaggcttccgttacactggatagaacctgtgagcatattaaagtgacatgcgggaagaagacccttcagttccacgcctgttttaaacatcacatgagctgcatccggttctttcacaataccatcctgcctggaacaatggctgtctctatttgtcagaacatcgagctcattatcattacgtccctgacccttatcatcttcattctgatggtgatcctcacaaagacctatatttgctacgtgctgatgcccctgtttatgcctgtcgcctatctctacggctgggcgtataatcgcagctgtaaaaagtgctcttgctgtggcctggcctaccatcccttcacaaactgcgggtcccactgtgtttgcggacttaaattcgaagctagcgacagaatgcggatccatcgcgagtccggcctgtgtcaagggtacaagtctctcagagtggcccggctgctttgcaaaagcaagggatccagcctgattatctctatcctcctgtccgtgctgattctcagctttgtcacccctatcgaaggcacgctgacaaattatccggagtctaagaaatacagccttgaggaaattgctgatgtgatcgaggggttcattgccgaaaagggaatcaaagagtatattgttctgtacacctccatctttggcgcgctcctgcttctgatcgccctcattatcaccgtgtctctgaaccgcattacagaatatctgaccaatctcaacgtcatctactgtcacgagtgcagcatgtatcactccaagaaaaatattaagtacgtgggcgacttcacaaacaagtgtgggttttgcacgtgtggagagctggaagatcaggagggccttaacatgcataaagttagcaagaaatgcatctacagatatcagctgacctggtctaaggtgatcatgacaattctcgtctgcctgctgatcgctcagaataccgtgcttattgtcgccgctaacgacgactgttgggccaaacaatccctcgaaatcgagtgcgtggggcccctgcagcaggttgatgcctgtgaagacaagagctctcggtcctacaatggagaggctaagaaactggtgggcacaagcaaggtcaccgagctcgatgcgggacaggtgaacctgcttgggcaaacgattgaatccgccatcatcgctattcgcaaacagagaacctatgccacaatgcacttcctggagtctgtttttctcggccggcattgcgactactataaggtgttcgaacacaatagcggctactcccaggccaaatggcgcctgctggctaagaccaaccattttgatatctgttctagacacagcacacaccatttctgccggtgtatgtccgacgggaccaagtgcgagaatggaaactgggattttgccggcgaaatgaatacgacatatcacagcaaaagagacttctttaagcatgatttcaaacttttctgtaccctcctggagaacgcgtttcctgggacaaccgagtctctgtactaccaactcctgtccaagcgcaataccacaggagctagcaaacttctgggcaagctcattacgaaattcgggaacaataacctgtttgtcggcatctggaagttcggacagtttctgctttctctcccctatgtgaataacaccgaactgtccgccctgcagagctctaagattctcgagagccctgaacccctgcttcggtccgccagcggcagacaggagtctctgtccagcgctacaccgggggaggcctcccgcgaatgccggaacgctaaaaagatctcttgtatcagccctagattcggagtgcccatggagaatctcaccgcctgcggcgaatcccctaactacaaaatttataagacacccgcgcgcatctacaaatctaataacaagggggagatttggtgcgccggagacgttcactgttttcaagagttcacccccgtcctgcaggaggtggtggataagctgaaaaagatgacgtgctttcttacagagcctgaagctgaggaagacgccttcagcatcgctattgccatgtgtaaaatcctcgacaagggcgtctgcaccattaattccgagcggtggaacatcatcaaatgtgattctgggctgatgtattacaccgaccagagagatggccaggacacaggaaatgattttggcgaatattgcattagccacaactgtaagaccgagcgcttcccgatcaatccctccattatcagcgactgcatttgggagtaccattctcggaagtccagatacatcagcacactgaacctcgaatctctggaggaatttaaacgcgcgatctccgagaaacttagccacacgctggtggtttatcaattcaagcctacctctaatctcccccatatgaagcctgtgtacaaatatattacagcccagggggtcgaaaactccgatggaatcgacagcgctttcattaccgcctccatgcccgctctgagcggcacatctatcgggtacaatgtgatgagcaaggataactttccgctgttcgacattatcatctttattaagtccgccgttatcaaaaccacgtataatcacatttacgataccggacctacaatcggcattaacgtgatgcatgacgagcactgtaccgggcagtgccccatcgagattcctcacaaggaaaactggcttacattctctcaggagcggaccagcagatggggctgtgaagagtttggatgcctggccatcaatacaggctgcgtcttcgggtcctgtcaagatatcattcggcccgagaccaaagtgtatcgcaaggctatcgaagagtctgttctcctgacggtgtgcgtcacataccctggaaacaccttttgtaccgaaattaatgcgatcgagcccaaaattacagacgaactcgagctgcagttcaagaccgtggacacgaaaacacttccgaacctgctcgccgtgcagaatcataagctgtacagcggccagatcaacgatctggggtcctttgctcaaggatgcggcaatatccagaagaccaacctttctgtcattgggacaggcaccgccaaattcgactatatctgtcacggagccagcagaaaggatattgttgtgcggagatgctacaataacaattatgagtcctgtaaactgctcaaggaagaacctagcctgatcttttctgacaaccatgaaacaattgaggtggctaatatccgccacctcctgggcgaacttcagttcaaactgatgctcggggatctgcggtacaagtccttcgccgagaaccccgagctggaaatcgaggcgaagtgcgtcggatgtcccagctgcttttcttcctatagctgtaatttcagaatttcctctagcatcgacaccgtgtgcgctattgatggcccttgcacggtttttcataaccgccttatcatttccagcaccaaacaagactacgggatcaagatgtcttgtaaagaaaagccgaaccccgtggagaaattcaatatttgcaagagagtctattccgtgctgtttacaaccatcgataagaacgacaaaatcgaaattaatacaggagatcagaccagcttcatccaggagaaggacgatcggtgtaaaacgtggctctgccgcgttagagacgagggcatttctgtgatctttgaacctattaaggccttctttggcagctacttctccatcgccttttacgtcgtgatcgggattatcgctctgttcattacaatctatatttttctccccatggttttcaaactgaaggacatccttaagaaaaacgagctgctgtacctccaggaaatgaagtataaatga

SEQ ID NO: 14151 - RNA, 4305 nt, synthetic construct
  misc_feature 1..4305: note = derived and/or modified CDS sequence (opt5) from ANADV(EIV-16199Mg)__KT313730.1__GP
  source 1..4305: mol_type = other RNA
atgttcctgatcctcgtgctgcttattcccttttacatcaccgccacacctgtcacgaccagatgcttccacggcgggcagctgattgctgagagcaagtccctcacagccatctctgaattttgtctgaaagacgatgttagcaccgtgaagtccgagattacatatcttaaaaacgacaccggaatcttcgcgcattctaaggtgctgcggaattggatcattaaagattggaagaactgcaatccggtccccacagctggcgggagcatcaacgtgattgaagttaatgccgacctctccctgtctaccaagacgtacgtgtgtagccgcgattgcaccatcacagtcgacaaagaggatgcccaaattatctttcagaccgacaagctgaaccacttcgaagtgtccggaacaaccctcagctctggctggtttaaaacgaaggcttccgttacactggatagaacctgtgagcatattaaagtgacatgcgggaagaagacccttcagttccacgcctgttttaaacatcacatgagctgcatccggttctttcacaataccatcctgcctggaacaatggctgtctctatttgtcagaacatcgagctcattatcattacgtccctgacccttatcatcttcattctgatggtgatcctcacaaagacctatatttgctacgtgctgatgcccctgtttatgcctgtcgcctatctctacggctgggcgtataatcgcagctgtaaaaagtgctcttgctgtggcctggcctaccatcccttcacaaactgcgggtcccactgtgtttgcggacttaaattcgaagctagcgacagaatgcggatccatcgcgagtccggcctgtgtcaagggtacaagtctctcagagtggcccggctgctttgcaaaagcaagggatccagcctgattatctctatcctcctgtccgtgctgattctcagctttgtcacccctatcgaaggcacgctgacaaattatccggagtctaagaaatacagccttgaggaaattgctgatgtgatcgaggggttcattgccgaaaagggaatcaaagagtatattgttctgtacacctccatctttggcgcgctcctgcttctgatcgccctcattatcaccgtgtctctgaaccgcattacagaatatctgaccaatctcaacgtcatctactgtcacgagtgcagcatgtatcactccaagaaaaatattaagtacatcggcgacttcacaaacaagtgtgggttttgcacgtgtggagagctggaagatcaggagggccttaacatgcataaagtgagcaagaaatgcatctacagatatcagctgacctggtctaaggttattatgacaatcctcgtgtgcctgctgattgctcagaataccgtccttatcgtggccgctaacgacgactgttgggccaaacaatccctcgaaattgagtgcgtcgggcccctgcaacaggtggatgcctgtgaagacaagagctctcggtcctacaatgaggaggctaagaaactggttggaacaagcaaggtgaccgaactcgatgcgggccaggtcaacctgcttgggcagacgatcgagtccgccatcattgctatccgcaaacagagaacctatgccacaatgcacttcctggaatctgtgtttctcggacggcattgcgactactataaggttttcgagcacaatagcggctactcccaggccaaatggcgcctgctggctaagaccaaccattttgatatttgttctagacacagcacacaccatttctgccggtgtatgtccgacggcaccaagtgcgaaaatgggaactgggattttgccggagagatgaatacgacatatcacagcaaaagagacttctttaagcatgatttcaaccttttctgtaccctcctggagaatgcgtttcctggcacaaccgaatctctgtactaccaactcctgtccaaacgcaacaccacaggggctagcaaacttctgggaaaactcatcacgaagttcggcaataacaatctgtttgtggggatttggaaattcggccagtttctgctttctctcccctatgtcaacaacaccgagctgtccgccctgcagagctctaagatcctcgaaagccctgagcccctgcttcggtccgccagcggaagacaggagtctctgtccagcgctacaccgggcgaagcctccaaggagtgccgcaatgctaaaaagatctcttgtattagccctcggttcggggtgcccatggaaaacctcaccgcctgcggagagtcccctaattacaaaatctataagacacccaccagaatttacaaatctaacaataagggcgaaatctggtgcgcgggggacgtgcactgttttcaagagttcacgcccgttctgcaggaggtcgtggataagctgaaaaagatgacatgctttcttaccgaacctgaggccgaagaggacgctttcagcattgccatcgctatgtgtaaaattctcgacaagggagtgtgcaccatcaactccgaacgctggaatatcattaaatgtgattctggcctgatgtattacacagaccagcgggatgggcaggacaccggcaacgattttggagagtattgcatcagccacaattgtaagacagagagattcccgattaacccctccatcattagcgactgcatctgggaataccattctcgcaagtcccggtacatcagcacgctgaatctcgagtctctggaagagtttaaaagagccatttccgaaaaacttagccacaccctgatcgtctatcaattcaagcctacatctaacctcccccatatgaagcctgtgtacaaatatattaccgcgcagggcgttgaaaattccgatgggatcgacagcgccttcattacagcttccatgcccgccctgagcggaacctctatcggctacaacgtgatgagcaaggataattttccgctgttcgacatcattatctttattaagtccgctgtcatcaaaacgacctataaccacatttacgatacagggcctaccatcggaattaacgtgatgcatgacgagcactgtacaggccagtgccccatcgagatccctcacaaggagaattggcttaccttctctcaggaacgcacaagccggtgggggtgtgaggagtttggctgcctggccattaacaccggatgcgttttcggctcctgtcaagatatcattagacccgaaacgaaagtgtatcggaaggccatcgaggaatctgtcctcctgacagtgtgcgttacctaccctgggaataccttttgtacagagattaacgctatcgaacccaaaatcaccgacgagctcgagctgcagttcaagacggtggacacaaaaacccttccgaatctgctcgcggtccagaaccataagctgtacagcggacagattaatgatctgggctcctttgcccaagggtgcggaaacatccagaagacaaatctttctgtgattggcaccgggacagctaaattcgactatatctgtcacggcgccagccgcaaggatattgtggtcagacggtgctacaacaataactatgaatcctgtaaactgctcaaggaggaacctagcctgatcttttctgacaatcatgagaccatcgaagttgccaacattagacacctcctgggagagcttcagttcaaactgatgctcggcgatctgcgctacaagtccttcgctgagaatcccgaactggagatcgaagcccggtgcgtggggtgtcccagctgcttttcttcctatagctgtaacttcagaatttcctctagcatcgacacggtgtgcgcgattgatggaccttgcaccatctttcataaccgccttattatctccagcacaaagcaagactacggcatcaaaatgtcttgtaaggagaaaccgaatcccgtcgaaaagttcaacatttgcaaaagagtgtattccgttctgtttaccacaatcgataagaatgacaagattgagatcaacaccggggatcagacgagcttcattcaggagaaagacgatcggtgtaagacatggctctgccgcgtgagagacgaaggaatctctgtcatctttgagcctattaaggctttctttggcagctacttctccatcgccttttacgtggttattggcatcattgccctgttcatcatcatttatatctttctccccatggtgttcaagctgaaagacattcttaagaagaatgaactgctgtacctccaggagatgaaatataagtga

SEQ ID NO: 14152 - RNA, 4305 nt, synthetic construct
  misc_feature 1..4305: note = derived and/or modified CDS sequence (opt5) from ANADV(EIV-16208Mg)__KT313733.1__GP
  source 1..4305: mol_type = other RNA
atgttcctgatcctcgtgctgcttattcccttttacatcaccgccacacctgtcacgaccagatgcttccacggcgggcagctgattgctgagagcaagtccctcacagccatctctgaattttgtctgaaagacgatgttagcaccgtgaagtccgagattacatatcttaaaaacgacaccggaatcttcgcgcattctaaggtgctgcggaattggatcattaaagattggaagaactgcaatccggtccccacagctggcgggagcatcaacgtgattgaagttaatgccgacctctccctgtctaccaagacgtacgtgtgtagccgcgattgcaccatcacagtcgacaaagaggatgcccaaattatctttcagaccgacaagctgaaccacttcgaagtgtccggaacaaccctcagctctggctggtttaaaacgaaggcttccgttacactggatagaacctgtgagcatattaaagtgacatgcgggaagaagacccttcagttccacgcctgttttaaacatcacatgagctgcatccggttctttcacaataccatcctgcctggaacaatggctgtctctatttgtcagaacatcgagctcattatcattacgtccctgacccttatcatcttcattctgatggtgatcctcacaaagacctatatttgctacgtgctgatgcccctgtttatgcctgtcgcctatctctacggctgggcgtataatcgcagctgtagaaaatgctcttgctgtggcctggcctaccatcccttcacaaactgcgggtcccactgtgtttgcggacttaagttcgaagctagcgaccggatgcgcatccatagagagtccggcctgtgtcaagggtacaaatctctccgggtggcccgcctgctttgcaagagcaaaggatccagcctgattatctctatcctcctgtccgtgctgattctcagctttgtcacccctatcgaaggcacgctgacaaattatccggagtctaagaagtacagccttgaggaaattgctgatgtgatcgaggggttcattgccgaaaaaggaatcaaggagtatattgttctgtacacctccatctttggcgcgctcctgcttctgatcgccctcattatcaccgtgtctctgaacagaattacagaatatctgaccaatctcaacgtcatctactgtcacgagtgcagcatgtatcactccaaaaagaatattaaatacatcggcgacttcacaaacaagtgtgggttttgcacgtgtggagagctggaagatcaggagggccttaacatgcataaggtgagcaaaaagtgcatctaccggtatcagctgacctggtctaaagttattatgacaatcctcatttgcctgctgatcgctcagaatgccgtgcttattgtcgctgccaacgacgactgttgggccaagcaatccctcgaaatcgagtgcgtggggcccctgcagcaggtcgatgcttgtgaagacaaaagctctcgctcctacaatggagaggcgaagaagctggtgggcaccagcaaagttacagagctcgatgccggacaggtgaacctgcttgggcaaaccatcgaatccgctattatcgccattagaaagcagcggacgtatgccaccatgcacttcctggagtctgtctttctcggccgccattgcgactactataaagtgttcgaacacaatagcggctactcccaggctaagtggagactgctggccaaaacaaaccattttgatatctgttctcggcacagcacccaccatttctgcagatgtatgtccgacgggacaaagtgcgagaatggaaactgggattttgcgggcgaaatgaataccacgtatcacagcaagcgcgacttctttaaacatgatttcaaacttttctgtacactcctggagaacgcttttcctgggaccacagagtctctgtactaccaactcctgtccaagcggaataccaccggagccagcaaacttctgggcaagctcattacaaagttcgggaacaataacctgtttgttggcatctggaaattcggacagtttctgctttctctcccctatgtgaataacacggaactgtccgccctgcagagctctaagatcctcgagagccctgaacccctgcttagatccgctagcggccgccaggagtctctgtccagcgccaccccgggggaggcttccaaggaatgccggaacgccaaaaagatttcttgtatcagccctagattcggagtccccatggagaatctcacagcgtgcggcgaatcccctaactacaaaatttataagacccccacacgcatctacaaatctaataacaagggggagatttggtgcgccggagacgtgcactgttttcaagagttcacccccgtgctgcaggaggttgtcgataagctgaaaaagatgacgtgctttcttacagagcctgaagctgaggaagacgccttcagcatcgctattgccatgtgtaaaatcctcgacaagggcgtgtgcaccatcaattccgagcggtggaacattatcaaatgtgattctgggctgatgtattacaccgaccagagagatggccaggacacaggaaatgattttggcgaatattgcattagccacaactgtaagaccgagcgcttcccgatcaatccctccattatcagcgactgcatctgggagtaccattctcggaagtccaaatacattagcacactgaacctcgaatctctggaggaatttaagagagcgatctccgagaaacttagccacacgctggtggtctatcaattcaagcctacctctaatctcccccatatgaaacctgtgtacaagtatattacagcccagggggttgaaaactccgatggaatcgacagcgctttcattaccgcctccatgcccgctctgagcggcacatctatcgggtacaatgtgatgagcaaggataactttccgctgttcgacatcattatctttattaaatccgccgtcatcaagaccacgtataatcacatttacgataccggacctacaatcggcattaacgtgatgcatgacgagcactgtaccgggcagtgccccatcgagatccctcacaaagaaaactggcttacattctctcaggagcgcaccagccggtggggctgtgaagagtttggatgcctggccattaatacaggctgcgttttcgggtcctgtcaagatatcattagacccgagaccaaggtgtatcggaaagctatcgaagagtctgtcctcctgacggtgtgcgttacataccctggaaacaccttttgtaccgaaattaatgcgatcgagcccaagatcacagacgaactcgagctgcagttcaaaaccgtggacacgaagacacttccgaacctgctcgccgtccagaatcataagctgtacagcggccagattaacgatctggggtcctttgctcaaggatgcggcaatatccagaaaaccaacctttctgtgattgggacaggcaccgccaagttcgactatatctgtcacggagccagccgcaaagatattatcgtgagacggtgctacaataacaattatgagtcctgtaagctgctcaaagaagaacctagcctgatcttttctgacaaccatgaaacaattgaggtcgctaatatcagacacctcctgggcgaacttcagttcaagctgatgctcggggatctgcgctacaagtccttcgccgagaaccccgagctggaaattgaggcgaaatgcgttggatgtcccagctgcttttcttcctatagctgtaatttccggatctcctctagcattgacaccgtgtgcgctatcgatggcccttgcacgatttttcataacagacttatcatctccagcaccaagcaagactacgggattaaaatgtcttgtaaggaaaaaccgaactccgtggagaagttcaatatctgcaagcgcgtctatagcgtgctgtttacaaccattgataaaaacgacaagatcgaaattaatacaggagatcagacctctttcatccaggagaaagacgatagatgtaagacgtggctctgccgggttcgcgacgagggcatcagcgtgatttttgaacccatcaaagccttctttggctcctacttctctattgccttttacgtcgtgatcgggattatcgctctgttcatcattatctatatttttctccctatggttttcaagctgaaggacatccttaaaaagaacgagctgctgtacctccaggaaatgaaatataagtga

SEQ ID NO: 14153 - RNA, 4305 nt, synthetic construct
  misc_feature 1..4305: note = derived and/or modified CDS sequence (opt5) from ANADV(EIV-16356Mg)__KT313736.1__GP
  source 1..4305: mol_type = other RNA
atgttcctgatcctcgtgctgcttattcccttttacatcaccgccacacctgtcacgaccagatgcttccacggcgggcagctgattgctgagagcaagtccctcacagccatctctgaattttgtctgaaagacgatgttagcaccgtgaagtccgagattacatatcttaaaaacgacaccggaatcttcgcgcattctaaggtgctgcggaattggatcattaaagattggaagaactgcaatccggtccccacagctggcgggagcatcaacgtgattgaagttaatgccgacctctccctgtctaccaagacgtacgtgtgtagccgcgattgcaccatcacagtcgacaaagaggatgcccaaattatctttcagaccgacaagctgaaccacttcgaagtgtccggaacaaccctcagctctggctggtttaaaacgaaggcttccgttacactggatagaacctgtgagcatattaaagtgacatgcgggaagaagacccttcagttccacgcctgttttaaacatcacatgagctgcatccggttctttcacaataccatcctgcctggaacaatggctgtctctatttgtcagaacatcgagctcattatcattacgtccctgacccttatcatcttcattctgatggtgatcctcacaaagacctatatttgctacgtgctgatgcccctgtttatgcctgtcgcctatctctacggctgggcgtataatcgcagctgtaaaaagtgctcttgctgtggcctggcctaccatcccttcacaaactgcgggtcccactgtgtttgcggacttaaattcgaagctagcgacagaatgcggatccatcgcgagtccggcctgtgtcaagggtacaagtctctcagagtggcccggctgctttgcaaaagcaagggatccagcctgattatctctatcctcctgtccgtgctgattctcagctttgtcacccctatcgaaggcacgctgacaaattatccggagtctaagaaatacagccttgaggaaattgctgatgtgatcgaggggttcattgccgaaaagggaatcaaagagtatattgttctgtacacctccatctttggcgcgctcctgcttctgatcgccctcattatcaccgtgtctctgaaccgcattacagaatatctgaccaatctcaacgtcatctactgtcacgagtgcagcatgtatcactccaagaaaaatattaagtacatcggcgacttcacaaacaagtgtgggttttgcacgtgtggagagctggaagatcaggagggccttaacatgcataaagtgagcaagaaatgcatctacagatatcagctgacctggtctaaggttattatgacaatcctcgtgtgcctgctgattgctcagaataccgtccttatcgtggccgctaacgacgactgttgggccaaacaatccctcgaaattgagtgcgtcgggcccctgcaacaggtggatgcctgtgaagacaagagctctcggtcctacaatggagaggctaagaaactggttggcacaagcaaggtgaccgagctcgatgcggggcaggtcaacctgcttggacagacgatcgaatccgccatcattgctatccgcaaacagagaacctatgccacaatgcacttcctggagtctgtgtttctcggccggcattgcgactactataaggttttcgaacacaatagcggctactcccaggccaaatggcgcctgctggctaagaccaaccattttgatatttgttctagacacagcacacaccatttctgccggtgtatgtccgacgggaccaagtgcgagaatggaaactgggattttgccggcgaaatgaatacgacatatcacagcaaaagagacttctttaagcatgatttcaaacttttctgtaccctcctggagaacgcgtttcctgggacaaccgagtctctgtactaccaactcctgtccaagcgcaataccacaggagctagcaaacttctgggcaagctcatcacgaaattcgggaacaataacctgtttgtgggcatttggaagttcggacagtttctgctttctctcccctatgtcaataacaccgaactgtccgccctgcagagctctaagatcctcgagagccctgaacccctgcttcggtccgccagcggcagacaggagtctctgtccagcgctacaccgggggaggcctccaaagaatgccgcaacgctaagaaaatctcttgtattagccctcggttcggagtgcccatggagaatctcaccgcctgcggcgaatcccctaactacaagatctataaaacacccaccagaatttacaagtctaataacaagggggagatctggtgcgcgggagacgtgcactgttttcaagaatttacgcccctgctgcaggaggttgtcgataaacttaagaaaatgacatgctttctcaccgagcctgaagccgaggaagacgctttcagcattgccatcgctatgtgtaagattctggacaaaggcgtgtgcaccatcaattccgagcgctggaacatcattaagtgtgattctgggctgatgtattacacagaccagcgggatggccaggacaccggaaatgattttggcgaatattgcatcagccacaactgtaagacagagagattcccgattaatccctccatcattagcgactgcatctgggagtaccattctcgcaaatcccggtacatcagcacgctcaacctggaatctcttgaggaatttaagagagccatttccgagaaactgagccacaccctcgtggtctatcaattcaagcctacatctaatctgccccatatgaaacctgtgtacaagtatatcaccgcgcagggggttgaaaactccgatggaattgacagcgccttcatcacagcttccatgcccgccctgagcggcacctctattgggtacaatgtgatgagcaaggataactttccgcttttcgacatcatcatttttatcaaatccgctgtcattaagacgacctataatcacatctacgatacaggacctaccattggcatcaacgtgatgcatgacgagcactgtacagggcagtgccccattgagatccctcacaaagaaaactggctgaccttctctcaggagcgcacaagccggtggggctgtgaagagtttggatgcctcgccatcaataccggctgcgttttcgggtcctgtcaagatattatcagacccgagacgaaggtgtatcggaaagccattgaagagtctgtcctgctcacagtgtgcgttacctaccctggaaacaccttttgtacagaaatcaatgctattgagcccaagatcaccgacgaactggagcttcagttcaaaacggtggacacaaagaccctgccgaacctcctggcggtccagaatcataagctgtacagcggccagatcaacgatcttgggtcctttgcccaaggatgcggcaatattcagaaaacaaacctgtctgtgatcgggaccggcacagctaagttcgactatatttgtcacggagccagccgcaaagatatcgtggtcagacggtgctacaataacaattatgagtcctgtaagctcctgaaagaggaacctagcctcattttctctgacaaccatgaaaccatcgaggttgccaatatcagacatctgcttggcgaactgcagttcaagctcatgctgggggatctgcgctacaagtccttcgctgagaaccccgagcttgaaattgaggccaaatgcgtgggatgtcccagctgcttttcttcctatagctgtaatttccggatctcctctagcattgacacggtgtgcgcgatcgatggcccttgcaccatttttcacaacagactgatcatttccagcacaaagcaagactacgggatcaaaatgtcttgtaaggaaaaaccgaaccccgtcgagaagttcaatatctgcaagcgcgtgtattccgttctctttaccacaattgataaaaacgacaagatcgaaattaataccggagatcagacgagcttcatccaggagaaagacgatagatgtaagacatggctgtgccgggtgcgcgacgagggcatttctgtcatctttgaacctatcaaggctttctttggcagctacttctccattgccttttacgtggttatcgggattatcgccctcttcattaccatctatatctttctgcccatggtgttcaaacttaaggacattctgaaaaagaacgagctgctctacctgcaggaaatgaaatataagtga

SEQ ID NO: 14154 - RNA, 4305 nt, synthetic construct
  misc_feature 1..4305: note = derived and/or modified CDS sequence (opt5) from ANADV(EIV-17769Yak)__KT313739.1__GP
  source 1..4305: mol_type = other RNA
atgttcctgatcctcgtgctgcttattcccttttacatcaccgccacacctgtcgctacgagatgcttccacggcgggcagctgattgccgagagcaagtccctcaccgcgatctctgaattttgtctgaaagacgatgttagcacagtgaagtccgagattacctatcttaaaaacgacacaggaatcttcgctcattctaaggtgctgcggaattggatcattaaagattggaagaactgcaatccggtccccaccgccggcgggagcatcaacgtgattgaagttaatgccgacctctccctgtctacaaagacctacgtgtgtagccgcgattgcacgatcaccgtcgacaaagaggatgctcaaattatctttcagacagacaacctgaatcacttcgaagtgtccggaaccacactcagctctggctggtttaagaccaaagcctccgttacgctggatagaacatgtgagcatattaaggtgacctgcgggaaaaagacacttcagttccacgcttgttttaagcatcacatgagctgcatccggttctttcacaacaccatcctgcctggaaccatggccgtctctatttgtcagaatatcgagctcattatcattacatccctgacgcttatcatcttcattctgatggtgatcctcaccaaaacatatatttgctacgtgctgatgcccctgtttatgcctgtcgcgtatctctacggctgggcctataaccgcagctgtaagaaatgctcttgctgtggcctggcttaccatcccttcaccaattgcgggtcccactgtgtttgcggacttaagttcgaagccagcgacagaatgcggatccatcgcgagtccggcctgtgtcaagggtacaaatctctcagagtggctcggctgctttgcaagagcaaaggatccagcctgattatctctatcctcctgtccgtgctgattctcagctttgtcacacctatcgaaggcaccctgacgaactatccggagtctaagaagtacagccttgaggaaattgccgatgtgatcgaggggttcattgcggaaaaaggaatcaaggagtatattgttctgtacacatccatctttggcgccctcctgcttctgatcgctctcattatcaccgtgtctctgaatcgcattaccgaatatctgacaaacctcaatgtcatctactgtcacgagtgcagcatgtatcactccaaaaagaacattaaatacgtgggcgacttcaccaacaagtgtgggttttgcacatgtggagagctggaagatcaggagggccttaatatgcataaggttagcaaaaagtgcatctacagatatcagctgacgtggtctaaagtgatcatgaccattctcgtctgcctgctgatcgcccagaacacagtgcttattgtcgctgccaatgacgactgttgggccaagcaatccctcgaaatcgagtgcgtggggcccctgcagcaggttgatgcttgtgaagacaaaagctctcggtcctacaacggagaggcgaagaagctggtgggcaccagcaaagtcacagagctcgatgccggacaggtgaatctgcttgggcaaaccattgaatccgctatcatcgccattcgcaagcagagaacgtatgccaccatgcacttcctggagtctgtttttctcggccggcattgcgactactataaagtgttcgaacacaacagcggctactcccaggctaagtggcgcctgctggccaaaacaaatcattttgatatctgttctagacacagcacccaccatttctgccggtgtatgtccgacgggacaaagtgcgagaacggaaatagagattttgcgggcgaaatgaacaccacgtatcacagcaagcgcgacttctttaaacatgatttcaatcttttctgtacactcctggagaacgcttttcctgggaccacagagtctctgtactaccaactcctgtccaagcggaataccaccggagccagcaaacttctgggcaagctcattacaaaattcgggaacaataacctgtttgtcggcatctggaagttcggacagtttctgctttctctcccctatgtgaacaatacggaactgtccgccctgcagagctctaaaattctcgagagccctgaacccctgcttagatccgctagcggccgccaggagtctctgtccagcgccaccccgggggaggcttcccgggaatgcagaaacgccaagaagatctcttgtatcagccctcgcttcggagtgcccatggagaatctcacagcgtgcggcgaatcccctaactacaaaatttataagacccccacacggatctacaaatctaataacaagggggagatttggtgcgccggagacgttcactgttttcaagagttcacccccgtcctgcaggaggtggtggataaactgaagaagatgacgtgctttcttacagagcctgaagctgaggaagacgccttcagcatcgctattgccatgtgtaaaatcctcgacaagggcgtctgcaccattaattccgagagatggaacatcatcaaatgtgattctgggctgatgtattacaccgaccagcgcgatggccaggacacaggaaatgattttggcgaatattgcattagccacaactgtaagaccgagcggttcccgatcaatccctccattatcagcgactgcatttgggagtaccattctagaaaatcccgctacatcagcacactgaacctcgaatctctggaggaatttaagcgggcgatctccgagaaacttagccacacgctggtggtttatcaattcaagcctacctctaatctcccccatatgaagcctgtgtacaaatatattacagcccagggggtcgaaaactccgatggaatcgacagcgctttcattaccgcctccatgcccgctctgagcggcacatctatcgggtacaatgtgatgagcaaggataactttccgctgttcgacattatcatctttattaaatccgccgttatcaagaccacgtataaccacatttacgataccggacctacaatcggcattaatgtgatgcatgacgagcactgtaccgggcagtgccccatcgagattcctcacaaggaaaactggcttacattctctcaggagagaaccagccggtggggctgtgaagagtttggatgcctggccatcaatacaggctgcgtcttcgggtcctgtcaagatatcattcgccccgagaccaaagtgtatagaaaggctatcgaagagtctgttctcctgacggtgtgcgtcacataccctggaaacaccttttgtaccgaaattaatgcgatcgagcccaaaattacagacgaactcgagctgcagttcaagaccgtggacacgaaaacacttccgaacctgctcgccgtgcagaatcataagctgtacagcggccagatcaacgatctggggtcctttgctcaaggatgcggcaatatccagaaaaccaacctttctgtcattgggacaggcaccgccaagttcgactatatctgtcacggagccagccggaaggatattgttgtgagacgctgctacaataacaattatgagtcctgtaaactgctcaaggaagaacctagcctgatcttttctgacaaccatgaaacaattgaggtggctaatatccggcacctcctgggcgaacttcagttcaaactgatgctcggggatctgagatacaagtccttcgccgagaaccccgagctggaaatcgaggcgaaatgcgtcggatgtcccagctgcttttcttcctatagctgtaacttccgcatttcctctagcatcgacaccgtgtgcgctattgatggcccttgcacgatctttcataatagacttattatctccagcaccaagcaagactacgggattaagatgtcttgtaaagaaaagccgaaccccgttgagaaattcaatatctgcaagcgggtgtattccgtcctgtttacaaccatcgataaaaacgacaagattgaaatcgatacaggagaccagaccagcttcattcaggagaaggatgaccgctgtaaaacgtggctctgcagagtgcgggacgagggcatctctgttatttttgaacctatcaaggccttctttggcagctacttctccatcgccttttacgtggtcattgggatcattgctctgttcatcacaatttatatctttctccccatggtgttcaaactgaaggatatccttaaaaagaatgagctgctgtacctccaggaaatgaagtataaatga

SEQ ID NO: 14155 - RNA, 4305 nt, synthetic construct
  misc_feature 1..4305: note = derived and/or modified CDS sequence (opt5) from ANADV(EIV-18098Yak)__KT313742.1__GP
  source 1..4305: mol_type = other RNA
atgttcctgatcctcgtgctgcttattcccttttacatcaccgccacacctgtcacgaccagatgcttccacggcgggcagctgattgctgagagcaagtccctcacagccatctctgaattttgtctgaaagacgatgttagcaccgtgaagtccgagattacatatcttaaaaacgacaccggaatcttcgcgcattctaaggtgctgcggaattggatcattaaagattggaagaactgcaatccggtccccacagctggcgggagcatcaacgtgattgaagttaatgccgacctctccctgtctaccaagacgtacgtgtgtagccgcgattgcaccatcacagtcgacaaagaggatgcccaaattatctttcagaccgacaagctgaaccacttcgaagtgtccggaacaaccctcagctctggctggtttaaaacgaaggcttccgttacactggatagaacctgtgagcatattaaagtgacatgcgggaagaagacccttcagttccacgcctgttttaaacatcacatgagctgcatccggttctttcacaataccatcctgcctggaacaatggctgtctctatttgtcagaacatcgagctcattatcattacgtccctgacccttatcatcttcattctgatggtgatcctcacaaagacctatatttgctacgtgctgatgcccctgtttatgcctgtcgcctatctctacggctgggcgtataatcgcagctgtaaaaagtgctcttgctgtggcctggcctaccatcccttcacaaactgcgggtcccactgtgtttgcggacttaaattcgaagctagcgacagaatgcggatccatcgcgagtccggcctgtgtcaagggtacaagtctctcagagtggcccggctgctttgcaaaagcaagggatccagcctgattatctctatcctcctgtccgtgctgattctcagctttgtcacccctatcgaaggcacgctgacaaattatccggagtctaagaaatacagccttgaggaaattgctgatgtgatcgaggggttcattgccgaaaagggaatcaaagagtatattgttctgtacacctccatctttggcgcgctcctgcttctgatcgccctcattatcaccgtgtctctgaaccgcattacagaatatctgaccaatctcaacgtcatctactgtcacgagtgcagcatgtatcactccaagaaaaatattaagtacgtgggcgacttcacaaacaagtgtgggttttgcacgtgtggagagctggaagatcaggagggccttaacatgcataaagttagcaagaaatgcatctacagatatcagctgacctggtctaaggtgatcatgacaattctcgtctgcctgctgatcgctcagaataccgtgcttattgtcgccgctaacgacgactgttgggccaaacaatccctcgaaatcgagtgcgtggggcccctgcagcaggttgatgcctgtgaagacaagagctctcggtcctacaatggagaggctaagaaactggtgggcacaagcaaggtcaccgagctcgatgcgggacaggtgaacctgcttgggcaaacgattgaatccgccatcatcgctattcgcaaacagagaacctatgccacaatgcacttcctggagtctgtttttctcggccggcattgcgactactataaggtgttcgaacacaatagcggctactcccaggccaaatggcgcctgctggctaagaccaaccattttgatatctgttctagacacagcacacaccatttctgccggtgtatgtccgacgggaccaagtgcgagaatggaaactgggattttgccggcgaaatgaatacgacatatcacagcaaaagagacttctttaagcatgatttcaaccttttctgtaccctcctggagaatgcgtttcctgggacaaccgagtctctgtactaccaactcctgtccaaacgcaacaccacaggagctagcaaacttctgggcaagctcattacgaagttcgggaataacaatctgtttgtcggcatctggaaattcggacagtttctgctttctctcccctatgtgaacaacaccgaactgtccgccctgcagagctctaagattctcgagagccctgaacccctgcttcggtccgccagcggcagacaggagtctctgtccagcgctacaccgggggaggcctcccgcgaatgccggaatgctaagaaaatctcttgtatcagccctagattcggagtgcccatggagaacctcaccgcctgcggcgaatcccctaattacaagatttataaaacacccgcgcgcatctacaagtctaacaataaaggggagatttggtgcgccggagacgttcactgttttcaagagttcacccccgtcctgcaggaggtggtggataagctgaagaaaatgacgtgctttcttacagagcctgaagctgaggaagacgccttcagcatcgctattgccatgtgtaagatcctcgacaaaggcgtctgcaccattaactccgagcggtggaatatcatcaagtgtgattctgggctgatgtattacaccgaccagagagatggccaggacacaggaaacgattttggcgaatattgcattagccacaattgtaaaaccgagcgcttcccgatcaacccctccattatcagcgactgcatttgggagtaccattctcggaagtccagatacatcagcacactgaatctcgaatctctggaggaatttaagcgcgcgatctccgagaaacttagccacacgctggtggtttatcaattcaagcctacctctaacctcccccatatgaaacctgtgtacaagtatattacagcccagggggtcgaaaattccgatggaatcgacagcgctttcattaccgcctccatgcccgctctgagcggcacatctatcgggtacaacgtgatgagcaaagataattttccgctgttcgacattatcatctttattaagtccgccgttatcaagaccacgtataaccacatttacgataccggacctacaatcggcattaacgtgatgcatgacgagcactgtaccgggcagtgccccatcgagattcctcacaaagaaaattggcttacattctctcaggagcggaccagcagatggggctgtgaagagtttggatgcctggccatcaacacaggctgcgtcttcgggtcctgtcaagatatcattcggcccgagaccaaggtgtatcgcaaagctatcgaagagtctgttctcctgacggtgtgcgtcacataccctggaaataccttttgtaccgaaattaacgcgatcgagcccaagattacagacgaactcgagctgcagttcaaaaccgtggacacgaagacacttccgaatctgctcgccgtgcagaaccataaactgtacagcggccagatcaatgatctggggtcctttgctcaaggatgcggcaacatccagaagaccaatctttctgtcattgggacaggcaccgccaagttcgactatatctgtcacggagccagcagaaaagatattgttgtgcggagatgctacaacaataactatgagtcctgtaagctgctcaaagaagaacctagcctgatcttttctgacaatcatgaaacaattgaggtggctaacatccgccacctcctgggcgaacttcagttcaagctgatgctcggggatctgcggtacaaatccttcgccgagaatcccgagctggaaatcgaggcgaagtgcgtcggatgtcccagctgcttttcttcctatagctgtaacttcagaatttcctctagcatcgacaccgtgtgcgctattgatggcccttgcacggtttttcataaccgccttatcatttccagcaccaagcaagactacgggatcaaaatgtcttgtaaggaaaaaccgaatcccgtggagaagttcaacatttgcaaaagagtctattccgtgctgtttacaaccatcgataagaatgacaagatcgaaattaacacaggagatcagaccagcttcatccaggagaaagacgatcggtgtaagacgtggctctgccgcgttagagacgagggcatttctgtgatctttgaacctattaaagccttctttggcagctacttctccatcgccttttacgtcgtgatcgggattatcgctctgttcattacaatctatatttttctccccatggttttcaagctgaaagacatccttaagaagaatgagctgctgtacctccaggaaatgaaatataagtga

SEQ ID NO: 14156 - RNA, 4305 nt, synthetic construct
  misc_feature 1..4305: note = derived and/or modified CDS sequence (opt5) from ANADV(EIV-18136Yak)__KT313745.1__GP
  source 1..4305: mol_type = other RNA
atgttcctgatcctcgtgctgcttattcccttttacatcaccgccacacctgtcacgaccagatgcttccacggcgggcagctgattgctgagagcaagtccctcacagccatctctgaattttgtctgaaagacgatgttagcaccgtgaagtccgagattacatatcttaaaaacgacaccggaatcttcgcgcattctaaggtgctgcggaattggatcattaaagattggaagaactgcaatccggtccccacagctggcgggagcatcaacgtgattgaagttaatgccgacctctccctgtctaccaagacgtacgtgtgtagccgcgattgcaccatcacagtcgacaaagaggatgcccaaattatctttcagaccgacaagctgaaccacttcgaagtgtccggaacaaccctcagctctggctggtttaaaacgaaggcttccgttacactggatagaacctgtgagcatattaaagtgacatgcgggaagaagacccttcagttccacgcctgttttaaacatcacatgagctgcatccggttctttcacaataccatcctgcctggaacaatggctgtctctatttgtcagaacatcgagctcattatcattacgtccctgacccttatcatcttcattctgatggtgatcctcacaaagacctatatttgctacgtgctgatgcccctgtttatgcctgtcgcctatctctacggctgggcgtataatcgcagctgtaaaaagtgctcttgctgtggcctggcctaccatcccttcacaaactgcgggtcccactgtgtttgcggacttaaattcgaagctagcgacagaatgcggatccatcgcgagtccggcctgtgtcaagggtacaagtctctcagagtggcccggctgctttgcaaaagcaagggatccagcctgattatctctatcctcctgtccgtgctgattctcagctttgtcacccctatcgaaggcacgctgacaaattatccggagtctaagaaatacagccttgaggaaattgctgatgtgatcgaggggttcattgccgaaaagggaatcaaagagtatattgttctgtacacctccatctttggcgcgctcctgcttctgatcgccctcattatcaccgtgtctctgaaccgcattacagaatatctgaccaatctcaacgtcatctactgtcacgagtgcagcatgtatcactccaagaaaaatattaagtacatcggcgacttcacaaacaagtgtgggttttgcacgtgtggagagctggaagatcaggagggccttaacatgcataaagtgagcaagaaatgcatctacagatatcagctgacctggtctaaggttattatgacaatcctcgtgtgcctgctgattgctcagaataccgtccttatcgtggccgctaacgacgactgttgggccaaacaatccctcgaaattgagtgcgtcgggcccctgcaacaggtggatgcctgtgaagacaagagctctcggtcctacaatggagaggctaagaaactggttggcacaagcaaggtgaccgagctcgatgcggggcaggtcaacctgcttggacagacgatcgaatccgccatcattgctatccgcaaacagagaacctatgccacaatgcacttcctggagtctgtgtttctcggccggcattgcgactactataaggttttcgaacacaatagcggctactcccaggccaaatggcgcctgctggctaagaccaaccattttgatatttgttctagacacagcacacaccatttctgccggtgtatgtccgacgggaccaagtgcgagaatggaaactgggattttgccggcgaaatgaatacgacatatcacagcaaaagagacttctttaagcatgatttcaaacttttctgtaccctcctggagaacgcgtttcctgggacaaccgagtctctgtactaccaactcctgtccaagcgcaataccacaggagctagcaaacttctgggcaagctcatcacgaaattcgggaacaataacctgtttgtgggcatttggaagttcggacagtttctgctttctctcccctatgtcaataacaccgaactgtccgccctgcagagctctaagatcctcgagagccctgaacccctgcttcggtccgccagcggcagacaggagtctctgtccagcgctacaccgggggaggcctccaaagaatgccgcaacgctaagaaaatctcttgtattagccctcggttcggagtgcccatggagaatctcaccgcctgcggcgaatcccctaactacaagatctataaaacacccaccagaatttacaagtctaataacaagggggagatctggtgcgtgggagacgttcactgttttcaagagttcacgcccgtcctgcaggaggtggtggataaactgaagaaaatgacatgctttcttaccgagcctgaagcggaggaagacgccttcagcattgctatcgccatgtgtaagattctcgacaaaggcgtctgcaccatcaattccgagcgctggaacatcatgaagtgtgattctgggctgatgtattacacagaccagcgggatggccaggacaccggaaatgattttggcgaatattgcattagccacaactgtaagacagagagattcccgatcaatccctccattatcagcgactgcatttgggagtaccattctcgcaaatcccggtacatcgggacgctgaacctcgaaagcctggaggaatttaagagagctatctctgagaaactttcccacaccctggtggtttatcaattcaagcctacaagcaatctcccccatatgaaacctgtgtacaagtatattaccgcccagggagtcgaaaactctgatggcatcgactccgcgttcattacagccagcatgcccgctctgtccgggaccagcatcggatacaatgtgatgtctaaggataactttccgctgttcgacattatcatctttattaaaagcgccgttatcaagacgacctataatcacatttacgatacaggccctaccatcgggattaacgtgatgcatgacgagcactgtacaggccagtgccccatcgagattcctcacaaagaaaactggcttaccttctcccaggagcgcacatctcggtggggatgtgaagagtttggctgcctggctatcaataccgggtgcgtcttcggaagctgtcaagatatcattagacccgagacgaaggtgtatcggaaagccatcgaagagtccgttctcctgacagtgtgcgtcacctaccctggcaacaccttttgtacagaaattaatgccatcgagcccaagattaccgacgaactcgagctgcagttcaaaacggtggacacaaagacccttccgaacctgctcgctgtgcagaatcataagctgtactctgggcagatcaacgatctgggcagctttgcgcaaggatgcgggaatatccagaaaacaaacctttccgtcattggcaccggaacagccaagttcgactatatctgtcacggcgcttctcgcaaagatattgttgtgagacggtgctacaataacaattatgagagctgtaagctgctcaaagaagaaccttccctgatctttagcgacaaccatgaaaccattgaggtggccaatatcagacacctcctgggggaacttcagttcaagctgatgctcggagatctgcgctacaagtctttcgccgagaaccccgagctggaaatcgaggctcggtgcgtcggctgtccctcctgctttagctcttattcctgtaatttcagaattagctcctctatcgacacggtgtgcgccattgatgggccttgcaccatctttcataaccgccttattatcagctccacaaaacaagactacggaattaagatgagctgtaaagaaaagccgaaccccgttgagaaattcaatatctgcaagagagtgtattctgtcctgtttaccacaatcgataagaacgacaaaattgaaatcaataccggcgatcagacgtccttcattcaggagaaggacgatcggtgtaaaacatggctctgccgcgtgagagacgagggcatcagcgttatttttgaacctatcaaggcgttctttgggtcttacttcagcatcgctttttacgtggtcattggaatcattgccctgttcatcattatctatatctttctccccatggtgttcaaactgaaggacattcttaagaaaaacgagctgctgtacctccaggaaatgaagtataaatga

SEQ ID NO: 14157 - RNA, 4305 nt, synthetic construct
  misc_feature 1..4305: note = derived and/or modified CDS sequence (opt5) from ANADV(EIV-18146Yak)__KT313748.1__GP
  source 1..4305: mol_type = other RNA
atgttcctgatcctcgtgctgcttattcccttttacatcaccgccacacctgtcacgaccagatgcttccacggcgggcagctgattgctgagagcaagtccctcacagccatctctgaattttgtctgaaagacgatgttagcaccgtgaagtccgagattatctatcttaaaaacgacacaggaatcttcgcgcattctaaggtgctgcggaattggattatcaaagattggaagaactgcaatccggtccccaccgctggcgggagcattaacgtgatcgaagttaatgccgacctctccctgtctacaaagacctacgtgtgtagccgcgattgcacgattaccgtcgacaaagaggatgcccaaatcatttttcagacagacaagctgaaccacttcgaagtgtccggaaccacactcagctctggctggtttaaaaccaaggcttccgttacgctggatagaacatgtgagcatatcaaagtgacctgcgggaagaagacacttcagctgcacgcctgtttcaaacatcacatgagctgcatccggtttttccacaataccattctccctggaaccatggctgtctctatctgtcagaacattgagctgatcattatcacatcccttacgctgatcatttttatcctcatggtgattctgaccaagacatatatctgctacgtgctgatgcccctcttcatgcctgtcgcctatctgtacggctgggcgtataatcgcagctgtaaaaagtgctcttgctgtggccttgcctaccatccctttaccaactgcgggtcccactgtgtttgcggactgaaattcgaagctagcgacagaatgcggattcatcgcgagtccggcctctgtcaagggtacaagtctctgagagtggcccggcttctgtgcaaaagcaagggatccagcctcatcgtgtctatcctgctgtccgtcctcattctgagcttcgtgacacctatcgaaggcacccttacgaattatccggagtctaagaaatacagcctggaggaaattgctgatgttatcgaggggtttattgccgaaaagggaatcaaagagtatattgtgctctacacatccatcttcggcgcgctgcttctgctcatcgccctgattatcaccgtctctctgaaccgcattaccgaatatctcacaaatctgaacgtgatctactgtcacgagtgcagcatgtatcactccaagaaaaatattaagtacatcggcgactttaccaacaagtgtgggttctgcacatgtggagagcttgaagatcaggagggcctgaacatgcataaagttagcaagaaatgcatctacagatatcagctcacgtggtctaaggtgattatgaccatcctggtctgcctgcttattgctcagaatacagtgctcatcgtcgccgctaacgacgactgttgggccaaacaatccctggaaattgagtgcgtggggcccctgcagcaggttgatgcctgtgaagacaagagctctcggtcctacaatgaggaggctaagaaactcgtgggaaccagcaaggtcacagaactggatgcgggccaggtgaaccttctggggcaaaccatcgagtccgccatcattgctatccgcaaacagagaacgtatgccaccatgcactttctcgaatctgttttcctgggacggcattgcgactactataaggtgtttgagcacaatagcggctactcccaggccaaatggcgcctgcttgctaagacaaaccatttcgatatttgttctagacacagcacccaccatttttgccggtgtatgtccgacggcacaaagtgcgaaaatgggaactgggatttcgccggagagatgaataccacgtatcacagcaaaagagactttttcaagcatgattttaacctcttctgtacactgctggagaatgcgttccctggcaccacagaatctctctactaccaactgctttccaaacgcaacaccaccggggctagcaagctgctcggaaaactgatcacaaagtttggcaataacaatctgttcgtcgggatttggaaatttggccagttccttctctctctgccctatgtgaacaacacggagctgtccgccctccagagctctaagatcctggaaagccctgagccccttctgcggtccgccagcggaagacaggagtctctctccagcgctaccccgggcgaagcctccaaggagtgccgcaatgctaaaaagatctcttgtattagccctcggtttggggtgcccatggaaaacctgacagcctgcggagagtcccctaattacaaaatctataagacccccacaagaatttacaaatctaacaataagggcgaaatctggtgcgcgggggacgttcactgtttccaagagtttacccccgtcctgcaggaggtggtggataagctcaaaaagatgacgtgcttcctcacagaacctgaggccgaagaggacgcttttagcattgccatcgctatgtgtaaaattctggacaagggagtctgcaccatcaactccgaacgctggaatatcattaaatgtgattctggcctgatgtattacaccgaccagcgggatgggcaggacacaggcaacgatttcggagagtattgcatcagccacaattgtaagaccgagagatttccgattaacccctccatcattagcgactgcatctgggaataccattctcgcaagtcccggtacatcagcacactcaatctggagtctcttgaagagttcaaaagagccatttccgaaaagctgagccacacgctcatcgtgtatcaatttaaacctacctctaacctgccccatatgaagcctgtttacaaatatattacagcgcagggcgtggaaaattccgatgggatcgacagcgccttcattaccgcttccatgcccgccctgagcggaacatctatcggctacaacgtcatgagcaaggataatttcccgctttttgacatcattatcttcattaagtccgctgtgatcaaaaccacgtataaccacatttacgataccgggcctacaatcggaattaacgttatgcatgacgagcactgtaccggccagtgccccatcgagatccctcacaaggagaattggctgacattttctcaggaacgcaccagccggtgggggtgtgaggagttcggctgcctcgccattaacacaggatgcgtgtttggctcctgtcaagatatcattagacccgaaaccaaagtctatcggaaggccatcgaggaatctgtgctgctcacggtttgcgtgacataccctgggaataccttctgtaccgagattaacgctatcgaacccaaaatcacagacgagctggagcttcagtttaagaccgtcgacacgaaaacactgccgaatctcctggcggtgcagaaccataagctgtacagcggacagattaatgatcttggctccttcgcccaagggtgcggaaacatccagaagaccaatctgtctgtgattggcacagggaccgctaaatttgactatatctgtcacggcgccagccgcaaggatattgtcgttagacggtgctacaacaataactatgaatcctgtaaactcctgaaggaggaacctagcctcatcttctctgacaatcatgagacaatcgaagtggccaacattagacatctgcttggagagctgcagtttaaactcatgctgggcgatctgcgctacaagtccttcgctgagaatcccgaacttgagatcgaagcccggtgcgtggggtgtcccagctgcttctcttcctatagctgtaactttagaatttcctctagcatcgacaccgtctgcgcgattgatggaccttgcacgatcttccacaaccgcctgattatctccagcaccaagcaagactacggcatcaaaatgtcttgtaaggagaaaccgaatcccgtggaaaagtttaacatttgcaaaagagtttattccgtgcttttcacaaccatcgataagaatgacaagattgagatcaacacaggggatcagaccagctttattcaggagaaagacgatcggtgtaagacgtggctgtgccgcgtcagagacgaaggaatctctgtgatcttcgagcctattaaagcctttttcggcagctacttttccatcgctttctacgttgtgattggcatcattgccctctttatcatcatttatatcttcctgcccatggtctttaaacttaaggacattctgaagaagaatgaactgctctacctgcaggagatgaaatataagtga

SEQ ID NO: 14158 - RNA, 4305 nt, synthetic construct
  misc_feature 1..4305: note = derived and/or modified CDS sequence (opt5) from ANADV(EIV-18353Yak)__KT313751.1__GP
  source 1..4305: mol_type = other RNA
atgttcctgatcctcgtgctgcttattcccttttacatcaccgccacacctgtcacgaccagatgcttccacggcgggcagctgattgctgagagcaagtccctcacagccatctctgaattttgtctgaaagacgatgttagcaccgtgaagtccgagattatctatcttaaaaacgacacaggaatcttcgcgcattctaaggtgctgcggaattggattatcaaagattggaagaactgcaatccggtccccaccgctggcgggagcattaacgtgatcgaagttaatgccgacctctccctgtctacaaagacctacgtgtgtagccgcgattgcacgattaccgtcgacaaagaggatgcccaaatcatttttcagacagacaagctgaaccacttcgaagtgtccggaaccacactcagctctggctggtttaaaaccaaggcttccgttacgctggatagaacatgtgagcatatcaaagtgacctgcgggaagaagacacttcagttccacgcctgttttaaacatcacatgagctgcatccggttctttcacaataccattctgcctggaaccatggctgtctctatctgtcagaacattgagctcatcattatcacatccctgacgcttatcattttcatcctgatggtgattctcaccaagacatatatctgctacgtgctgatgcccctgtttatgcctgtcgcctatctctacggctgggcgtataatcgcagctgtaaaaagtgctcttgctgtggcctggcctaccatcccttcaccaactgcgggtcccactgtgtttgcggacttaaattcgaagctagcgacagaatgcggattcatcgcgagtccggcctgtgtcaagggtacaagtctctcagagtggcccggctgctttgcaaaagcaagggatccagcctgatcatctctattctcctgtccgtgctgatcctcagctttgtcacacctattgaaggcaccctgacgaattatccggagtctaagaaatacagccttgaggaaatcgctgatgtgattgaggggttcatcgccgaaaagggaattaaagagtatatcgttctgtacacatccatctttggcgcgctcctgcttctgattgccctcatcattaccgtgtctctgaaccgcatcaccgaatatctgacaaatctcaacgtcatttactgtcacgagtgcagcatgtatcactccaagaaaaatatcaagtacatcggcgacttcaccaacaagtgtgggttttgcacatgtggagagctggaagatcaggagggccttaacatgcataaagtgagcaagaaatgcatttacagatatcagctgacgtggtctaaggttatcatgaccattctcgtgtgcctgctgatcgctcagaatacagtccttattgtggccgctaacgacgactgttgggccaaacaatccctcgaaatcgagtgcgtcgggcccctgcaacaggtggatgcctgtgaagacaagagctctcggtcctacaatgaggaggctaagaaactggttggaaccagcaaggtgacagaactcgatgcgggccaggtcaacctgcttgggcagaccatcgagtccgccattatcgctattcgcaaacagagaacgtatgccaccatgcacttcctggaatctgtgtttctcggacggcattgcgactactataaggttttcgagcacaatagcggctactcccaggccaaatggcgcctgctggctaagacaaaccattttgatatctgttctagacacagcacccaccatttctgccggtgtatgtccgacggcacaaagtgcgaaaatgggaactgggattttgccggagagatgaataccacgtatcacagcaaaagagacttctttaagcatgatttcaaccttttctgtacactcctggagaatgcgtttcctggcaccacagaatctctgtactaccaactcctgtccaaacgcaacaccaccggggctagcaaacttctgggaaaactcattacaaagttcggcaataacaatctgtttgtggggatctggaaattcggccagtttctgctttctctcccctatgtcaacaacacggagctgtccgccctgcagagctctaagatcctcgaaagccctgagcccctgcttcggtccgccagcggaagacaggagtctctgtccagcgctaccccgggcgaagcctccaaggagtgccgcaatgctaaaaagatttcttgtatcagccctcggttcggggtgcccatggaaaacctcacagcctgcggagagtcccctaattacaaaatttataagacccccacaagaatctacaaatctaacaataagggcgaaatttggtgcgcgggggacgtgcactgttttcaagagttcacccccgttctgcaggaggtcgtggataagctgaaaaagatgacgtgctttcttacagaacctgaggccgaagaggacgctttcagcatcgccattgctatgtgtaaaatcctcgacaagggagtgtgcaccatcaactccgaacgctggaatattatcaaatgtgattctggcctgatgtattacaccgaccagcgggatgggcaggacacaggcaacgattttggagagtattgcattagccacaattgtaagaccgagagattcccgatcaacccctccattatcagcgactgcatctgggaataccattctcgcaagtcccggtacattagcacactgaatctcgagtctctggaagagtttaaaagagccatctccgaaaaacttagccacacgctgattgtctatcaattcaagcctacctctaacctcccccatatgaagcctgtgtacaaatatatcacagcgcagggcgttgaaaattccgatgggattgacagcgccttcatcaccgcttccatgcccgccctgagcggaacatctatcggctacaacgtgatgagcaaggataattttccgctgttcgacattatcatttttatcaagtccgctgtcattaaaaccacgtataaccacatctacgataccgggcctacaattggaatcaacgtgatgcatgacgagcactgtaccggccagtgccccatcgagattcctcacaaggagaattggcttacattctctcaggaacgcaccagccggtgggggtgtgaggagtttggctgcctggccatcaacacaggatgcgttttcggctcctgtcaagatattatcagacccgaaaccaaagtgtatcggaaggccattgaggaatctgtcctcctgacggtgtgcgttacataccctgggaataccttttgtaccgagatcaacgctatcgaacccaaaattacagacgagctcgagctgcagttcaagaccgtggacacgaaaacacttccgaatctgctcgcggtccagaaccataagctgtacagcggacagatcaatgatctgggctcctttgcccaagggtgcggaaacattcagaagaccaatctttctgtgatcggcacagggaccgctaaattcgactatatttgtcacggcgccagccgcaaggatatcgtggtcagacggtgctacaacaataactatgaatcctgtaaactgctcaaggaggaacctagcctgatcttttctgacaatcatgagacaattgaagttgccaacatcagacacctcctgggagagcttcagttcaaactgatgctcggcgatctgcgctacaagtccttcgctgagaatcccgaactggagattgaagcccggtgcgtggggtgtcccagctgcttttcttcctatagctgtaacttcagaatctcctctagcattgacaccgtgtgcgcgatcgatggaccttgcacgatttttcataaccgccttatcatctccccgaccaagcaagactacggcattaaaatgagctgtaaggagaaacccaatcctgtcgaaaagttcaacatctgcaaaagagtgtattctgttctgtttacaaccattgataagaatgacaagatcgagattaacacaggggatcagacctccttcatccaggagaaagacgatcggtgtaagacgtggctctgccgcgtgagagacgaaggaatcagcgtcatttttgagcccatcaaggctttctttggctcttacttcagcattgccttttacgtggttatcggcattatcgccctgttcatcattatctatatttttctccctatggtgttcaagctgaaagacatccttaagaagaatgaactgctgtacctccaggagatgaaatataagtga

SEQ ID NO: 14159 - RNA, 4305 nt, synthetic construct
  misc_feature 1..4305: note = derived and/or modified CDS sequence (opt5) from ANADV(EIV-18560Yak)__KT313754.1__GP
  source 1..4305: mol_type = other RNA
atgttcctgatcctcgtgctgcttattcccttttacatcaccgccacacctgtcacgaccagatgcttccacggcgggcagctgattgctgagagcaagtccctcacagccatctctgaattttgtctgaaagacgatgttagcaccgtgaagtccgagattatctatcttaaaaacgacacaggaatcttcgcgcattctaaggtgctgcggaattggattatcaaagattggaagaactgcaatccggtccccaccgctggcgggagcattaacgtgatcgaagttaatgccgacctctccctgtctacaaagacctacgtgtgtagccgcgattgcacgattaccgtcgacaaagaggatgcccaaatcatttttcagacagacaagctgaaccacttcgaagtgtccggaaccacactcagctctggctggtttaaaaccaaggcttccgttacgctggatagaacatgtgagcatatcaaagtgacctgcgggaagaagacacttcagttccacgcctgttttaaacatcacatgagctgcatccggttctttcacaataccattctgcctggaaccatggctgtctctatctgtcagaacattgagctcatcattatcacatccctgacgcttatcattttcatcctgatggtgattctcaccaagacatatatctgctacgtgctgatgcccctgtttatgcctgtcgcctatctctacggctgggcgtataatcgcagctgtaaaaagtgctcttgctgtggcctggcctaccatcccttcaccaactgcgggtcccactgtgtttgcggacttaaattcgaagctagcgacagaatgcggattcatcgcgagtccggcctgtgtcaagggtacaagtctctcagagtggcccggctgctttgcaaaagcaagggatccagcctgatcatctctattctcctgtccgtgctgatcctcagctttgtcacacctattgaaggcaccctgacgaattatccggagtctaagaaatacagccttgaggaaatcgctgatgtgattgaggggttcatcgccgaaaagggaattaaagagtatatcgttctgtacacatccatctttggcgcgctcctgcttctgattgccctcatcattaccgtgtctctgaaccgcatcaccgaatatctgacaaatctcaacgtcatttactgtcacgagtgcagcatgtatcactccaagaaaaatatcaagtacatcggcgacttcaccaacaagtgtgggttttgcacatgtggagagctggaagatcaggagggccttaacatgcataaagtgagcaagaaatgcatttacagatatcagctgacgtggtctaaggttatcatgaccattctcgtgtgcctgctgatcgctcagaatacagtccttattgtggccgctaacgacgactgttgggccaaacaatccctcgaaatcgagtgcgtcgggcccctgcaacaggtggatgcctgtgaagacaagagctctcggtcctacaatgaggaggctaagaaactggttggaaccagcaaggtgacagaactcgatgcgggccaggtcaacctgcttgggcagaccatcgagtccgccattatcgctattcgcaaacagagaacgtatgccaccatgcacttcctggaatctgtgtttctcggacggcattgcgactactataaggttttcgagcacaatagcggctactcccaggccaaatggcgcctgctggctaagacaaaccattttgatatctgttctagacacagcacccaccatttctgccggtgtatgtccgacggcacaaagtgcgaaaatgggaacagagattttgccggagagatgaataccacgtatcacagcaaacgcgacttctttaagcatgatttcaaccttttctgtacactcctggagaatgcgtttcctggcaccacagaatctctgtactaccaactcctgtccaaacggaacaccaccggggctagcaaacttctgggaaaactcattacaaagttcggcaataacaatctgtttgtggggatctggaaattcggccagtttctgctttctctcccctatgtcaacaacacggagctgtccgccctgcagagctctaagatcctcgaaagccctgagcccctgcttagatccgccagcggacgccaggagtctctgtccagcgctaccccgggcgaagcctccaaggagtgccggaatgctaaaaagatttcttgtatcagccctagattcggggtgcccatggaaaacctcacagcctgcggagagtcccctaattacaaaatttataagacccccacacgcatctacaaatctaacaataagggcgaaatttggtgcgcgggggacgtgcactgttttcaagagttcacccccgttctgcaggaggtcgtggataagctgaaaaagatgacgtgctttcttacagaacctgaggccgaagaggacgctttcagcatcgccattgctatgtgtaaaatcctcgacaagggagtgtgcaccatcaactccgaacggtggaatattatcaaatgtgattctggcctgatgtattacaccgaccagagagatgggcaggacacaggcaacgattttggagagtattgcattagccacaattgtaagaccgagcgcttcccgatcaacccctccattatcagcgactgcatctgggaataccattctcggaagtccagatacattagcacactgaatctcgagtctctggaagagtttaaacgcgccatctccgaaaaacttagccacacgctgattgtctatcaattcaagcctacctctaacctcccccatatgaagcctgtgtacaaatatatcacagcgcagggcgttgaaaattccgatgggattgacagcgccttcatcaccgcttccatgcccgccctgagcggaacatctatcggctacaacgtgatgagcaaggataattttccgctgttcgacattatcatttttatcaagtccgctgtcattaaaaccacgtataaccacatctacgataccgggcctacaattggaatcaacgtgatgcatgacgagcactgtaccggccagtgccccatcgagattcctcacaaggagaattggcttacattctctcaggaacggaccagcagatgggggtgtgaggagtttggctgcctggccatcaacacaggatgcgttttcggctcctgtcaagatattatccggcccgaaaccaaagtgtatcgcaaggccattgaggaatctgtcctcctgacggtgtgcgttacataccctgggaataccttttgtaccgagatcaacgctatcgaacccaaaattacagacgagctcgagctgcagttcaagaccgtggacacgaaaacacttccgaatctgctcgcggtccagaaccataagctgtacagcggacagatcaatgatctgggctcctttgcccaagggtgcggaaacattcagaagaccaatctttctgtgatcggcacagggaccgctaaattcgactatatttgtcacggcgccagcagaaaggatatcgtggtccggagatgctacaacaataactatgaatcctgtaaactgctcaaggaggaacctagcctgatcttttctgacaatcatgagacaattgaagttgccaacatccgccacctcctgggagagcttcagttcaaactgatgctcggcgatctgcggtacaagtccttcgctgagaatcccgaactggagattgaagccagatgcgtggggtgtcccagctgcttttcttcctatagctgtaacttccgcatctcctctagcattgacaccgtgtgcgcgatcgatggaccttgcacgatttttcataacagacttatcatctccccgaccaagcaagactacggcattaaaatgagctgtaaggagaaacccaatcctgtcgaaaagttcaacatctgcaaacgggtgtattctgttctgtttacaaccattgataagaatgacaagatcgagattaacacaggggatcagacctccttcatccaggagaaagacgatcgctgtaagacgtggctctgcagagtgcgggacgaaggaatcagcgtcatttttgagcccatcaaggctttctttggctcttacttcagcattgccttttacgtggttatcggcattatcgccctgttcatcattatctatatttttctccctatggtgttcaagctgaaagacatccttaagaagaatgaactgctgtacctccaggagatgaaatataagtga

SEQ ID NO: 14160 - RNA, 4305 nt, synthetic construct
  misc_feature 1..4305: note = derived and/or modified CDS sequence (opt5) from ANADV(EIV-18715Yak)__KT313757.1__GP
  source 1..4305: mol_type = other RNA
atgttcctgatcctcgtgctgcttattcccttttacatcaccgccacacctgtcacgaccagatgcttccacggcgggcagctgattgctgagagcaagtccctcacagccatctctgaattttgtctgaaagacgatgttagcaccgtgaagtccgagattacatatcttaaaaacgacaccggaatcttcgcgcattctaaggtgctgcggaattggatcattaaagattggaagaactgcaatccggtccccacagctggcgggagcatcaacgtgattgaagttaatgccgacctctccctgtctaccaagacgtacgtgtgtagccgcgattgcaccatcacagtcgacaaagaggatgcccaaattatctttcagaccgacaagctgaaccacttcgaagtgtccggaacaaccctcagctctggctggtttaaaacgaaggcttccgttacactggatagaacctgtgagcatattaaagtgacatgcgggaagaagacccttcagttccacgcctgttttaaacatcacatgagctgcatccggttctttcacaataccatcctgcctggaacaatggctgtctctatttgtcagaacatcgagctcattatcattacgtccctgacccttatcatcttcattctgatggtgatcctcacaaagacctatatttgctacgtgctgatgcccctgtttatgcctgtcgcctatctctacggctgggcgtataatcgcagctgtaaaaagtgcccctgctgtggcctggcctaccatcctttcacaaactgcgggtctcactgtgtttgcggacttaaattcgaggcttccgacagaatgcggatccatcgcgagagcggcctgtgtcaagggtacaagtccctcagagtggcccggctgctttgcaaatctaagggaagctccctgattatcagcatcctcctgtctgtgctgattctctcctttgtcaccccgatcgaaggcacgctgacaaattatcccgagagcaagaaatactctcttgaggaaattgctgatgtgatcgaggggttcattgccgaaaagggaatcaaagagtatattgttctgtacaccagcatctttggcgcgctcctgcttctgatcgccctcattatcaccgtgtccctgaaccgcattacagaatatctgaccaatctcaacgtcatctactgtcacgagtgctctatgtatcacagcaagaaaaatattaagtacatcggcgacttcacaaacaagtgtgggttttgcacgtgtggagagctggaagatcaggagggccttaacatgcataaagtgtccaagaaatgcatctacagatatcagctgacctggagcaaggttattatgacaatcctcatttgcctgctgatcgctcagaataccgtgcttattgtcgccgctaacgacgactgttgggccaaacaatctctcgaaatcgagtgcgtggggcctctgcagcaggtcgatgcctgtgaagacaagtccagccggtcttacaatggagaggctaagaaactggtgggcacatcccgcgttaccgagctcgatgcgggacaggtgaacctgcttgggcaaacgatcgaaagcgccattatcgctattagaaagcagcggacctatgccacaatgcacttcctggagtccgtctttctcggccgccattgcgactactataaagtgttcgaacacaattctggctacagccaggccaagtggagactgctggctaaaaccaaccattttgatatctgttcccggcactctacacaccatttctgcagatgtatgagcgacgggaccaagtgcgagaatggaaactgggattttgccggcgaaatgaatacgacatatcactccaagcgcgacttctttaaacatgatttcagccttttctgtaccctcctggagaacgcgtttcccgggacaaccgagtctctgtactaccaactcctgtccaagcggaataccacaggagctagcaaacttctgggcaagctcattacgaaattcgggaacaataacctgtttgttggcatctggaagttcggacagtttctgctttctctcccttatgtgaataacaccgaactgtccgccctgcagagctctaaaatcctcgagagccccgaaccgctgcttagatccgccagcggccgccaggagtctctgtccagcgctacacctggggaggcctccaaggaatgccggaacgctaagaaaatttcttgtatcagccccagattcggagtccctatggagaatctcaccgcctgcggcgaatcccccaactacaagatttataaaacacccacccgcatctacaagtctaataacaaaggggagatttggtgcgcgggagacgtgcactgttttcaagaatttacgcctgtgctgcaggaggttgtcgataagctgaagaaaatgacatgctttcttaccgagccggaagccgaggaagacgctttcagcatcgccattgctatgtgtaagatcctcgacaaaggcgtgtgcaccatcaattccgagcggtggaacattatcaagtgtgattctgggctgatgtattacacagaccagagagatggccaggacaccggaaatgattttggcgaatattgcattagccacaactgtaaaacagagcgcttccccatcaatccttccattatcagcgactgcgtgtgggagtaccattctcggaagtccagatacatcagcacgctgaacctcgaatctctggaggaatttaagcgcgccatttccgagaaacttagccacaccctggtcgtgtatcaattcaagcccacatctaatctccctcatatgaaacccgtttacaagtatatcaccgcgcagggggtggaaaactccgatggaattgacagcgccttcatcacagcttccatgccggccctgagcggcacctctattgggtacaatgtcatgagcaaagataactttcctctgttcgacatcatcatttttatcaagtccgctgtgattaagacgacctataatcacatctacgatacaggacccaccattggcatcaacgttatgcatgacgagcactgtacagggcagtgccctattgagatcccccacaaagaaaactggcttaccttctctcaggagcggacaagcagatggggctgtgaagagtttggatgcctggccatcaataccggctgcgtgttcgggtcctgtcaagatattatccggcctgagacgaaggtctatcgcaaagccattgaagagtctgtgctcctgacagtttgcgtgacctaccccggaaacaccttttgtacagaaatcaatgctattgagccgaagatcaccgacgaactcgagctgcagttcaaaacggtcgacacaaagacccttcctaacctgctcgcggtgcagaatcataaactgtacagcggccagatcaacgatctggggtcctttgcccaaggatgcggcaatattcagaagacaaacctttctgtgatcgggaccggcacagctaagttcgactatatttgtcacggagccagcagaaaagatatcgtcgttcggagatgctacaataacaattatgagtcctgtaagctgctcaaagaagaacccagcctgattttctctgacaaccatgaaaccatcgaggtggccaatatccgccacctcctgggcgaacttcagttcaagctgatgctcggggatctgcggtacaaatccttcgctgagaaccccgagctggaaattgaggccagatgcgtgggatgtcctagctgcttttcttcctatagctgtaatttccgcatctcctctagcattgacacggtctgcgcgatcgatggcccgtgcaccatttttcattccagacttatcattagctctacaaagcaagactacgggatcaagatgtcctgtaaagaaaagcccaaccctgtggagaaattcaacatctgcaagcgggtttatagcgtgctgtttaccacaattgataaaaatgacaagatcgaaattaacaccggagatcagacgtctttcatccaggagaaggacgatcgctgtaaaacatggctctgcagagtccgggacgagggcattagcgtgatctttgaacccatcaaggctttctttggctcctacttctctattgccttttacgttgtgatcgggattatcgccctgttcattatcatctatatttttctccctatggtcttcaaactgaaggacatccttaaaaagaatgagctgctgtacctccaggaaatgaagtataaatga

SEQ ID NO: 14161 - RNA, 4305 nt, synthetic construct
  misc_feature 1..4305: note = derived and/or modified CDS sequence (opt5) from ANADV(EIV-23263Tyum)__KT313760.1__GP
  source 1..4305: mol_type = other RNA
atgttcctgatcctcgtgctgcttattcccttttacatcaccgccacacctgtcacgaccagatgcttccacggcgggcagctgattgctgagagcaagtccctcacagccatctctgaattttgtctgaaagacgatgttagcaccgtgaagtccgagattacatatcttaaaaacgacaccggaatcttcgcgcattctaaggtgctgcggaattggatcattaaagattggaagaactgcaatccggtccccacagctggcgggagcatcaacgtgattgaagttaatgccgacctctccctgtctaccaagacgtacgtgtgtagccgcgattgcaccatcacagtcgacaaagaggatgcccaaattatctttcagaccgacaagctgaaccacttcgaagtgtccggaacaaccctcagctctggctggtttaaaacgaaggcttccgttacactggatagaacctgtgagcatattaaagtgacatgcgggaagaagacccttcagttccacgcctgttttaaacatcacatgagctgcatccggttctttcacaataccatcctgcctggaacaatggctgtctctatttgtcagaacatcgagctcattatcattacgtccctgacccttatcatcttcattctgatggtgatcctcacaaagacctatatttgctacgtgctgatgcccctgtttatgcctgtcgcctatctctacggctgggcgtataatcgcagctgtaaaaagtgctcttgctgtggcctggcctaccatcccttcacaaactgcgggtcccactgtgtttgcggacttaaattcgaagctagcgacagaatgcggatccatcgcgagtccggcctgtgtcaagggtacaagtctctcagagtggcccggctgctttgcaaaagcaagggatccagcctgattatctctatcctcctgtccgtgctgattctcagctttgtcacccctatcgaaggcacgctgacaaattatccggagtctaagaaatacagccttgaggaaattgctgatgtgatcgaggggttcattgccgaacgcggaatcaaggagtatattgttctgtacacctccatctttggcgcgctcctgcttctgatcgccctcattatcaccgtgtctctgaacagaattacagaatatctgaccaatctcaacgtcatctactgtcacgagtgcagcatgtatcactccaaaaagaatattaaatacatcggcgacttcacaaacaagtgtgggttttgcacgtgtggagagctggaagatcaggagggccttaacatgcataaggtgagcaaaaagtgcatctaccggtatcagctgacctggtctaaagttattatgacaatcctcgtgtgcctgctgattgctcagaataccgtccttatcgtggccgctaacgacgactgttgggccaagcaatccctcgaaattgagtgcgtcgggcccctgcaacaggtggatgcctgtgaagacaaaagctctcgctcctacaatggagaggctagaaagctggttggcacaagcaaggtgaccgagctcgatgcggggcaggtcaacctgcttggacagacgatcgaatccgccatcattgctatccggaaacagcgcacctatgccacaatgcacttcctggagtctgtgtttctcggcagacattgcgactactataaggttttcgaacacaatagcggctactcccaggccaaatggcggctgctggctaagaccaaccattttgatatttgttctagacacagcacacaccatttctgccgctgtatgtccgacgggaccaaatgcgagaatggaaactgggattttgccggcgaaatgaatacgacatatcacagcaagcgggacttctttaagcatgatttcaaacttttctgtaccctcctggagaacgcgtttcctgggacaaccgagtctctgtactaccaactcctgtccaagagaaataccacaggagctagcaaacttctgggcaagctcatcacgaaattcgggaacaataacctgtttgtgggcatttggaagttcggacagtttctgctttctctcccctatgtcaataacaccgaactgtccgccctgcagagctctaaaatcctcgagagccctgaacccctgcttcgctccgccagcggccggcaggagtctctgtccagcgctacaccgggggaggcctccaaggaatgcagaaacgctaagaaaatctcttgtattagccctcgcttcggagtgcccatggagaatctcaccgcctgcggcgaatcccctaactacaagatctttaaaacacccacccggatttataagtctaataacaaaggggagatctggtgcgcgggagacgtgcactgtttccaagaatttacgcccattctgcaggaggttgtcgataagctgaagaaaatgacatgcttccttaccgagcctgaagccgaggaagacgcttttagcatcgccattgctatgtgtaagatcctcgacaaaggcgtgtgcaccatcaattccgagagatggaacattatcaagtgtgattctgggctgatgtactatacagaccagcgcgatggccaggacaccggaaatgatttcggcgaatactgcattagccacaactgtaaaacagagcggtttccgatcaatccctccattatcagcgactgcatctgggagtatcattctagaaagtcccgctacattagcacgctgaacctcgaatctctggaggaatttaagcgggccatctccgagaaacttagccacaccctggtggtctaccaattcaagcctacatctaatctcccccatatgaaacctgtgtataagtacattaccgcgcagggggttgaaaactccgatggaatcgacagcgcctttattacagcttccatgcccgccctgagcggcacctctatcgggtataatgtgatgagcaaagataacttcccgctgtttgacatcattatcttcattaagtccgctgtcatcaagacgacctacaatcacatttatgatacaggacctaccatcggcattaacgtgatgcatgacgagcactgtacagggcagtgccccatcgagatccctcacaaagaaaactggcttaccttttctcaggagagaacaagccggtggggctgtgaagagttcggatgcctggccattaataccggctgcgtttttgggtcctgtcaagatatcattcgccccgagacgaaggtgtacagaaaagccatcgaagagtctgtcctcctgacagtgtgcgttacctatcctggaaacaccttctgtacagaaattaatgctatcgagcccaagatcaccgacgaactcgagctgcagtttaaaacggtggacacaaagacccttccgaacctgctcgcggtccagaatcataaactgtacagcggccagattaacgatctggggtccttcgcccaaggatgcggcaatatccagaagacaaacctttctgtgattgggaccggcacagctaagtttgactacatctgtcacggagccagccggaaagatattgtggtcagacgctgctataataacaattacgagtcctgtaagctgctcaaagaggaacctagcctgatcttctctgacaaccatgaaaccatcgaggttgccaatattcggcacctcctgggcgaacttcagttcaagctgatgctcggggatctgagatataaatcctttgctgagaaccccgagctggaaatcgaggcccgctgcgtgggatgtcccagctgcttctcttcctacagctgtaattttagaatttcctctagcatcgacacggtgtgcgcgattgatggcccttgcaccatcttccataaccggcttattatctccagcacaaagcaagactatgggatcaagatgtcttgtaaagaaaagccgaaccccgtcgagaaatttaatatttgcaagcgcgtgtactccgttctgttcaccacaatcgataaaaacgacaagattgaaatcaataccggagatcagacgagctttattcaggagaaggacgatagatgtaaaacatggctctgccgggtgcgcgacgagggcatctctgtcatcttcgaacctattaaggctttcttcggcagctatttttccatcgccttctacgtggttattgggatcattgccctgtttatcatcatttacatcttcctccccatgggattcaaactgaaggacattcttaaaaagaacgagctgctgtatctccaggaaatgaagtacaaatga

SEQ ID NO: 14162 - RNA, 4305 nt, synthetic construct
  misc_feature 1..4305: note = derived and/or modified CDS sequence (opt5) from BATV(804992)__FJ436801.1__GP
  source 1..4305: mol_type = other RNA
atgctgctcctgcttgtgctgctcatcccctgctgtgtcagcgcctcccctgttattaccagatgcttccacggcgggcagctgatcgctgagcggaagtctcaagccgcgattagcgaattttgtcttaaagacgatgtgtccacaatcaagtctgagattatctacgaaaagaacgacacgggactgttcgctcataataaggtgctccgcaactggatcattaaagattggaagaattgcaacccggtccccaccgccggcgggagcatcaatgtgattgaggttaacacagacctgtccctgaccacaaagacctatgtgtgttctagagattgcacaatcaccgtcgacaaagaagatgcccagattatctttcagacggagaagctcaatcacttcgaggtgagcggaaccacactgtccagcggctggtttaaaaccaaggcttctgttacacttgaccggacctgtgaacatattaaagtgacgtgcgggaagaagacactgcagttccacgcctgttttaaacatcacatgtcctgcatccgcttctttcacggaaccatcctccctggcacaatggctaccagcatttgtcaaaacatcgagctgattatcattatctctcttaccctgatcattttcatcctcatggtcattctgacaaagacgtacatctgctatctgctcatgcccctgtttatgcctattgcctacttctatggctggtcctacaataaaagctgcaagaaatgtccctgctgtgggcttgcgtatcatccttttaccaactgcggatctcactgtgtgtgcggcctgaagttcgaagcctccgatagaatgcggatccatcgcgagagcgggctctgtcagggatacaaatccctgagagtggctcggcttctgtgcaagtctaagggcagctccctcatcattagcatcctgctgtctatgctcattctgtccttcgtcacaccgatcgaggggacccttacaaattaccccgaaagccgcaaatatgacctggaggaaattgccgatgttctcgagggatttgtggtggaaaagggcatcaaagagtacgtcgtgttctatacctctatttttggcgctctgttccttctgatggccctcatcgttatcattgcgctgaacagagtgacggagtacctgacaaatatcaacgtcctctattgtcacgaatgcagcatgtaccactccaagaaaaatattaagtatatcggggactttaccaacaagtgtggattctgtacctgcggcgagctggaagatcaggaggggcttaaaattcataaggtgtctcggaaatgcatctacaagtaccagctgacatggagcaaagttatcatgatgattctcgtgtgcctgctgatcgcccaaaacaccattcttatcgtcgctgcctccgacgactgttggacaaagaagtccctcgaaatggagtgcattggacctctgcaacaggtggatacgtgtgacgataaaacctctcgctcctatagcggcgaggctaagaaactggtcagagcctctaagatctccgacctcgatgccgctcaggtggggctgcttggaagcacaatcgaatccgcgattgcctctatccggcgccaaagaacctacagcacaatgcatctgctcgagtccgtttttctgggcaaacactgcgactattacaaggtgttcgaacacaattctggctatagccaggctaagtggcggctgaccgccaaaacgcatcactttgatatttgttccagacacagcacccatcacttctgccgctgtatctctgacgggacaaagtgccagaacggagattgggactttgccggcgagatgaatagcatttaccaaagcaaaaaggatttctttaaacatgacttcaaacttttctgtaccctcgtcgaaaacgcttttcccgggacaaccgagtctctgttctatgagatgctgtccaaaaagaatacgacaggaatcaccaagctcctggacaaacttacaaagaaatttggcaacaataacatgttcgtggggatctggaagtttggccagtacctgatgagcctcccttacgttaatgaaacctctctgagccccattcagctggccaaagtgcttgaggtcaccgatcagcaccaccggtccgtgagcggaagacaagaatctctcgcgtccgctacaccgggcagcaagtcctctgagtgcgaccatgccaagaaagtgagctgcatctcccctcgcttcggggcccccatggagggactgatggcttgtggcaactctcctaattataagatttacaaaacgcccgccaagctgtataaaagcaacaataagggggaagtttggtgctccggagatgtccactgttttcaggagctcacccccgcttctcaggaaagcgtggaccggatcaagcagatgacatgcttcctgaccgagcctgaagtgaacgatgacgtcttttccattgccatcgcgatgtgtaaagtgcaagataagggcgtttgcacaattaatgaggacagatggaacatcatcaaatgtgatagcgggcttatttactataccgaccagcgcgagggccaggatacgggaaacgacttcggcgaatactgcctgtctcattcctgtcggatcgagagatttccgattaatcccgccatcattagcgattgcctctgggaatatcactctcgcaagtccaaatacatcacaagcctggacctggagtctcttgaagagttcaagcgggctatctccgagaagctcagccataccctggtggtctacaactttaaacctaccgccaatctgccccacattaagcctgtgtataaatacatcacagttcagggggtggaaaactccgacggagtcgatagcgcttatattaccgcctctatgcccgcgctcagcggcacatccatcgggtacaatattatgtctagagacaacttcccgctgttcgatatcatcatttttatcaagagcgccattatcaaagctacgtataatcacatttacgacaccggacctacaatcggcattaacgtgatgcatgatgagcactgtaccgggcaatgccccacagacatccctcataaggaaaattggatcaccttcgcccaggagcgcacgtcccggtggggctgcgaagagtttggatgtcttgctgttaacaccggctgcgtgttcgggtcttgtcaggatattatcagacccgagacaaaagtctatcggaaggccgtggaagagagcgtgctgctcaccgtctgcattacataccctggaaagaccttttgtacagaaatcaatgccattgagcccaaaatcaccgacgagctggaactgcagttcaagacggttgatacaaaaacccttccgaacatcctggctgtgcaaaatcacaagctctactccggccagattaacgacctggggtcttttagccagggatgcggcaatatccagaaaaccaactccagcattatcgggacaggcaccgcgaagttcgattatgtgtgtcatggagcctctcgcaaggacattatcgtcagacggtgctacaacaataactatgagtcctgtaaactcctgaaggaggaacagagccttatgtttgctgataatcacgaaacgatcgacgtggccaacgttagacatctgctcggcgacctgcagttcaaactgatgcttggggatctgcgctacaagtcttttgccgagaatcctgacctcgagattgaagctaaatgcgtgggatgtccctcctgcttcacaagctattcctgctctttcaagatcgtcagcaacattgataccgtgtgttccatcgagggcccctgcacaacctttcacaatcggctgatgattacaagcaccaagcaggactacgggatcaaaatgtcttgtaagacgaaacctggactcaccgaagagttccaaatttgcaagaaaacatataccgttctgtttgccacagtggaaaagaacgataagatcgagatctccaccggcgaccagacgagcttcattcaggagagagatgaccgctgtaaaacatggctttgcagagtccgggatgaaggcatctctgtgatttttgagccgatccgcgcgttctttgggagctacttctccattgctttttacatcgttatcggaattatcgtgctgttcctcgtcatttatatctttctgcccatgatgttcaagctgagagacgtgcttaaacggaatgaatacctgtatctccaggagattaagcacaaatga

SEQ ID NO: 14163 - RNA, 4305 nt, synthetic construct
  misc_feature 1..4305: note = derived and/or modified CDS sequence (opt5) from BATV(8627-11)__FJ436799.1__GP
  source 1..4305: mol_type = other RNA
atgctgctcctgcttgtgctgctcatcccctgctgtgtcagcgcctcccctgttattaccagatgcttccacggcgggcagctgatcgctgagcggaagtctcaagccgcgattagcgaattttgtcttaaagacgatgtgtccacaatcaagtctgagattatctacgaaaagaacgacacgggactgttcgctcataataaggtgctccgcaactggatcattaaagattggaagaattgcaacccggtccccaccgccggcgggagcatcaatgtgattgaggttaacacagacctgtccctgaccacaaagacctatgtgtgttctagagattgcacaatcaccgtcgacaaagaagatgcccagattatctttcagacggagaagctcaatcacttcgaggtgagcggaaccacactgtccagcggctggtttaaaaccaaggcttctgttacacttgaccggacctgtgaacatattaaagtgacgtgcgggaagaagacactgcagttccacgcctgttttaaacatcacatgtcctgcatccgcttctttcacggaaccatcctccctggcacaatggctaccagcatttgtcaaaacatcgagctgattatcattatctctcttaccctgatcattttcatcctcatggtcattctgacaaagacgtacatctgctatctgctcatgcccctgtttatgcctattgcctacttctatggctggtcctacaataaaagctgcaagaaatgtccctgctgtgggcttgcgtatcatccttttaccaactgcggatctcactgtgtgtgcggcctgaagttcgaagcctccgatagaatgcggatccatcgcgagagcgggctctgtcagggatacaaatccctgagagtggctcggcttctgtgcaagtctaagggcagctccctcatcattagcatcctgctgtctatgctcattctgtccttcgtcacaccgatcgaggggacccttacaaattaccccgaaagccgcaaatatgacctggaggaaattgccgatgttctcgagggatttgtggtggaaaagggcatcaaagagtacgtcgtgttctatacctctatttttggcgctctgttccttctgatggccctcatcgttatcattgcgctgaacagagtgacggagtacctgacaaatatcaacgtcctctattgtcacgaatgcagcatgtaccactccaagaaaaatattaagtatatcggggactttaccaacaagtgtggattctgtacctgcggcgagctggaagatcaggaggggcttaaaattcataaggtgtctcggaaatgcatctacaagtaccagctgacatggagcaaagttatcatgatgattctcgtgtgcctgctgatcgcccaaaacaccattcttatcgtcgctgcctccgacgactgttggacaaagcgcagcctcgaaatggagtgcattggacctctgcaacaggtggatacgtgtgacgataagacctctagatcctatagcggcgaggctaaaaagctggtccgggcctctaaaatctccgacctcgatgccgctcaggtggggctgcttggaagcacaatcgaatccgcgattgcctctatccgcagacaacggacctacagcacaatgcatctgctcgagtccgtttttctgggcaagcactgcgactattacaaagtgttcgaacacaattctggctatagccaggctaagtggagactgaccgccaagacgcatcactttgatatttgttcccgccacagcacccatcacttctgccggtgtatctctgacgggacaaaatgccagaacggagattgggactttgccggcgagatgaatagcacctaccaaagcaagaaagatttctttgaacatgacttcaaacttttctgtacactcgtcgagaacgcttttcccgggaccacggagtctctgttctatgaaatgctgtccaaaaagaatacaaccggaattacaaaactcctggacaaacttaccaagaagtttggcaacaataacatgttcgtggggatctggaagtttggccagtacctgatgagcctcccttacgttaatgagacctctctgagccccacacagctggccaaagtgcttgaagtcacggatcagcaccacagatccgtgagcggacgccaagagtctctcgcgtccgctaccccgggcagcaagtcctctgagtgcgaccatgccaaaaaggtgagctgcatctcccctcggttcggggttcccatggaaggactgatggcctgtggcaactctcctaattataagatttacaaaacacccgctaagctgtataaaagcaacaataagggggaggtctggtgctccggaaacgtgcactgttttcaggaactcaatcccgcctctcaggagagcgtggatagaatcaaacagatgacctgcttcctgacagaacctgaggtcaacgacgatgtgttttccattgctatcgccatgtgtaaggttcaagacaagggcgtgtgcaccattaacaaagatcgctggaatatcattaagtgtgacagcgggcttatctactatacggatcagcgggagggccaggacacaggaaacgatttcggcgaatactgcctgtctcattcctgtagaatcgagcgctttccgattaatcccgcgatcattagcgactgcctctgggaatatcactctcggaaatccaagtacatcaccagcctggatctggagtctcttgaagagttcaaaagagccatttccgagaagctcagccataccctggtcgtgtacaactttaagcctacagctaatctgccccacatcaaacctgtttatgaatacatcaccgtgcagggggtcgagaactccgacggagtggacagcgcctatattacagcttctatgcccgccctcagcggcacgtccatcgggtacaatattatgtctcgcgataacttcccgctgttcgacatcattatctttatcaagagcgcgattatcaaagccacctataatcacatttacgatacaggacctaccatcggcattaacgttatgcatgacgaacactgtacagggcaatgccccaccgatatccctcataaggagaattggattacgttcgctcaggaacggacctccagatggggctgcgaggagtttggatgtcttgccgtgaacacaggctgcgtcttcgggtcttgtcaggacatcatccggcccgaaaccaaagtgtatcgcaaggctgtggaggaaagcgtcctgctcacagtttgcattacctaccctggaaaaacattttgtaccgagatcaatgccattgagcccaagatcacggatgaactggagctgcagttcaagacagtggacaccaaaacccttccgaacattctggccgtgcaaaatcacaagctctactccggccagatcaacgatctggggtcttttagccagggatgcggcaacatccagaaaacaaattccagcattatcgggaccggcacggctaagttcgactatgtctgtcatggagcgtctagaaaagatattatcgtgcggagatgctacaacaataactatgaatcctgtaagctcctgaaggaggaacagagccttatgtttgccgacaatcacgagacaattgatgttgctaacgtgcgccatctgctcggcgacctgcagttcaaactgatgcttggggacctgcggtacaagtcttttgccgagaatcctgatctcgaaatcgaggccaaatgcgtcggatgtccctcctgcttcaccagctattcctgctctttcaagatcgtgagcaacattgacacagtttgttccatcgaaggcccctgcaccacatttcacaatagactgatgattaccagcacgcgccaggattacgggatcaaaatgtcttgtaagaccaagcctggactcacagaggaatttcaaatttgcaaaaagacctatacagtgctgttcgctaccgtcgagaaaaacgacaagatcgagatttccacgggcgatcagacatccttcatccaggaaagagacgatcggtgtaaaacctggctttgccgcgtgagagacgagggcatctctgttatttttgaaccgatccgggccttctttgggagctacttctccattgcgttttacatcgtgattggaatcatcgtcctgttcctcgtgatttatatctttctgcccatgatgttcaagctgcgcgatgtgcttaagagaaatgagtacctgtatctccaggaaattaaacacaagtga

SEQ ID NO: 14164 - RNA, 4305 nt, synthetic construct
  misc_feature 1..4305: note = derived and/or modified CDS sequence (opt5) from BATV(Chittoor/IG-20217)__JX846599.1__GP
  source 1..4305: mol_type = other RNA
atgctgctcctgcttgtgctgctcatcccctgctgtgtcagcgcctcccctgttattaccagatgcttccacggcgggcagctgatcgctgagcggaagtctcaagccgcgattagcgaattttgtcttaaagacgatgtgtccacaatcaagtctgagattatctacgaaaagaacgacacgggactgttcgctcataataaggtgctccgcaactggatcattaaagattggaagaattgcaacccggtccccaccgccggcgggagcatcaatgtgattgaggttaacacagacctgtccctgaccacaaagacctatgtgtgttctagagattgcacaatcaccgtcgacaaagaagatgcccagattatctttcagacggagaagctcaatcacttcgaggtgagcggaaccacactgtccagcggctggtttaaaaccaaggcttctgttacacttgaccggacctgtgaacatattaaagtgacgtgcgggaagaagacactgcagttccacgcctgttttaaacatcacatgtcctgcatccgcttctttcacggaaccatcctccctggcacaatggctaccagcatttgtcaaaacatcgagctgattatcattatctctcttaccctgatcattttcatcctcatgattatcctgacaaagacgtacatttgctatctgctcatgcccctgtttatgcctatcgcctacttctatggctggtcctacaataaaagctgcaagaaatgtccctgctgtgggcttgcgtatcatccttttaccaactgcggatctcactgtgtctgcggcctgaagttcgaagcctccgatagaatgcggatccatcgcgagagcgggctctgtcagggatacaaatccctgagagtggctcggcttctgtgcaagtctaagggcagctccctcattatcagcattctgctgtctatgctcatcctgtccttcgtgacaccgattgaggggacccttacaaattaccccgaaagccgcaaatatgacctggaggaaatcgccgatgtcctcgagggatttgttgtggaaaagggcattaaagagtacgtggtcttctatacctctatctttggcgctctgttccttctgatggccctcatcgtgattatcgcgctgaacagagttacggagtacctgacaaatattaacgtgctctattgtcacgaatgcagcatgtaccactccaagaaaaatatcaagtatattggggactttaccaacaagtgtggattctgtacctgcggcgagctggaagatcaggaggggcttaaaatccataaggtctctcggaaatgcatctacaagtaccagctgacatggagcaaagtgattatgatgatcctcgtttgcctgctgattgcccaaaacaccatccttattgtggctgcctccgacgactgttggacaaagaagtccctcgaaatggagtgcatcggacctctgcagcaggtcgatacgtgtgacgataaaacctctcgctcctatagcggcgaggctaagaaactggtgagagcctctaagatctccgacctcgatgccgctcaggtcgggctgcttggaagcacaattgaatccgcgatcgcctctattcggcgccaaagaacctacagcacaatgcatctgctcgagtccgtgtttctgggcaaacactgcgactattacaaggttttcgaacacaattctggctatagccaggctaagtggcggctgaccgccaaaacgcatcactttgatatctgttccagacacagcacccatcacttctgccgctgtatttctgacgggacaaagtgccagaacggagattgggactttgccggcgagatgaatagcacctaccaaagcaaacgggatttctttgaacatgacttcaaacttttctgtacactcatcgagaacgcttttcccgggaccacggagtctctgttctatgaaatgctgtccaaaaagaatacaaccggaatcacaaaactcctggacaaacttaccaagaaatttggcaacaataacatgttcgtggggatttggaagtttggccagtacctgatcagcctcccttacgtcaatgagacctctctgagccccacacagctggccaaagtgcttgaagttacggatcagcaccacagatccattagcggacgccaagagtctctcgcgtccgctaccccgggcagcaagtcctctgagtgcgaccatgccaaaaaggccagctgcatctcccctcggttcggggtgcccatggaaggactgatggcttgtggcaactctcctaattataagatttacaaaacacccgccaagctgtataaaagcaacaataagggggaggtctggtgctccggaaactttcactgtttccaggaactcatccccgcttctcaggagagcgtggatagaattaaacagatgacctgctttctgacagaacctgaggtgaatgacgatgttttctccatcgccatcgcgatgtgtaaggtccaagacaagggcgtgtgcaccattaacaaagatcgctggaacgtgatcaagtgtgacagcgggcttatttactatacggatcagcgggagggccaggacacaggaaatgattttggcgaatactgcctgtctcattcctgtagaatcgagcgcttcccgattaaccccgccatcatcagcgactgcctctgggaatatcactctcggaaatccaagtacattaccagcctggatctggagtctcttgaagagtttaaaagagctatctccgagaagctcagccataccctgattgtctacaatttcaagcctacagccaacctgccccacatcaaacctgtgtataagtacattaccgttcagggggtggaaaattccgacggagtcgacagcgcttatatcacagcctctatgcccgcgctcagcggcacgtccatcgggtacaacattatgtctcgcgataatttcccgctgtttgacatcattatcttcattaaaagcgccatcattaaggctacctataaccacatctacgatacaggacctaccatcggcattaatgtgatgcatgacgagcactgtacagggcaatgccccaccgatatccctcataaagaaaactggattacgtttgcccaggagcggacctccagatggggctgcgaagagttcggatgtcttgctgttaatacaggctgcgtgtttgggtcttgtcaggacatcattcggcccgagaccaaggtctatcgcaaagccgtggaagagagcgttctgctcacagtgtgcatcacctaccctggaaagacattctgtaccgaaatcaacgccattgagcccaagatcacggatgagctggaactgcagtttaaaacagtcgacattaagacccttccgaatatcctggctgtgcaaaaccacaaactctactccggccagattaatgatctggggtctttcagccagggatgcggcaacatccaaaagaccaactccagcatcattgggacaggcaccgcgaaatttgactatgtgtgtcatggagcctctagaaaggatatcattgtccggagatgctacaataacaattatgagtcctgtaagctcctgaaagaggaacagagccttatgttcgctgacaaccacgaaacgatcgatgttgccaatgtgcgccatctgctcggcgacctgcagtttaagctgatgcttggggacctgcggtacaaatctttcgccgagaaccctgatctcgagattgaagctaagtgcgtgggatgtccctcctgcttcacaagctattcctgctcttttaaaatcgtcagcaatattgacaccgtgtgttccatcgagggcccctgcacaaccttccacaacagactgatgatcacaagcaccaagcaggattacgggattaagatgtcttgtaaaacgaagcctggactcaccgaagagtttcaaatctgcaaaaagacatataccgttctgttcgccacagtggaaaagaatgacaagattgagatctccaccggcgatcagacgagctttattcaggagcgcgacgatagatgtaagacatggctttgccgggtccgcgacgaaggcatctctgtgatcttcgagccgattagagcgtttttcgggagctacttttccatcgctttctacattgttatcggaattatcgtgctgtttctcgtcatctatattttcctgcccatgatgtttaaactgcgggatgtgcttaagcgcaacgaatacctgtatctccaggagatcaaacacaagtga

SEQ ID NO: 14165 - RNA, 4305 nt, synthetic construct
  misc_feature 1..4305: note = derived and/or modified CDS sequence (opt5) from BATV(41.3)__KM507322.1__GP
  source 1..4305: mol_type = other RNA
atgcttctcttcctgatccttctgattccctgctacgccagcgcttcccctgtggtcaccagatgttttcacggcgggcagctcatcgccgagtctcggagcccgacagcggtttccgaattttgcctgaaggacgatgtgtctacgattaaaagcgagatcatttatgtgaagaacgacaccggactttttgctcataataaagtcctgcgcaactggatcatcaaggattggaaaaattgtaaccccgtgcctacagccggcgggtccattaatgttatcgaagtgaacaccgacctctctctgagcacaaagacctacgtctgctccagagattgtacaattaccgtggacaaggaggatgcccaaatcattttccagacggaaaaactgaatcactttgaggttagcggaaccacactctcttccggctggttcaagaccaaagctagcgtgacactggaccggacctgcgagcatatcaaggtcacgtgtgggaaaaagacacttcagtttcacgcctgcttcaagcatcacatgtcttgtattcgctttttccactccaccatcctgcccggaacaatggctaccagcatctgccagaacattgaactcatcattatcatttctctgacccttctgatctttatcctcatggccattctgacaaaaacgtatatctgttacctgctcatgcctctgttcatgcccattgcgtatctttacggctggtcctataatagaagctgcaagaaatgctcctgttgcggcctggcctaccatccttttaccaactgtgggtctcactgcgtgtgtggactcaagttcgaggctagcgatcggatgcgcatccatagagaatccggcctgtgccaagggtacaaaagccttcgggtggcccgcctgctctgtaagtctaaaggatccagcctgattatctctatcctgctcagcatgctgattctttccttcgtcacaccgatcgagggcaccctgacaaattatcccgagtctagaaagtacgacctcgaagagattgctgatgttctggaagggtttatcaccgagaagggaattaaagaatatgtggtgttctacacgagcatctttggcggccttttcctgctcctggccctgattatcatcattgcgctcaaccgggtcacagagtatctgaccaatatcaacgtgttttactgccacgagtgttccatgtatcacagcaagaaaaatattaagtacatcggggacttcaccaacaaatgcggattttgtacatgcggcgaacttgaggatcaggaagggctgaagattcataaggtttctcgcaaatgcatctacaagtatcagctcacctggtccaaaatcattatgatcattctggtgtgtctgcttatcgcccagaacacaattctcatcgtcgctgccagcaatgactgctgggctaagaaatctctggagatggaatgtatcggacctctgcaacaggtggagtcctgcgacgataaggccagcagatcctactctggcgaggccaagaaactcgttcgggctagcaagatttccgacctggatgcggcccaggtggggcttctgggatctacgatcgaaagcgctattgcctccatccgcaaacagagaacctatcccacaatgcacctcctggagagcgtcttcctggccaagcattgtgactactataaatcttttgaacacaactccggctacagccaagctaagtggcggcttaccgccaagacacatcacttcgatatttgctctagacactccacccatcacttttgtcgctgcatcagcgacggcacgaaatgtcagaatggggattgggacttcgcgggagagatgaactctacctatcagagcaagaaagatttcttcgaacatgacttcaagctcttttgcacactgctggagaatgctttccctggcaccacagagtccttttactaccaaatgctccagaaaaagaacaccacgggggtggtcaaactgcttgatgaactgacaaagaagttcggaaataacaatatgtttgtgggcatctggaaattcgggcagtatctcatgagcctgccctacattaacgagacctctctgacaccgcttcagctctccaagatcctggaagccagcaatcaacaccaccggtccatttctggcagacaggagagcctggccaacgctgcctccggaggcaaatctaaggagtgtgaccatgctaaaaaggttagctgcatctcccctcgctttggggtgcccatggaaggactcattgcctgcggctctagccctaattataagatctacaaaatgcccaccaagctgtataaatccaacaataagggggaggtctggtgtagcggagacgtgcactgcttccaggaacttaaccccgcgtctcaggagtccgttgatcggattaaacaaatgacctgttttctgacagaacctgagacgaacgaggacgtgttcagcatcgccatctctatgtgcaaggtccaggataagggcgtgtgtaccattaatgaagagagatggaacgtgatcaaatgcgactccgggctcatttactatacagatcagcgcgacggccaggataccggaaatgactttggcgaatactgtctgagccataactgccggatcgagagattcccgattaatcccacaatcatcaacgattgtctgtgggaataccactctcgcaagtccaaatatattaccagccttgacctcgagtccctggaggaatttaagcgggctatcagcgagaaactgtctcatacgctcattgtttacaatttcaagcctacagccaacctgccccacatcaagcctgtctataaatacattaccgtgcaaggggtggaaaatagcgatggagtcgactccgcttatatcaccgcctctatgcccgcgcttagcggcacatccatcgggtacaacattatgtctaaggataatttcccgctgtttgacatcattatcttcattaaaagcgccgtgatcaaggctacctataaccacatttacgacacaggacctacgatcggcatcaatgttatgcatgatgagcactgcaccgggcagtgtcccacagacattcctcataaagaaaactggatcaccttttcccaggagagaacatctcgctggggctgcgaggaatttggatgcctcgccgtgaataccggctgtgtctttgggagctgccaggatattatccggcccgagacgaaggtgtacagaaaagctattgaagagtccgttctgctgaccgtgtgtatcacatatcctggaaagaccttctgcacagagatcaacgccattgaacccaagatcaccgacgagcttgaactgcaatttaaaacagtcgataccaagacgctcccgaacattctggccgtgcagaatcacaaactctacagcggccagatcaacgacctggggtctttctcccaaggatgtggcaatattcagaagacaaacagctctatcatcgggaccggcaccgctaaatttgattatgtttgccatggagcgtcccggaaggacattatcgtgcgcagatgttacaataacaattatgagagctgccggcttctgaaggaggaacagtccctcatgttcgccgataaccacgagacaattgacgtcgctaatgtgagacatctgctgggcgatcttcagtttaaactgatgctcggggacctgcgctacaagtctttcgccgaagatcctgacctcgagatcgaagccaaatgtgtgggatgccccagctgtttcacctcctatagctgcaactttcggattgtctctaatatcgacacggtttgctccattgagggcccctgtacaaccttccacaacagactgatgatcacaagcaccaagcaagattacgggatcaaaatgtcttgcaagggaaagcctggcagcacagaagagtttcagatttgtaaaaagacctacacggtgcttttcaccacagtggagaaaaatgacaagatcgaaattaacaccggcgatcagacatcctttatccaggagcgcgacgatagatgcaaaacctggctgtgtcgggtccgcgacgaagggatttctgtgatcttcgagccgatcagagctttcttcggaagctatttttccattgccttctacatcgttgtgggcattatcgtcctctttctgatgatttatatcttcctgcccatggcgtttaagctgcgggatgtgctgaagcgcaatgaatacctctatctgcaagagatcaaacacaagtga

SEQ ID NO: 14166 - RNA, 4305 nt, synthetic construct
  misc_feature 1..4305: note = derived and/or modified CDS sequence (opt5) from BATV(EIV-1217Astr)__KT313699.1__GP
  source 1..4305: mol_type = other RNA
atgctgctctttctgatccttctgattccctgctacgccagcgcttcccctgtggtcaccagatgttttcacggcgggcagctcatcgccgagtctcggagcccgacagcggtttccgaattttgcctgaaggacgatgtgtctacgattaaaagcgagatcatttatgtgaagaacgacaccggactttttgctcataataaagtcctgcgcaactggatcatcaaggattggaaaaattgtaaccccgtgcctacagccggcgggtccattaatgttatcgaagtgaacaccgacctctctctgagcacaaagacctacgtctgctccagagattgtacaattaccgtggacaaggaggatgcccaaatcattttccagacggaaaaactgaatcactttgaggttagcggaaccacactctcttccggctggttcaagaccaaagctagcgtgacactggaccggacctgcgagcatatcaaggtcacgtgtgggaaaaagacacttcagtttcacgcctgcttcaagcatcacatgtcttgtattcgctttttccacggaaccatcctgcccggcacaatggctacctccatctgccagaacattgaactcatcattatcattagcctgacccttctgatctttatcctcatggccattctgacaaaaacgtatatctgttacctgctcatgcctctgttcatgcccattgcgtatctttacggctggtcttataatagatcctgcaagaaatgcagctgttgcgggctggcctaccatccttttaccaactgtggatcccactgcgtgtgtggcctcaagttcgaggcttctgatcggatgcgcatccatagagaaagcgggctgtgccaaggatacaaatcccttcgggtggcccgcctgctctgtaagagcaaagggtcttccctgattatcagcatcctgctctctatgctgattcttagcttcgtcacaccgatcgagggcaccctgacaaattatcccgagtccagaaagtacgacctcgaagagattgctgatgttctggaaggatttgtgaccgagaagggcatcaaagaatatgtggtcttctacacgtctatttttggcgggcttttcctgctcctggccctgatcattatcatcgcgctcaaccgggtgacagagtatctgaccaatattaacgttttctactgccacgagtgtagcatgtatcactccaagaaaaatatcaagtacattggagacttcaccaacaaatgcggcttttgtacatgcggggaacttgaggatcaggaaggactgaagatccataaggtgagccgcaaatgcatttacaagtatcagctcacctggtctaaaatcatcatgattatcctggtctgtctgcttattgcccagaacacaatcctcattgtggctgcctccaatgactgctgggctaagaaaagcctggagatggaatgtatcggccctctgcaacagatggagtcttgcgacgataaggcctccagaagctactccggggaggccaagaaactcgttcgggcttctaagatcagcgacctggatgcggcccaggtgggacttctgggctccacgattgaatctgctatcgccagcattcgcaaacagagaacctatcccacaatgcacctcctggagtccgtcttcctggccaagcattgtgactactataagagctttgaacacaactctggctactcccaagctaaatggcggcttaccgccaagacacatcacttcgatatctgcagcagacactctacccatcacttttgtcgctgcatttccgacgggacgaaatgtcagaatggagattgggacttcgcgggcgagatgaacagcacctatcagtctaagaaagatttcttcaagcatgacttcaaactcttttgcacactgctggaaaatgctttccctgggaccacagagagcttttactaccaaatgctccagaagaaaaacaccacgggagtggtcaagctgcttgatgagctgacaaagaaattcggcaataacaatatgtttgtggggatctggaagttcggccagtatctcatgtccctgccctacatcaacgaaaccagcctgacaccgcttcagctctctaaaattctggaggcctccgaccaacaccaccggagcatctccggaagacaggaatctctggccaatgctgccagcggcgggaagtccaaagagtgtgaccatgctaagaaggtttcttgcattagccctcgctttggagtgcccatggagggcctcatcgcctgcgggggatcccctaactataaaatttacaagatgcccaccaaactgtataagtctaataacaaaggcgaagtctggtgtagcggggatgtgcactgcttccaggagcttaatcccgcgctgcaggaatccgttgaccggatcaagcaaatgacctgttttctcacagagcctgaaacgaacgaggatgtgttcagcattgccatctctatgtgcaaggtccaggacaaaggcgtgtgtaccatcaacgaggaaagatggaatgtgattaagtgcgattccggactgatctactatacagaccagcgcgatggccaggacaccgggaacgattttggagagtactgtctgagccataattgccggattgaaagattcccgatcaaccccacaattatcaatgactgtctttgggagtaccactctcgcaaatccaagtatatcaccagcctcgatctggaatctctggaggagtttaaacgggctatttccgaaaagctcagccatacgctgatcgtttacaacttcaagcctacagccaatcttccccacattaaacctgtctataagtacatcaccgtgcaaggcgtggagaactccgacggggtcgatagcgcttatattaccgcctctatgcccgcgctgagcggaacatccatcggctacaatatcatgtctaaagacaacttcccgctctttgacattatcattttcatcaagagcgccgtgattaaagctacctataatcacatctacgatacagggcctacgattggcatcaacgttatgcatgacgaacactgcaccggacagtgtcccacagatatccctcataaggagaattggattaccttttcccaggaaagaacatctcgctggggctgcgaggagttcgggtgcctggccgtgaacaccggatgtgtctttggcagctgccaggacatcattcggcccgaaacgaaagtgtacagaaaggctatcgaggaatccgttctgcttaccgtgtgtattacatatcctgggaagaccttctgcacagagatcaatgccatcgagcccaaaattaccgatgaactggagctccaatttaagacagtcgacaccaaaacgctgccgaacatcctcgccgtgcagaaccacaagctgtactctggacagattaatgatcttggcagcttctcccaagggtgtggcaacatccagaaaacaaatagctctattatcggaaccggcaccgctaagtttgactatgtttgccatggggcgtcccggaaggatatcattgtgcgcagatgttacaacaataactatgaaagctgccggctgctcaaagaggaacagtctctgatgttcgccgacaatcacgagacaatcgatgtcgctaacgtgagacatctgcttggagacctgcagtttaagctcatgctgggcgatctccgctacaaatccttcgccgaggaccctgacctggaaattgaggccaagtgtgtggggtgccccagctgtttcacctcctattcttgcaattttcggatcgtcagcaacattgatacggtttgctccatcgaaggaccctgtacaaccttccacaatagacttatgattacaagcaccaaacaagactacggcatcaagatgtcttgcaagggcaaacctgggtccacagaggaatttcagatctgtaagaaaacctacacggtgctgttcaccacagtggagaagaacgataaaattgagatcaataccggagaccagaccagctttattcaggaacgcgatgacagatgcaagacatggctctgtcgggtccgcgatgagggcatctctgtggttttcgaaccgattagagcctttttcgggagctatttttccatcgctttctacatcgtggtcggaattatcgtgctgtttctggttatttatatcttccttcccatggcgtttaagctgcgggacgtgctcaaacgcaacgagtacctgtatctccaagaaattaagcacaaatga

SEQ ID NO: 14167 - RNA, 4305 nt, synthetic construct
  misc_feature 1..4305: note = derived and/or modified CDS sequence (opt5) from BATV(EIV-12497Bl)__KT313692.1__GP
  source 1..4305: mol_type = other RNA
atgctcctgttcctgatccttctgattccctgctacgccagcgcttcccctgtggtcaccagatgttttcacggcgggcagctcatcgccgagtctcggagcccgacagcggtttccgaattttgcctgaaggacgatgtgtctacgattaaaagcgagatcatttatgtgaagaacgacaccggactttttgctcataataaagtcctgcgcaactggatcatcaaggattggaaaaattgtaaccccgtgcctacagccggcgggtccattaatgttatcgaagtgaacaccgacctctctctgagcacaaagacctacgtctgctccagagattgtacaattaccgtggacaaggaggatgcccaaatcattttccagacggaaaaactgaatcactttgaggttagcggaaccacactctcttccggctggttcaagaccaaagctagcgtgacactggaccggacctgcgagcatatcaaggtcacgtgtgggaaaaagacacttcagtttcacgcctgcttcaagcatcacatgtcttgtattcgctttttccacggaaccatcctgcccggcacaatggctacctccatctgccagaacattgaactcatcattatcaccagcctgacacttctgatttttatcctcatggccatcctgacgaaaacctatatttgttacctgctcatgcctctgttcatgcccatcgcgtatctttacggctggtcttataatagatcctgcaagaaatgcagctgttgcgggctggcctaccatccttttacaaactgtggatcccactgcgtgtgtggcctcaagttcgaggcttctgatcggatgcgcattcatagagaaagcgggctgtgccaaggatacaaatcccttcgggtggcccgcctgctctgtaagagcaaaggcagctccctgatcattagcatcctgctctctatgctgatccttagcttcgtcaccccgattgaggggacactgaccaattatcccgagtccagaaagtacgacctcgaagagatcgctgatgttctggaaggatttattacggagaagggcatcaaagaatatgtggtgttctacacatctatttttggcgggcttttcctgctcctggccctgatcattatcatcgcgctcaaccgggtcaccgagtatctgaccaatattaacgtgttttactgccacgagtgtagcatgtatcactccaagaaaaatatcaagtacattggagacttcacaaacaaatgcggcttttgtacctgcggggaacttgaggatcaggaaggactgaagatccataaggttagccgcaaatgcatttacaagtatcagctcacatggtctaaaatcatcatgattatcctggtgtgtctgcttattgcccagaacacgatcctcattgtcgctgcctccaatgactgctgggctaagaaaagcctggagatggaatgtatcggccctctgcaacaggtggagtcttgcgacgataaggcctccagaagctactccggggaggccaagaaactcgttcgggcttctaagatcagcgacctggatgcggcccaggctggacttctgggctccaccattgaatctgccatcgccagcattcgcaaacagagaacatatcccaccatgcacctcctggagtccgtgttcctggctaagcattgtgactactataaatcttttgaacacaactctggctactcccaagccaagtggcggcttacagcgaagacccatcacttcgatatctgcagcagacactctacgcatcacttttgtcgctgcatttccgacgggaccaaatgtcagaatggagattgggacttcgctggcgagatgaacagcacatatcagtctaagaaagatttcttcgaacatgacttcaagctcttttgcaccctgctggagaatgccttccctgggacaaccgagagcttttactaccaactcctgcagaaaaagaacacgacaggagtcgtgaaacttctggatgaactcaccaagaagttcggcaataacaatatgtttgtcgggatctggaaattcggccagtatctgatgtccctgccctacatcaacgagacaagccttaccccgctccagctgtctaagattctggaagcctccgaccaacaccaccggagcatctccggaagacaggagtctctcgctagcgccgcttccggcgggaaatctaaggagtgtgaccatgccaaaaaggtgagctgcatttcccctcgcttttctgttcccatggaaggactgatcgcgtgcggcagctcccctaattataagatttaccggatgcccaccaaactttataagagcaacaataaaggggaggtgtggtgttctggagatgtccactgcttccaggaactgaaccccgcctcccaggagagcgtggacagaatcaagcaaatgatttgttttctcacagaacctgaggttaatgaggatgtgttctctatcgctatctccatgtgcaaagtccaggacaagggcgtgtgtacgattaacgaagaacgctggaacgtgatcaagtgcgatagcgggctgatttactataccgaccagcgggatggccaggacacaggaaatgattttggcgaatactgtctgtctcataactgcagaatcgagcgcttcccgattaatcccaccatcatcaacgactgtctttgggaataccactcccggaaaagcaagtatattacatccctcgatctggagagcctggaggaatttaaaagagccatctctgagaagctcagccataccctgattgtttacaatttcaaacctacggctaaccttccccacatcaagcctgtctataagtacattacagtgcaaggggtggaaaattccgacggagtcgattctgcctatatcaccgcgagcatgcccgccctgtccggcacctctatcgggtacaacattatgagccgcgacaatttcccgctctttgacatcattatcttcattaaatccgctgtgatcaaggccacatataaccacatttacgataccggacctacaatcggcatcaatgttatgcatgacgagcactgcacggggcagtgtcccaccgatattcctcataaagaaaactggatcacattttctcaggagcggaccagcagatggggctgcgaggagttcggatgcctggctgtgaatacaggctgtgtctttgggtcctgccaggacattatccggcccgagaccaaggtgtaccgcaaagccgttgaagagagcgtgctgcttacggtctgtattacctatcctggaaagacattctgcaccgagatcaacgccatcgaacccaaaattacagatgagctggaactccaatttaagaccgtggacacaaagaccctgccgaatatcctcgctgttcagaaccacaaactgtactctggccagattaacgatcttgggtccttcagccaaggatgtggcaatatccagaagacgaactcttccattatcgggacaggcaccgcgaaatttgactatgtgtgccatggagccagcagaaaggatatcattgtccggagatgttacaataacaattatgagtcctgccgcctgctcaaagaggaacagtctctgatgttcgctgacaaccacgagaccatcgatgtggccaatgtgcggcatctgcttggcgacctgcagtttaagctcatgctgggggatctcagatacaagagcttcgccgaagaccctggactggagattgaagctaaatgtgtcggctgcccctcctgtttcacaagctattcttgcaactttcgcatcgtttccaatattgacaccgtgtgcagcatcgaggggccctgtacgacattccacaacagacttatgattacctctacaaagcaagattacggaatcaaaatgagctgcaagggcaaacctggctccaccgaagagtttcagatctgtaagaagacatacaccgtgctgttcacgaccattgagaaaaatgacaagatcgaaattaacacaggggatcagacctcttttgtccaggagcgggacgatcgctgcaaaacatggctctgtagagtgcgggacgaaggaatcagcgttattttcgagccgatccgcgcctttttcggctcctatttttctatcgcgttctacattgtggtcgggatcattgtgctgtttctggttatctatattttccttcccatggcttttaagctgagagatgtgctcaaacggaatgaatacctgtatctccaagagatcaagcacaagtga

SEQ ID NO: 14168 - RNA, 4305 nt, synthetic construct
  misc_feature 1..4305: note = derived and/or modified CDS sequence (opt5) from BATV(EIV-12845Ms)__KT313690.1__GP
  source 1..4305: mol_type = other RNA
atgcttctcttcctgatccttctgattccctgctacgccagcgcttcccctgtggtcaccagatgttttcacggcgggcagctcatcgccgagaaccggtctccgacagcggttagcgaattttgcctgaaggacgatgtgtccacgattaaatctgagatcatttatgtgaagaatgacaccggactttttgctcataacaaagtcctgcgcaattggatcatcaaggattggaaaaactgtaatcccgtgcctacagccggcgggagcattaacgttatcgaagtgaataccgacctctccctgtctacaaagacctacgtctgcagcagagattgtacaattaccgtggacaaggaggatgcccaaatcattttccagacggaaaaactgaaccactttgaggtttccggaaccacactcagctctggctggttcaagaccaaagctagcgtgacactggaccggacctgcgagcatatcaaggtcacgtgtgggaaaaagacacttcagtttcacgcctgcttcaagcatcacatgagctgtattcgctttttccactctaccatcctgcccggaacaatggctacctccatctgccagaatattgaactcatcattatcattagcctgacccttctgatctttatcctcatggccattctgacaaaaacgtatatctgttacctgctcatgcctctgttcatgcccattgcgtatctttacggctggtcttataacagatcctgcaagaaatgcagctgttgcggcctggcctaccatccttttaccaattgtgggtcccactgcgtgtgtggactcaagttcgaggcttctgatcggatgcgcatccatagagaaagcggcctgtgccaagggtacaaatcccttcgggtggcccgcctgctctgtaagagcaaaggatcttccctgattatcagcatcctgctctctatgctgattcttagcttcgtcacaccgatcgagggcaccctgacaaactatcccgagtccagaaagtacgacctcgaagagattgctgatgttctggaagggtttatcaccgagaagggaattaaagaatatgtggtgttctacacgtctatctttggcggccttttcctgctcctggccctgattatcatcattgcgctcaatcgggtcacagagtatctgaccaacatcaatgtgttttactgccacgagtgtagcatgtatcactccaagaaaaacattaagtacatcggggacttcaccaacaaatgcggattttgtacatgcggcgaacttgaggatcaggaagggctgaagattcataaggttagccgcaaatgcatctacaagtatcagctcacctggtctaaaatcattatgatcattctggtgtgtctgcttatcgcccagaatacaattctcatcgtcgctgcctccaacgactgctgggctaagaaaagcctggagatggaatgtatcggacctctgcaacaggtggagtcttgcgacgataaggcctccagaagctactccggcgaggccaagaaactcgttcgggcttctaagattagcgacctggatgcggcccaggtggggcttctgggatccacgatcgaatctgctattgccagcatccgcaaacagagaacctatcccacaatgcacctcctggagtccgtcttcctggccaagcattgtgactactataaatcctttgaacacaattctggctactcccaagctaagtggcggcttaccgccaagacacatcacttcgatatttgcagcagacactctacccatcacttttgtcgctgcatctccgacggcacgaaatgtcagaacggggattgggacttcgcgggagagatgaatagcacctatcagtctaagaaagatttcttcgaacatgacttcaagctcttttgcacactgctggagaacgctttccctggcaccacagagagcttttactaccaaatgctccagaaaaagaataccacgggggtggtcaaactgcttgatgaactgacaaagaagttcggaaacaataacatgtttgtgggcatctggaaattcgggcagtatctcatgtccctgccctacattaatgagaccagcctgacaccgcttcagctctctaagatcctggaagcctccgaccaacaccaccggagcatttccggcagacaggagtctctggccaacgctgccagcggatccaaatctaaggagtgtgaccatgctaaaaaggttagctgcatctcccctcgctttggcgtgcccatggaagggctcattgcctgcggatctagccctaattataagatctacaaaatgcccaccaagctgtataaatccaacaataagggcgaggtctggtgtagcggggatgtgcactgcttccaggaacttaaccccgcgtctcaggagtccgttgaccggattaaacaaatgacctgttttctgacagaacctgagacgaacgaggatgtgttcagcatcgccatctctatgtgcaaggtccaggacaagggagtgtgtaccattaatgaagagagatggaacgtgatcaaatgcgattccggcctcatttactatacagaccagcgcgatgggcaggacaccggcaatgattttggagaatactgtctgagccataactgccggatcgagagattcccgattaatcccacaatcatcaacgactgtctgtgggaataccactctcgcaagtccaaatatattaccagccttgatctcgagtccctggaggaatttaagcgggctatcagcgagaaactgtctcatacgctcattgtttacaatttcaagcctacagccaacctgccccacatcaagcctgtctataaatacattaccgtgcaaggcgtggaaaatagcgacggggtcgattccgcttatatcaccgcctctatgcccgcgcttagcggaacatccatcggctacaacattatgtctaaggacaatttcccgctgtttgacatcattatcttcattaaaagcgccgtgatcaaggctacctataaccacatttacgatacagggcctacgatcggaatcaatgttatgcatgacgagcactgcaccggccagtgtcccacagatattcctcataaagaaaactggatcaccttttcccaggagagaacatctcgctgggggtgcgaggaatttggctgcctcgccgtgaataccggatgtgtctttggcagctgccaggacattatccggcccgagacgaaggtgtacagaaaagctattgaagagtccgttctgctgaccgtgtgtatcacatatcctgggaagaccttctgcacagagatcaacgccattgaacccaagatcaccgatgagcttgaactgcaatttaaaacagtcgacaccaagacgctcccgaacattctggccgtgcagaattacaaactctatagcggacagatcaacgatctgggctctttctcccaagggtgtggaaatattcagaagacaaacagctctatcatcggcaccgggaccgctaaatttgactacgtttgccacggcgcgtcccggaaggatattatcgtgcgcagatgttataataacaattacgagagctgccggcttctgaaggaggaacagtccctcatgttcgccgacaaccatgagacaattgatgtcgctaatgtgagacatctgctgggagaccttcagtttaaactgatgctcggcgatctgcgctataagtctttcgccgaagaccctgacctcgagatcgaagccaaatgtgtggggtgccccagctgtttcacctcctacagctgcaactttcggattgtctctaatatcgatacggtttgctccattgagggaccctgtacaaccttccacaacagactgatgatcacaagcaccaagcaagactacggcatcaaaatgtcttgcaaggggaagcctggaagcacagaagagtttcagatttgtaaaaagacctatacggtgcttttcaccacagtggagaaaaatgataagatcgaaattaacaccggcgaccagacatcctttatccaggagcgcgatgacagatgcaaaacctggctgtgtcgggtccgcgatgaaggcatttctgtgatcttcgagccgatcagagctttcttcgggagctacttttccattgccttctatatcgttgtgggaattatcgtcctctttctggtgatttacatcttcctgcccatggcgtttaagctgcgggacgttctgaagcgcaatgaatatctctacctgcaagagatcaaacacaagtga

SEQ ID NO: 14169 - RNA, 4305 nt, synthetic construct
  misc_feature 1..4305: note = derived and/or modified CDS sequence (opt5) from BATV(EIV-2077Astr)__KT313702.1__GP
  source 1..4305: mol_type = other RNA
atgctcctgttcctgatccttctgattccctgctacgccagcgcttcccctgtggtcaccagatgttttcacggcgggcagctcatcgccgagtctcggagcccgacagcggtttccgaattttgcctgaaggacgatgtgtctacgattaaaagcgagatcatttatgtgaagaacgacaccggactttttgctcataataaagtcctgcgcaactggatcatcaaggattggaaaaattgtaaccccgtgcctacagccggcgggtccattaatgttatcgaagtgaacaccgacctctctctgagcacaaagacctacgtctgctccagagattgtacaattaccgtggacaaggaggatgcccaaatcattttccagacggaaaaactgaatcactttgaggttagcggaaccacactctcttccggctggttcaagaccaaagctagcgtgacactggaccggacctgcgagcatatcaaggtcacgtgtgggaaaaagacacttcagtttcacgcctgcttcaagcatcacatgtcttgtattcgctttttccacggaaccatcctgcccggcacaatggctacctccatctgccagaacattgaactcatcattatcattagcctgacccttctgatctttatcctcatggccattctgacaaaaacgtatatctgttacctgctcatgcctctgttcatgcccattgcgtatctttacggctggtcttataatagatcctgcaagaaatgcagctgttgcgggctggcctaccatccttttaccaactgtggatcccactgcgtgtgtggcctcaagttcgaggcttctgatcggatgcgcatccatagagaaagcgggctgtgccaaggatacaaatcccttcgggtggcccgcctgctctgtaagagcaaagggtcttccctgattatcagcatcctgctctctatgctgattcttagcttcgtcacaccgatcgagggcaccctgacaaattatcccgagtccagaaagtacgacctcgaagagattgctgatgttctggaaggatttgtgaccgagaagggcatcaaagaatatgtggtcttctacacgtctatttttggcgggcttttcctgctcctggccctgatcattatcatcgcgctcaaccgggtgacagagtatctgaccaatattaacgttttctactgccacgagtgtagcatgtatcactccaagaaaaatatcaagtacattggagacttcaccaacaaatgcggcttttgtacatgcggggaacttgaggatcaggaaggactgaagatccataaggtgagccgcaaatgcatttacaagtatcagctcacctggtctaaaatcatcatgattatcctggtctgtctgcttattgcccagaacacaatcctcattgtggctgcctccaatgactgctgggctaagaaaagcctggagatggaatgtatcggccctctgcaacagatggagtcttgcgacgataaggcctccagaagctactccggggaggccaagaaactcgttcgggcttctaagatcagcgacctggatgcggcccaggtgggacttctgggctccacgattgaatctgctatcgccagcattcgcaaacagagaacctatcccacaatgcacctcctggagtccgtcttcctggccaagcattgtgactactataagagctttgaacacaactctggctactcccaagctaaatggcggcttaccgccaagacacatcacttcgatatctgcagcagacactctacccatcacttttgtcgctgcatttccgacgggacgaaatgtcagaatggagattgggacttcgcgggcgagatgaacagcacctatcagtctaagaaagatttcttcgaacatgacttcaagctcttttgcacactgctggagaatgctttccctgggaccacagagagcttttactaccaaatgctccagaaaaagaacaccacgggagtggtcaaactgcttgatgaactgacaaagaagttcggcaataacaatatgtttgtggggatctggaaattcggccagtatctcatgtccctgccctacatcaacgagaccagcctgacaccgcttcagctctctaagattctggaagcctccgaccaacaccaccggagcatctccggaagacaggagtctctggccaatgctgccagcggcgggaaatccaaggagtgtgaccatgctaaaaaggtttcttgcattagccctcgctttggagtgcccatggaaggcctcatcgcctgcgggggatcccctaactataagatttacaaaatgcccaccaagctgtataaatctaataacaagggcgaggtctggtgtagcggggatgtgcactgcttccaggaacttaatcccgcgctgcaggagtccgttgaccggatcaaacaaatgacctgttttctcacagaacctgagacgaacgaggatgtgttcagcattgccatctctatgtgcaaggtccaggacaagggcgtgtgtaccatcaacgaagagagatggaatgtgattaaatgcgattccggactgatctactatacagaccagcgcgatggccaggacaccgggaacgattttggagaatactgtctgagccataattgccggattgagagattcccgatcaaccccacaattatcaatgactgtctttgggaataccactctcgcaagtccaaatatatcaccagcctcgatctggagtctctggaggaatttaagcgggctatttccgagaaactcagccatacgctgatcgtttacaacttcaagcctacagccaatcttccccacattaagcctgtctataaatacatcaccgtgcaaggcgtggaaaactccgacggggtcgatagcgcttatattaccgcctctatgcccgcgctgagcggaacatccatcggctacaatatcatgtctaaggacaacttcccgctctttgacattatcattttcatcaaaagcgccgtgattaaggctacctataatcacatctacgatacagggcctacgattggcatcaacgttatgcatgacgagcactgcaccggacagtgtcccacagatatccctcataaagaaaattggattaccttttcccaggagagaacatctcgctggggctgcgaggaatttgggtgcctggccgtgaacaccggatgtgtctttggcagctgccaggacatcattcggcccgagacgaaggtgtacagaaaagctatcgaagagtccgttctgcttaccgtgtgtattacatatcctgggaagaccttctgcacagagatcaatgccatcgaacccaagattaccgatgagctggaactccaatttaaaacagtcgacaccaagacgctgccgaacatcctcgccgtgcagaaccacaaactgtactctggacagattaatgatcttggcagcttctcccaagggtgtggcaacatccagaagacaaatagctctattatcggaaccggcaccgctaaatttgactatgtttgccatggggcgtcccggaaggatatcattgtgcgcagatgttacaacaataactatgagagctgccggctgctcaaggaggaacagtctctgatgttcgccgacaatcacgagacaatcgatgtcgctaacgtgagacatctgcttggagacctgcagtttaaactcatgctgggcgatctccgctacaagtccttcgccgaagaccctgacctggagattgaagccaaatgtgtggggtgccccagctgtttcacctcctattcttgcaattttcggatcgtcagcaacattgatacggtttgctccatcgagggaccctgtacaaccttccacaatagacttatgattacaagcaccaagcaagactacggcatcaaaatgtcttgcaagggcaagcctgggtccacagaagagtttcagatctgtaaaaagacctacacggtgctgttcaccacagtggagaaaaacgataagattgaaatcaataccggagaccagaccagctttattcaggagcgcgatgacagatgcaaaacatggctctgtcgggtccgcgatgaaggcatctctgtggttttcgagccgattagagcctttttcgggagctatttttccatcgctttctacatcgtggtcggaattatcgtgctgtttctggttatttatatcttccttcccatggcgtttaagctgcgggacgtgctcaagcgcaacgaatacctgtatctccaagagattaaacacaagtga

SEQ ID NO: 14170 - RNA, 4305 nt, synthetic construct
  misc_feature 1..4305: note = derived and/or modified CDS sequence (opt5) from BATV(Italy-2009)__KC168047.1__GP
  source 1..4305: mol_type = other RNA
atgctcctgttcctgatccttctgattccctgctacgccagcgcttcccctgtggtcaccagatgttttcacggcgggcagctcatcgccgagtctcggagcccgacagcggtttccgaattttgcctgaaggacgatgtgtctacgattaaaagcgagatcatttatgtgaagaacgacaccggactttttgctcataataaagtcctgcgcaactggatcatcaaggattggaaaaattgtaaccccgtgcctacagccggcgggtccattaatgttatcgaagtgaacaccgacctctctctgagcacaaagacctacgtctgctccagagattgtacaattaccgtggacaaggaggatgcccaaatcattttccagacggaaaaactgaatcactttgaggttagcggaaccacactctcttccggctggttcaagaccaaagctagcgtgacactggaccggacctgcgagcatatcaaggtcacgtgtgggaaaaagacacttcagtttcacgcctgcttcaagcatcacatgtcttgtattcgctttttccactccaccatcctgcccggaacaatggctaccagcatctgccagaacattgaactcatcattatcatttctctgacccttctgatctttatcctcatggccattctgacaaaaacgtatatctgttacctgctcatgcctctgttcatgcccattgcgtatctttacggctggtcctataatagaagctgcaagaaatgctcctgttgcggcctggcctaccatccttttaccaactgtgggtctcactgcgtgtgtggactcaagttcgaggctagcgatcggatgcgcatccatagagaatccggcctgtgccaagggtacaaaagccttcgggtggcccgcctgctctgtaagtctaaaggatccagcctgattatctctatcctgctcagcatgctgattctttccttcgtcacaccgatcgagggcaccctgacaaattatcccgagtctagaaagtacgacctcgaagagattgctgatgttctggaagggtttatcaccgagaagggaattaaagaatatgtggtgttctacacgagcatctttggcggccttttcctgctcctggccctgattatcatcattgcgctcaaccgggtcacagagtatctgaccaatatcaacgtgttttactgccacgagtgttccatgtatcacagcaagaaaaatattaagtacatcggggacttcaccaacaaatgcggattttgtacatgcggcgaacttgaggatcaggaagggctgaagattcataaggtttctcgcaaatgcatctacaagtatcagctcacctggtccaaaatcattatgatcattctggtgtgtctgcttatcgcccagaacacaattctcatcgtcgctgccagcaatgactgctgggctaagaaatctctggagatggaatgtatcggacctctgcaaagagtggagtcctgcgacgataaggccagccggtcctactctggcgaggccaagaaactcgttcgcgctagcaagatttccgacctggatgcggcccaggtggggcttctgggatctacgatcgaaagcgctattgcctccatcagaaaacagcggacctatcccacaatgcacctcctggagagcgtcttcctggccaagcattgtgactactataaatcttttgaacacaactccggctacagccaggctaagtggagacttaccgccaagacacatcacttcgatatttgctctcgccactccacccatcacttttgtcggtgcatcagcgacggcacgaaatgtcaaaatggggattgggacttcgcgggagagatgaactctacctatcagagcaagaaagatttcttcgaacatgacttcaagctcttttgcacactgctggagaatgctttccctggcaccacagagtccttttactaccagatgctccagaaaaagaacaccacgggggtggtcaaactgcttgatgaactgacaaagaagttcggaaataacaatatgtttgtgggcatctggaaattcgggcaatatctcatgagcctgccctacattaacgagacctctctgacaccgcttcagctctccaagatcctggaagccagcaatcagcaccacagatccatttctggccgccaagagagcctggccaacgctgcctccggaggcaaatctaaggagtgtgacaatgctaaaaaggttagctgcatctcccctcggtttggggtgcccatggaaggactcattgcctgcggctctagccctaactataagatctacaaaatgcccaccaagctgtataaatccaataacaagggggaggtctggtgtagcggagacgtgcattgcttccaggaacttaaccccgcgtctcaggagtccgttgatagaattaaacagatgacctgttttctgacagaacctgagacgaatgaggacgtgttcagcatcgccatctctatgtgcaaggtccgcgataagggcgtgtgtaccattaacgaagaacggtggaatgtgatcaaatgcgactccgggctcatttactatacagatcaaagagacggccaggataccggaaacgactttggcgaatactgtctgagccacaattgccgcatcgagcggttcccgattaaccccgctatcatcaatgattgtctgtgggaataccattctagacgctccaagtatattacaagccttgacctcgagtccctggaggaatttaaacgggccatcagcgagaagctgtctcacaccctcattgtttacaacttcaaacctacggctaatctgccccatatcaagcctgtctataagtacattacagtgcagggggtggaaaacagcgatggagtcgactccgcctatatcaccgcgtctatgcccgcccttagcggcacctccatcgggtacaatattatgtctaaagataacttcccgctgtttgacatcattatcttcattaagagcgctgtgatcaaagccacatataatcacatttacgacaccggacctacaatcggcatcaacgttatgcacgatgagcattgcacggggcagtgtcccaccgacattcctcacaaggaaaattggatcacattttcccaagagagaacctctcggtggggctgcgaggagttcggatgcctcgctgtgaacacaggctgtgtctttgggagctgccaggatattatccgccccgagaccaaagtgtacagaaaggccattgaagagaacgttctgctgacggtgtgtatcacctatcctggaaaaacattctgcaccgagatcaatgccattgaacccaagatcacagacgagcttgaactgcagtttaagaccgtcgatacaaaaaccctcccgaacattctggctgtgcagaatcataagctctactccggccaaatcaacgacctggggagcttctctcagggatgtggcaatattcagaaaacgaactccagcatcatcgggacaggcaccgcgaagtttgattatgtttgccacggagcctctcggaaagacattatcgtgagacgctgttacaataacaattatgagtcctgccggcttctgaaggaggaacaaagcctcatgttcgctgataaccatgagaccattgacgtcgccaatgtgagacatctgctgggcgatcttcagtttaagctgatgctcggggacctgcgctacaaatccttcgccgaagatcctgacctcgagatcgaagctaagtgtgtgggatgcccctcttgtttcacaagctattcctgcaactttagaattgtcagcaatatcgacaccgtttgctctattgagggcccctgtacgacattccacaaccggctgatgatcacctccacaaaacaggattacgggatcaagatgagctgcaaaggaaagcctggctctaccgaagagtttcagatttgtaagaaaacatacaccgtgcttttcacgaccgtggagaagaatgacaaaatcgaaattaacacaggcgatcaaaccagctttatccaggagcgcgacgatagatgcaagacatggctgtgtcgggtccgcgacgaagggatttccgtgatcttcgagccgatcagagcctttttcggatcttattttagcattgcgttctacatcgttgtgggcattatcgtcctctttctgatgatttatatcttcctgcccatggcttttaaacttcgggatgtgctgaagcgcaacgaatacctctatctgcaggagatcaagcacaaatga

SEQ ID NO: 14171 - RNA, 4305 nt, synthetic construct
  misc_feature 1..4305: note = derived and/or modified CDS sequence (opt5) from BATV(MM2222)__AB257763.1__GP
  source 1..4305: mol_type = other RNA
atgctgctcctgcttgtgctgctcatcagctgctgtgtctccgcctctcccgttattaccagatgcttccacggcgggcagctgatcgctgagcggaaaagccaaacagccatttccgaattttgtcttaaagacgatgtgtctacgatcaagagcgagattatctacgaaaagaacgacaccggactgttcgcgcataataaggtgctccgcaactggatcattaaagattggaagaattgcaaccctgtcccgacagctggcgggtccatcaatgtgattgaggttaacaccgacctgtctctgacaaccaagacatatgtgtgtagcagagattgcaccatcacggtcgacaaagaagatgcccagattgtgtttcagaccgagaagctcaatcacttcgaggtttccggaacaaccctgagctctggctggtttaaaacaaaggcctccgtgacccttgaccggacgtgtgaacatatcaaagtcacatgcgggaagaagaccctgcagttccacgcttgttttaaacatcacatgagctgcattcgcttctttcacggaacaatcctccccggcaccatggccacctctatctgtcaaaacattgagctgatcattatcatttcccttacactgatcatcttcattctcatggtgatcctgacgaagacctacatttgctatctgctcatgcctctgtttatgcccatcgcttacttctatggctggagctacaataaatcttgcaagaaatgtccttgctgtgggcttgcctatcatccctttacaaactgcggatcccactgtgtgtgcggcctgaagttcgaagcgagcgatagaatgcggattcatcgcgagtccgggctctgtcagggatacaaatctctgagagtcgcccggcttctgtgcaagagcaagggctccagcctcatcatctctattctgctgtccatgctcatcctgagcttcgttacccctattgaggggacacttaccaattacccggaatctcgcaaatataacctggaggaaatcgctgacgtgctcgagggatttgtggtcgaaaagggcattaaagagtacgtggttttctatacgagcatctttggcgccctgttccttctgatggctctcattgtgatcatcgccctgaatagagtcacagagtacctgaccaacattaatgtgctctattgtcacgaatgctccatgtaccactctaagaaaaacatcaagtatattggggattttaccaacaagtgtggattctgcacatgcggcgagctggaagaccaggaggggcttaaaatccataaggttagccggaaatgtatttacaagtaccagctgacctggtccaaaatcatcatgatgattctcgtgtgcctgctgatcgcgcaaaatacaattcttatcgtcgccgctagcgatgactgttggacgaagaagtctctcgaaatggagtgcattggacccctgcaacaggtggacacctgtgaggataaaacatcccgcagctattctggcgaagccaagaaactggtcagagcttccaagatcagcgacctcgatgccgcccaggtggggctgcttggatccaccatcgagtctgctattgcgagcatccggcgccagagaacatactccaccatgcaccttctcgaatctgtttttctgggcaaacattgcgactattacaaggtgttcgagcacaacagcggctattcccaggccaagtggcggctgacggctaaaacccatcactttgatatttgtagcagacactctacacatcacttctgccgctgtatctccgacgggaccaagtgccagaatggagattgggactttgccggcgaaatgaacagcatttaccaatctaaacgggatttctttaagcatgacttcaaacttttctgtacactcatcgaggatgcctttcctgggaccacggagtccctgttctatgaaatgctgagcaagaaaaatacaaccggaatcacaaagctcctggacaagctgaccaaaaagtttggcaacaataacatgttcgtcgggatttggaaatttggccagtacctgatgtctctcccctacgtgaatgagaccagcctgtcccctacacagctggctaaggttcttgaagtgacggaccaccaccatagaagcatctctggacgccaggagtccctcgccagcgcgacctccggctctaaaagctccgagtgcgatcacgctaagaaggtctcttgcattagcccccggttcggggtgccgatggaaggactgatcgcctgtggcaactcccctaattataaaatttacaagacacccgccaaactgtataagtctaacaataaaggggaggtgtggtgcagcggagacgttcattgttttcaagaactcatccctgcttcccaggagagcgtcgatagaattaagcagatgacctgcttcctgacagaacccgaggtgaacgacgatgtgttttctatcgccatctccatgtgtaaggtccaggacaaaggcgtgtgcaccattaatgaggatcgctggaacgttatcaagtgtgacagcgggcttatttactatacggatcaacgggaaggccaggacacaggaaacgatttcggcgagtactgcctgtctcactcctgtagaatcgaacgctttcccattaatcctaccatcatcagcgactgcctctgggagtatcattctcggaaatccaagtacattaccagcctggatctggaatcccttgaggagttcaaaagagctatcagcgaaaagctctctcacacactgattgtgtacaactttaagccgaccgccaatctgccccacatcaaacctgtctataagtacattacagtgcagggggttgagaacagcgacggagtggactccgcgtatatcacggcctctatgcccgctctcagcggcacctccatcgggtacaatattatgtctcgcgataacttccctctgttcgacatcattatctttattaaaagcgccatcattaaggctacatataatcatatctacgataccggacccacaatcggcattaacgtcatgcacgacgaacattgtaccgggcagtgcccgacggatatccctcacaaagagaattggattaccttcgcccaagaacggacatccagatggggctgcgaggagtttggatgtcttgcggtgaacaccggctgcgttttcgggtcttgtcaggacatcattcggcccgaaacaaaggtgtatcgcaaagccgtcgaggaaagcgtgctgctcaccgtgtgcatcacataccctggaaagaccttttgtacggagatcaatgctattgagcccaagatcacagatgaactggagctgcagttcaaaaccgtcgacaccaagacacttcctaacattctggccgttcagaatcataaactctactccggccaaatcaacgatctggggagcttttctcagggatgcggcaatattcagaagaccaactccagcatcatcgggacgggcacagctaaattcgactatgtgtgtcacggagcctctagaaaggatattatcgtgcggagatgctacaacaataactatgaatcctgtaagctcctgaaagaggaacaaagccttatgtttgccgacaatcacgagaccattgatgtcgctaacgtgcgccatctgctcggcgacctgcagttcaagctgatgcttggggacctgcggtacaaatcctttgcggagaatcccgatctcgaaatcgaggccaagtgcgttggatgtccgtcttgcttcacaagctattcctgcagcttcaaaattgtgtctaacatcgacaccgtctgttccattgaaggcccttgcacaacctttcacaatagactgatgatcacgagcaccaagcaggattacgggatcaagatgtcttgtaaaacaaagcccggacccattgaggaatttcagatctgcaaaaagacctatacaattctcttcaccacggtggagaaaaacgacaagatcgagattagcacaggcgatcaaacctccttcatccaggaaaaggacgatcgctgtaaaacatggctgtgcagagttcgggacgagggcatctctgtgatttttgaacctatccgcgctttctttgggagctacttctccattgccttttacatcgtcattggaatcatcgtgcttttcctggttatttatatctttctcccgatgatgttcaagctgagagatgtgctgaaacggaatgagtacctttatctgcaggaaattaagcataaatga

SEQ ID NO: 14172 - RNA, 4305 nt, synthetic construct
  misc_feature 1..4305: note = derived and/or modified CDS sequence (opt5) from BATV(MM2222)__AY772534.1__GP
  source 1..4305: mol_type = other RNA
atgctgctcctgcttgtgctgctcatcagctgctgtgtctccgcctctcccgttattaccagatgcttccacggcgggcagctgatcgctgagcggaaaagccaaacagccatttccgaattttgtcttaaagacgatgtgtctacgatcaagagcgagattatctacgaaaagaacgacaccggactgttcgcgcataataaggtgctccgcaactggatcattaaagattggaagaattgcaaccctgtcccgacagctggcgggtccatcaatgtgattgaggttaacaccgacctgtctctgacaaccaagacatatgtgtgtagcagagattgcaccatcacggtcgacaaagaagatgcccagattgtgtttcagaccgagaagctcaatcacttcgaggtttccggaacaaccctgagctctggctggtttaaaacaaaggcctccgtgacccttgaccggacgtgtgaacatatcaaagtcacatgcgggaagaagaccctgcagttccacgcttgttttaaacatcacatgagctgcattcgcttctttcacggaacaatcctccccggcaccatggccacctctatctgtcaaaacattgagctgatcattatcatttcccttacactgatcatcttcattctcatggtgatcctgacgaagacctacatttgctatctgctcatgcctctgtttatgcccatcgcttacttctatggctggagctacaataaatcttgcaagaaatgtccttgctgtgggcttgcctatcatccctttacaaactgcggatcccactgtgtgtgcggcctgaagttcgaagcgagcgatagaatgcggattcatcgcgagtccgggctctgtcagggatacaaatctctgagagtcgcccggcttctgtgcaagagcaagggctccagcctcatcatctctattctgctgtccatgctcatcctgagcttcgttacccctattgaggggacacttaccaattacccggaatctcgcaaatataacctggaggaaatcgctgacgtgctcgagggatttgtggtcgaaaagggcattaaagagtacgtggttttctatacgagcatctttggcgccctgttccttctgatggctctcattgtgatcatcgccctgaatagagtcacagagtacctgaccaacattaatgtgctctattgtcacgaatgctccatgtaccactctaagaaaaacatcaagtatattggggattttaccaacaagtgtggattctgcacatgcggcgagctggaagaccaggaggggcttaaaatccataaggttagccggaaatgtatttacaagtaccagctgacctggtccaaaatcatcatgatgattctcgtgtgcctgctgatcgcgcaaaatacaattcttatcgtcgccgctagcgatgactgttggacgaagaagtctctcgaaatggagtgcattggacccctgcaacaggtggacacctgtgaggataaaacatcccgcagctattctggcgaagccaagaaactggtcagagcttccaagatcagcgacctcgatgccgcccaggtggggctgcttggatccaccatcgagtctgctattgcgagcatccggcgccagagaacatactccaccatgcaccttctcgaatctgtttttctgggcaaacattgcgactattacaaggtgttcgagcacaacagcggctattcccaggccaagtggcggctgacggctaaaacccatcactttgatatttgtagcagacactctacacatcacttctgccgctgtatctccgacgggaccaagtgccagaatggagattgggactttgccggcgaaatgaacagcatttaccaatctaaacgggatttctttaagcatgacttcaaacttttctgtacactcatcgaggatgcctttcctgggaccacggagtccctgttctatgaaatgctgagcaagaaaaatacaaccggaatcacaaagctcctggacaagctgaccaaaaagtttggcaacaataacatgttcgtcgggatttggaaatttggccagtacctgatgtctctcccctacgtgaatgagaccagcctgtcccctacacagctggctaaggttcttgaagtgacggaccaccaccatagaagcatctctggacgccaggagtccctcgccagcgcgacctccggctctaaaagctccgagtgcgatcacgctaagaaggtctcttgcattagcccccggttcggggtgccgatggaaggactgatcgcctgtggcaactcccctaattataaaatttacaagacacccgccaaactgtataagtctaacaataaaggggaggtgtggtgcagcggagacgttcattgttttcaagaactcatccctgcttcccaggagagcgtcgatagaattaagcagatgacctgcttcctgacagaacccgaggtgaacgacgatgtgttttctatcgccatctccatgtgtaaggtccaggacaaaggcgtgtgcaccattagcgaggatcgctggaatgttatcaagtgtgactctgggcttatttactatacggatcaacgggaaggccaggacacaggaaacgatttcggcgagtactgcctgtcccacagctgtagaatcgaacgctttcccattaaccctaccatcatctctgactgcctctgggagtatcattcccggaaaagcaagtacattacctccctggatctggaaagccttgaggagttcaaaagagctatctctgaaaagctcagccacacactgattgtgtacaattttaagccgaccgccaacctgccccacatcaaacctgtctataagtacattacagtgcagggggttgaaaattccgacggagtggactctgcgtatatcacggccagcatgcccgctctctccggcacctctatcgggtacaacattatgagccgcgataatttccctctgttcgacatcattatctttattaaatccgccatcattaaggctacatataaccatatctacgataccggacccacaatcggcattaatgtcatgcacgacgaacattgtaccgggcagtgcccgacggatatccctcacaaagagaactggattaccttcgcccaagaacggacatctagatggggctgcgaggagtttggatgtcttgcggtgaataccggctgcgttttcgggagctgtcaggacatcattcggcccgaaacaaaggtgtatcgcaaagccgtcgaggaatccgtgctgctcaccgtgtgcatcacataccctggaaagaccttttgtacggagatcaacgctattgagcccaagatcacagatgaactggagctgcagttcaaaaccgtcgacaccaagacacttcctaatattctggccgttcagaaccataaactctacagcggccaaatcaatgatctggggtctttttcccagggatgcggcaacattcagaagaccaatagctctatcatcgggacgggcacagctaaattcgactatgtgtgtcacggagcctccagaaaggatattatcgtgcggagatgctacaacaacaattatgaaagctgtaagctcctgaaagaggaacaatcccttatgtttgccgacaaccacgagaccattgatgtcgctaatgtgcgccatctgctcggcgacctgcagttcaagctgatgcttggggacctgcggtacaaatcttttgcggagaaccccgatctcgaaatcgaggccaagtgcgttggatgtccgagctgcttcacatcctatagctgctctttcaaaattgtgtccaatatcgacaccgtctgtagcattgaaggcccttgcacaacctttcacaacagactgatgatcacgtctaccaagcaggattacgggatcaagatgagctgtaaaacaaagcccggacccattgaggagttccagatctgcaaaaagacctatacaattctctttaccacggtggagaaaaatgacaagatcgagatttccacaggcgatcaaacctctttcatccaggaaaaggacgatcgctgtaaaacatggctgtgcagagttcgggacgagggcatcagcgtgatttttgaacctatccgcgctttctttgggtcctacttctctattgccttttacatcgtcattggaatcatcgtgcttttcctggttatttatatctttctcccgatgatgttcaagctgagagatgtgctgaaacggaacgagtacctttatctgcaggaaattaagcataaatga

SEQ ID NO: 14173 - RNA, 4305 nt, synthetic construct
  misc_feature 1..4305: note = derived and/or modified CDS sequence (opt5) from BATV(MM2222)__JX846596.1__GP
  source 1..4305: mol_type = other RNA
atgctgctcctgcttgtgctgctcatcagctgctgtgtctccgcctctcccgttattaccagatgcttccacggcgggcagctgatcgctgagcgcaagagccaaacagccatttccgaattttgtcttaaagacgatgtgtctacgatcaagagcgagattatctacgaaaagaacgacaccggactgttcgcgcataataaggtgctccggaactggatcattaaagattggaagaattgcaaccctgtcccgacagctggcgggtccatcaatgtgattgaggttaacaccgacctgtctctgacaaccaagacatatgtgtgtagcagagattgcaccatcacggtcgacaaagaagatgcccagattgtgtttcagaccgagaagctcaatcacttcgaggtttccggaacaaccctgagctctggctggtttaaaacaaaggcctccgtgacccttgaccggacgtgtgaacatatcaaagtcacatgcgggaagaagaccctgcagttccacgcttgttttaaacatcacatgagctgcattcgcttctttcacggaacaatcctccccggcaccatggccacctctatctgtcaaaacattgagctgatcattatcatttcccttacactgatcatcttcattctcatggtgatcctgacgaagacctacatttgctatctgctcatgcctctgtttatgcccatcgcttacttctatggctggagctacaataaatcttgcaagaaatgtccttgctgtgggcttgcctatcatccctttacaaactgcggatcccactgtgtgtgcggcctgaagttcgaagcgagcgatagaatgcggattcatcgcgagtccgggctctgtcagggatacaaatctctgagagtcgcccggcttctgtgcaagagcaagggctccagcctcatcatctctattctgctgtccatgctcatcctgagcttcgttacccctattgaggggacacttaccaattacccggaatctcgcaaatataacctggaggaaatcgctgacgtgctcgagggatttgtggtcgaaaagggcattaaagagtacgtggttttctatacgagcatctttggcgccctgttccttctgatggctctcattgtgatcatcgccctgaatagagtcacagagtacctgaccaacattaatgtgctctattgtcacgaatgctccatgtaccactctaagaaaaacatcaagtatattggggattttaccaacaagtgtggattctgcacatgcggcgagctggaagaccaggaggggcttaaaatccataaggttagccggaaatgtatttacaagtaccagctgacctggtccaaaatcatcatgatgattctcgtgtgcctgctgatcgcgcaaaatacaattcttatcgtcgccgctagcgatgactgttggacgaagaagtctctcgaaatggagtgcattggacccctgcaacaggtggacacctgtgaggataaaacatcccgcagctattctggcgaagccaagaaactggtcagagcttccaagatcagcgacctcgatgccgcccaggtggggctgcttggatccaccatcgagtctgctattgcgagcatccggcgccagagaacatactccaccatgcatctgctcgaatctgtttttctgggcaaacactgcgactattacaaggtgttcgagcacaacagcggctattcccaggccaagtggcggctgacggctaaaacccatcactttgatatttgtagcagacactctacacatcacttctgccgctgtatctccgacgggaccaagtgccagaatggagattgggactttgccggcgaaatgaacagcatttaccaatctaaacgggatttctttaagcatgacttcaaacttttctgtacactcatcgaggatgcctttcctgggaccacggagtccctgttctatgaaatgctgagcaagaaaaatacaaccggaatcacagagctcctggacaaacttaccaagaaatttggcaacaataacatgttcgtcgggatttggaagtttggccagtacctgatgtctctcccctacgtgaatgaaaccagcctgtcccctacacagctggctaaagttcttgaggtgacggaccaccaccatagaagcatctctggacgccaggagtccctcgccagcgcgacctccggctctaagagctccgaatgcgatcacgctaaaaaggtctcttgcattagcccccggttcggggtgccgatggagggactgatcgcctgtggcaactcccctaattataagatttacaaaacacccgccaagctgtataaatctaacaataagggggaagtgtggtgcagcggagacgttcattgttttcaagagctcatccctgcttcccaggaaagcgtcgatagaattaaacagatgacctgcttcctgacagagcccgaggtgaacgacgatgtgttttctatcgccatctccatgtgtaaggtccaggacaagggcgtgtgcaccattaatgaagatcgctggaacgttatcaaatgtgacagcgggcttatttactatacggatcaacgggagggccaggacacaggaaacgatttcggcgaatactgcctgtctcactcctgtagaatcgagcgctttcccattaatcctaccatcatcagcgactgcctctgggaatatcattctcggaagtccaaatacattaccagcctggatctggagtcccttgaggagttcaagagagctatcagcgagaaactctctcacacactgattgtgtacaactttaagccgaccgccaatctgccccacatcaagcctgtctataaatacattacagtgcagggggttgaaaacagcgacggagtggactccgcgtatatcacggcctctatgcccgctctcagcggcacctccatcgggtacaatattatgtctcgcgataacttccctctgttcgacatcattatctttattaagagcgccatcattaaagctacatataatcatatctacgataccggacccacaatcggcattaacgtcatgcacgacgagcattgtaccgggcagtgcccgacggatatccctcacaaggaaaattggattaccttcgcccaagagcggacatccagatggggctgcgaggaatttggatgtcttgcggtgaacaccggctgcgttttcgggtcttgtcaggacatcattcggcccgagacaaaagtgtatcgcaaggccgtcgaagagagcgtgctgctcaccgtgtgcatcacataccctggaaaaaccttttgtacggagatcaatgctattgaacccaagatcacagatgagctggaactgcagttcaagaccgtcgacaccaaaacacttcctaacattctggccgttcagaatcataagctctactccggccaaatcaacgatctggggagcttttctcagggatgcggcaatattcagaaaaccaactccagcatcatcgggacgggcacagctaagttcgactatgtgtgtcacggagcctctagaaaagatattatcgtgcggagatgctacaacaataactatgagtcctgtaagctcctgaaggaagaacaaagccttatgtttgccgacaatcacgagaccattgatgtcgctaacgtgcgccatctgctcggcgacctgcagttcaaactgatgcttggggacctgcggtacaagtcctttgcggaaaatcccgatctcgagatcgaagccaaatgcgttggatgtccgtcttgcttcacaagctattcctgcagcttcaagattgtgtctaacatcgacaccgtctgttccattgagggcccttgcacaacctttcacaatagactgatgatcacgagcaccaaacaggattacgggatcaagatgtcttgtaagacaaaacccggacccattgaagagttccagatctgcaagaaaacctatacaattctctttaccacggtggagaagaacgacaaaatcgaaattagcacaggcgatcaaacctccttcatccaggagaaggacgatcgctgtaagacatggctgtgcagagttcgggacgaaggcatctctgtgatttttgagcctatccgcgctttctttgggagctacttctccattgccttttacatcgtcattggaatcatcgtgcttttcctggttatttatatctttctcccgatgatgttcaaactgagagatgtgctgaagcggaatgaatacctttatctgcaggagattaaacataagtga

SEQ ID NO: 14174 - RNA, 4305 nt, synthetic construct
  misc_feature 1..4305: note = derived and/or modified CDS sequence (opt5) from BATV(MS50)__JX846605.1__GP
  source 1..4305: mol_type = other RNA
atgaagatgctgaccctcatcattatcgtgagctgctgggtcgccacactgcagaacccccttatttccagatgtttccacggcgggcaactgatcgctgagaaaaagtctctcacgagcatttccgaattttgcatcaaagacgatgtttctatgctgaaaagcgaggtgatctaccagaaaaatgacaccggaatttatggccattccaaggtgttccggcactggacaatcgccgattggaagtactgtaaccctgtcccgaccgctgggggatctattaatgtgatcgaacttgacaaaaacctgaatctcattgctaagaactatgtttgcacacgcgattgtaccatcacagtggacaaagagaatgcccagattgtctttcagaccgataagctgaaccatttcgaagtgacgggcaccacaatcagcaccgggtggtttaaaacaaaggcctccgttgctctggacagaacctgcgagcacatcaaggtgagctgtggaaagaagacgctccaattccatgcctgctttaaacagcacatgtcttgtgtccggttcctgcaccgctccatgcttcccggcagcatggctaattctatttgccagaacatcgagctgattatcattatcacactcaccctggtgatctttattcttatgctgatcgccacaagattctacatttgttatctcctgatccctgtgtttatgcccattgcgtacgcctatggctgggcttacaatcggtcctgcaagaaatgcagctgttgcgggctggcctaccatcctttcaccaactgtggatcttattgcgtctgtggcgctcgctttgaaacctccgatagaatgcggctccaccgcgagagcgggctgtgccagggattcaagtcccttagaatggcccggcgcctgtgtaaatctaagggcagctccctcgttatcagcatcctgcttgcgacactgattctctctttcgtgacgcccatcgaagggaccatgacaaattaccctaccaacgagaagtattccctggacgagattgccgatgtgctgaaatggaaggaacaagagagcgaatacaaatattacgctatcctctatgcctctattatcggagcttgctttacagtcctgttcgccggcaccgcccttgctctgaatattgtgctcgagctgcttacgaagatcaacgttatctactgtgaagagtgcagcatgtaccattccaaatctaacattaagtatatcggcgactttacaaataagtgtgggttctgtacctgcggactgctcgaggatccggacggcgtggtcgtgcacaaagttaagagaagctgcacctaccagtataaactgacatgggtgaagaccattatgatcgtcctgtccattctctttctgcttcagaacatcatcgtgattgtcgcggccgacagcgattgctggacaaatgaggaactgaaacccgaatgtgtggggcctctcatcgctcccgccgactgcacggagaaggataagaaaacctacctgacagaagccgctgccctggttaagaccaaaaagatttctcaggtggacgcggataacgtcgagatccttggaaaaacaattgagtccgctatcaaggccatcgaaaagcagaaaacctatcaccggatgcatctcctggaggccgtgttcctgaataagcactgtgactactataaactctttgaacataacagcggctactctcaagttaagtggcgcatgctggctaaaacgcagcacttcgatatttgcgcctttgctaaggagtccaaattctgtaagtgcatggccgggggagcgtgtgccgaagacagctgggattttgacaccacaatgaactccacctacacatctaagggcgataatttcaaacatgacatgagcctttttctgaagatcttcgaggctgccttccctggcacctcctatgtgtacatgctcaataaaattaaggagaaaaagccctatcaatctgtcacgatgatcgacaagattaaaacaaagtacccgaacaataaaatgctggtggcttatctggaatttgggaagtgccttatgggagtgggccacgccagcaccttcgagctccagcagtcccagctggaaagactgtaccaacctgcggagctcagccggtctgttgggcagctgacatcccttagcaacgcccaggtcggaaccatcaccaaagagtgttctaagtataaggatatctcctgcctgagccccagatttggcattcctatggaaaatatggtggcttgcggggactctcccaactacaaaatctacaagaaacccattaaggtgtataaagcccacgatcgcgtcgagacatggtgtatcaaggaccagcattgcctcgtggattacacgcctgctgaagccgacgttgtgaagaaactgaagaccatgaaatgttggctgaatgatccgggcacagagaccgacgcctatacaaccgctattaagagctgccggatcatggataaaggagtctgtacggtgaacggccaaaagtggtccattatcaaatgcgacagcgatcttctctactatacagaccacatcgaaggggaggataccggaaacgacattggccattactgtatctctgttgggtgcaagaccgacagatatcccattaatcctgatatcgtgacagactgtacctgggagttcaagtcccgcaaaagctcctacattggaaagatctctatgcagagcctggaagattacaaaaaggcgctgacagacaaactcacgcacaccctggagacatattcctttgcccccaccgctgatcttcctcacatcaagcccatttacaagtatatcacagcccagggcgtcgaaaactctgacgggattgagggcgcctacatcaccgctacgattccggccctgggaggcaccagcatcgggtattccgtgcagtctaaagatggattccctctcctggacctgatcatttacatcaaggcggctgttattcggagcacatatatccatctttacgataccggccccacaatttccatcaataccaaacacgacgaaaagtgcacagggcaatgtcctgccgagattgagcatgaagccaactggctcacctttagccaggagagaacgtctcgctggggatgcgaagagttcggctgcctggctatcaatacagggtgtgtgtttggctcctgccaggatgtcatccggcccgaaaccaaagtgtacagaaagagcgtggaggaggaagtcgttctgaccgtgtgtattaactatcctggaaatacattctgcaccgagatcaacgccattgaacccaagatcacggaggaggtggaactccagtttaaaacagtcgacaccaagacactgccgacccttctggcggtgacaaatcacaaactcttctctggccaaattaacgatctggggacctttggacagatgtgtggcaatgttcagaagacgaactccagcatcctggggtctggaacccctaaattcgactacacatgccatggcgcttcccgcaaggacatcattgtgcggaagtgttataataacaattacgatagctgcaaacttctgaaggaggaaaaacaactcgtcttcaacgacgatcacgagaccatcacagtggttaacaatagacacctggtgggggaactcgccattaagctgatccttggcgacattcagtataaactgtttaccgagaagctcgatctgcagatcgacgccaagtgtgtcggatgccccgattgtttcgagtcctacgcttgcaactttcagatcgtgagcaatattgacacggtttgcgccatcaacggcccctgtgatattttccataatcgcatctctattcggagcacacaacagaactatggggtgaaaatgtcctgcaagagaacccctgaccagaatgaaaaatttgtcatctgtggacgggagtactctgtgttctttcacacagtgcagaagaacgataaaattgaaatcaataccggcgaccaaaccagctacatcaaggagatggacacacgctgcaaaacgtggctgtgtagagtccgggatgaagggctttccgttattttcgagccgatcaaggcgtttttcggatcttattttagcattgccttctacatcgtgctgttcattatcatcgcgtttctcgtgatttatatcttcatgcccatgtttatgaagctgagagacattctcaaacagaacgagaagctgtaccttcaggaaatcaaacagaagtga

SEQ ID NO: 14175 - RNA, 4305 nt, synthetic construct
  misc_feature 1..4305: note = derived and/or modified CDS sequence (opt5) from BATV(NM/12)__KJ187039.1__GP
  source 1..4305: mol_type = other RNA
atgctgctcctgcttgtgctgctcatcccctgctgtgtcagcgcctcccctgctattaccagatgcttccacggcgggcagctgatcgccgagcggaagtctcaaacagcgattagcgaattttgtcttaaagacgatgtttccacgatcaagtctgagattatctacgagaaaaacgacaccggactgttcgctcataataaggtgctccgcaactggatcattaaagattggaagaattgcaacccggtgcccacagccggcgggagcatcaatgtcattgaagtgaacaccgacctgtccctgacaaccaagacatatgtttgttctagagattgcaccatcacggtggacaaagaagatgcccagattatctttcggaccgagaagctcaatcacttcgaggtcagcggaacaaccctgtccagcggctggtttaaaacaaaggcttctgtgacccttgaccgcacgtgtgaacatattaaagttacatgcgggaagaagaccctgcagttccacgcctgttttaaacatcacatgtcctgcatcagattctttcacggaacaatcctccctggcaccatggctaccagcatttgtcagaacatcgagctgattatcattatctctcttacactgatcattttcatcctcatggtgattctgacgcggacctacatctgctatctgctcatgcccctgtttatgcctattgcctacttctatggctggtcctacaataagagctgcaaaaagtgtcaatgctgtgggcttgcgtatcatccctttacaaactgcggatctcactgtgtctgcggcctgaaattcgaagcctccgatcgcatgagaatccatcgggagagcgggctctgtcagggatacaagtccctgcgcgtggctagacttctgtgcaaatctaagggcagctccctcatcattagcatcctgctgtctatgctcattctgtccttcgtgacccctatcgaggggacacttaccaattacccggaaagccggaagtatgacctggaggaaattgccgatgtcctcgagggatttgttgtggaaaaaggcatcaaggagtacgtggtcttctatacgtctatttttggcgctctgttccttctgatggccctcatcatcattatcgcgctgaaccgcgtgacagagtacctgaccaatattaacgtgttttattgtcacgaatgcagcatgtaccactccaaaaagaatatcaaatatattggggacttcaccaacaagtgtggattttgcacatgcggcgagctcgaagatcaggaggggctgaagatccataaagtttctagaaagtgtatctacaaataccagcttacctggagcaagattatcatgatgattctggtctgcctcctgatcgcccaaaacacaattctgatcgtggctgcctccgacgactgttggacgaaacggagccttgaaatgggatgcatcggccccctccagcaggttgatacctgtgacgataagacatctcgctcctatagcggggaggctaagaaactggtgagagcctctaagatttccgacctggatgccgctcaggtcggactcctgggcagcaccatcgagtccgcgattgcctctatccggaaacaaagaacatacagcaccatgcaccttctggaatccgtgttcctcggcaagcattgcgactattacaaagtctttgagcacaattctgggtatagccaggctaagtggcgcctgacggccaagacccatcacttcgatatttgttcccggcacagcacacatcacttttgcagatgtatctctgacggaaccaaatgccagaacggcgattgggacttcgcctccgaaatgaatagcacataccaatctaagcgcgactttttcgagcatgatttcaaacagttttgtaccctgatcgaaaacgctttccctgggacgacagagtccctcttttatgagatgctcagcaagaaaaataccacaggaattaccaagctgctggacaaactcaccaagaagttcggcaacaataacatgtttgtggggatctggaaattcggccagtacctgatgtctcttccctacgttaatgaaacaagcctgtcccctacgcagctcgccaaggtgctggaggtcaccgatcaccaccatcggagcatttctggaagacaagaatccctggcgagcgctgcccccggctccaaatctagcgagtgcgaccacgcccgccgggtgtcctgcatctctccgagatttggggttcctattgagggacttacagcttgtggcagctcccccaactataagatctacaaaacccctgccaagctctataagtctaataacaaaggggaagtgtggtgcagcggagatgtccattgtctgcaggagctgattcccgctccccaggaatccgtggaccgcatcaagcagatgacatgcttcctcaccgagcctggcgtgaatgatgacatctttagcattgccatctctatgtgtaaagttcaagataagggggtctgcacgattaacgaagaccggtggaatgtggtgaaatgtgatagaggcctgatctactatacagaccagcgcgagggacaggataccggcaacgacttcgggaagtactgcctttcccacagctgtcggattgagagatttccgatcaaccccgcgatcattaatgattgcctgtgggaatatcattctcggaagtccaaatacatcaccagcctcgacctggagtctctggaagagttcaagcgcgccatttccgaaaaacttagccacacactcatcgtccacaactttaagcctaccgctaatctgccccatattaaacctgtgtacaagtatatcacagttcagggagtggagaactccgacggcgtcgatagcgcctacatcacggcttctatgcccgccctgagcgggacctccattggatataatatcatgtctagagacaacttcccgcttttcgatattatcatttttatcaagagcgcgattatcaaagccacatacaatcacatctatgacaccggccctacaattgggatcaacgtgattcatgatgagcactgtaccggccaatgccccacggacatccctcataaggaaaattggattaccttcgctcaggagcggacatccagatggggatgcgaagagtttggctgtctggccatcaacaccgggtgcgttttcggatcttgtcaggatatcattcgccccgaaacaaaagtgtaccggaaggctgtcgaggagagcgtgcttctgaccgtttgcatcacatatcctggcaaaaccttttgtacggaaattaatgccatcgagcccaagattacagacgaactcgagctgcagttcaaaaccgtggataccaagacactgccgaacatccttgccgtccaaaatcacaagctgtactccgggcagatcaacgacctcggatcttttagccagggctgcgggaatattcagaaaaccaactccagcatcattggcacgggaacagctaagttcgattacgtgtgtcacggcgcgtctagaaaagacatcattgtgcgcagatgctataacaataactacgagtcctgtaagctgctcaaagaggaacaaagcctgatgtttgccgataatcatgaaaccatcgacgtcgctaacgttcggcaccttctgggggacctccagttcaagctgatgctgggagatcttcgctataagtcttttgccgagaatcctgacctggaaattgaggccaaatgcgtgggctgtccctcctgcttcacaagctactcctgctctttcaagatcgtgagcaacatcgataccgtctgttccattgaggggccctgcacaatctttcatagcagactcatgattacctctacgaaacaggactatggaatcaagatgtcctgtaaaaccaagcctggcccgacagaagagttccaaatttgcaagaaaacctacacaatcctgtttaccacgatcgaaaagaatgataaaattgagatcagcacaggcgaccagacctctttcattcaggaacgggatgaccgctgtagaacatggctctgccgggtgcgcgatgaggggatcggagttatttttgagcccatcagagctttctttggcagctatttctccatcgccttttacattgtgatcgggattatcattctgttccttgtcatctacatttttctgcctatggtgttcaagctccgggacgttctgaaacgcaacgaatatctgtaccttcaggagatcaagcacaagtga

SEQ ID NO: 14176 - RNA, 4305 nt, synthetic construct
  misc_feature 1..4305: note = derived and/or modified CDS sequence (opt5) from BATV(ON-1/E/94)__AB257764.1__GP
  source 1..4305: mol_type = other RNA
atgctcctgttcctggtgcttctgatcagctgctacgtctccgcctctcccgttattaccagatgttttcacggcgggcagctcatcgctgagcgcaagagccaaacagccatttccgagttctgcctgaaagacgatgtgtctacgatcaagagcgaaattatctatgaaaagaacgacaccggactttttgcgcattccaaggtgctgcggaattggatcattaaagattggaagaactgtaatcctgtcccgacagctggcgggtctatcaacgtgattgaggttaatgccgacctcagcctggccaccaagacatacgtgtgctccagagattgtaccatcacagtcgacaaagaagatgctcagattgtgttccagaccgagaagctgaaccactttgaggttagcggaacgaccctctcttccggctggttcaaaacaaaggccagcgtgaccctggaccggacatgcgaacatatcaaagtcacctgtgggaagaagacgcttcagtttcacgcttgcttcaaacatcacatgtcttgtattcgctttttccacggaacaatcctgcccggcaccatggccacatccatctgccaaaatattgagctcatcattatcattagcctgacccttatcatctttattctgatggtgatcctcaccaagacatatatttgttacctgctgatgcctctcttcatgcccatcgcgtatttttacggctggtcttataacaaatcctgcaagaaatgcagctgttgcgggctggcctaccatcctttcacgaattgtggatcccactgcgtgtgtggccttaagttcgaggcttctgatagaatgcggattcatcgcgaaagcgggctgtgccagggatacaaatccctcagagtcgcccggctgctttgtaagagcaaggggtcttccctgatcatcagcattctcctgtctatgctgatcctcagctttgttacccccattgagggcacactgaccaactatcctgaatcccgcaaatacgaccttgaggaaatcgctgatgtgctggagggattcgtggtcgaaaagggcattaaagagtatgtggtgttttacacatctatcttcggcgccctctttctgcttatggcgctgattgtgatcatcgccctcaatagagtcaccgagtatctgacgaacattaatgtgctgtactgccacgaatgtagcatgtatcactccaagaaaaacatcaagtacattggggacttcacaaataagtgcggattttgtacctgcggcgagctcgaagatcaggaggggctgaaaatccataaggttagccggaaatgcatttacaagtatcagcttacctggtctaaaatcatcatgattatcctggtgtgtctcctgattgctcaaaacacaatcctgattgtcgccgcttccgacgactgctggaccaaaaagagccttgaaatggagtgtgtgggaccgctccagcaggtcgatacatgcgaggacaaaacgtctcgctcctacagcggcgaagccaagaaactggtgagagcctccaagatctctgatctggacgctgcgcaggttgggctcctgggaagcaccatcgagtccgccattgcttctatccggaaacaacgcacatatagcaccatgcaccttctggaatccgtgttcctcggcaagcattgtgattactataaggtctttgagcacaacagcggctactctcaggccaaatggagactgacagccaagacccatcacttcgacatttgctcccggcacagcacgcatcacttttgtagatgcatctctgatgggaccaaatgtcagaatggagactgggatttcgctggcgaaatgaactccacatatcaaagcaagcgcgactttttcgagcatgatttcaaactgttttgcacccttattgagaatgccttccccgggacaaccgaatctctcttttacgagatgctgagcaagaaaaacacgacaggaatcaccaagctgctcgacaagctgacaaagaagttcggcaataacaatatgtttgtggggatctggaaattcggccagtaccttatgtccctgccttatgttaacgaaaccagcctctctcccacccagctggcgaaggtgctggaggtcacagaccaccttcaccggtccattagcggaagacaggagctcctgacgtccgctacccctggctctaaaagctccgaatgtgatcatgccaagaaggtgtcttgcatcagcccccgctttggggtgccgatggagggactgattgcctgcggcaattccccttcttacaaaatctataagacacccaccaaactctacaagagcaacaataaaggggaagtttggtgttccggagacgtccactgcttccaagagctgattcctgctagccaggaatctgtggatcggatcaagcagatgacatgttttcttaccgagcccgaggtgtccgacgatgtcttcagcattgccatctctatgtgcaaggtgcaggacaaaggcgtttgtacgatcaacgaagatagatggaatgtgattaagtgcgactccgggctgatctattacacagatcaacgcgagggccaggacaccggaaacgatctcggcgaatattgtctgagccattcttgccggattgagagatttcccatcaatcctattatcatctccgactgtctgtgggaataccacagccgcaaatccaagtacattaccagccttgatctcgagtctctggaggagttcaaacgggctatcagcgaaaagctgtcccatacactcattgtctataactttaagccgaccgccaacctgccccacatcaaacctgtgtacaagtatattacagttcagggggtggaaaattctgacggagtcgacagcgcgtacatcacggcctccatgcccgctctttctggcaccagcatcgggtataacattatgtccagagataatttccctctgttcgacatcattatctttattaaatctgccatcattaaggctacatacaaccacatctatgataccggacccacaatcggcattaatgtgatgcatgacgagcactgcaccgggcagtgtccgacggatatccctcataaagaaaactggattaccttcgcccaagagcgcacaagccggtggggctgcgaggaatttggatgcctcgcggttaataccggctgtgtgttcgggtcctgccaggacatcattagacccgagacaaaggtctaccggaaagccgtggaagagagcgtgctgctgaccgtctgtatcacataccctggaaagaccttttgcacggagatcaacgctattgaacccaagatcacagatgagcttgaactgcagttcaaaaccgttgacaccaagacactccctaatattctggccgtgcagaaccacaaactctattctggccaaatcaatgatctggggtcctttagccagggatgtggcaacattcagaagaccaattcttccatcatcgggacgggcacagctaaattcgactacgtgtgccatggagccagccgcaaggatattgtcgtgagacggtgttataacaataactacgagtcctgcaaacttctgaaagaggaacaatctctcatgtttgccgacaaccacgagaccatcgatgttgctaatgtgagacatctgctgggcgaccttcagttcaagctgatgctcggggacctgcgctataagagctttgcggaaaaccccgatctcgagattgaagccaagtgtgtcggatgcccgtcctgtttcacaagctactcttgctccttcaaaatcgtgagcaatattgacaccgtttgctctatcgagggcccttgtacaacctttcacaaccggctgatgattacgagcaccaagcaggattatgggatcaagatgtcctgcaaaacaaagcccggacccaccgaagagttccagatctgtaaaaagacatacaccattctttttacgacagtggagaaaaatgacaagatcgaaatttctaccggcgatcaaaccagcttcatccaggagaaggacgatagatgcaaaacatggctgtgtcgcgtcagagacgaaggcatttccgtgatctttgagcctatccgggctttctttgggtcttacttcagcattgccttttatatcgttattggaatcattgttctcttcctggtcatctacatctttctgccgatgattttcaaacttcgcgatgtgctgaaaagaaacgaatatctctacctgcaggagatcaagcacaaatga

SEQ ID NO: 14177 - RNA, 4305 nt, synthetic construct
  misc_feature 1..4305: note = derived and/or modified CDS sequence (opt5) from BATV(ON-7/B/01)__AB257765.1__GP
  source 1..4305: mol_type = other RNA
atgctgctcctgcttgtgctgctcatcccctgctgtgtcagcgcctcccctgttattaccagatgcttccacggcgggcagctgatcgctgagcggaagtctcaagccgcgattagcgaattttgtcttaaagacgatgtgtccacaatcaagtctgagattatctacgaaaagaacgacacgggactgttcgctcataataaggtgctccgcaactggatcattaaagattggaagaattgcaacccggtccccaccgccggcgggagcatcaatgtgattgaggttaacacagacctgtccctgaccacaaagacctatgtgtgttctagagattgcacaatcaccgtcgacaaagaagatgcccagattatctttcagacggagaagctcaatcacttcgaggtgagcggaaccacactgtccagcggctggtttaaaaccaaggcttctgttacacttgaccggacctgtgaacatattaaagtgacgtgcgggaagaagacactgcagttccacgcctgttttaaacatcacatgtcctgcatccgcttctttcacggaaccatcctccctggcacaatggctaccagcatttgtcaaaacatcgagctgattatcattatctctcttaccctgatcattttcatcctcatggtcattctgacaaagacgtacatctgctatctgctcatgcccctgtttatgcctattgcctacttctatggctggtcctacaataaaagctgcaagaaatgtccctgctgtgggcttgcgtatcatccttttaccaactgcggatctcactgtgtgtgcggcctgaagttcgaagcctccgatagaatgcggatccatcgcgagagcgggctctgtcagggatacaaatccctgagagtggctcggcttctgtgcaagtctaagggcagctccctcatcattagcatcctgctgtctatgctcattctgtccttcgtcacaccgatcgaggggacccttacaaattaccccgaaagccgcaaatatgacctggaggaaattgccgatgttctcgagggatttatcgtggaaaagggcattaaagagtacgtggtcttctatacctctatctttggcgctctgttccttctgatcgccctcattgtgatcattgcgctgaacagagttacggagtacctgacaaatatcaacgtgctctattgtcacgaatgcagcatgtaccactccaagaaaaatattaagtatatcggggactttaccaacaagtgtggattctgtacctgcggcgagctggaagatcaggaggggcttaaaatccataaggtctctcggaaatgcatttacaagtaccagctgacatggagcaaagtgatcatgatgattctcgtttgcctgctgatcgcccaaaacaccattcttatcgtggctgcctccgacgactgttggacaaagaaaagcctcgaaatgggatgcatcggccctctgcagcaggtcgatacgtgtgacgataaggcttctcgctcctatagcggggaggccaagaaactggtgagagcctctaagatttccgacctcgatgctgcgcaggtcggacaactgggcagcaccatcgagtccgccattgcttctatccggcgccagagaacatacagcaccatgcaccttctggaatccgtgtttctcggcaaacattgcgactattacaaggttttcgagcacaattctgggtatagccaggccaagtggcggctgacagccaaaacccatcactttgatatttgttccagacacagcacgcatcacttctgccgctgtatctctgacggaaccaagtgccaaaacggcgattgggactttgctggggaaatgaactccacataccagagcaaacgggatttctttgagcatgacttcaatctgttctgtacccttatcgaaaatgcctttcccggaacaaccgagtctctcttctatgagatgctgtccaagaaaaacacgacaggcattaccaagctgctcgacaaactgacaaagaagtttgggaataacaatatgttcgtgggcatctggaaatttggacagtaccttattagcctgccttacgtcaacgaaacctctctcagccccacccagctggcgaaggtgctggttgtgacagatcaacaccacagatccatcagcggccgccaggagtctcttgcttccgccacgccggggagcaaatcctctgaatgcggacatgccaagaaagtcagctgcatttcccctcggttcggcgtgcccatggaggggctcatggcttgtggatctagccctaattataagatctacaagacccccgccaaactgtataagtccaacaataaaggcgaggtgtggtgctctggggacgttcactgttttcaggatctgattcccgctagccaggaatccgtcgacagaatcaagcaaatgacatgcttcctcaccgagcctgaagtgaacgatgacgtgtttagcatcgccattgcgatgtgtaaagtccaggataagggcgtgtgcacaatcaatgaggaccgctggaacctgattaagtgtgattctggacttatctactataccgaccagcgggaaggccaggatacggggaacgacttcggagagtactgcctgtcccataattgtaaaatggagagatttccgattaaccccgccatcatcagcgattgcctctgggaatatcactctcgcaagtccaaatacattacaagcctggacctggagtctcttgaagagttcaagcgggctatctccgaaaaactcagccataccctggttgtgtacaattttaagcctaccgccaacctgccccacattaagcctgtctataaatacatcacagtgcaaggcgttgaaaattccgacggggtggatagcgcttatattaccgcctctatgcccgcgctcagcggaacatccatcggctacaacatcatgtctagagacaatttcccgctgttcgatattatcatttttatcaagagcgccattatcaaagctacgtataaccacatttacgacaccgggcctacaatcggcatcaatgtcatgcatgatgagcactgtaccggacagtgccccacagacattcctcataaggaaaactggatcaccttcgcccaggagcgcacgtcccggtggggctgcgaagagtttgggtgtcttgctgtgaataccggatgcgttttcggctcttgtcaggatattatcagacccgaaacaaaagtgtatcggaaggccgtcgaggagagcgtgctgctcaccgtgtgcattacataccctgggaaaaccttttgtacagaaatcaacgccatcgagcccaagattaccgacgaactggagctgcaattcaagacggtcgatacaaaaacccttccgaatatcctggctgttcagaaccacaagctctactccggacagattaatgacctgggctcttttagccaagggtgcggcaacatccagaaaaccaacctctccattatcggaacaggcaccgcgaagttcgattatgtgtgtcatggggccagccgcaaagacatcattgtgagacggtgctacaataacaattatgagtcttgtaagctgcttaaggaggagcagtccctgatgtttgctgataaccacgaaacgatcgacgtcgccaatgtgagacacctcctgggagacctgcagttcaaacttatgctgggcgatctccgctacaagagctttgccgagaaccctgacctggaaattgaggctaaatgcgttgggtgtccctcttgcttcacatcctatagctgcaatttcaagatcgtgtccaacattgataccgtctgttctatcgagggaccctgcacaacctttcataatcggctcatgattacaagcgccaaacaagactacggcatcaagatgtcctgtaagaccaaacctggcctgacggaagagttccagatctgcaagaaaacctatacagtgctttttgcgaccgttgaaaagaacgatgagattgaaatcagcacaggggaccagacctctttcattcaggagagagatgaccgctgtaaaacgtggctgtgcagagtgcgggatgagggaatctccgtcatttttgaaccgatccgcgctttctttggcagctacttctctatcgccttttacattgtgatcgggattatcgttctcttcctggtgatttatatctttctgcccatggtcttcaaacttagagacgtgctgaagcggaatgagtacctctatctgcaagaaatcaaacacaagtga

SEQ ID NO: 14178 - RNA, 4305 nt, synthetic construct
  misc_feature 1..4305: note = derived and/or modified CDS sequence (opt5) from BATV(UgMP-6830)__DQ436460.1__GP
  source 1..4305: mol_type = other RNA
atgctgctcctgcttgtgctgctcatcccctgctacgtcagcgcctcccctgttgtgaccagatgtttccacggcgggcagctgattgctgagaagaaatctcaaacagccgtgagcgaattttgccttaaggacgatgtctccacgatcaaatctgagattacctatgaaaagaacaatacaggactgttcgcgcataacaaagtgctccggaattggatcattaaggactggaagaactgtaatccggttcccaccgctggcgggagcatcaacgtgatcgaggtcaatacagatctgtccctgaccacaaaaacctacgtgtgctctcgcgactgtacgattaccgttgataaggaagacgcccagatcatttttcagacagagaaactcaaccacttcgaggtgagcggaaccacactgtccagcggctggtttaagaccaaagcctctgtcacgcttgatagaacatgcgaacatatcaaggtgacctgtgggaagaaaacactgcagttccacgcttgctttaagcatcacatgtcctgtattcggttctttcacggaaccatcctccctggcaccatggccacaagcatttgccaaaatatcgagctgatcattatcatttctcttacgctgatcattttcatcctcatggtgatcctgaccaaaacatatatttgttacctgctcatgcccctgtttatgcctatcgcttatttctacggctggtcctataacaagagctgcaaaaagtgctcttgttgcgggcttgcctaccatccctttaccaattgtggatcccactgcgtctgtggcctgaaattcgaagcgagcgaccgcatgcggattcatagagagtccgggctctgccagggatacaagtctctgcgcgttgccagacttctgtgtaagagcaaaggctccagcctcatcatttctatcctgctgtccatgctcatcctgagcttcgtgacacctattgaggggacccttacgaactatccggaatctcggaagtacgatctggaggaaatcgctgacgtgctcgagggatttattgtcgaaaaaggcatcaaggagtatgtggttttctacacaagcatttttggcgccctgttccttctgatggctctcgtgatcattatcgccctgaataaagtcaccgagtatctgaccaacatcaatgtgctctactgccacgaatgttccatgtatcactctaagaagaacattaaatacatcggggattttacaaacaagtgcggattctgtacctgcggcgagctggaagaccaggaggggcttaaaattcataaggttagccgcaaatgcatctacaagtatcagctgacatggtccaagattatcatgatgatcctcgtgtgtctgctgattgcgcaaaatacgatccttattgtcgccgctagcgatgactgctggaccaaaaagtctctcgaaatggagtgtatcggacccctgcaacaggtggacacatgcgatgacaaatccagcagatcttactccggcgaggccaagaaactggtccgggctagcaagatttccgatctcaacgccgcccaggtggggctgcttggatctaccatcgaaagcgctatcgcgtccattcgcaagcagagaacatattctaccatgcaccttctcgagagcgtttttctgggcaaacattgtgactactataaggccttcgaacacaattccggctacagccaggctaaatggcggctgacggccaagacccatcactttgatatctgctctcgccactccacacatcacttctgtagatgcattagcgacgggaccaaatgtcagaacggagattgggactttgccggcgagatgaatagcacatatcaatccaagaaagatttctttgaacatgaccttaaactcttctgcaccctggtggagaacgctttccctgggacgacagagagcctgttttacgaaatgctctctaagaagaataccacaggagtcaagaaactgcttgataagctgaccaaaaagttcggcaacaataacatgtttgtggggatctggaagttcggccagtacctcatgagcctgccctatgttaatgagacctccctgacgcctgcccagcttgcgaaaattctcgaagtgacagaccagcaccaccggagcatctctggaagacaagagtccctggctagcgccacccccggctccaagtctaaagagtgtgggcatgccaagaaagtcagctgcatctccccgcgctttggagtgcctatggaaggcctgctcgcttgcggggactctcccaactacaagatttataagacccctgccaaactgtacaagagcaataacaaaggagaggtgtggtgttccggcgatgttcactgctctcaggaacttagccccgcttcccaggagagcgtcgaccggatcaagcagattacatgtttcctgacagaacccgaggtgtctgatgacgtgttttccatcgccatttctacctgcaaagtccaagataagggggtgtgtacggttaatgaggacagatggaacgtgatcaagtgcgattctggcctcatttattacacagaccagcgcgatggacaggacaccggcaacgatttcggggaatattgtctgtcccatagctgccggatcgagagatttcctatcaatccggcgattatctctgactgtctgtgggaataccactcccgcaaaagcaagtacattacctcccttgatctcgagagcctggaagagttcaaacgggccatctctgagaagctgagccatacactcattgtctataactttaaacccaccgctaatctgcctcacatcaagcccatctacaaatatattacagtgcagggagttgaaaactccgacggcgtggactctgcctacatcacggctagcatgcctgccctttccgggacctctattggatataatatcatgagcagagataacttccccctgtttgacattatcatcttcattaagtccgcgatcattaaggccacatacaatcacatctatgataccggcccgacaattgggatcaacgtcatgcatgacgagcactgcaccggccaatgtcctacggatattccccataaagaaaattggatcaccttcgctcaggagcgcacatctcggtggggatgcgaagagtttggctgcctcgccgtgaacaccgggtgtgttttcggaagctgccaggacatcattagacctgagacaaaggtgtaccgcaaagctgtcgaagagtccgtgctgctgaccgtgtgtatcacataccccggcaagaccttttgcacggaaattaatgccatcgagcctaaaattacagatgagcttgaactgcagttcaagaccgtcgacaccaagacactccccaacatcctggccgttcaaaatcacaaactctatagcgggcagatcaacgatctgggatctttttcccagggctgtgggaatattcaaaagaccaacagctctatcattggcacgggaacagctaaattcgactacgtgtgccatggcgcgtcccggaaggatatcattgtgagacggtgttataacaataactacgagagctgcaaacttctgaaggaggaacagtccctcatgtttgccgacaatcacgaaaccatcgatgtcgctaacgtgcgccatctgctgggggaccttcagttcaagctgatgctcggagacctgagatataaatcttttgccgagaatccggatctcgagatcgaagccaagtgtgttggctgccctagctgtttcacatcctacagctgctcttttaaaattgtgtccaacatcgacaccgtctgcagcattgaggggccctgtacaaccttccacaatcggctgatgatcacgtctaccaagcaggattatggaattaaaatgagctgcaagacaaagcccgaagagaccgaagagttccaaatctgtaaaaagacatacaccgtgctttttacgacagttgagaaaaacgacaagattgaaatctccaccggcgatcagacatctttcatccaggagagagacgatcgctgcaaaacctggctgtgtcgggtgagagacgaaggcattagcgtcatctttgagcctattcgcgctttctttgggtcctacttctctatcgccttttatgtggttgtgagcattatcgtcctcttcctggcgatctacatttttctgccgatggtgttcaagctgagagatgtgctgaagaaaaatgaatatctctacctgcaggagatcaagcacaaatga

SEQ ID NO: 14179 - RNA, 4305 nt, synthetic construct
  misc_feature 1..4305: note = derived and/or modified CDS sequence (opt5) from BATV(ZJ2014)__KU746870.1__GP
  source 1..4305: mol_type = other RNA
atgctggtgctcctggtccttctgatcccctgctgtgttagcgcctcccctgctattaccagatgcttccacggcgggcagctcatcgccgagcggaagtctcaaacagcgattagcgaattttgtctgaaagacgatgtgtccacgatcaagtctgagattatctacgagaaaaacgacaccggacttttcgctcataataaggtgctgcgcaactggatcattaaagattggaagaattgcaacccggtccccacagccggcgggagcatcaatgtgattgaggttaacaccgacctctccctgacaaccaagacatatgtgtgttctagagattgcaccatcacggtcgacaaagaagatgcccagattatctttcagaccgagaagctgaatcacttcgaggtgagcggaacaaccctctccagcggctggtttaaaacaaaggcttctgttaccctggaccggacgtgtgaacatattaaagtgacatgcgggaagaagacccttcagttccacgcctgttttaaacatcacatgtcctgcatccgcttctttcacggaacaatcctgcctggcaccatggctaccagcatttgtcaaaacatcgagctcattatcattatctctctgacacttatcattttcatcctgatggtcattctcacgagaacctacatctgctatctgctgatgcccctctttatgcctattgcctacttctatggctggtcctacaataagagctgcaaaaagtgtcagtgctgtgggctggcgtatcatccctttacaaactgcggatctcactgtgtgtgcggccttaaattcgaagcctccgatcggatgcgcatccatagagagagcgggctgtgtcagggatacaagtccctccgggtggctcgcctgctttgcaaatctaagggcagctccctgatcattagcatcctcctgtctatgctgattctctccttcgtcacccctatcgaggggacactgaccaattacccggaaagcagaaagtatgaccttgaggaaattgccgatgttctggagggatttgtggtggaaaaaggcatcaaggagtacgtcgtgttctatacgtctatttttggcgctctcttcctgcttatggccctgatcgttatcattgcgctcaaccgggtgacagagtacctgaccaatatcaacgtcttttattgtcacgaatgcagcatgtaccactccaaaaagaatattaaatatatcggggacttcaccaacaagtgtggattttgcacatgcggcgagctggaagatcaggaggggctcaagattcataaagtgtctcgcaagtgtatctacaaataccaactgacctggagcaagatcattatgatgatccttgtttgcctgctcattgcccagaacacaatcctgattgtggctgcctccgacgactgttggacgaaaaagagcctggaaatgggatgcatcggcccccttcagcaggtcgatacctgtgacgataagacatctagatcctatagcggggaggctaaaaagctcgtgcgggcctctaaaatctccgacctggatgccgctcaagtcggactgctcggcagcaccattgagtccgcgatcgcctctattcgcaagcagagaacatacagcaccatgcaccttcttgaatccgtgttcctgggcaaatattgcgactactataaggtttttgagcataattctgggtacagccaggctaagtggcggctcacggccaaaacccaccatttcgatatctgttccagacacagcacacaccatttttgccgctgtatttctgacggaaccaagtgccaaaacggcgattgggacttcgcctccgaaatgaatagcacatatcagtctaaacgggatttcttcgagcacgacttcaaggtgttttgtaccctgatcgaaaacgctttccctgggacgacagagtccctgttttacgagatgcttagcaaaaagaataccacaggaatcaccaaactcctggacaagctgaccaagaaattcggcaacaataacatgtttgtcgggatttggaagttcggccagtacctcatgtctctgccctatgtgaatgaaacaagcctttcccctacgcagctggccaaagttctcgaggtgaccgatcatcaccacagaagcatctctggacgccaagaatccctggcgagcgctgcccccggctccaagtctagcgagtgcgaccatgccaaaaaggtctcctgcatttctccgcggtttggggtgcctatcgagggactgacagcttgtggcagctcccccaactacaagatttataaaacccctgccaagctgtacaaatctaatagcaagggggaagtgtggtgctccggagatgttcactgtctccaggagctgatccccgctagccaggaatctgtcgacagaattaaacagatgacatgcttcctgaccgagcccggcgtgaacgatgacatcttttccatcgccattagcatgtgtaaggtgcaagataagggggtctgcacgatcaatgaagaccgctggaacgtggttaaatgtgattctggcctcatttattacacagaccagcgggagggacaggataccggcaatgacttcggggagtattgcctgtcccatagctgtagaatcaagcgctttcctattaacccggcgatcatcaacgattgcctttgggaataccactctcggaaatccaagtacattaccagcctggacctcgagtccctggaagagttcaaaagagccatcagcgaaaagctgtctcatacacttattgtgtataattttaagcccaccgctaacctccctcacatcaaacccgtctacaagtatattacagtgcagggagttgagaatagcgacggcgtggattccgcctacatcacggcttctatgcctgccctgagcgggacctccatcggatataacattatgtctcgcgacaatttccccctgttcgatatcattatctttattaaaagcgcgatcattaaggccacatacaaccacatctatgacaccggcccgacaatcgggattaatgtcatccatgatgagcactgtaccggccaatgccctacggacattccccataaagaaaactggatcaccttcgctcaggagcggacatccagatggggatgcgaagagtttggctgtctcgccattaataccgggtgcgtgttcggatcttgtcaggatatcatccggcctgaaacaaaggtttaccgcaaagctgtggaggagagcgtcctgcttaccgtgtgcattacataccccggcaagaccttttgtacggaaatcaacgccattgagcctaagatcacagacgaactggagctccagttcaaaaccgtggataccaagacactgcccaatattctggccgtccaaaaccacaaactttattccgggcagatcaatgacctgggcagcttttctcagggatgcgggaacatccaaaagaccaattccagcattatcggcacgggaacagctaaattcgattacgtttgtcatggcgcgtctagaaaggacattatcgtgcggagatgctataacaacaattacgagtcctgtaagctcctgaaagaagaacagagcctcatgtttgccgataaccacgaaaccattgacgtggctaatgtccgccatctgcttggggacctgcagttcaagctcatgctgggagatctgcggtataaatcctttgccgagaacccggaccttgaaatcgaggccaagtgcgtgggctgtccttcttgcttcacaagctactcctgcagcttcaaaattgtttctaatatcgataccgtgtgttccatcgacgggccctgcacaatttttcacaacagactgatgatcaccagcacgaagcaggattatggaattaagatgtcttgtaaaaccaagcccggccctacagaggaatttcaaatctgcaaaaagacctacacaattctctttaccacgatcgagaaaaatgacaagatcgaaattagcacaggcgatcagacctccttcatccaggagcgcgacgatagatgtcggacatggctgtgccgcgtcagagacgaagggatttctgtgatctttgagccgattcgggctttctttggaagctacttctccatcgccttttatatcgttattggcatcattatcctcttcctggtgatttacatctttcttcccatggtcttcaagctgcgcgatgtgctcaaaagaaacgagtatctgtacctgcaggaaattaagcacaaatga

SEQ ID NO: 14180 - RNA, 4305 nt, synthetic construct
  misc_feature 1..4305: note = derived and/or modified CDS sequence (opt5) from CVV__AF082576.1__GP
  source 1..4305: mol_type = other RNA
atgctgttcctcctgatccttgcctttctgggcttcagcacctccaaccccattgctacaagatgctttcacgggggacagctcatcgccgagtctaagagcgcgacgtccatttctgagttctgtctgaaagacgatgtgagcatgcttaagtccgaagtcgtttacatcaaaaatgacaccggcctgtttgggcataacaaggtgttccggtcttggacaattaaagattggaagctctgcaatcctatcccgaccgctggaggcacaatcaacgtgattgaagtcaataaggacctgagcctgatgaccaaaacatatatctgttcccgcgattgcaccattacgatcgacaaggaggaagcccaaattatctttcagaccgataaactcaaccacttcgaggtgagcgggacaaccctgtcttccggatggtttaagagcaaagcctctgttacacttgacagaacctgtgagcatgtgaaggtcacgtgcggcaagaaatccctgcagttccacgcttgttttaagcatcacatgagctgcgtgcggttctttcacaatacaattctccccggcaacatgatcacctctatgtgtcagaatatcgaactgattatcattcttgggctgacactcgccatcttcattctgatggttatgctgaccaaaacctacatctgctatctcctgatgcctatcttcatgcccattgcttacctttatggatgggcctacaacaagtcctgtaaaaagtgcaattgctgtggcctggcgtatcatccttttacaaactgcgggagccactgtgtgtgcggactcaaattcgaggcctccgatcgcatgagaatccatcgggaatctggcctgtgtcaagggtacaagagccttcgcattgctagactgctctgcaagtccaaaggaagctctctggtcatctccggcctgctcagcatgctgattctttcttttgtgacgcccatcgagggcaccatcacaagctaccctgagtcccggaagtataccctggaagagattacagacgtggtcgaagggctcgtttctgagcagaatatcaaagaatacattgtgttctataccagcctgtttggatcccttatcctgctcctggccttcattatgagcatcacgctgtctaagattacatccatcctcgctaaacgcaacgtgatctactgtgaggagtgcagcatgtatcactctaagagaggcattaagtacaatggggattttaccaacaaatgtggattctgcacctgtaacgaacaggaggacacagaaggcctggtcatccacaaggtgtccaaacggtgcacctataagtaccagcttaaatgggccaaggttctgatgattacactcgtgctgctgcttatcgcgcaaaatacgattctcatcgtcgccgctgagaccgattgctggacaaagaaaagcctggacatcgactgtattgggccgatgctggatatcggatcctgcaccaacaagaatacacgctcttacgacgccgaagctcagaaactcgtgagccagtccaagatttctcagctggatgccgaccaagccagccttctgggcaactccatcgatagcgctattaaagcgatcagagcccagaagacctatcccacgatgcatctcctggagaccatctttctgatgaagaattgtgactactatacatctttcaaccacaattccggctacagccaggctaaatggcggcttattgccaagaccgggcattttgatatctgctctcgccactccacacatcacttctgtcaatgcattaacgacggaaccaaatgtcagaatggcgattgggactttgccggggagatgaacgaaacgtataatagcaagaacgatttctactctcacgacctcaatctgttctatacaatctttgagaacgctttccctggaaccacagaaagcctgttttaccagctcattcagaaaaagaataccaccggcgcctccaaagttctggggaaacttatcacaaagtacggcaacaacaatatgttcgtgggaatctggaaatttggccaatatctgctcacgctgccctacattaacaataccgagctgagccagaacagacggcttacaatcctcgcgacccaggaactgctgtctagatcccatagcgggcgccaggagtccatgtctaatgctattcaaggaagcatcacaaaggagtgccacaacgccaaaggcgtcgggtgtatttcccctcagttcggaatccccattggcaatctcaccgcctgcggggactctccgaactataagatctacaaaacgcctgaaaagctgtataagagcaataacaaaggcgaggtgtggtgttccaatgatgtccattgccttaacgactttgaacccgctgatgaggaggtggttaataagatcaaaaagctgacatgcttcctcaccgacgtgtctgtcgaagtggatatttttagcgttgccgcttccacctgtaaaatggccgacaagggagtgtgcacagtcaacggcgcgaagtggaatatcattaaatgtgatagcgggctgtactatttcaccgaccaccgggagggacaggatacaggcaacgactttggggaatactgcatctctcactcctgtaacacggagagattccctattaatcccgataccctgaaggactgcacatgggaatttcatagccgcaaatctaagtacatctccaccatcagccttgagtctctcgaggagttccggagagccatggctgaaaaactgtcccacacactgaccatttataacttcaagcccacggccaatctccctcatatccgcccgacctacaagtttattacagctaacggagtggaaaatagcgatggcatcgagtccgcctatattctgagctctatccccgcgcttgggggcatcagcgtgggatacaacgttcagaccaaagacaatttccctctgctcgacattatcgtctttattaagtccgccgtgatccggacaacctataaccacatttacgatacaggccccaccatcgggattaatacgcaacatgacgaacactgtacaggaccttgccccgctgtggtcccgcacaaagagaactggatgaccttctctcaggagagaaccagccgctggggctgtgaagagtttgggtgcctggccatcaatacaggatgtgtgttcggctcctgccaggatatcattcatcctgaaaccaaggtttatcggaaagctgtggaggaagaggtcgtgctgacggtttgcatcaactttcccgggaataactactgtacagagattaatgccatcgaacctaagattaccgacgagatcgaacttcagttcaaaacagtggataccaagacactgcccaacctcctggccgtccaaaaccacaagctctactctggccagatcaatgacctgggcagcttttcccagggatgcgggaacgtgcaaaagaccaatcattctattcttggaatgggcacggttaagttcgattatgtgtgtcacggggctagcagaaaagacgtcatcgtgcgccggtgctacaacaataactttgattcctgtaagctgctcaaagaggagaccagcctgattttcgcggacaatcatgaaacactggaggtggcccacaccaagcaccttatcggagaactgcagttcaagattatgctcggcgatatcagatataaatcttttgctgagtcccctgaactggagatcgacgccaagtgcgtcggctgtcccagctgcttcgagtcttactcctgtaactttcagattgttagcaatatcgatacagtgtgctccgtggaagggccgtgtaccctcttccataaccggattatcatttctgccaataaacagagctatggactgaagatgtcctgccaaacgaaacctaaccagaatgaggaatttatcatttgcaaccgcaagtacagcgtccttttcacaaccatcgacaagaatgacaaaatcgaggtgaacacaggcgatcagacctcttatatttacgaaaaggactccagatgtaaaacctggctgtgccgggttagagatgaggggatcagcgtgctctttgagcccctgaaggctttctttggatcttacttcagcattatcttttatgtcgtggttggcattatcgtgctgttccttatcatttacatctttctgcccatgttcttcaaactcaaggacgtcctgaagcgcaatgaatatctctacctgcaggagcttaaacacaagtga

SEQ ID NO: 14181 - RNA, 4305 nt, synthetic construct
  misc_feature 1..4305: note = derived and/or modified CDS sequence (opt5) from CVV(Montgomery County/VA/2015 4b)__KX583998.1__GP
  source 1..4305: mol_type = other RNA
atgctgttcctcctgatccttgcctttctgggcttcagcacctccaaccccattgctacaagatgctttcacgggggacagctcatcgccgagtctaagagcgcgacgtccatttctgagttctgtctgaaagacgatgtgagcatgcttaagtccgaagtcgtttacaccaaaaatgacacaggcctgtttgggcataacaaggtgttccggtcttggaccatcaaagattggaagctctgcaatcctattccgacagctggaggcaccatcaacgtgatcgaagtcaataaggacctgagcctgatgacaaaaacctatatttgttcccgcgattgcacgatcaccattgacaaggaggaagcccaaatcatttttcagacagataaactcaaccacttcgaggtgagcgggaccacacttaattctggatggtttaagtccaaagccagcgttacccttgacagaacgtgtgagcatgtgaaggtcacatgcggcaagaaatctctgcagttccacgcttgttttaagcatcacatgtcctgcgtgcggttctttcacaacaccatcctccccggcaatatgattaacagcatgtgtcagaatatcgaactgatcattatccttgggctgacactcgccattttcatcctgatggttatgctgaccaaaacctacatttgctatctcctgatgcctatcttcatgcccatcgcttacctttatggatgggcctacaacaagtcttgtaaaaagtgcaattgctgtggcctggcgtatcatccttttacaaactgcgggtcccactgtgtgtgcggactcaaattcgaggccagcgatcgcatgcggattcatagagaatccggcctgtgtcaagggtacaagtctcttcgcatcgctagactgctctgcaagagcaaaggatccagcctggtcatttctggcctgctctccatgctgatccttagctttgtgacgcccattgagggcaccatcacatcttaccctgagagccggaagtataccctggaagagatcacagacgtggtcgaagggctcgtttccgagcagaatattaaagaatacatcgtgttctatacctctctgtttggaagccttattctgctcctggccttcatcatgtccattacgctgagcaagatcacatctattctcgctcgcagaaacgtgatctactgtgaggagtgctccatgtatcacagcaaacggggcatcaagtacaacggggattttaccaataagtgtggattctgcacctgtaacgaacaggaggacgccgaaggcctggtcattcacaaagtgtctaagcgctgcacatataaataccagcttaagtgggcgaaagttctgatggtgaccctcgtcctgctgcttatcgcccaaaatacaattctcatcgtggctgccgggacggattgctgggctaagaagtccctggacatggactgtattggaccgatgctggatatcggcagctgcaccaacaaaaatacaagaaactacgacaccgaggcccagaagctcgtttcccagtctaaagtgagccagctggatgccgaccaagcgtcccttctgggcaattctatcgatagcgctattaaggccatccgggctcagaaaacatatcccaccatgcatctcctggaaacgatttttctgatgaagaactgtgactactatacctccttcaatcacaacagcgggtactctcaggccaagtggcgccttatcgccaaaacaggacattttgatatttgctccagacacagcacccatcacttctgtcggtgcatcaatgacggcacaaagtgtcaaaacggggattgggactttgctggagagatgaatgagacctataactctaaaaatgatttctactcccacgacctcaacctgttctatacgatctttgaaaacgccttccctggcacaaccgagagcctgttttaccagctcattcagaagaaaaatacaaccggggcgtctaagatcctgggcaaacttattaccaagtacggaaacaataacatgttcgtcggcgtgtggaagtttgggcagtatctgctcacactgccctacatcaataacacggaactgagccaaaatagacgccagaccattcttgctacacaggagtccctcagccggtctcattccggaagacaggaaagcatgtcctctgccatccaaggcagcgtcaccaaagagtgccacaacgccaaggacgtggggtgtatctcccctcgcttcggcattcccatcggaaatctgacagcttgcggggattctccgaactataaaatttacaagacccctgagaaactgtataagagcaataacaagggcgaagtttggtgttccaatgacgtgcattgcctcaacgattttgagcccgccgacgaagaggtcgtgaataaagttaagaaactgacgtgcttccttacagatgtgtctgtcaagaccgacatctttagcgtggctgtgtccacctgtaaaatggccgataagggaacatgcaccgttaaggacgcgaaatggaacattatcaagtgtgatagcggcctgtactatttcacagaccaccgggaggggcaggatacgggaaacgactttggcgaatactgcatttctcactcctgtaataccgagagattccctatcaaccccgatatcctcaaagactgcacatgggaatttcatagccgcaagtctaaatacatttccaccatcagcctggagtctctggaagagttccggagagccatgacagagaagctgtcccacaccctcacgatttataatttcaagcccaccgctaacctgcctcatatccgcccgacatacaaatttattaccgccaatggggtcgaaaacagcgacggaatcgagtccgcttatatcctgagctctattcccgccctcggcgggatcagcgtgggctacaatgtgcagacaaaggataacttccctctgcttgacattatcgtctttattaaatccgcggtgatccggaccacatataatcacatctacgataccggacccacgattggcatcaacacacagcatgacgaacactgtaccgggccttgccccgccgttgtgccgcacaaggagaattggattaccttctctcaagaaagaacaagccgctggggatgtgaggagtttggctgcctggctatcaacaccgggtgtgtcttcggatcctgccaggatattatccatcctgaaacgaaagtgtatcggaaggccgttgaggaagaggtggtcctcacagtgtgcattaattttcccggcaacaattactgtaccgaaatcaacgctgttgagcctaaaatcacagacgagattgaactgcagttcaagaccgtggatacaaagaccctgcccaaccttctggccgtccagaatagaaaactctactctgggcaaatcaacgacctgggcagcttttcccagggatgcggcaatgtgcagaagacgaaccactctattctcgggatgggaaccgccaaattcgattatgtgtgtcatggcgctagccggaaggacgtcatcgttcgcagatgctacaataacaattttgattcctgtcggctgcttaaagaggaaacaagcctgattttcgcggacaaccacgagaccctcgaggtggcccatacaaagcacctgatcggggaactgcaattcaagatcatgcttggagatattagatataaatcttttgctgagtcccctgaactggagatcgacgccaagtgcgtgggctgtcccagctgcttcgaatcttactcctgtaattttcagattgtcaccaacatcgacacggtgtgcagcgttgagggcccgtgtacactcttccacaatcgcattatcatctccgccaacaaacagtcttatgggctgaagatgagctgccagaccaaacctaatcaaaacgaggaatttattatctgcaatcggaagtactccgtcctcttcacaaccattgataagaacgacaaaatcgaggtgaataccggagatcagacaagctatatttacgaaaaggactctagatgtaaaacgtggctgtgccgcgtgagagatgagggcatctccgttctttttgaacccctgaaggctttctttgggagctacttctctattatcttttatgtggtcgtgggaatcattgttctcttcctgatcatttacatctttctgcccatgttcttcaaacttaaggacgtgctgaagcggaacgagtatctctacctgcaggagctcaaacataagtga

SEQ ID NO: 14182 - RNA, 4305 nt, synthetic construct
  misc_feature 1..4305: note = derived and/or modified CDS sequence (opt5) from CVV(Montgomery County/VA/2015 K)__KX583999.1__GP
  source 1..4305: mol_type = other RNA
atgctgttcctcctgatccttgcctttctgggcttcagcacctccaaccccattgctacaagatgctttcacgggggacagctcatcgccgagtctaagagcgcgacgtccatttctgagttctgtctgaaagacgatgtgagcatgcttaagtccgaagtcgtttacaccaaaaatgacacaggcctgtttgggcataacaaggtgttccggtcttggaccatcaaagattggaagctctgcaatcctattccgacagctggaggcaccatcaacgtgatcgaagtcaataaggacctgagcctgatgacaaaaacctatatttgttcccgcgattgcacgatcaccattgacaaggaggaagcccaaatcatttttcagacagataaactcaaccacttcgaggtgagcgggaccacacttaattctggatggtttaagtccaaagccagcgttacccttgacagaacgtgtgagcatgtgaaggtcacatgcggcaagaaatctctgcagttccacgcttgttttaagcatcacatgtcctgcgtgcggttctttcacaacaccatcctccccggcaatatgattaacagcatgtgtcagaatatcgaactgatcattatccttgggctgacactcgccattttcatcctgatggttatgctgaccaaaacctacatttgctatctcctgatgcctatcttcatgcccatcgcttacctttatggatgggcctacaacaagtcttgtaaaaagtgcaattgctgtggcctggcgtatcatccttttacaaactgcgggtcccactgtgtgtgcggactcaaattcgaggccagcgatcgcatgcggattcatagagaatccggcctgtgtcaagggtacaagtctcttcgcatcgctagactgctctgcaagagcaaaggatccagcctggtcatttctggcctgctctccatgctgatccttagctttgtgacgcccattgagggcaccatcacatcttaccctgagagccggaagtataccctggaagagatcacagacgtggtcgaagggctcgtttccgagcagaatattaaagaatacatcgtgttctatacctctctgtttggaagccttattctgctcctggccttcatcatgtccattacgctgagcaagatcacatctattctcgctcgcagaaacgtgatctactgtgaggagtgctccatgtatcacagcaaacggggcatcaagtacaacggggattttaccaataagtgtggattctgcacctgtaacgaacaggaggacgccgaaggcctggtcattcacaaagtgtctaagcgctgcacatataaataccagcttaagtgggcgaaagttctgatggtgaccctcgtcctgctgcttatcgcccaaaatacaattctcatcgtggctgccgggacggattgctgggctaagaagtccctggacatggactgtattggaccgatgctggatatcggcagctgcaccaacaaaaatacaagaaactacgacaccgaggcccagaagctcgtttcccagtctaaagtgagccagctggatgccgaccaagcgtcccttctgggcaattctatcgatagcgctattaaggccatccgggctcagaaaacatatcccaccatgcatctcctggaaacgatttttctgatgaagaactgtgactactatacctccttcaatcacaacagcgggtactctcaggccaagtggcgccttatcgccaaaacaggacattttgatatttgctccagacacagcacccatcacttctgtcggtgcatcaatgacggcacaaagtgtcaaaacggggattgggactttgctggagagatgaatgagacctataactctaaaaatgatttctactcccacgacctcaacctgttctatacgatctttgaaaacgccttccctggcacaaccgagagcctgttttaccagctcattcagaagaaaaatacaaccggggcgtctaagatcctgggcaaacttattaccaagtacggaaacaataacatgttcgtcggcgtgtggaagtttgggcagtatctgctcacactgccctacatcaataacacggaactgagccaaaatagacgccagaccattcttgctacacaggagtccctcagccggtctcattccggaagacaggaaagcatgtcctctgccatccaaggcagcgtcaccaaagagtgccacaacgccaaggacgtggggtgtatctcccctcgcttcggcattcccatcggaaatctgacagcttgcggggattctccgaactataaaatttacaagacccctgagaaactgtataagagcaataacaagggcgaagtttggtgttccaatgacgtgcattgcctcaacgattttgagcccgccgacgaagaggtcgtgaataaagttaagaaactgacgtgcttccttacagatgtgtctgtcaagaccgacatctttagcgtggctgcctccacctgtaaaatggcggataagggaacatgcaccgtgaacgacgccaagtggaacattatcaaatgtgatagcggcctgtactatttcacagaccaccgggaggggcaggatacgggaaatgactttggcgaatactgcatttctcactcctgtaacaccgagagattccctatcaatcccgatatcctcaaggactgcacatgggaatttcatagccgcaaatctaagtacatttccaccatcagcctggagtctctggaagagttccggagagctatgacagagaaactttcccacaccctcacgatttataacttcaagcccaccgccaatctgcctcatatccgcccgacatacaagtttattaccgctaacggggttgaaaatagcgacggaatcgagtccgcctatatcctgagctctattcccgcgctcggcgggatcagcgtcggctacaacgtgcagacaaaagataatttccctctgcttgacattatcgtgtttattaagtccgccgtcatccggaccacatataaccacatctacgataccggacccacgattggcatcaatacacagcatgacgaacactgtaccgggccttgccccgctgtggttccgcacaaagagaactggattaccttctctcaagaaagaacaagccgctggggatgtgaggagtttggctgcctggccatcaataccgggtgtgtgttcggatcctgccaggatattatccatcctgaaacgaaggtctatcggaaagctgtggaggaagaggttgtgctcacagtctgcattaactttcccggcaataactactgtaccgaaatcaacgccgtggagcctaagatcacagacgagattgaactgcagttcaaaaccgttgatacaaagaccctgcccaatcttctggccgtgcagaaccacaagctctactctgggcaaatcaatgacctgggcagcttttcccagggatgcggcaacgtccagaaaacgaatcattctattctcgggatgggaaccgctaagttcgattatgtgtgtcacggcgcgagcagaaaagacgtgatcgtccggcgctgctacaacaataactttgattcctgtagactgcttaaggaggaaacaagcctgattttcgccgacaatcatgagaccctcgaggttgctcacacaaaacacctgatcggggaactgcaattcaagatcatgcttggagatattcggtataagtcttttgccgagtcccctgaactggagatcgacgccaaatgcgtgggctgtcccagctgcttcgaatcttactcctgtaactttcagattgtgaccaatatcgacacggtctgcagcgtggagggcccgtgtacactcttccataacagaattatcatctccgctaataagcagtcttatgggctgaaaatgagctgccagaccaagcctaaccaaaatgaggaatttattatctgcaaccgcaaatactccgttctcttcacaaccattgataagaatgacaagatcgaggtgaacaccggagatcagacaagctatatttacgaaaaagactctcggtgtaagacgtggctgtgcagagtccgcgatgagggcatctccgtgctttttgaacccctgaaagccttctttgggagctacttctctattatcttttatgttgtggtcggaatcattgttctcttcctgatcatttacatctttctgcccatgttcttcaagctgaaagacgtgctgaagagaaacgagtatctctacctgcaggagctcaagcacaaatga

SEQ ID NO: 14183 - RNA, 4305 nt, synthetic construct
  misc_feature 1..4305: note = derived and/or modified CDS sequence (opt5) from CVV(1156)__EU583730.1__GP
  source 1..4305: mol_type = other RNA
atgctgttcctcctgatccttgcctttctgggcttcagcacctccaaccccattgctacaagatgctttcacgggggacagctcatcgccgagtctaagagcgcgacgtccatttctgagttctgtctgaaagacgatgtgagcatgcttaagtccgaagtcgtttacatcaaaaatgacaccggcctgtttgggcataacaaggtgttccggtcttggacaattaaagattggaagctctgcaatcctatcccgaccgctggaggcacaatcaacgtgattgaagtcaataaggacctgagcctgatgaccaaaacatatatctgttcccgcgattgcaccattacgatcgacaaggaggaagcccaaattatctttcagaccgataaactcaaccacttcgaggtgagcgggacaaccctgtcttccggatggtttaagagcaaagcctctgttacacttgacagaacctgtgagcatgtgaaggtcacgtgcggcaagaaatccctgcagttccacgcttgttttaagcatcacatgagctgcgtgcggttctttcacaatacaattctccccggcaacatgatcacctctatgtgtcagaatatcgaactgattatcattcttgggctgacactcgccatcttcattctgatggttatcctgaccaaaacctacatctgctatctcctgatgcctattttcatgcccatcgcttacctttatggatgggcctacaacaagtcctgtaaaaagtgcaattgctgtggcctggcgtatcatccttttacaaactgcgggagccactgtgtgtgcggactcaaattcgaggcctccgatcgcatgcggattcatagagaatctggcctgtgtcaagggtacaagagccttcgcatcgctagactgctctgcaagtccaaaggaagctctctggtcatttccggcctgctcagcatgctgatcctttcttttgtgacgcccatcgagggcaccattacaagctaccctgagtcccggaagtataccctggaagagatcacagacgtggtcgaagggctcgtttctgagcagaatattaaagaatacatcgtgttctataccagcctgtttggatcccttattctgctcctggccttcatcatgagcattacgctgtctaagatcacatccatcctcgctaaacgcaacgtgatttactgtgaggagtgcagcatgtatcactctaagagaggcatcaagtacaatggggattttaccaacaaatgtggattctgcacctgtaacgaacaggaggacacagaaggcctggtcattcacaagatctccaaacggtgcacctataagtaccagcttaaatgggccaaggtgctgatgattacactcgttctgctgcttatcgcgcaaaatacgatcctcattgtggccgctgagaccgattgctggacaaagaaaagcctggacatcgactgtattgggccgatgctggatatcggatcctgcaccaacaagaatacacgctcttacgacgccgaagctcagaaactcgtcagccagtccaagatttctcagctggatgccgaccaagtgagccttctgggcaactccatcgatagcgccatcaaagctattagagcgcagaagacctatcccacgatgcatctcctggagaccatctttctgatgaagaattgtgactactatacatctttcaaccacaattccggctacagccaggccaaatggcggcttattgctaagaccgggcattttgatatctgctctcgccactccacacatcacttctgtagatgcattaacgacggaaccaaatgtcaaaatggcgattgggactttgccggggagatgaacgaaacgtataatagcaagaacgatttctactctcacgacctcaatctgttctatacaatctttgagaacgccttccctggaaccacagaaagcctgttttaccagctcatccagaaaaagaataccaccggcgcttccaaagttctggggaagctcattacaaagtacggcaacaacaatatgttcgtgggagtctggaaatttggccagtatctgctcacgctgccctacatcaacaataccgagctgagccaaaaccggagacttacaattctcaccacacaggaactgctgtctcgctcccatagcgggcggcaggagtccatgtctaatgccatccagggaagcattaccaaggagtgccacaacgcgaaaggcgtggggtgtatctcccctagattcggcattcccatcggaaatctcacggcttgcggggactctccgaactataagatctacaaaacacctgaaaagctgtataagagcaataacaaaggcgaggtctggtgttccaatgatgtgcattgccttaacgactttgaacccgccgatgaggaggttgtgaataagattaaaaagctgacctgcttcctcaccgacgtctctgtggaagttgatatctttagcgtggccgcttccacatgtaaaatggccgacaagggagtctgcaccgtgaacggcgctaagtggaatattatcaaatgtgatagcgggctgtactatttcacagaccaccgcgagggacaagatacgggcaacgactttggggaatactgcatttctcactcctgtaacaccgagcggttccctatcaatcccgatatcctgaaggactgcacatgggaatttcatagcagaaaatctaagtacatttccaccatcagccttgagtctctcgaggagttccgccgggccatggcggaaaaactgtcccacacactgaccatttataacttcaagcccacggccaatctccctcatatcagaccgacctacaagtttattacagctaacggagtggaaaatagcgatggcatcgagtccgcctatatcctgagctctattcccgctcttgggggcatcagcgttggatacaacgtccagaccaaagacaatttccctctgctcgacattatcgtgtttattaagtccgccgtgatccgcacaacctataaccacatttacgatacaggccccaccatcgggatcaatacgcagcatgacgaacactgtacaggaccttgccccgcggtcgtgccgcacaaagagaactggatgaccttctctcaggagcggaccagcagatggggctgtgaagagtttgggtgcctggccattaatacaggatgtgttttcggctcctgccaagatatcattcatcctgaaaccaaggtgtatcgcaaagctgtcgaggaagaggtggttctgacggtgtgcatcaactttcccgggaataactactgtacagagattaatgccatcgaacctaagatcaccgacgagattgaacttcagttcaaaacagtcgataccaagacactgcccaacctcctggctgtgcagaaccacaagctctactctggccagatcaatgacctgggcagcttttcccaaggatgcgggaacgttcagaaaaccaatcattctattcttggaatgggcacggtgaagttcgattatgtctgtcacggggccagccggaaagacgtgatcgtgagacggtgctacaacaataactttgattcctgtaagctgctcaaagaggagaccagcctgattttcgccgacaatcatgaaacactggaggtcgctcacaccaagcaccttatcggagaactgcagttcaagatcatgctcggcgatattcgctataaatcttttgcggagtcccctgaactggagatcgacgccaagtgcgttggctgtcccagctgcttcgagtcttactcctgtaactttcaaattgtgacaaatatcgataccgtgtgcagcgtcgaagggccgtgtacgcttttccataacagaattatcatttccgctaataaacagtcttatggactgaagatgagctgccagacaaaacctaaccagaatgaggaatttatcatctgcaaccggaagtactccgtgcttttcaccacaattgacaagaatgacaaaatcgaggttaacaccggcgatcaaaccagctatatttacgaaaaggactctagatgtaaaacatggctgtgccgcgtgcgggatgaggggatctccgtcctctttgagcccctgaaggccttctttggaagctacttctctattatcttttatgtggttatcggcattatcgtgctgttccttattatctacatttttctgcccatgttcttcaaactcaaggacgtcctgaagagaaatgaatatctctacctgcaggagcttaaacacaagtga

SEQ ID NO: 14184 - RNA, 4305 nt, synthetic construct
  misc_feature 1..4305: note = derived and/or modified CDS sequence (opt5) from CVV(6V633)__KX100134.1__GP
  source 1..4305: mol_type = other RNA
atgctgttcctcctgatccttgcctttctgggcttcagcacctccaaccccattgctacaagatgctttcacgggggacagctcatcgccgagtctaagagcgcgacgtccatttctgagttctgtctgaaagacgatgtgagcatgcttaagtccgaagtcgtttacatcaaaaatgacaccggcctgtttgggcataacaaggtgttccggtcttggacaattaaagattggaagctctgcaatcctatcccgaccgctggaggcacaatcaacgtgattgaagtcaataaggacctgagcctgatgaccaaaacatatatctgttcccgcgattgcaccattacgatcgacaaggaggaagcccaaattatctttcagaccgataaactcaaccacttcgaggtgagcgggacaaccctgtcttccggatggtttaagagcaaagcctctgttacacttgacagaacctgtgagcatgtgaaggtcacgtgcggcaagaaatccctgcagttccacgcttgttttaagcatcacatgagctgcgtgcggttctttcacaatacaattctccccggcaacatgatcacctctatgtgtcagaatatcgaactgattatcattcttgggctgacactcgccatcttcattctgatggttatgctgaccaaaacctacatctgctatctcctgatgcctatcttcatgcccattgcttacctttatggatgggcctacaacaagtcctgtaaaaagtgcaattgctgtggcctggcgtatcatccttttacaaactgcgggagccactgtgtgtgcggactcaaattcgaggcctccgatcgcatgagaatccatcgggaatctggcctgtgtcaagggtacaagagccttcgcattgctagactgctctgcaagtccaaaggaagctctctggtcatctccggcctgctcagcatgctgattctttcttttgtgacgcccatcgagggcaccatcacaagctaccctgagtcccggaagtataccctggaagagattacagacgtggtcgaagggctcgtttctgagcagaatatcaaagaatacattgtgttctataccagcctgtttggatcccttatcctgctcctggccttcattatgagcatcacgctgtctaagattacatccatcctcgctaaacgcaacgtgatctactgtgaggagtgcagcatgtatcactctaagagaggcattaagtacaatggggattttaccaacaaatgtggattctgcacctgtaacgaacaggaggacacagaaggcctggtcatccacaaggtgtccaaacggtgcacctataagtaccagcttaaatgggccaaggttctgatgattacactcgtgctgctgcttatcgcgcaaaatacgattctcatcgtcgccgctgagaccgattgctggacaaagaaaagcctggacatcgactgtattgggccgatgctggatatcggatcctgcaccaacaagaatacacgctcttacgacgccgaagctcagaaactcgtgagccagtccaagatttctcagctggatgccgaccaagccagccttctgggcaactccatcgatagcgctattaaagcgatcagagcccagaagacctatcccacgatgcatctcctggagaccatctttctgatgaagaattgtgactactatacatctttcaaccacaattccggctacagccaggctaaatggcggcttattgccaagaccgggcattttgatatctgctctcgccactccacacatcacttctgtagatgcattaacgacggaaccaaatgtcaaaatggcgattgggactttgccggggagatgaacgaaacgtataatagcaagaacgatttctactctcacgacctcaatctgttctatacaatctttgagaacgctttccctggaaccacagaaagcctgttttaccagctcattcagaaaaagaataccaccggcgcctccaaagttctggggaagctcatcacaaagtacggcaacaacaatatgttcgtgggaatctggaaatttggccagtatctgctcacgctgccctacattaacaataccgagctgagccaaaaccggagacttacaatcctcgcgacccaggaactgctgtctcgctcccatagcgggcggcaggagtccatgtctaatgctattcagggaagcatcacaaaggagtgccacaacgccaaaggcgtcgggtgtatttcccctagattcggaatccccattggcaatctcaccgcctgcggggactctccgaactataagatctacaaaacgcctgaaaagctgtataagagcaataacaaaggcgaggtgtggtgttccaatgatgtccattgccttaacgactttgaacccgctgatgaggaggtggttaataagatcaaaaagctgacatgcttcctcaccgacgtgtctgtcgaagtggatatttttagcgttgccgcttccacctgtaaaatggccgacaagggagtgtgcacagtcaacggcgcgaagtggaatatcattaaatgtgatagcgggctgtactatttcaccgaccaccgcgagggacaagatacaggcaacgactttggggaatactgcatctctcactcctgtaacacggagcggttccctattaatcccgataccctgaaggactgcacatgggaatttcatagcagaaaatctaagtacatctccaccatcagccttgagtctctcgaggagttccgccgggccatggctgaaaaactgtcccacacactgaccatttataacttcaagcccacggccaatctccctcatatcagaccgacctacaagtttattacagctaacggagtggaaaatagcgatggcatcgagtccgcctatattctgagctctatccccgcgcttgggggcatcagcgtgggatacaacgttcagaccaaagacaatttccctctgctcgacattatcgtctttattaagtccgccgtgatccgcacaacctataaccacatttacgatacaggccccaccatcgggattaatacgcagcatgacgaacactgtacaggaccttgccccgctgtggtcccgcacaaagagaactggatgaccttctctcaggagcggaccagcagatggggctgtgaagagtttgggtgcctggccatcaatacaggatgtgtgttcggctcctgccaagatatcattcatcctgaaaccaaggtttatcgcaaagctgtggaggaagaggtcgtgctgacggtttgcatcaactttcccgggaataactactgtacagagattaatgccatcgaacctaagattaccgacgagatcgaacttcagttcaaaacagtggataccaagacactgcccaacctcctggccgtccagaaccacaagctctactctggccagatcaatgacctgggcagcttttcccaaggatgcgggaacgtgcagaaaaccaatcattctattcttggaatgggcacggttaagttcgattatgtgtgtcacggggctagccggaaagacgtcatcgtgagacggtgctacaacaataactttgattcctgtaagctgctcaaagaggagaccagcctgattttcgcggacaatcatgaaacactggaggtggcccacaccaagcaccttatcggagaactgcagttcaagattatgctcggcgatatccgctataaatcttttgctgagtcccctgaactggagatcgacgccaagtgcgtcggctgtcccagctgcttcgagtcttactcctgtaactttcaaattgttacaaatatcgataccgtgtgcagcgtggaagggccgtgtacgcttttccataacagaattatcatttccgccaataaacagtcttatggactgaagatgagctgccagacaaaacctaaccagaatgaggaatttatcatttgcaaccggaagtactccgtccttttcaccacaatcgacaagaatgacaaaatcgaggtgaacaccggcgatcaaaccagctatatttacgaaaaggactctagatgtaaaacatggctgtgccgcgttcgggatgaggggatctccgtgctctttgagcccctgaaggctttctttggaagctacttctctattatcttttatgtcgtggttggcattatcgtgctgttccttatcatttacatctttctgcccatgttcttcaaactcaaggacgtcctgaagagaaatgaatatctctacctgcaggagcttaaacacaagtga

SEQ ID NO: 14185 - RNA, 4305 nt, synthetic construct
  misc_feature 1..4305: note = derived and/or modified CDS sequence (opt5) from CVV(807270)__AF186243.1__GP
  source 1..4305: mol_type = other RNA
atgctgttcctcctgatccttgcctttctgggcttcagcacctccaaccccattgctacaagatgctttcacgggggacagctcatcgccgagtctaagagcgcgacgtccatttctgaattttgtctgaaagacgatgtgagcatgcttaagtccgaggtcgtttacatcaaaaatgacaccggcctgtttgggcataacaaggtgttccggtcttggacaattaaagattggaagctctgcaatcctatcccgaccgctggaggcacaatcaacgtgattgaagtcaataaggacctgagcctgatgaccaaaacatatatctgttcccgcgattgcaccattacgatcgacaaggaggaagcccaaattatctttcagaccgataaactcaaccacttcgaggtgagcgggacaaccctgtcttccggatggtttaagagcaaagcctctgttacacttgacagaacctgtgagcatgtgaaggtcacgtgcggcaagaaatccctgcagttccacgcttgttttaagcatcacatgagctgcgtgcggttctttcacaatacaattctccccggcaacatgatcacctctatgtgtcagaatatcgaactgattatcattcttgggctgacactcgccatcttcattctgatggttatcctgaccaaaacctacatctgctatctcctgatgcctattttcatgcccatcgcttacctttatggatgggcctacaacaagtcctgtaaaaagtgcaattgctgtggcctggcgtatcatccttttacaaactgcgggagccactgtgtgtgcggactcaaattcgaggcctccgatcgcatgcggattcatagagaatctggcctgtgtcaagggtacaagagccttcgcatcgctagactgctctgcaagtccaaaggaagctctctggtcatttccggcctgctcagcatgctgatcctttcttttgtgacgcccatcgagggcaccattacaagctaccctgagtcccggaagtataccctggaagagatcacagacgtggtcgaagggctcgtttctgagcagaatattaaagaatacatcgtgttctataccagcctgtttggatcccttattctgctcctggccttcatcatgagcattacgctgtctaagatcacatccatcctcgctaaacgcaacgtgatttactgtgaggagtgcagcatgtatcactctaagagaggcatcaagtacaatggggattttaccaacaaatgtggattctgcacctgtaacgaacaggaggacacagaaggcctggtcattcacaaggtgtccaaacggtgcacctataagtaccagcttaaatgggccaaggttctgatgatcacactcgtgctgctgcttattgcgcaaaatacgatcctcatcgtcgccgctgagaccgattgctggacaaagaaaagcctggacattgactgtatcgggccgatgctggatattggatcctgcaccaacaagaatacacgctcttacgacgccgaagctcagaaactcgtgagccagtccaagatctctcagctggatgccgaccaagttagccttctgggcaactccattgatagcgccatcaaagctatcagagcgcagaagacctatcccacgatgcatctcctggagaccatttttctgatgaagaattgtgactactatacatctttcaaccacaattccggctacagccaggccaaatggcggcttatcgctaagaccgggcattttgatatttgctctcgccactccacacatcacttctgtcaatgcatcaacgacggaaccaaatgtcagaatggcgattgggactttgccggggagatgaacgaaacgtataatagcaagaacgatttctactctcacgacctcaatctgttctatacaatttttgagaacgccttccctggaaccacagaaagcctgttttaccagctcatccagaaaaagaataccaccggcgcttccaaagtgctggggaaacttatcacaaagtacggcaacaacaatatgttcgtcggagtgtggaagtttggccaatatctgctcacgctgccctacattaacaataccgagctgagccagaacagacggcttacaatcctcgccacccaggaactgctgtctagatcccatagcgggcgccaggagtccatgtctaatgcgattcaaggaagcatcacaaaggagtgccacaacgctaaaggcgtcgggtgtatttcccctcggttcggaatccccattggcaatctcaccgcctgcggggactctccgaactataagatctacaaaacgcctgaaaagctgtataagagcaataacaaaggcgaggtgtggtgttccaatgatgttcattgccttaacgactttgaacccgccgatgaggaggtggtcaataagatcaaaaagctgacatgcttcctcaccgacgtgtctgttgaagtggatatttttagcgtcgctgcctccacctgtaaaatggctgacaagggagtgtgcacagtgaacggcgccaagtggaatatcattaaatgtgatagcgggctgtactatttcaccgaccacagagagggacaggatacaggcaacgactttggggaatactgcatctctcactcctgtaacacggagcgcttccctattaatcccgatatcctgaaggactgcacctgggaatttcatagccggaaatctaagtacatctccacaattagccttgagtctctcgaggagttcagacgcgcgatggccgaaaaactgtcccacaccctgacaatctataacttcaagcccaccgctaatctccctcatattcggccgacgtacaagtttatcaccgccaacggagttgaaaatagcgatggcattgagtccgcttatatcctgagctctatccccgcccttgggggcattagcgtcggatacaacgtgcagacaaaagacaatttccctctgctcgacatcattgtgtttatcaagtccgcggtcattagaaccacatataaccacatctacgataccggccccacaattgggatcaatacccagcatgacgaacactgtacgggaccttgccccgccgtggttccgcacaaagagaactggatgacattctctcaagagcgcaccagccggtggggctgtgaagagtttgggtgcctggctatcaataccggatgtgtgttcggctcctgccaggatattatccatcctgaaacaaaggtctatagaaaagccgtggaggaagaggttgtgctgaccgtctgcattaactttcccgggaataactactgtacggagatcaatgctattgaacctaagatcacagacgagatcgaacttcagttcaaaaccgtggatacaaagaccctgcccaacctcctggccgttcagaaccacaagctctactctggccaaattaatgacctgggcagcttttcccagggatgcgggaacgtgcagaaaacaaatcattctatccttggaatgggcaccgtcaagttcgattatgtgtgtcacggggccagccgcaaagacgtgattgtccggagatgctacaacaataactttgattcctgtaagctgctcaaagaggagacgagcctgatcttcgctgacaatcatgaaaccctggaggttgcgcacacaaagcaccttattggagaactgcaattcaagatcatgctcggcgatatccggtataaatcttttgccgagtcccctgaactggagattgacgctaagtgcgtgggctgtcccagctgcttcgagtcttactcctgtaactttcagatcgtgaccaatattgatacagtctgcagcgtggaagggccgtgtaccctcttccataaccgcatcattatctccgccaataaacagtcttatggactgaagatgagctgccagacgaaacctaaccaaaatgaggaatttattatctgcaacagaaagtactccgttcttttcacaaccatcgacaagaatgacaaaattgaggtgaacacaggcgatcagaccagctatatctacgaaaaggactctcggtgtaaaacctggctgtgcagagtccgcgatgaggggatttccgtgctctttgagcccctgaaggccttctttggaagctacttctctatcattttctatgttgtggtcggcatcatcgtgctgttccttattatctacatttttctgcccatgttcttcaaactcaaggacgttctgaagcggaatgaatatctctacctgcaggagcttaaacacaagtga

SEQ ID NO: 14186 - RNA, 4305 nt, synthetic construct
  misc_feature 1..4305: note = derived and/or modified CDS sequence (opt5) from CVV(856 clone 1)__EU583732.1__GP
  source 1..4305: mol_type = other RNA
atgctgttcctcctgatccttgcctttctgggcttcagcacctccaaccccattgctacaagatgctttcacgggggacagctcatcgccgagtctaagagcgcgacgtccatttctgagttctgtctgaaagacgatgtgagcatgcttaagtccgaagtcgtttacatcaaaaatgacaccggcctgtttgggcataacaaggtgttccggtcttggacaattaaagattggaagctctgcaatcctatcccgaccgctggaggcacaatcaacgtgattgaagtcaataaggacctgagcctgatgaccaaaacatatatctgttcccgcgattgcaccattacgatcgacaaggaggaagcccaaattatctttcagaccgataaactcaaccacttcgaggtgagcgggacaaccctgtcttccggatggtttaagagcaaagcctctgttacacttgacagaacctgtgagcatgtgaaggtcacgtgcggcaagaaatccctgcagttccacgcttgttttaagcatcacatgagctgcgtgcggttctttcacaatacaattctccccggcaacatgatcgcctctatgtgtcagaatatcgaactgattatcattcttgggctgaccctcgctatcttcattctgatggttatcctgacaaaaacctacatctgctatctcctgatgcctattttcatgcccatcgcctacctttatggatgggcgtacaacaagtcctgtaaaaagtgcaattgctgtggcctggcctatcatccttttaccaactgcgggagccactgtgtgtgcggactcaaattcgaggcttccgatcgcatgcggattcatagagaatctggcctgtgtcaagggtacaagagccttcgcatcgccagactgctctgcaagtccaaaggaagctctctggtcatttccggcctgctcagcatgctgatcctttcttttgtgacacccatcgagggcacgattaccagctaccctgagtcccggaagtatacactggaagagatcaccgacgtggtcgaagggctcgtttctgagcagaatattaaagaatacatcgtgttctatacaagcctgtttggatcccttattctgctcctggctttcatcatgagcattaccctgtctaagatcacgtccatcctcgccaaacgcaacgtgatttactgtgaggagtgcagcatgtatcactctaagagaggcatcaagtacaatggggattttacaaacaaatgtggattctgcacctgtaacgaacaggaggacaccgaaggcctggtcattcacaaggtgtccaaacggtgcacatataagtaccagcttaaatgggcgaaggttctgatgatcaccctcgtgctgctgcttattgcccaaaatacaatcctcatcgtcgctgccgagacggattgctggattaagaaaagcctggacatcgactgtattgggccgatgctggatatcggatcctgcaccaacaagaatacacgctcttacgacgctgaagcccagaaactcgtgagccagtccaagatttctcagctggatgccgaccaagttagccttctgggcaactccatcgatagcgctatcaaagcgattagagcccagaagacctatcccacaatgcatctcctggagaccatctttctgatgaagaattgtgactactatacgtctttcaaccacaattccggctacagccaggctaaatggcggcttattgccaagaccgggcattttgatatctgctctcgccactccacacatcacttctgtagatgcattaacgacggaaccaaatgtcaaaatggcgattgggactttgccggggagatgaacgaaacatataatagcaagaacgatttctactctcacgacctcaatctgttctataccatctttgagaacgctttccctggaacgacagaaagcctgttttaccagctcatccagcggaaaaataccacaggcgcctccaaggtgctggggaaacttattaccaagtacggcaacaacaatatgttcgtcggagtgtggaagtttggccagtatctgctcaccctgccctacatcaacaatacagagctgagccaaaacagacgccttacgattctcaccacacaggaactgctgtctcggtcccatagcgggagacaggagtccatgtctaatgcgatccagggaagcattaccaaagagtgccacaacgctaagggcgtcgggtgtatctcccctcgcttcggcattcccatcggaaatctcacagcctgcggggactctccgaactataaaatctacaagacccctgaaaaactgtataagagcaataacaagggcgaggtgtggtgttccaatgatgttcattgccttaacgactttgaacccgccgatgaggaggtggtcaataaaattaagaaactgacgtgcttcctcacagacgtgtctgttgaagtggatatctttagcgtcgctgcctccacctgtaagatggctgacaaaggagtgtgcaccgtgaacggcgccaagtggaatattatcaagtgtgatagcgggctgtactatttcacagaccaccgggagggacaagataccggcaacgactttggggaatactgcatttctcactcctgtaacacagagagattccctatcaatcccgatatcctgaaagactgcacgtgggaatttcatagccgcaagtctaaatacatttccaccatcagccttgagtctctcgaggagttccggagagcgatggccgaaaagctgtcccacacactgaccatttataacttcaaacccacagctaatctccctcatatccgcccgacctacaagtttattacggccaacggagttgaaaatagcgatggcatcgagtccgcttatatcctgagctctattcccgcccttgggggcatcagcgtcggatacaacgtgcagaccaaggacaatttccctctgctcgacattatcgtgtttattaaatccgcggtcatccggacaacctataaccacatttacgatacaggccccaccatcgggatcaatacacagcatgacgaacactgtaccggaccttgccccgccgtggttccgcacaaggagaactggatgacgttctctcaggagagaacaagccgctggggctgtgaagagtttgggtgcctggctattaataccggatgtgtgttcggctcctgccaagatatcattcatcctgaaaccaaagtctatcggaaggccgtggaggaagaggttgtgctgacagtctgcatcaactttcccgggaataactactgtaccgagattaatgctatcgaacctaaaatcacggacgagattgaacttcagttcaagacagtggataccaaaacactgcccaacctcctggccgttcagaaccacaagctctactctggccagatcaatgacctgggcagcttttcccaaggatgcgggaacgtgcagaagaccaatcattctattcttggaatgggcacagtcaaattcgattatgtgtgtcacggggccagcagaaaggacgtgatcgtccggcgctgctacaacaataactttgattcctgtaaactgctcaaggaggagaccagcctgattttcgctgacaatcatgaaacgctggaggttgcgcacaccaaacaccttatcggagaactgcagttcaagatcatgctcggcgatattagatataagtcttttgccgagtcccctgaactggagatcgacgctaaatgcgtgggctgtcccagctgcttcgagtcttactcctgtaactttcaaattgtgacaaatatcgataccgtctgcagcgtggaagggccgtgtacactcttccataaccggattatcatttccgccaataagcagtcttatggactgaaaatgagctgccagaccaagcctaaccagaatgaggaatttatcatctgcaacagaaaatactccgttcttttcacgacaattgacaagaatgacaagatcgaggtgaacaccggcgatcaaacaagctatatttacgaaaaagactctcgctgtaagacctggctgtgccgggtcagagatgaggggatctccgtgctctttgagcccctgaaagccttctttggaagctacttctctattatcttttatgttgtgatcggcattatcgtcctgttccttattatctacatttttctgcccatgttcttcaagctcaaagacgtgctgaagcgcaatgaatatctctacctgcaggagcttaagcacaaatga

SEQ ID NO: 14187 - RNA, 4305 nt, synthetic construct
  misc_feature 1..4305: note = derived and/or modified CDS sequence (opt5) from CVV(856 clone 3)__EU583731.1__GP
  source 1..4305: mol_type = other RNA
atgctgttcctcctgatccttgcctttctgggcttcagcacctccaaccccattgctacaagatgctttcacgggggacagctcatcgccgagtctaagagcgcgacgtccatttctgagttctgtctgaaagacgatgtgagcatgcttaagtccgaagtcgtttacatcaaaaatgacaccggcctgtttgggcataacaaggtgttccggtcttggacaattaaagattggaagctctgcaatcctatcccgaccgctggaggcacaatcaacgtgattgaagtcaataaggacctgagcctgatgaccaaaacatatatctgttcccgcgattgcaccattacgatcgacaaggaggaagcccaaattatctttcagaccgataaactcaaccacttcgaggtgagcgggacaaccctgtcttccggatggtttaagagcaaagcctctgttacacttgacagaacctgtgagcatgtgaaggtcacgtgcggcaagaaatccctgcagttccacgcttgttttaagcatcacatgagctgcgtgcggttctttcacaatacaattctccccggcaacatgatcgcctctatgtgtcagaatatcgaactgattatcattcttgggctgaccctcgctatcttcattctgatggttatcctgacaaaaacctacatctgctatctcctgatgcctattttcatgcccatcgcctacctttatggatgggcgtacaacaagtcctgtaaaaagtgcaattgctgtggcctggcctatcatccttttaccaactgcgggagccactgtgtgtgcggactcaaattcgaggcttccgatcgcatgcggattcatagagaatctggcctgtgtcaagggtacaagagccttcgcatcgccagactgctctgcaagtccaaaggaagctctctggtcatttccggcctgctcagcatgctgatcctttcttttgtgacacccatcgagggcacgattaccagctaccctgagtcccggaagtatacactggaagagatcaccgacgtggtcgaagggctcgtttctgagcagaatattaaagaatacatcgtgttctatacaagcctgtttggatcccttattctgctcctggctttcatcatgagcattaccctgtctaagatcacgtccatcctcgccaaacgcaacgtgatttactgtgaggagtgcagcatgtatcactctaagagaggcatcaagtacaatggggattttacaaacaaatgtggattctgcacctgtaacgaacaggaggacaccgaaggcctggtcattcacaaggtgtccaaacggtgcacatataagtaccagcttaaatgggcgaaggttctgatgatcaccctcgtgctgctgcttattgcccaaaatacaatcctcatcgtcgctgccgagacggattgctggattaagaaaagcctggacatcgactgtattgggccgatgctggatatcggatcctgcaccaacaagaatacacgctcttacgacgctgaagcccagaaactcgtgagccagtccaagatttctcagctggatgccgaccaagttagccttctgggcaactccatcgatagcgctatcaaagcgattagagcccagaagacctatcccacaatgcatctcctggagaccatctttctgatgaagaattgtgactactatacgtctttcaaccacaattccggctacagccaggctaaatggcggcttattgccaagaccgggcattttgatatctgctctcgccactccacacatcacttctgtagatgcattaacgacggaaccaaatgtcaaaatggcgattgggactttgccggggagatgaacgaaacatataatagcaagaacgatttctactctcacgacctcaatctgttctataccatctttgagaacgctttccctggaacgacagaaagcctgttttaccagctcatccagcggaaaaataccacaggcgcctccaaggtgctggggaaacttattaccaagtacggcaacaacaatatgttcgtcggagtgtggaagtttggccagtatctgctcaccctgccctacatcaacaatacagagctgagccaaaacagacgccttacgattctcaccacacatgaactgctgtctcggtcccacagcgggagacaggagtccatgtctaatgcgatccagggaagcattaccaaagagtgccataacgctaagggcgtcgggtgtatctcccctcgcttcggcattcccatcggaaatctcacagcctgcggggactctccgaactataaaatctacaagacccctgaaaaactgtataagagcaataacaagggcgaggtgtggtgttccaatgatgttcactgccttaacgactttgaacccgccgatgaggaggtggtcaataaaattaagaaactgacgtgcttcctcacagacgtgtctgttgaagtggatatctttagcgtcgctgcctccacctgtaagatggctgacaaaggagtgtgcaccgtgaacggcgccaagtggaatattatcaagtgtgatagcgggctgtactatttcacagaccaccgggagggacaggataccggcaacgactttggggaatactgcatttctcattcctgtaacacagagagattccctatcaatcccgatatcctgaaagactgcacgtgggaatttcacagccgcaagtctaaatacatttccaccatcagccttgagtctctcgaggagttccggagagcgatggccgaaaagctgtcccatacactgaccatttataacttcaaacccacagctaatctccctcacatccgcccgacctacaagtttattacggccaacggagttgaaaatagcgatggcatcgagtccgcttatatcctgagctctattcccgcccttgggggcatcagcgtcggatacaacgtgcaaaccaaggacaatttccctctgctcgacattatcgtgtttattaaatccgcggtcatccggacaacctataaccatatttacgatacaggccccaccatcgggatcaatacacagcacgacgaacactgtaccggaccttgccccgccgtggttccgcataaggagaactggatgacgttctctcaggagagaacaagccgctggggctgtgaagagtttgggtgcctggctattaataccggatgtgtgttcggctcctgccaggatatcattcaccctgaaaccaaagtctatcggaaggccgtggaggaagaggttgtgctgacagtctgcatcaactttcccgggaataactactgtaccgagattaatgctatcgaacctaaaatcacggacgagattgaacttcaattcaagacagtggataccaaaacactgcccaacctcctggccgttcagaaccataagctctactctggccagatcaatgacctgggcagcttttcccagggatgcgggaacgtgcaaaagaccaatcactctattcttggaatgggcacagtcaaattcgattatgtgtgtcatggggccagcagaaaggacgtgatcgtccggcgctgctacaacaataactttgattcctgtaaactgctcaaggaggagaccagcctgattttcgctgacaatcacgaaacgctggaggttgcgcacaccaaacatcttatcggagaactgcagttcaagatcatgctcggcgatattagatataagtcttttgccgagtcccctgaactggagatcgacgctaaatgcgtgggctgtcccagctgcttcgagtcttactcctgtaactttcagattgtgacaaatatcgataccgtctgcagcgtggaagggccgtgtacactcttccacaaccggattatcatttccgccaataagcaatcttatggactgaaaatgagctgccagaccaagcctaaccagaatgaggaatttatcatctgcaacagaaaatactccgttcttttcacgacaattgacaagaatgacaagatcgaggtgaacaccggcgatcagacaagctatatttacgaaaaagactctcgctgtaagacctggctgtgccgggtcagagatgaggggatctccgtgctctttgagcccctgaaagccttctttggaagctacttctctattatcttttatgttgtgatcggcattatcgtcctgttccttattatctacatttttctgcccatgttcttcaagctcaaagacgtgctgaagcgcaatgaatatctctacctgcaagagcttaagcataaatga

SEQ ID NO: 14188 - RNA, 4305 nt, synthetic construct
  misc_feature 1..4305: note = derived and/or modified CDS sequence (opt5) from CVV(CK102)__AF186242.1__GP
  source 1..4305: mol_type = other RNA
atgctgttcctcctgatccttgcctttctgggcttcagcacctccaaccccattgctacaagatgctttcacgggggacagctcatcgccgagtctaagagcgcgacgtccatttctgagttctgtctgaaagacgatgtgagcatgcttaagtccgaagtcgtttacatcaaaaatgacaccggcctgtttgggcataacaaggtgttccggtcttggacaattaaagattggaagctctgcaatcctatcccgaccgctggaggcacaatcaacgtgattgaagtcaataaggacctgagcctgatgaccaaaacatatatctgttcccgcgattgcaccattacgatcgacaaggaggaagcccaaattatctttcagaccgataaactcaaccacttcgaggtgagcgggacaaccctgtcttccggatggtttaagagcaaagcctctgttacacttgacagaacctgtgagcatgtgaaggtcacgtgcggcaagaaatccctgcagttccacgcttgttttaagcatcacatgagctgcgtgcggttctttcacaatacaattctccccggcaacatgatcacctctatgtgtcagaatatcgaactgattatcattcttgggctgacactcgccatcttcattctgatggttatcctgaccaaaacctacatctgctatctcctgatgcctattttcatgcccatcgcttacctttatggatgggcctacaacaagtcctgtaaaaagtgcaattgctgtggcctggcgtatcatccttttacaaactgcgggagccactgtgtgtgcggactcaaattcgaggcctccgatcgcatgcggattcatagagaatctggcctgtgtcaagggtacaagagccttcgcatcgctagactgctctgcaagtccaaaggaagctctctggtcgtgtccggcctgctcagcatgctgattctttcttttgtgacgcccatcgagggcaccatcacaagctaccctgagtcccggaagtataccctggaagagattacagacgtcgttgaagggctcgtgtctgagcagaatatcaaagaatacattgtgttctataccagcctgtttggatcccttatcctgctcctggccttcattatgagcatcacgctgtctaagattacatccatcctcgctaaacgcaacgtcatctactgtgaggagtgcagcatgtatcactctaagagaggcattaagtacaatggggattttaccaacaaatgtggattctgcacctgtaacgaacaggaggacacagaaggcctggtgatccacaaggtttccaaacggtgcacctataagtaccagcttaaatgggccaaggtgctgatgattacactcgtcctgctgcttatcgcgcaaaatacgattctcatcgtggccgctgagaccgattgctggacaaagaaaagcctggacatcgactgtattgggccgatgctggatatcggatcctgcaccaacaagaatacacgctcttacgacaccgaagcccagaaactcgttagccagtccaagatttctcagctggatgctgaccaagtgagccttctgggcaactccatcgatagcgccattaaagccatcagagctcagaagacgtatcccaccatgcatctcctggagacaatctttctgatgaagaattgtgactactatacctctttcaaccacaattccggctacagccaggcgaaatggcggcttattgccaagacagggcattttgatatctgctctcgccactccacccatcacttctgtagatgcattaacgacggaacgaaatgtcaaaatggcgattgggactttgctggggagatgaacgaaacatataatagcaagaacgatttctactctcacgacctcaatctgttctataccatctttgagaacgccttccctggaacaaccgaaagcctgttttaccagctcattcagaaaaagaataccacaggcgcctccaaagtcctggggaaacttatcacgaagtacggcaacaacaatatgttcgtgggagtctggaagtttggccagtatctgctcaccctgccctacatcaacaatacagagctgagccaaaaccggagacttaccattctcgctacacaggaactgctgtctcgctcccatagcgggcggcaggagtccatgtctaatgccatccagggaagcattaccaaggagtgccacaacgcgaaaggcgtggggtgtatctcccctagattcggcattcccatcggaaatctcacggcttgcggggactctccgaactataagatttacaaaacacctgaaaagctgtataagagcaataacaaaggcgaggtttggtgttccaatgatgtgcattgccttaacgactttgaacccgccgatgaggaggtcgtgaataagatcaaaaagctgacctgcttcctcaccgacgtttctgtggaagtcgatatctttagcgtggccgcttccacatgtaaaatggccgacaagggagtgtgcaccgttaacggcgctaagtggaatattatcaaatgtgatagcgggctgtactatttcacagaccaccgcgagggacaagatacgggcaacgactttggggaatactgcatttctcactcctgtaacaccgagcggttccctatcaatcccgatattctgaaggactgcacatgggaatttcatagcagaaaatctaagtacatctccaccatcagccttgagtctctcgaggagttccgccgggccatggcggaaaaactgtcccacacactgaccatttataacttcaagcccacggccaatctccctcatatcagaccgacctacaagtttattacagctaacggagtcgaaaatagcgatggcatcgagtccgcctatattctgagctctatccccgctcttgggggcatcagcgtgggatacaacgtgcagaccaaagacaatctgcctctcctggacattatcgtcttcattaagtccgccgtgatccgcacaacctataaccacatttacgatacaggccccaccatcgggattaatacgcagcatgacgaacactgtacaggaccttgccccgcggttgtgccgcacaaagagaactggatgaccttttctcaggagcggaccagcagatggggctgtgaagagttcgggtgcctggccatcaatacaggatgtgtctttggctcctgccaagatatcattcatcctgaaaccaaggtgtatcgcaaagctgttgaggaagaggtggtccttacggtgtgcatcaacttccccgggaataactactgtacagagattaatgccatcgaacctaagattaccgacgagatcgaactgcagtttaaaacagttgataccaagacactccccaacctgctcgctgtgcagaaccacaagctgtactctggccagatcaatgaccttggcagcttctcccaaggatgcgggaacgtccagaaaaccaatcattctattctgggaatgggcacggtgaagtttgattatgtgtgtcacggggccagccggaaagacgtcatcgttagacggtgctacaacaataacttcgattcctgtaagctcctgaaagaggagaccagcctgatttttgccgacaatcatgaaacacttgaggtggctcacaccaagcacctgatcggagaactccagttcaagattatgctgggcgatatccgctataaatctttcgcggagtcccctgaactcgagatcgacgccaagtgcgtgggctgtcccagctgctttgagtcttactcctgtaacttccaaattgtcacaaatatcgataccgtgtgcagcgttgaagggccgtgtacgctgtttcataacagaattatcatttccgctaataaacagtcttatggacttaagatgagctgccagacaaaacctaaccagaatgaggagttcatcatttgcaaccggaagtactccgtgctgtttaccacaatcgacaagaatgacaaaatcgaagtcaacaccggcgatcaaaccagctatatttacgaaaaggactctagatgtaaaacatggctctgccgcgtgcgggatgaggggatctccgttctgttcgagcccctgaaggcctttagcggatcttacttcagcattatcttttatgtggtcgtgggcattatcgttcttttcctgatcatttacatctttctccccatgttctttaaactgaaggacgtgctcaagagaaatgaatatctgtaccttcaggagctgaaacacaagtga

SEQ ID NO: 14189 - RNA, 4305 nt, synthetic construct
  misc_feature 1..4305: note = derived and/or modified CDS sequence (opt5) from CVV(CK-102)__KX100146.1__GP
  source 1..4305: mol_type = other RNA
atgctgttcctcctgatccttgcctttctgggcttcagcacctccaaccccattgctacaagatgctttcacgggggacagctcatcgccgagtctaagagcgcgacgtccatttctgagttctgtctgaaagacgatgtgagcatgcttaagtccgaagtcgtttacatcaaaaatgacaccggcctgtttgggcataacaaggtgttccggtcttggacaattaaagattggaagctctgcaatcctatcccgaccgctggaggcacaatcaacgtgattgaagtcaataaggacctgagcctgatgaccaaaacatatatctgttcccgcgattgcaccattacgatcgacaaggaggaagcccaaattatctttcagaccgataaactcaaccacttcgaggtgagcgggacaaccctgtcttccggatggtttaagagcaaagcctctgttacacttgacagaacctgtgagcatgtgaaggtcacgtgcggcaagaaatccctgcagttccacgcttgttttaagcatcacatgagctgcgtgcggttctttcacaatacaattctccccggcaacatgatcacctctatgtgtcagaatatcgaactgattatcattcttgggctgacactcgccatcttcattctgatggttatcctgaccaaaacctacatctgctatctcctgatgcctattttcatgcccatcgcttacctttatggatgggcctacaacaagtcctgtaaaaagtgcaattgctgtggcctggcgtatcatccttttacaaactgcgggagccactgtgtgtgcggactcaaattcgaggcctccgatcgcatgcggattcatagagaatctggcctgtgtcaagggtacaagagccttcgcatcgctagactgctctgcaagtccaaaggaagctctctggtcgtgtccggcctgctcagcatgctgattctttcttttgtgacgcccatcgagggcaccatcacaagctaccctgagtcccggaagtataccctggaagagattacagacgtcgttgaagggctcgtgtctgagcagaatatcaaagaatacattgtgttctataccagcctgtttggatcccttatcctgctcctggccttcattatgagcatcacgctgtctaagattacatccatcctcgctaaacgcaacgtcatctactgtgaggagtgcagcatgtatcactctaagagaggcattaagtacaatggggattttaccaacaaatgtggattctgcacctgtaacgaacaggaggacacagaaggcctggtgatccacaaggtttccaaacggtgcacctataagtaccagcttaaatgggccaaggtgctgatgattacactcgtcctgctgcttatcgcgcaaaatacgattctcatcgtggccgctgagaccgattgctggacaaagaaaagcctggacatcgactgtattgggccgatgctggatatcggatcctgcaccaacaagaatacacgctcttacgacaccgaagcccagaaactcgttagccagtccaagatttctcagctggatgctgaccaagtgagccttctgggcaactccatcgatagcgccattaaagccatcagagctcagaagacgtatcccaccatgcatctcctggagacaatctttctgatgaagaattgtgactactatacctctttcaaccacaattccggctacagccaggcgaaatggcggcttattgccaagacagggcattttgatatctgctctcgccactccacccatcacttctgtagatgcattaacgacggaacgaaatgtcaaaatggcgattgggactttgctggggagatgaacgaaacatataatagcaagaacgatttctactctcacgacctcaatctgttctataccatctttgagaacgccttccctggaacaaccgaaagcctgttttaccagctcattcagaaaaagaataccacaggcgcctccaaagtcctggggaaacttatcacgaagtacggcaacaacaatatgttcgtgggagtctggaagtttggccagtatctgctcaccctgccctacatcaacaatacagagctgagccaaaaccggagacttaccattctcgctacacaggaactgctgtctcgctcccatagcgggcggcaggagtccatgtctaatgccatccagggaagcattaccaaggagtgccacaacgcgaaaggcgtggaatgtatctcccctagattcgggattcccatcggaaatctcacggcttgcggcgactctccgaactataagatttacaaaacacctgagaagctgtataagagcaataacaaaggggaagtttggtgttccaatgatgtgcattgccttaacgactttgagcccgccgatgaggaagtcgtgaataagatcaaaaagctgacctgcttcctcaccgacgtttctgtggaggtcgatatctttagcgtggccgcttccacatgtaaaatggccgacaagggcgtgtgcaccgttaacggagctaagtggaatattatcaaatgtgatagcggcctgtactatttcacagaccaccgcgaagggcaagatacgggaaacgactttggcgagtactgcatttctcactcctgtaacaccgaacggttccctatcaatcccgatattctgaaggactgcacatgggagtttcatagcagaaaatctaagtacatctccaccatcagccttgagtctctcgaagagttccgccgggccatggcggaaaaactgtcccacacactgaccatttataacttcaagcccacggccaatctccctcatatcagaccgacctacaagtttattacagctaacggggtcgagaatagcgatggaatcgaatccgcctatattctgagctctatccccgctcttggcgggatcagcgtgggctacaacgtgcagaccaaagacaatctgcctctcctggacattatcgtcttcattaagtccgccgtgatccgcacaacctataaccacatttacgatacaggacccaccatcggcattaatacgcagcatgacgagcactgtacagggccttgccccgcggttgtgccgcacaaagagaactggatgaccttttctcaggaacggaccagcagatggggatgtgaggagttcggctgcctggccatcaatacagggtgtgtctttggatcctgccaagatatcattcatcctgaaaccaaggtgtatcgcaaagctgttgaagaggaggtggtccttacggtgtgcatcaacttccccggcaataactactgtacagaaattaatgccatcgagcctaagattaccgacgaaatcgagctgcagtttaaaacagttgataccaagacactccccaacctgctcgctgtgcagaaccacaagctgtactctgggcagatcaatgaccttggcagcttctcccaaggatgcggcaacgtccagaaaaccaatcattctattctggggatgggaacggtgaagtttgattatgtgtgtcacggcgccagccggaaagacgtcatcgttagacggtgctacaacaataacttcgattcctgtaagctcctgaaagaggaaaccagcctgatttttgccgacaatcatgagacacttgaagtggctcacaccaagcacctgatcggggagctccagttcaagattatgctgggagatatccgctataaatctttcgcggaatcccctgagctcgagatcgacgccaagtgcgtgggctgtcccagctgctttgaatcttactcctgtaacttccaaattgtcacaaatatcgataccgtgtgcagcgttgagggcccgtgtacgctgtttcataacagaattatcatttccgctaataaacagtcttatgggcttaagatgagctgccagacaaaacctaaccagaatgaagagttcatcatttgcaaccggaagtactccgtgctgtttaccacaatcgacaagaatgacaaaatcgaagtcaacaccggagatcaaaccagctatatttacgagaaggactctagatgtaaaacatggctctgccgcgtgcgggatgagggcatctccgttctgttcgaacccctgaaggcctttttcgggagctacttttctattatcttctatgtggtcgtgggaattatcgttctttttctgatcatttacatcttcctccccatgtttttcaaactgaaggacgtgctcaagagaaatgagtatctgtaccttcaggaactgaaacacaagtga

SEQ ID NO: 14190 - RNA, 4305 nt, synthetic construct
  misc_feature 1..4305: note = derived and/or modified CDS sequence (opt5) from CVV(MI80-1-450)__AF186241.1__GP
  source 1..4305: mol_type = other RNA
atgctgttcctcctgatccttgcctttctgggcttcagcacctccaaccccattgctacaagatgctttcacgggggacatctcatcgccgagtctaagagcgcgacgtccatttctgaattttgtctgaaagacgatgtgagcatgcttaagtccgaggtcgtttacatcaaaaatgacaccggcctgtttgggcacaacaaggtgttccggtcttggacaattaaagattggaagctctgcaatcctatcccgaccgctggaggcacaatcaacgtgattgaagtcaataaggacctgagcctgatgaccaaaacatatatctgttcccgcgattgcaccattacgatcgacaaggaggaagcccagattatctttcaaaccgataaactcaaccatttcgaggtgagcgggacaaccctgtcttccggatggtttaagagcaaagcctctgttacacttgacagaacctgtgagcacgtgaaggtcacgtgcggcaagaaatccctgcagttccatgcttgttttaagcaccacatgagctgcgtgcggttctttcataatacaattctccccggcaacatgatcacctctatgtgtcagaatatcgaactgattatcattcttgggctgacactcgccatcttcattctgatggttatcctgaccaaaacctacatctgctatctcctgatgcctattttcatgcccatcgcttacctttatggatgggcctacaacaagtcctgtaaaaagtgcaattgctgtggcctggcgtatcacccttttacaaactgcgggagccattgtgtgtgcggactcaaattcgaggcctccgatcgcatgcggattcacagagaatctggcctgtgtcaggggtacaagagccttcgcatcgctagactgctctgcaagtccaaaggaagctctctggtcatttccggcctgctcagcatgctgatcctttcttttgtgacgcccatcgagggcaccattacaagctaccctgagtcccggaagtataccctggaagagatcacagacgtggtcgaagggctcgtttctgagcaaaatattaaagaatacatcgtgttctataccagcctgtttggatcccttattctgctcctggccttcatcatgagcattacgctgtctaagatcacatccatcctcgctaaacgcaacgtgatttactgtgaggagtgcagcatgtatcactctaagagaggcatcaagtacaatggggattttaccaacaaatgtggattctgcacctgtaacgaacaggaggacacagaaggcctggtcattcataaggtgtccaaacggtgcacctataagtaccagcttaaatgggccaaggttctgatgatcacactcgtgctgctgcttattgcgcagaatacgatcctcatcgtcgccgctgagaccgattgctggacaaagaaaagcctggacattgactgtatcgggccgatgctggatattggatcctgcaccaacaagaatacacgctcttacgacgccgaagctcaaaaactcgtgagccagtccaagatctctcagctggatgccgaccaggttagccttctgggcaactccattgatagcgccatcaaagctatcagagcgcaaaagacctatcccacgatgcacctcctggagaccatttttctgatgaagaattgtgactactatacatctttcaaccataattccggctacagccaggccaaatggcggcttatcgctaagaccgggcactttgatatttgctctcgccattccacacaccacttctgtagatgcatcaacgacggaaccaaatgtcagaatggcaactgggattttgccggggagatgaatgaaacgtataacagcaagaatgacttctactctcatgatctcaacctgttctatacaatttttgagaatgccttccctggaaccacagaaagcctgttttaccaactcatccagaaaaagaacaccaccggcgcttcccaggtgctggggaaacttatcacaaagtacggcaacaataacatgttcgtcggagtgtggaagtttggccagtatctgctcacgctgccctacattaataacaccgagctgagccaaaatcggagacttacaatcctcgccacccaggaactgctgtctcgctcccacagcgggcggcaggagtccatgtctaacgcgattcagggaagcatcacaaaagagtgccataatgctaagggcgtcgggtgtatttcccctagattcggaatccccattggcaacctcaccgcctgcggggactctccgaattataaaatctacaagacgcctgaaaaactgtataagagcaacaataagggcgaggtgtggtgttccaacgacgttcactgccttaatgattttgaacccgccgacgaggaggtggtcaacaaaatcaagaaactgacatgcttcctcaccgatgtgtctgttgaagtggacatttttagcgtcgctgcctccacctgtaagatggctgataaaggagtgtgcacagtgaatggcgccaagtggaacatcattaagtgtgacagcgggctgtactatttcaccgatcaccgcgagggacaagacacaggcaacgattttggggaatactgcatctctcattcctgtaatacggagcggttccctattaaccccgacatcctgaaagattgcacctgggaatttcacagcagaaagtctaaatacatctccacaattagccttgagtctctcgaggagttccgccgggcgatggccgaaaagctgtcccataccctgacaatctataatttcaaacccaccgctaacctccctcacattagaccgacgtacaagtttatcaccgccaatggagttgaaaacagcgacggcattgagtccgcttatatcctgagctctatccccgcccttgggggcattagcgtcggatacaatgtgcagacaaaggataacttccctctgctcgacatcattgtgtttatcaaatccgcggtcattcgcaccacatataatcatatctacgacaccggccccacaattgggatcaacacccagcacgatgaacactgtacgggaccttgccccgccgtggttccgcataaggagaattggatgacattctctcaggagcggaccagcagatggggctgtgaagagtttgggtgcctggctatcaacaccggatgtgtgttcggctcctgccaagacattatccaccctgaaacaaaagtctatcgcaaggccgtggaggaagaggttgtgctgaccgtctgcattaattttcccgggaacaattactgtacggagatcaacgctattgaacctaaaatcacagatgagatcgaacttcagttcaagaccgtggacacaaaaaccctgcccaacctcctggccgttcagaatcataagctctactctggccagattaacgatctgggcagcttttcccaaggatgcgggaatgtgcagaagacaaaccactctatccttggaatgggcaccgtcaaattcgactatgtgtgtcatggggccagccggaaggatgtgattgtcagacggtgctacaataacaattttgactcctgtaaactgctcaaggaggagacgagcctgatcttcgctgataaccacgaaaccctggaggttgcgcacacaaaacatcttattggagaactgcagttcaagatcatgctcggcgacatccgctataagtcttttgccgagtcccctgaactggagattgatgctaaatgcgtgggctgtcccagctgcttcgagtcttactcctgtaattttcaaatcgtgaccaacattgacacagtctgcagcgtggaagggccgtgtaccctcttccacaatagaatcattatctccgccaacaagcagtcttatggactgaaaatgagctgccagacgaagcctaatcagaacgaggaatttattatctgcaatcggaaatactccgttcttttcacaaccatcgataagaacgacaagattgaggtgaatacaggcgaccaaaccagctatatctacgaaaaagattctagatgtaagacctggctgtgccgcgtccgggacgaggggatttccgtgctctttgagcccctgaaagccttctttggaagctacttctctatcattttctatgttgtggtcggcatcatcgtgctgttccttattatctacatttttctgcccatgttcttcaagctcaaagatgttctgaagagaaacgaatatctctacctgcaggagcttaagcataaatga

SEQ ID NO: 14191 - RNA, 4305 nt, synthetic construct
  misc_feature 1..4305: note = derived and/or modified CDS sequence (opt5) from CVV(MI80-1-450)__KX100149.1__GP
  source 1..4305: mol_type = other RNA
atgctgttcctcctgatccttgcctttctgggcttcagcacctccaaccccattgctacaagatgctttcacgggggacagctcatcgccgagtctaagagcgcgacgtccatttctgaattttgtctgaaagacgatgtgagcatgcttaagtccgaggtcgtttacatcaaaaatgacaccggcctgtttgggcataacaaggtgttccggtcttggacaattaaagattggaagctctgcaatcctatcccgaccgctggaggcacaatcaacgtgattgaagtcaataaggacctgagcctgatgaccaaaacatatatctgttcccgcgattgcaccattacgatcgacaaggaggaagcccaaattatctttcagaccgataaactcaaccacttcgaggtgagcgggacaaccctgtcttccggatggtttaagagcaaagcctctgttacacttgacagaacctgtgagcatgtgaaggtcacgtgcggcaagaaatccctgcagttccacgcttgttttaagcatcacatgagctgcgtgcggttctttcacaatacaattctccccggcaacatgatcacctctatgtgtcagaatatcgaactgattatcattcttgggctgacactcgccatcttcattctgatggttatcctgaccaaaacctacatctgctatctcctgatgcctattttcatgcccatcgcttacctttatggatgggcctacaacaagtcctgtaaaaagtgcaattgctgtggcctggcgtatcatccttttacaaactgcgggagccactgtgtgtgcggactcaaattcgaggcctccgatcgcatgcggattcatagagaatctggcctgtgtcaagggtacaagagccttcgcatcgctagactgctctgcaagtccaaaggaagctctctggtcatttccggcctgctcagcatgctgatcctttcttttgtgacgcccatcgagggcaccattacaagctaccctgagtcccggaagtataccctggaagagatcacagacgtggtcgaagggctcgtttctgagcagaatattaaagaatacatcgtgttctataccagcctgtttggatcccttattctgctcctggccttcatcatgagcattacgctgtctaagatcacatccatcctcgctaaacgcaacgtgatttactgtgaggagtgcagcatgtatcactctaagagaggcatcaagtacaatggggattttaccaacaaatgtggattctgcacctgtaacgaacaggaggacacagaaggcctggtcattcacaaggtgtccaaacggtgcacctataagtaccagcttaaatgggccaaggttctgatgatcacactcgtgctgctgcttattgcgcaaaatacgatcctcatcgtcgccgctgagaccgattgctggacaaagaaaagcctggacattgactgtatcgggccgatgctggatattggatcctgcaccaacaagaatacacgctcttacgacgccgaagctcagaaactcgtgagccagtccaagatctctcagctggatgccgaccaagttagccttctgggcaactccattgatagcgccatcaaagctatcagagcgcagaagacctatcccacgatgcatctcctggagaccatttttctgatgaagaattgtgactactatacatctttcaaccacaattccggctacagccaggccaaatggcggcttatcgctaagaccgggcattttgatatttgctctcgccactccacacatcacttctgtagatgcatcaacgacggaaccaaatgtcaaaatggcaactgggattttgccggggagatgaatgaaacgtataacagcaagaatgacttctactctcacgatctcaacctgttctatacaatttttgagaatgccttccctggaaccacagaaagcctgttttaccagctcatccagaaaaagaacaccaccggcgcttcccaggtgctggggaaacttatcacaaagtacggcaacaataacatgttcgtcggagtgtggaagtttggccaatatctgctcacgctgccctacattaataacaccgagctgagccagaatcggagacttacaatcctcgccacccaggaactgctgtctcgctcccatagcgggcggcaggagtccatgtctaacgcgattcaaggaagcatcacaaaagagtgccacaatgctaagggcgtcgggtgtatttcccctagattcggaatccccattggcaacctcaccgcctgcggggactctccgaattataaaatctacaagacgcctgaaaaactgtataagagcaacaataagggcgaggtgtggtgttccaacgacgttcattgccttaatgattttgaacccgccgacgaggaggtggtcaacaaaatcaagaaactgacatgcttcctcaccgatgtgtctgttgaagtggacatttttagcgtcgctgcctccacctgtaagatggctgataaaggagtgtgcacagtgaatggcgccaagtggaacatcattaagtgtgacagcgggctgtactatttcaccgatcaccgcgagggacaggacacaggcaacgattttggggaatactgcatctctcactcctgtaatacggagcggttccctattaaccccgacatcctgaaagattgcacctgggaatttcatagcagaaagtctaaatacatctccacaattagccttgagtctctcgaggagttccgccgggcgatggccgaaaagctgtcccacaccctgacaatctataatttcaaacccaccgctaacctccctcatattagaccgacgtacaagtttatcaccgccaatggagttgaaaacagcgacggcattgagtccgcttatatcctgagctctatccccgcccttgggggcattagcgtcggatacaatgtgcagacaaaggataacttccctctgctcgacatcattgtgtttatcaaatccgcggtcattcgcaccacatataatcacatctacgacaccggccccacaattgggatcaacacccagcatgatgaacactgtacgggaccttgccccgccgtggttccgcacaaggagaattggatgacattctctcaagagcggaccagcagatggggctgtgaagagtttgggtgcctggctatcaacaccggatgtgtgttcggctcctgccaggacattatccatcctgaaacaaaagtctatcgcaaggccgtggaggaagaggttgtgctgaccgtctgcattaattttcccgggaacaattactgtacggagatcaacgctattgaacctaaaatcacagatgagatcgaacttcagttcaagaccgtggacacaaaaaccctgcccaacctcctggccgttcagaatcacaagctctactctggccaaattaacgatctgggcagcttttcccagggatgcgggaatgtgcagaagacaaaccattctatccttggaatgggcaccgtcaaattcgactatgtgtgtcacggggccagccggaaggatgtgattgtcagacggtgctacaataacaattttgactcctgtaaactgctcaaggaggagacgagcctgatcttcgctgataaccatgaaaccctggaggttgcgcacacaaaacaccttattggagaactgcaattcaagatcatgctcggcgacatccgctataagtcttttgccgagtcccctgaactggagattgatgctaaatgcgtgggctgtcccagctgcttcgagtcttactcctgtaattttcagatcgtgaccaacattgacacagtctgcagcgtggaagggccgtgtaccctcttccataatagaatcattatctccgccaacaagcagtcttatggactgaaaatgagctgccagacgaagcctaatcaaaacgaggaatttattatctgcaatcggaaatactccgttcttttcacaaccatcgataagaacgacaagattgaggtgaatacaggcgaccagaccagctatatctacgaaaaagattctagatgtaagacctggctgtgccgcgtccgggacgaggggatttccgtgctctttgagcccctgaaagccttctttggaagctacttctctatcattttctatgttgtggtcggcatcatcgtgctgttccttattatctacatttttctgcccatgttcttcaagctcaaagatgttctgaagagaaacgaatatctctacctgcaggagcttaagcacaaatga

SEQ ID NO: 14192 - RNA, 4305 nt, synthetic construct
  misc_feature 1..4305: note = derived and/or modified CDS sequence (opt5) from CVV(MNZ-92011)__KC436107.1__GP
  source 1..4305: mol_type = other RNA
atgctgttcctcctgatccttgcctttctgggcttcagcacctccaaccccattgctacaagatgctttcacgggggacagctcatcgccgagtctaagagcgcgacgtccatttctgagttctgtctgaaagacgatgtgagcatgcttaagtccgaagtcgtttacaccaaaaatgacacaggcctgtttgggcataacaaggtgttccggtcttggaccatcaaagattggaagctctgcaatcctattccgacagctggaggcaccatcaacgtgatcgaagtcaataaggacctgagcctgatgacaaaaacctatatttgttcccgcgattgcacgatcaccattgacaaggaggaagcccaaatcatttttcagacagataaactcaaccacttcgaggtgagcgggaccacacttaattctggatggtttaagtccaaagccagcgttacccttgacagaacgtgtgagcatgtgaaggtcacatgcggcaagaaatctctgcagttccacgcttgttttaagcatcacatgtcctgcgtgcggttctttcacaacaccatcctccccggcaatatgattaacagcatgtgtcagaatatcgaactgatcattatccttgggctgacactcgccattttcatcctgatggttatgctgaccaaaacctacatttgctatctcctgatgcctatcttcatgcccatcgcttacctttatggatgggcctacaacaagtcttgtaaaaagtgcaattgctgtggcctggcgtatcatccttttacaaactgcgggtcccactgtgtgtgcggactcaaattcgaggccagcgatcgcatgcggattcatagagaatccggcctgtgtcaagggtacaagtctcttcgcatcgctagactgctctgcaagagcaaaggatccagcctggtcatttctggcctgctctccatgctgatccttagctttgtgacgcccattgagggcaccatcacatcttaccctgagagccggaagtataccctggaagagatcacagacgtggtcgaagggctcgtttccgagcagaatattaaagaatacatcgtgttctatacctctctgtttggaagccttattctgctcctggccttcatcatgtccattacgctgagcaagatcacatctattctcgctcgcagaaacgtgatctactgtgaggagtgctccatgtatcacagcaaacggggcatcaagtacaacggggattttaccaataagtgtggattctgcacctgtaacgaacaggaggacgccgaaggcctggtcattcacaaagtgtctaagcgctgcacatataaataccagcttaagtgggcgaaagttctgatggtgaccctcgtcctgctgcttatcgcccaaaatacaattctcatcgtggctgccgggacggattgctgggctaagaagtccctggacatggactgtattggaccgatgctggatatcggcagctgcaccaacaaaaatacaagaaactacgacaccgaggcccagaagctcgtttcccagtctaaagtgagccagctggatgccgaccaagcgtcccttctgggcaattctatcgatagcgctattaaggccatccgggctcagaaaacatatcccaccatgcatctcctggaaacgatttttctgatgaagaactgtgactactatacctccttcaatcacaacagcgggtactctcaggccaagtggcgccttatcgccaaaacaggacattttgatatttgctccagacacagcacccatcacttctgtcggtgcatcaatgacggcacaaagtgtcaaaacggggattgggactttgctggagagatgaatgagacctataactctaaaaatgatttctactcccacgacctcaacctgttctatacgatctttgaaaacgccttccctggcacaaccgagagcctgttttaccagctcattcagaagaaaaatacagcgggggcttctaagatcctgggcaaacttattaccaagtacggaaacaataacatgttcgtcggcgtgtggaagtttgggcagtatctgctcaccctgccctacatcaataacacagaactgagccaaaatagacgccagacgattcttgccacccaggagtccctcagccggtctcattccggaagacaggaaagcatgtcctctgccatccaaggcagcgtcacaaaagagtgccacaacgctaaggacgtggggtgtatctcccctcgcttcggcattcccatcggaaatctgaccgcctgcggggattctccgaactataaaatttacaagacacctgagaaactgtataagagcaataacaagggcgaagtttggtgttccaatgacgtgcattgcctcaacgattttgagcccgctgacgaagaggtcgtgaataaagttaagaaactgacctgcttccttacggatgtgtctgtcaagacagacatctttagcgtggccgcgtccacctgtaaaatggccgataagggaatttgcaccgtgaacgacgctaagtggaacatcattaaatgtgatagcggcctgtactatttcacagaccaccgggaggggcaggataccggaaatgactttggcgaatactgcatctctcactcctgtaacacagagagattccctatcaatcccgatattctcaaggactgcacgtgggaatttcatagccgcaaatctaagtacatctccaccattagcctggagtctctggaagagttccggagagccatgacagagaaactttcccacaccctcacaatctataacttcaagcccaccgctaatctgcctcatattcgcccgacgtacaagtttatcaccgccaacggggttgaaaatagcgacggaatcgagtccgcgtatattctgagctctatccccgccctcggcgggattagcgtcggctacaacgtgcagacaaaagataatttccctctgcttgacatcattgtgtttatcaagtccgctgtcatccggaccacatataaccacatttacgataccggacccacaatcggcattaatacccagcatgacgaacactgtacggggccttgccccgccgtggttccgcacaaagagaactggatcacattctctcaagaaagaaccagccgctggggatgtgaggagtttggctgcctggctattaataccgggtgtgtgttcggatcctgccaggatatcattcatcctgaaacaaaggtctatcggaaagccgtggaggaagaggttgtgctcaccgtctgcatcaactttcccggcaataactactgtacggaaatcaacgccgtggagcctaagattacagacgagatcgaactgcagttcaaaaccgttgatacaaagaccctgcccaatcttctggctgtgcagaaccacaagctctactctgggcaaattaatgacctgggcagcttttcccagggatgcggcaacgtccagaaaacaaatcattctatcctcgggatgggaaccgcgaagttcgattatgtgtgtcacggcgccagcagaaaagacgtgattgtccggcgctgctacaacaataactttgattcctgtagactgcttaaggaggaaacgagcctgatcttcgctgacaatcatgagaccctcgaggttgcccacacaaaacacctgatcggggaactgcaattcaagattatgcttggagatatccggtataagtcttttgccgagtcccctgaactggagattgacgctaaatgcgtgggctgtcccagctgcttcgaatcttactcctgtaactttcagatcgtgaccaatattgacacagtctgcagcgtggagggcccgtgtaccctcttccataacagaatcatcatttccgccaataagcagtcttatgggctgaaaatgagctgccagacgaagcctaaccaaaatgaggaatttatcatttgcaaccgcaaatactccgttctcttcacaaccatcgataagaatgacaagattgaggtgaacacaggagatcagaccagctatatctacgaaaaagactctcggtgtaagacctggctgtgcagagtccgcgatgagggcatttccgtgctttttgaacccctgaaagcgttctttgggagctacttctctatcatcttttatgttgtggtcggaattatcgttctcttcctgattatctacatttttctgcccatgttcttcaagctgaaagacgtgctgaagagaaacgagtatctctacctgcaggagctcaagcacaaatga

SEQ ID NO: 14193 - RNA, 4305 nt, synthetic construct
  misc_feature 1..4305: note = derived and/or modified CDS sequence (opt5) from CVV(MPB1-1551)__KX100143.1__GP
  source 1..4305: mol_type = other RNA
atgctgttcctcctgatccttgcctttctgggcttcagcacctccaaccccattgctacaagatgctttcacgggggacagctcatcgccgagtctaagagcgcgacgtccatttctgaattttgtctgaaagacgatgtgagcatgcttaagtccgaggtcgtttacatcaaaaatgacaccggcctgtttgggcataacaaggtgttccggtcttggacaattaaagattggaagctctgcaatcctatcccgaccgctggaggcacaatcaacgtgattgaagtcaataaggacctgagcctgatgaccaaaacatatatctgttcccgcgattgcaccattacgatcgacaaggaggaagcccaaattatctttcagaccgataaactcaaccacttcgaggtgagcgggacaaccctgtcttccggatggtttaagagcaaagcctctgttacacttgacagaacctgtgagcatgtgaaggtcacgtgcggcaagaaatccctgcagttccacgcttgttttaagcatcacatgagctgcgtgcggttctttcacaatacaattctccccggcaacatgatcacctctatgtgtcagaatatcgaactgattatcattcttgggctgacactcgccatcttcattctgatggttatgctgaccaaaacctacatctgctatctcctgatgcctatcttcatgcccattgcttacctttatggatgggcctacaacaagtcctgtaaaaagtgcaattgctgtggcctggcgtatcatccttttacaaactgcgggagccactgtgtgtgcggactcaaattcgaggcctccgatcgcatgagaatccatcgggaatctggcctgtgtcaagggtacaagagccttcgcattgctagactgctctgcaagtccaaaggaagctctctggtcatctccggcctgctcagcatgctgattctttcttttgtgacgcccatcgagggcaccatcacaagctaccctgagtcccggaagtataccctggaagagattacagacgtggtcgaagggctcgtttctgagcagaatatcaaagaatacattgtgttctataccagcctgtttggatcccttatcctgctcctggccttcattatgagcatcacgctgtctaagattacatccatcctcgctaaacgcaacgtgatctactgtgaggagtgcagcatgtatcactctaagagaggcattaagtacaatggggattttaccaacaaatgtggattctgcacctgtaacgaacaggaggacacagaaggcctggtcatccacaaggtgtccaaacggtgcacctataagtaccagcttaaatgggccaaggttctgatgattacactcgtgctgctgcttatcgcgcaaaatacgattctcatcgtcgccgctgagaccgattgctggacaaagaaaagcctggacatcgactgtattgggccgatgctggatatcggatcctgcaccaacaagaatacacgctcttacgacgccgaagctcagaaactcgtgagccagtccaagatttctcagctggatgccgaccaagccagccttctgggcaactccatcgatagcgctattaaagcgatcagagcccagaagacctatcccacgatgcatctcctggagaccatctttctgatgaagaattgtgactactatacatctttcaaccacaattccggctacagccaggctaaatggcggcttattgccaagaccgggcattttgatatctgctctcgccactccacacatcacttctgtagatgcattaacgacggaaccaaatgtcaaaatggcgattgggactttgccggggagatgaacgaaacgtataatagcaagaacgatttctactctcacgacctcaatctgttctatacaatctttgagaacgctttccctggaaccacagaaagcctgttttaccagctcattcagaaaaagaataccaccggcgcctccaaagttctggggaaacttatcacaaagtacggcaacaacaatatgttcgtgggagtctggaagtttggccagtatctgctcacgctgccctacatcaacaataccgagctgagccaaaaccggagacttacaattctcgcgacccaggaaatcctgtctcgctcccatagcgggcggcaggagtccatgtctaatgctattcagggaagcatcacaaaggagtgccacaacgccaaaggcgtggggtgtatttcccctagattcggaatccccattggcaatctgaccgcctgcggggactctccgaactataagatctacaaaacgcctgaaaagctctataagagcaataacaaaggcgaggtctggtgttccaatgatgtgcattgcctgaacgactttgaacccgctgatgaggaggttatcaataagattaaaaagctgacatgcttcctgaccgacgtgtctgtcgaagtggatatctttagcgttgccgcttccacctgtaaaatggccgacaagggagtgtgcacagtcaacggcgcgaagtggaatattatcaaatgtgatagcgggctctactatttcaccgaccaccgcgagggacaagatacaggcaacgactttggggaatactgcatttctcactcctgtaacacggagcggttccctatcaatcccgataccctgaaggactgcacatgggaatttcatagcagaaaatctaagtacatctccaccattagcctggagtctcttgaggagttccgccgggccatggctgaaaaactctcccacacactgaccatctataacttcaagcccacggccaatctgcctcatattagaccgacctacaagtttatcacagctaacggagtggaaaatagcgatggcattgagtccgcctatatcctcagctctatccccgcgcttgggggcattagcgtgggatacaacgttcagaccaaagacaatttccctcttctggacatcattgtctttatcaagtccgccgtgattcgcacaacctataaccacatctacgatacaggccccaccattgggatcaatacgcagcatgacgaacactgtacaggaccttgccccgctgtggtcccgcacaaagagaactggatgaccttctctcaggagcggaccagcagatggggctgtgaagagtttgggtgcctcgccatcaatacaggatgtgtgttcggctcctgccaagatattatccatcctgaaaccaaggtttatcgcaaagctgtggaggaagaggtcgtgctgacggtttgcattaactttcccggcaattcttactgtacagagatcaacgccattgaacctaagatcaccgacgagatcgaactgcagttcaaaacagtggataccaagacacttcccaatctgctcgccgtccagaaccacaagctgtacagcgggcagattaacgacctcggatccttttctcaaggctgcgggaatgtgcagaaaaccaaccatagcatcctgggaatgggcacggttaagttcgattatgtgtgtcacggggcttcccggaaagacgtcattgtgagacggtgctacaataacaattttgatagctgtaaacttctgaaggaggagacctctctcatcttcgcggacaaccatgaaacactggaggtggcccacaccaagcacctgattggagaacttcagttcaagatcatgctgggcgatatccgctataaatcctttgctgagagccctgaactcgagattgacgccaagtgcgtcggctgtccctcttgcttcgagtcctacagctgtaattttcaaatcgttacaaacattgataccgtgtgctccgtggaagggccgtgtacgctgttccataatagaatcattatctctgccaacaaacagagctatggactcaagatgtcctgccagacaaaacctaatcagaacgaggaatttattatctgcaatcggaagtacagcgtcctgttcaccacaatcgacaagaacgacaaaattgaggtgaataccggcgatcaaacctcttatatctacgaaaaggactccagatgtaaaacatggctttgccgcgttcgggatgaggggattagcgtgctgtttgagcccctcaaggctttctttggatcttacttcagcatcattttctatgtcgtggttggcatcatcgtgctgttcctgattatctacatttttcttcccatgttcttcaaactgaaggacgtcctcaagagaaacgaatatctgtacctccaggagctgaaacacaagtga

SEQ ID NO: 14194 - RNA, 4305 nt, synthetic construct
  misc_feature 1..4305: note = derived and/or modified CDS sequence (opt5) from CVV(W308-67)__KX100140.1__GP
  source 1..4305: mol_type = other RNA
atgctgttcctcctgatccttgcctttctgggcttcagcacctccaaccccattgctacaagatgctttcacgggggacagctcatcgccgagtctaagagcgcgacgtccatttctgaattttgtctgaaagacgatgtgagcatgcttaagtccgaggtcgtttacatcaaaaatgacaccggcctgtttgggcataacaaggtgttccggtcttggacaattaaagattggaagctctgcaatcctatcccgaccgctggaggcacaatcaacgtgattgaagtcaataaggacctgagcctgatgaccaaaacatatatctgttcccgcgattgcaccattacgatcgacaaggaggaagcccaaattatctttcagaccgataaactcaaccacttcgaggtgagcgggacaaccctgtcttccggatggtttaagagcaaagcctctgttacacttgacagaacctgtgagcatgtgaaggtcacgtgcggcaagaaatccctgcagttccacgcttgttttaagcatcacatgagctgcgtgcggttctttcacaatacaattctccccggcaacatgatcacctctatgtgtcagaatatcgaactgattatcattcttgggctgacactcgccatcttcattctgatggttaccctgaccaaaacatacatctgctatctcctgatgcctatcttcatgcccattgcttacctttatggatgggcctacaacaagtcctgtaaaaagtgcaattgctgtggcctggcgtatcatccttttacgaactgcgggagccactgtgtgtgcggactcaaattcgaggcctccgatcgcatgagaatccatcgggaatctggcctgtgtcaagggtacaagagccttcgcattgctagactgctctgcaagtccaaaggaagctctctggtcatctccggcctgctcagcatgctgattctttcttttgtgacccccatcgagggcacaatcaccagctaccctgagtcccggaagtatacactggaagagattaccgacgtggtcgaagggctcgtttctgagcagaatatcaaagaatacattgtgttctatacgagcctgtttggatcccttatcctgctcctggccttcattatgagcatcacactgtctaagattacctccatcctcgctaaacgcaacgtgatctactgtgaggagtgcagcatgtatcactctaagagaggcattaagtacaatggggattttaccaacaaatgtggattctgcacatgtaacgaacaggaggacaccgaaggcctggtcatccacaaggtgtccaaacggtgcacatataagtaccagcttaaatgggccaaggttctgatgattacgctcgtgctgctgcttatcgcgcaaaataccattctcatcgtcgccgctgagacagattgctggaccaagaaaagcctggacatcgactgtattgggccgatgctggatatcggatcctgcacaaacaagaatacccgctcttacgacgccgaagctcagaaactcgtgagccagtccaagatttctcagctggatgccgaccaagccagccttctgggcaactccatcgatagcgctattaaagcgatcagagcccagaagacgtatcccaccatgcatctcctggagacaatctttctgatgaagaattgtgactactatacctctttcaaccacaattccggctacagccaggctaaatggcggcttattgccaagacagggcattttgatatctgctctcgccactccacccatcacttctgtagatgcattaacgacgagacgaaatgtcaaaatggagattgggactttgccggcgaaatgaacgagacatataagagcaaaaatgatttctactctcacgacctcaacctgttctataccatctttgaaaatgctttccctgggacaaccgagagcctgttttaccagctcattcagaagaaaaacaccacaggagcctccaaggttctgggcaaacttatcacgaaatacgggaataacaacatgttcgtgggcgtctggaagtttggacagtatctgctcaccctgccctacatcaataacacagaactgagccaaaatcggagacttaccattctcgcgacacaggagatcctgtctcgctcctatagcggccggcaggagtccatgtctaacgctattcaggggagcatcaccaaagaatgccataatgccaagggagtgggctgtatttcccctagattcgggatccccattggaaacctgacggcctgcggcgactctccgaattacaaaatctataagacacctgagaagctctacaaaagcaacaataagggggaagtctggtgttccaacgatgtgcactgcctgaatgactttgagcccgctgatgaggaagttatcaacaaaattaagaaacttacctgcttcctgaccgacgtgtctgtcgaggtggatatctttagcgttgccgcttccacatgtaagatggccgacaagggcgtgtgcaccgtcaatggagcgaaatggaacattatcaagtgtgatagcggcctctattacttcacagaccatcgcgaagggcaagatacgggaaatgactttggcgagtactgcatttctcactcctgtaacaccgaacggttccctatcaaccccgatacactgaaagactgcacctgggagtttcacagcagaaagtctaaatatatctccacaattagcctggagtctcttgaagagttccgccgggccatggctgaaaagctctcccataccctgacgatctacaatttcaagcccaccgccaacctgcctcacattagaccgacatataaatttatcaccgctaatggggtggagaacagcgatggaattgaatccgcctacatcctcagctctatccccgcgctgggcgggattagcgtgggctataatgttcagacaaaggacaacttccctcttctggacatcattgtctttatcaaatccgccgtgattcgcaccacatacaatcatatctatgataccggacccacgattggcatcaacacacagcacgacgagcattgtaccgggccttgccccgctgtggtcccgcacaaggagaattggatgaccttctctcaggaacggacaagcagatggggatgtgaggaatttggctgcctcgccatcaacaccgggtgtgtgttcggatcctgccaagatattatccaccctgagacgaaagtttaccgcaaggctgtggaagaggaggtcgtgctgacagtttgcattaattttcccggcaacaattactgtaccgaaatcaacgccattgagcctaaaatcacagacgaaatcgagctgcagttcaagaccgtggatacaaagacccttcccaatctgctcgccgtccagaaccataaactgtattctgggcagattaacgacctcggcagcttttcccaaggatgcggcaatgtgcagaagacgaaccactctatcctggggatgggaaccgttaaattcgattacgtgtgtcatggcgctagccggaaggacgtcattgtgagacggtgctataataacaattttgattcctgtaaacttctgaaggaggaaacaagcctcatcttcgcggacaaccacgagaccctggaagtggcccatacaaagcacctgattggggagcttcagttcaaaatcatgctgggagatatccgctacaagtcttttgctgaatcccctgagctcgagattgacgccaaatgcgtcggctgtcccagctgcttcgaatcttattcctgttactttcaaatcgttaccaatattgatacggtgtgcagcgtggagggcccgtgtacactgttccacaacagaatcattatctccgccaataagcagtcttatgggctcaaaatgagctgccagaccaagcctaaccagaatgaagagtttattatctgcaaccggaagtactccgtcctgttcacaaccatcgacaaaaatgacaagattgaagtgaacaccggagatcaaacaagctacatctatgagaaagactctagatgtaagacgtggctttgccgcgttcgggatgagggcatttccgtgctgtttgaacccctcaaggctttctttgggagctacttctctatcattttctatgtcgtggttggaatcatcgtgctgttcctgattatctacatttttcttcccatgttcttcaagctgaaggacgtcctcaaaagaaatgagtatctgtacctccaggaactgaagcataaatga

SEQ ID NO: 14195 - RNA, 4305 nt, synthetic construct
  misc_feature 1..4305: note = derived and/or modified CDS sequence (opt5) from CVV(W728-67)__KX100137.1__GP
  source 1..4305: mol_type = other RNA
atgctgttcctcctgatccttgcctttctgggcttcagcacctccaaccccattgctacaagatgctttcacgggggacagctcatcgccgagtctaagagcgcgacgtccatttctgaattttgtctgaaagacgatgtgagcatgcttaagtccgaggtcgtttacatcaaaaatgacaccggcctgtttgggcataacaaggtgttccggtcttggacaattaaagattggaagctctgcaatcctatcccgaccgctggaggcacaatcaacgtgattgaagtcaataaggacctgagcctgatgaccaaaacatatatctgttcccgcgattgcaccattacgatcgacaaggaggaagcccaaattatctttcagaccgataaactcaaccacttcgaggtgagcgggacaaccctgtcttccggatggtttaagagcaaagcctctgttacacttgacagaacctgtgagcatgtgaaggtcacgtgcggcaagaaatccctgcagttccacgcttgttttaagcatcacatgagctgcgtgcggttctttcacaatacaattctccccggcaacatgatcacctctatgtgtcagaatatcgaactgattatcattcttgggctgacactcgccatcttcattctgatggttatgctgaccaaaacctacatctgctatctcctgatgcctatcttcatgcccattgcttacctttatggatgggcctacaacaagtcctgtaaaaagtgcaattgctgtggcctggcgtatcatccttttacaaactgcgggagccactgtgtgtgcggactcaaattcgaggcctccgatcgcatgagaatccatcgggaatctggcctgtgtcaagggtacaagagccttcgcattgctagactgctctgcaagtccaaaggaagctctctggtcatctccggcctgctcagcatgctgattctttcttttgtgacgcccatcgagggcaccatcacaagctaccctgagtcccggaagtataccctggaagagattacagacgtggtcgaagggctcgtttctgagcagaatatcaaagaatacattgtgttctataccagcctgtttggatcccttatcctgctcctggccttcattatgagcatcacgctgtctaagattacatccatcctcgctaaacgcaacgtgatctactgtgaggagtgcagcatgtatcactctaagagaggcattaagtacaatggggattttaccaacaaatgtggattctgcacctgtaacgaacaggaggacacagaaggcctggtcatccacaaggtgtccaaacggtgcacctataagtaccagcttaaatgggccaaggttctgatgattacactcgtgctgctgcttatcgcgcaaaatacgattctcatcgtcgccgctgagaccgattgctggacaaagaaaagcctggacatcgactgtattgggccgatgctggatatcggatcctgcaccaacaagaatacacgctcttacgacgccgaagctcagaaactcgtgagccagtccaagatttctcagctggatgccgaccaagccagccttctgggcaactccatcgatagcgctattaaagcgatcagagcccagaagacctatcccacgatgcatctcctggagaccatctttctgatgaagaattgtgactactatacatctttcaaccacaattccggctacagccaggctaaatggcggcttattgccaagaccgggcattttgatatctgctctcgccactccacacatcacttctgtagatgcattaacgacggaaccaaatgtcaaaatggcgattgggactttgccggggagatgaacgaaacgtataatagcaagaacgatttctactctcacgacctcaatctgttctatacaatctttgagaacgctttccctggaaccacagaaagcctgttttaccagctcattcagaaaaagaataccaccggcgcctccaaaatcctggggaaacttatcacaaagtacggcaacaacaatatggttgtgggagtctggaagttcggccagtatctgctcacgctgccctacattaacaataccgagctgagccaaaaccggagacttacaatcctcgcgacccaggaactgctgtctcgctcccatagcgggcggcaggagtccatgtctaatgctattcagggaagcatcacaaaggagtgccacaacgccaaaggcgtggggtgtatttcccctagatttggaatccccattggcaatctcaccgcctgcggggactctccgaactataagatctacaaaacgcctgaaaagctgtataagagcaataacaaaggcgaggtctggtgttccaatgatgtgcattgccttaacgacttcgaacccgctgatgaggaggttgtgaataagatcaaaaagctgacatgctttctcaccgacgtctctgtggaagttgatattttcagcgtggccgcttccacctgtaaaatggccgacaagggagtctgcacagtgaacggcgcgaagtggaatatcattaaatgtgatagcgggctgtactattttaccgaccaccgcgagggacaagatacaggcaacgacttcggggaatactgcatctctcactcctgtaacacggagcggtttcctattaatcccgataccctgaaggactgcacatgggagttccatagcagaaaatctaagtacatctccaccatcagccttgaatctctcgaggaatttcgccgggccatggctgagaaactgtcccacacactgaccatttataacttcaagcccacggccaatctccctcatatcagaccgacctacaagttcattacagctaacggagtggaaaatagcgatggcatcgagtccgcctatattctgagctctatccccgcgcttgggggcatcagcgttggatacaacgtccagaccaaagacaattttcctctgctcgacattatcgtgttcattaagtccgccgtgatccgcacaacctataaccacatttacgatacaggccccaccatcgggattaatacgcagcatgacgaacactgtacaggaccttgccccgctgtcgtgccgcacaaagagaactggatgaccttttctcaggagcggaccagcagatggggctgtgaagagttcgggtgcctggccatcaatacaggatgtgtttttggctcctgccaagatatcattcatcctgaaaccaaggtgtatcgcaaagctgtcgaggaagaggtggttctgacggtgtgcatcaacttccccgggaataactactgtacagagattaatgccatcgaacctaagattaccgacgagatcgaacttcagtttaaaacagtcgataccaagacactgcccaacctcctggccgtgcagaaccacaagctctactctggccagatcaatgacctgggcagcttctcccaaggatgcgggaacgttcagaaaaccaatcattctattcttggaatgggcacggtgaagtttgattatgtctgtcacggggctagccggaaagacgtgatcgtgagacggtgctacaacaataacttcgattcctgtaagctgctcaaagaggagaccagcctgatttttgcggacaatcatgaaacactggaggtcgcccacaccaagcaccttatcggagaactgcagttcaagattatgctcggcgatatccgctataaatctttcgctgagtcccctgaactggagatcgacgccaagtgcgttggctgtcccagctgctttgagtcttactcctgtaacttccaaattgtgacaaatatcgataccgtgtgcagcgtcgaagggccgtgtacgctctttcataacagaattatcatttccgccaataaacagtcttatggactgaagatgagctgccagacaaaacctaaccagaatgaggagttcatcatttgcaaccggaagtactccgtgctttttaccacaatcgacaagaatgacaaaatcgaagttaacaccggcgatcaaaccagctatatttacgaaaaggactctagatgtaaaacatggctgtgccgcgtgcgggatgaggggatctccgtcctcttcgagcccctgaaggctttcttcggaagctacttttctattatcttctatgtggttgtgggcattatcgtcctgtttcttatcatttacatcttcctgcccatgtttttcaaactcaaggacgtgctgaagagaaatgaatatctctacctgcaggagcttaaacacaagtga

SEQ ID NO: 14196 - RNA, 4305 nt, synthetic construct
  misc_feature 1..4305: note = derived and/or modified CDS sequence (opt5) from CVV(WI-03BS7669)__KX100152.1__GP
  source 1..4305: mol_type = other RNA
atgctgttcctcctgatccttgcctttctgggcttcagcacctccaaccccattgctacaagatgctttcacgggggacagctcatcgccgagtctaagagcgcgacgtccatttctgagttctgtctgaaagacgatgtgagcatgcttaagtccgaagtcgtttacatcaaaaatgacaccggcctgtttgggcataacaaggtgttccggtcttggacaattaaagattggaagctctgcaatcctatcccgaccgctggaggcacaatcaacgtgattgaagtcaataaggacctgagcctgatgaccaaaacatatatctgttcccgcgattgcaccattacgatcgacaaggaggaagcccaaattatctttcagaccgataaactcaaccacttcgaggtgagcgggacaaccctgtcttccggatggtttaagagcaaagcctctgttacacttgacagaacctgtgagcatgtgaaggtcacgtgcggcaagaaatccctgcagttccacgcttgttttaagcatcacatgagctgcgtgcggttctttcacaatacaattctccccggcaacatgatcacctctatgtgtcagaatatcgaactgattatcattcttgggctgacactcgccatcttcattctgatggttatcctgaccaaaacctacatctgctatctcctgatgcctattttcatgcccatcgcttacctttatggatgggcctacaacaagtcctgtaaaaagtgcaattgctgtggcctggcgtatcatccttttacaaactgcgggagccactgtgtgtgcggactcaaattcgaggcctccgatcgcatgcggattcatagagaatctggcctgtgtcaagggtacaagagccttcgcatcgctagactgctctgcaagtccaaaggaagctctctggtcatttccggcctgctcagcatgctgatcctttcttttgtgacgcccatcgagggcaccattacaagctaccctgagtcccggaagtataccctggaagagatcacagacgtggtcgaagggctcgtttctgagcagaatattaaagaatacatcgtgttctataccagcctgtttggatcccttattctgctcctggccttcatcatgagcattacgctgtctaagatcacatccatcctcgctaaacgcaacgtgatttactgtgaggagtgcagcatgtatcactctaagagaggcatcaagtacaatggggattttaccaacaaatgtggattctgcacctgtaacgaacaggaggacacagaaggcctggtcattcacaaggtgtccaaacggtgcacctataagtaccagcttaaatgggccaaggttctgatgatcacactcgtgctgctgcttattgcgcaaaatacgatcctcatcgtcgccgctgagaccgattgctggattaagaaaagcctggacatcgactgtattgggccgatgctggatatcggatcctgcacaaacaagaatacccgctcttacgacacagaagcccagaaactcgtgagccagtccaagatttctcagctggatgctgaccaagttagccttctgggcaactccatcgatagcgccatcaaagccattagagctcagaagacctattctacgatgcatctcctggagaccatctttctgatgaagaattgtgactactatacatccttcaaccacaatagcggctactctcaggcgaaatggcggcttattgccaagaccgggcattttgatatctgctcccgccacagcacacatcacttctgtagatgcattaacgacggaaccaaatgtcaaaatggcgattgggactttgctggggagatgaacgaaacgtataattctaagaacgatttctacagccacgacctcaatctgttctatacaatctttgagaacgccttccccggaaccacagaatccctgttttaccagctcatccagaaaaagaataccaccggcgccagcaaagtgctggggaagctcattacaaagtacggcaacaacaatatgttcgtcggagtgtggaaatttggccagtatctgctcacgctgccttacatcaacaataccgagctgtctcaaaaccggagacttacaattctcaccacacaggaactgctgtcccgcagccattccgggcggcaggagtctatgagcaatgctatccagggatccattaccaaggagtgccacaacgccaaaggcgtcgggtgtatctctcccagattcggcattcctatcggaaatctcacggcgtgcggggacagccccaactataagatctacaaaacaccggaaaagctgtataagtccaataacaaaggcgaggtgtggtgttctaatgatgttcattgccttaacgactttgaacctgctgatgaggaggtggtcaataagattaaaaagctgacctgcttcctcaccgacgtgagcgttgaagtggatatcttttccgtcgccgccagcacatgtaaaatggctgacaagggagtgtgcaccgtgaacggcgccaagtggaatattatcaaatgtgattctgggctgtactatttcacagaccaccgcgagggacaagatacgggcaacgactttggggaatactgcatttcccacagctgtaacaccgagcggttccccatcaatcctgatatcctgaaggactgcacatgggaatttcattctagaaaatccaagtacattagcaccatctctcttgagtccctcgaggagttccgccgggctatggccgaaaaactgagccacacactgaccatttataacttcaagcccacggcgaatctcccccatatcagacctacctacaagtttattacagccaacggagttgaaaattccgatggcatcgagagcgcttatatcctgtctagcattccggcccttgggggcatctccgtcggatacaacgtgcagaccaaagacaatttccccctgctcgacattatcgtgtttattaagtctgctgtcatccgcacaacctataaccacatttacgatacaggccctaccatcgggatcaatacgcagcatgacgaacactgtacaggaccctgccctgccgtggttccccacaaagagaactggatgaccttcagccaggagcggacctccagatggggctgtgaagagtttgggtgcctggcgattaatacaggatgtgtgttcggctcttgccaagatatcattcatccggaaaccaaggtctatcgcaaagccgtggaggaagaggttgtgctgacggtctgcatcaactttcctgggaataactactgtacagagattaatgctatcgaacccaagatcaccgacgagattgaacttcagttcaaaacagtggataccaagacactgcctaacctcctggccgttcagaaccacaagctctacagcggccagatcaatgacctgggatccttttctcaaggctgcgggaacgtgcagaaaaccaatcatagcattcttggaatgggcacggtcaagttcgattatgtgtgtcacggggcttcccggaaagacgtgatcgtcagacggtgctacaacaataactttgatagctgtaagctgctcaaagaggagacctctctgattttcgccgacaatcatgaaacactggaggttgcccacaccaagcaccttatcggagaactgcagttcaagatcatgctcggcgatattcgctataaatcctttgctgagagccccgaactggagatcgacgcgaagtgcgtgggctgtccttcttgcttcgagtcctacagctgtaactttcaaattgtgacaaatatcgataccgtctgctccgtggaagggccctgtacgcttttccataacagaattatcatttctgccaataaacagagctatggactgaagatgtcctgccagacaaaaccgaaccagaatgaggaatttatcatctgcaaccggaagtacagcgttcttttcaccacaattgacaagaatgacaaaatcgaggtgaacaccggcgatcaaacctcttatatttacgaaaaggactccagatgtaaaacatggctgtgccgcgtccgggatgaggggatcagcgtgctctttgagcctctgaaggctttctttggatcttacttcagcattatcttttatgttgtggtcggcatcattgtgctgttccttatcatttacatctttctgcccatgttcttcaaactcaaggacgttctgaagagaaatgaatatctctacctgcaggagcttaaacacaagtga

SEQ ID NO: 14197 - RNA, 4317 nt, synthetic construct
  misc_feature 1..4317: note = derived and/or modified CDS sequence (opt5) from CHLV(CHLV-Mex07)__JN808310.1__GP
  source 1..4317: mol_type = other RNA
atggagcccagcatcaagctgttcctcattctggccatcgctgccgcggctgtgcactcccttcctgcctctagatgctttagcgaaggcattgtcatcaaagagaagcaggactccaaagccgtttctgagttctgtctgaaggatgacgtgagcatgattaaatcccatgtggtctactctaagaacgagagcgggatctttgctaattcccaaatcctccggaagtggattatcaaagattggaagctgtgcagcccgcttcccaccgccggaggccagattaacgtgatcgaaattaatcacgacctgacactctctacgaaaacctatgtttgtacaaccgattgcacaatcgggattgacaaggagaacgctcagatcaccttccagacaaataaactgaactactttgaggtgtccggaaccacgatcagctctggctggttcaagtccaagaccagcgtctctctggatcaaacatgtgaacatctcaaagtgtcctgcgggaagaaaagcatgcagtttcacgcctgtttcaagcagcatatgtcctgcattcgctatctgcacagaaccgcgcttcctggatacatggccgcttctatctgtagcaatattgagctgatcattatgacaaccctcacgctggccatctttatccttctgtgcattatcacaaaaacctatatttgttacctcctgatgcccctgttcatgcctatcgcttatatttacggctggctctacaacaagtcctgcaaaaagtgcaattgttgcggcctgagctatcacccctttacaaactgtgggtcttactgcgtttgtggagccaagttcgaaacctccgaccggatgcgcatccatagagagagcggcctttgccaggggtataaatctctgcgggtggcgcgcaagctctgtaaaagcaagggatcctctctggtcatcagcattaccctttccgtgtttatcttcagcttcattacacctatcggcggggccattatcaatgataaactgtctgaggaaaagtactccattaaccaaatgatggacgctatcgtggatctcgagaattttagccacaacgtctctggaacgcagcaggttatctccgtgattttcctgctgatcagctgcctctttctgcttctgacctatcatctcaataagattatccagcacctggccagattcggccttctgttttgtgaagagtgctccatgtaccactctaaaaaggacattaaatataacggcgatttcacaaacaagtgtgggttttgtacctgcggacaaccggaagaccccgagggcctcaatctgcatatcctgagccagaactgcacatacaaacagcaattcaagtgggtgaagatcattatctccattctcctgtctcttatcattatcgagaatagcatgatcctggctgccgccgaaaccgactgcttttccgagaaacagattagcgagttctgtctcgggcctctgctgtctatctccagctgcgaagataagaactctcggacgtttaaaggagaagctcagaaacttgtcgcgctcaaaaagattacatccgacgaggccatgctgatcgagagcatgggcgctaatgtggaaggggccctggagatgattcaggcccaaaagtctcccgatagcatgtacaccatggaatatgttttcctcaacacctactgtgactattactccctgtttgagcacaatagcggatattctcaggtgaaatggcgctacatccttaagacacatcagttcgatgcttgcgccagacactccaacagccatttctgtcggtgcatgtccgacggcatgcactgtccttctagcgattgggacatcgcggatgaactggacaatacctatattacaaaacccaactttttcaagcacgattacaatctcctgctggacgtcatcacggctgcctttccgggcaccggggccgtgttcgttattgacgcttgcaaaaaggccaacgctacagccatcaaaaccttttccaataacattatcgcgcgcttcccttacaataaccttctcaagggagtgatgaagtttctgcagtatatttctaaacatcccagcttcaagaaataccaacctgatacaagacactatgacctgatccccgtcgcccccaccgctcggggccgctccctcgggagatctaacagctacaataacgcccagatcggatcccctacgaaggattgtcagatgctgaaagaggtgggctgccttagcccgaagtttgggctgcccctcgagtctattatctcctgcggcagctctcctaattataagctgtacaaaaagccccagaaatattacaagtccaacaataaagaaaacacctggtgtagcaaggacgtccattgcctgcacgatttcgagcctattacagaagacgtgcttgagaaggttaaagtgatgacctgttgggagatcgaacccggaacaattgaggatatctttaccatcgcttctgaaacgtgcaagattaatgaccggggcgtctgtgaggtgaacgccgcgaaatggaagatcgttaaatgcgaaacagggctctactattacaccgatcacagagagggagacgatacaggctccgacctggggcattattgtctgacccacaagtgcgccggaggccgctacccgattaatcctgagatcctccaaaactgtgtgtgggagttccatagccagaagtcccagtatattaatcaggtcgatctggaacaaatcgaagagtacaaaaaggctcttaccgaaaaactgacacacacgctcaaccattataattttctgcccaccaagaacctgcctcacatcagccccaattacaaatacgtgacacttaacgggcaggagacctctgacggcattgagaacagctatatcgtgtccgaaattcctgccatcgctggaacatctattggcctcaaggttcagaccaaaacgaatgacgatatcttcgacctgattatctacgtcaagcgggccgatatcattgccagctataaccacatctacgacacagggcccaccattggacataatgtggagcacgaagaactgtgcaccggccaatgtccgcagcatatccctgctaaggcgaactggctcacattctcccaggaaagaacctctcgctgggggtgcgaggagtttggatgcctggccattaatacaggctgtgtgtatgggagctgccaggatatcatcaaacccgtcgctaaggtgtaccggaaatccacggaagagaaggttgaacttgagctgtgtattgtgctccccgacaaaaacttctgcaccacactgaatgccctggagcctaagatcaccgaagagattgaacttcaatttaagacaatcgatcagatgtctctgccgaacattgtcctcctgagagaccacaaactcttcaagggccagatcaatgatctgggaacctttggccagaactgtgggaatgtgcaaaagacgaaccagagcatccttggagccggcaccgttcgcttcgactatctgtgccattccgctagccggaaggatattatcattagacgctgttacaataacaattacgactcttgcaaccacctccagctggccgagtccctgatctttcttgataaccacgaaacactggaggtgcggaaacccaatcatattctcgggaccctgagcatgaagctcatgctgggagacttccagtataagacatttgcgaaagacatcgagcttgatttcaccggcagatgtgtcgggtgcattggctgttttgaaggattcgtgtgcgagatgcacatcacaaccacggttgaagctacatgcaacctggaggcctcttgtcaattctttcataatcagctccacatcaagcctgacgtgctgaaatactataccaagatgacctgccagacagatgaatacattccctccaaaatcaagatttgtaacaaggagtataaaatcaccgtcggcaaggtgcagaaaaatgacaagattgagatcgataacagcgaccaaacgtcctacatcaaagaaaaggatgagcgctgcaagacatggctgtgtcgggtgagagacgaagggatttctgtcatcttcgagcctcttctgaatatttttggaaactatggccggatcgccgttgctgtgattagcgccatcctcgcgctgatcattctcgtgtacatcctgatgcccatttgcatgcgcatcagagatattcttaaaaccaatgaacgggagttcctgatcgagtccaagtacaaatga

SEQ ID NO: 14198 - RNA, 4305 nt, synthetic construct
  misc_feature 1..4305: note = derived and/or modified CDS sequence (opt5) from FSV(86MSP18)__KX100131.1__GP
  source 1..4305: mol_type = other RNA
atgctgagcctcctgatccttgccctgctcggcctgtccacctctaaccccattgctacaagatgcttccacgggggacagcttatcgccgagagcaagtccgcgacgtctattagcgaattttgtctgaaagacgatgtgtccatgctcaagtctgaggtcatctacaccaaaaatgacacaggcctgttcgggcataacaaggtttttcggagctggaccattaaagattggaagctgtgcaatcctatcccgacagctggaggcaccatcaacgtgattgaagtgaataaggacctctccctgatgacaaaaacctatatctgtagccgcgattgcacgattaccatcgacaaggaggaagcccaaattatcttccagacagataaacttaaccactttgaggtctctgggaccacactgtccagcggatggttcaagtctaaagcctccgtgaccctcgacagaacgtgtgagcatgttaaggtgacatgcggcaagaaaagcctgcagtttcacgcttgtttcaagcatcacatgtcttgcgtccggtttttccacaataccattcttcccggcaacatgatcacatccatgtgtcagaatatcgaactgattatcattctcgggctgaccctggccatctttattctcatggtgatgatcaccaaaacatacatctgctatctgcttatgcctattttcatgcccatcgcttacctgtatggatgggcctacaacaagagctgtaaaaagtgcaattgctgtggcctcgcgtatcatccttttacgaactgcgggtcccactgtgtttgcggactgaaattcgaggcctctgatcgcatgcggattcatagagaaagcggcctttgtcaagggtacaagtccctgcgcatcgctagactcctgtgcaagagcaaaggatcttccctggtgattagcggcctcctgtctatgcttatcctgagcttcgtcacccccatcgagggcacaattaccaattaccctgactcccggaagtatacactcgaggaaatcaccgatgtggtggaggggctgatttctgaacagaacatcaaagagtacattgtcttttatacgagccttttcggatccctgatcctcctgctggcctttattatgagcatcacactctctaagatcacctccattctggctcgcagaaatgttatctactgtgaagagtgcagcatgtatcactctaaacggggcattaagtacaacggggacttcaccaacaagtgtggattttgcacatgtaatgagcaggaagatgccgagggcgtggtgatccacaaagtctccaagcgctgcacctataaataccagcttaagtgggcgaaagtgctgatgattacactcgttctgctgcttatcgcccaaaacacgatcctcattgtggctgccgaaaccgactgctgggctaaaaagagcctggacatcaattgtattgggccgatgctgaacatcggatcctgcacaaataagaacaccagatcttacgatacagaggcccagaagctcgtcagccagtccaaagtgtctcagctggacgccgatcaagctagccttctgggctccagcattgactctgcgatcaaggccatccgggctcagaaaacctatcccgccatgcatctcctggaaacgattttcctgatgaagaattgtgattactatacctcctttaaccacaatagcggctactctcaggccaagtggcgccttatcgctaaaacagggcatttcgacatttgctccagacacagcacccatcacttttgtcggtgcatcaacgatggaacaaagtgtcaaaatggcgactgggatttcgccggggagatgaacgagacctataattctaaaaacgacttttacctccacgatctgaatctgttctatacgatttttgaaaacgcgttccctggaacaaccgagagcctcttctaccagctgatccagaagagaaacacaatcggcgcttccaaagttcttgggaagctgattaccaaatacggcgacaataacatgtttgtgggagtctggaagttcggccagtatctcctgaccctgccctacatcaataacacagaacttagccaaaatcgccggcagacgattctcgccgcccaggagctgtcttccagaagccatcctgggcgccaggaatccatgtctagcgctatccaaggatccgtgaccaaggagtgccacaacgccaaagacgtcggctgtatttctccccggtttgggatcccgattggaaatctgacagcttgcggcgatagccctaactataagatctacaaaacccccgagaagctctataaatccaataacaagggggaagtgtggtgttctaatgacgttcattgcctgaacgatttcgagcctgccgacgaagaggtggtcaataaggtgaaaaagctgacatgctttcttaccgatgttagcgtgaaaacggacatcttctccgtcgcggccagcacatgtaagatggctgataaaggcgtgtgcaccgtgaacgacgccaagtggaatattatcaagtgtgattctggactctactattttaccgaccacagagagggccaggatacagggaacgacttcggagaatactgcatttcccacagctgtaacaccgagcgctttcccatcaatcccgatattctgaaagactgcacatgggaatttcattctcggaagtccaaatacatcagcacgatctctctggagtcccttgaagagtttagacgcgctatgaccgagaagctcagccacacactgaccatttataacttcaaacctacagccaatctgccgcatatccggcccacctacaagtttattacggcgaacggcgttgaaaattccgacgggatcgagagcgcctatattctctctagcatccctgctctgggaggcatctccgtcgggtacaacgtgcagaccaaggataatttcccccttctggacattatcgtgttcgtcaaatctgccgtgattagaacaacctataaccacatctacgatacaggccctaccattggaatcaatacacagcatgacgaacactgtaccggcccctgcccggctgttgtgcctcacaaggagaactggattacgtttagccaagaacgcacatcccggtgggggtgtgaggagttcggatgcctcgccatcaataccggctgtgtctttgggtcttgccaggatatcattcatcccgaaaccaaagtgtatagaaaggccgttgaggaagaggtggtcctgacagtgtgcatcaacttccctggaaataactactgtaccgaaattaatgctatcgagcccaaaattacggacgagatcgaactgcagtttaagacagttgataccaaaacacttcctaacctgctcgcggtgcagaaccacaagctgtacagcggccaaatcaatgacctcgggtccttctctcagggctgcggaaacgtccagaagaccaatcatagcattctgggcatggggacagccaaatttgattatgtgtgtcacggagcttcccggaaggacgtgatcgtccgcagatgctacaacaataacttcgatagctgtaaacttctgaaggaggaaacctctctcgtttttgccgacaatcatgagacgctggaggtggcccacaccaaacacctgattggcgaacttcaattcaagatcatgctgggggatattcggtataagtcctttgctgagagccccgaactcgagatcgacgccaaatgcgtgggatgtccgtcttgcttcgaatcctacagctgtaacttccagatcgtcacaaatattgacaccgtgtgctccgttgagggcccttgtacactgtttcataacagaatcattatctctgcgagcaagcagtcctatggcctcaaaatgagctgccagaccaagccctctcaaaatgaggagttcattatctgcaaccgcaaatactccgtgctgtttacgacaattgataagaatgacaagatcgaagtcaacaccggggatcagacaagctatatctacgaaaaagactctcggtgtaagacctggctttgcaaagtgagagatgagggaattagcgttctgttcgaacccctcaaggctttcttcggctcctacttttctatcattttctatgtggtcgtggggatcattgttctgtttctggtgatctacatcttccttcctatgtttttcaaactgaaggacgtcctcaagaaaaatgagtatctgtacctccaggagctgaagcaccgctga

SEQ ID NO: 14199 - RNA, 4314 nt, synthetic construct
  misc_feature 1..4314: note = derived and/or modified CDS sequence (opt5) from GERV__M21951.1__GP
  source 1..4314: mol_type = other RNA
atggccatcagcacctccctgctcattgtggctctgcttatcaagctgtgcctcgtcaacacagcgccccctatttctaaatgtttccaggacggcatcctgattgccgagcttaagagctcctctgggatcagcgaattttgcatcaaagatgacatttccatcctgaagtctgagattacgtacagcaaaaatgataccggaatcttcatgcactccaaggtttttagacattggacagtggctgactggaagcaatgtaaccacaccagcgccggcgggtctacaaatgtgctcgaagtcgataaaaacctgaatctggtggccaagaactatatgtgcacccggccgtgtgttattacaatcgacaaagagaatgctcagctcctgttccagaccgaacagcttaaccaatttgaggtgacgggaaccacaatttccaccggctggttcaagagcaaaacatctgtctccctggataatacctgcgagcatatcaaggtgacgtgtgggaagaaaagcctccagtttcacgcctgcttcaagcagcatatgtcttgtgttcgctttctgcacagatccgtgcttcccggatacatggctagctccatctgccagaacattgaactgatcattatcattatcctcacactggccatcttcatttttatgtgtatcattacccggacatatatctgctacctgatgctccctctgttcgcgcccattgcctatctttacggctggctgtataatcgctcttgcaaaaagtgtatctgctgtggcctcgcttaccacccttttaccaactgcgggagctactgtgtctgcggatccagattcgagaccagcgaccggatgcgcctgcatagagaatctggcctttgtcaagggttcaaatccctgcgggtggcccgcagcctctgcaagtctaaaggaagctccctggtgatctctattctgacagctatgctcatcctgagctttattacgccccttgaggccatgaccacaaattatcctgatgacaagaagttcaccctgaaagaggtcaacgatatcgttctcggcagagacatggaacaggagctgaagtccagcattcttatcctgatgtctatttgtgggatcggaatcattctcatctttttcggcctgacagtgctgctcgaaattgtgctggagcttatcgcgaaacggtccaccatcttttgcaaggaatgtaatctgattcacgataaaaagagcatgacgtaccgcggcgacttcacaaacaagtgcgggttttgcccgtgtggagagctcgaggaccccgaaggcctggtcatccataccaccagaaaatcttgcacatattacattaagatccggaacctgaaacttattatgctcatcttctccattgtgatcctgatgcagaatgccaccatgctggttgtggctggggagaactgttggacaaatacggaaatcaaggccgattgcgtcggacctctcattggccccagcgcttgtaccaacaaagggtccaagacatataagaccgtggcccaggagctggttacagcctctaaaatcacccaacttgacgctgataagtacgtgctgctcggagacacgattgaaagcgcgctggatgccatcacctcccagaaacactattctgctatgcatctgcttgagacaatgtttctcatgaagcactgcgactactacaaagtctatgagcacaatagcggctactcccagaccaagtggcgcctgattgccatcgccaacagcttcgatatctgtacaaatacccctacgcccaacttttgcaagtgtctgtctgactccagctgctctacaaccacactcaatttcgctacctccatgaacgccacctatacaagcaaagtggaatttttcaatcatgatttcacgctgtttcttgacattttcgaggcggcttttccgggctctgccaccgccttcctgtttaagaaaatcaaggaaaagaacccttaccaggctttcgagatgatggggaagattgccaataaatatcccaacaataagctcctggtcgtgatcctgaagtacggacaatatatggttggccttagccacgcttccacataccagctcaaacaggaatgggtggccaagagcctgtctctgaccagagcgcaacggacagggctcaaaatgtccatggccaacgctgagcctggacccgccaccaaggagtgtagcgatgctaaaacgattgcctgcctgacacccaagtttcaggtcgaagtgaacaatcttatgtcctgcggcgcgtctcctaacttcaagatctacgttaaaaccggggagctgtataaggcccatgacagaaatagcgtgtggtgtctcaacgacatgcactgcctgaccccgtacacacccgctaatgccgaaattatcaccacaatgaaaaagatggattgttggcaggacaaccctaaacagcccacggatgagtatgctatccctaagcgctcctgccaaatgaaggaccggggcctgtgtaattctggagccgataaatggaagattatcaaatgcgacaaccacaagctcttttacaccgatgcccttgagagacgcgaccccgctagcattgtcggctccaatcattgtttctctgaaaaatgccagatcgagcggtatccgattaaccctacaagcctgaccaattgtgaatggctgtacagagcggtgcgccccgagtatatcaagaagctctccctgcagacaatcgaagagtacaaaaaggccattgctgataaacttacccacacgctgcagctctaccattttgcccctctgctggagaaccttccccacatcaagcctacctataaatacattacagcccaagggacctatacagctgacggaatcgaaggcgccagcattaccacatctatccccgcgctgtccgggaccagcgtgggattcaagatcaatgctaaagatggcacggacctcctggatattgttgtctacatcaaggcctctgtggtgaagtccatttataaccacatctacgacacagggccgaccattaatatcaacagcaaacatgacgagctctgcaccggccagtgtcctaagaaaattcccgccgatcccaactggctgacattttctcaggaacggacctccagatggggatgcgaggagttcggctgccttgctatcaatacggggtgtgtctatggaagctgccaggacgtgatccgcacagaaaccaaggtttaccggaaagccaacgaggaaacagtgatgctgaccgtctgtattacataccctggccacaccttctgcacggatgtgaatgcgcatgagccgaagatcaccgacgaactcgagctgcaatttaagacaattgatatcaaatccctgcccaaccttgttgctgtgaccaatcacaagctgtatacagggcagattaacgacctcggaaccttcggccagatgtgtgggaatgtccagaaaacgaacacaagccataccggcgccggaacacctaagtttgattatacctgctactctgccagcagaaaagacatcatcattcgccggtgttacaataacaattatgattcctgcagactgctcaaccaagaatctgacctgcttttcgatgacaatcacgagaccctggtggtttacaacaataagcggctcaacggcgagctggctctgaaacttctgctcggggatatccagtataaactgtacacagaaaacatggagctcgaactggaggccaagtgtgtgggatgcgtcggctgttttgagagctaccagtgcaatcttcaaattacgtcctctctggacgaaaccgctctgtatctcgtgcccgtgagccacttccatgaccgcatccagattaaaacaaccaagaaagattacgccatgaagatctcctgcacaagagaccctggggataaggcgtcttttcgggtctgtggaaaaagctatgacttcaactttcacaccgttcccaagaatgataaaatcgaggtgaacgtgggcgacgaaacgtcctacattaaggagaaagataatagatgcgggcgctggctgtgtcgggtcagagacgaaggccttagcgtgatcttcgagcctctgaacaactttttcggaaattatctcaatatgttcctgtacattctcggcgggatcattctgctttttctggccctgtatatcctcatgcccatgtgcgctcgcctgagagatgagcttaagcggaacgaacgcctgcatcagatggagatgaagaaaagatga

SEQ ID NO: 14200 - RNA, 4260 nt, synthetic construct
  misc_feature 1..4260: note = derived and/or modified CDS sequence (opt5) from IACOV(BeAn314206)__JN572066.1__GP
  source 1..4260: mol_type = other RNA
atgagagtgatcgccctgttccacctcgtcatggttattaccgctaaccccgtgtttcatcggtgcttccagggcgggcaactgatccttgagaagaaaagccacgtgtccatgtctgaattttgtctgaaggacgatgtcagcatggtgaaatccgttgtggagtacgaaaagacaaataactctattgtcggaacgaataaagtgtatcgccagtgggttgtgagcgactggaagctctgccatcctatcaaggccgagggcgggggaattaacatcatcgaagtcgagaaagatctgaccattaagtccaatacatacatctgtaccacagactgcaccattacagtggataaagagaacgcgcagatcattttccagacctctaaacttaatcactttgaagtgacgggcaccacactgagcaccgggtggttcaaaacaaaggctgccgtcaccctcgaccaaacgtgtgagcatatcagagtttcctgcggaaagaaaagcattcagtttcacgcctgtttccggcagcacatgacatgcgtgcgctttctgcatagatctctgctcccgggctccatggctaacagcatctgtcagaatgtggaactgatcattatcattgtccttaccctgctcatcttcattgtgctgaacatcatcgccaagacatatatttgctaccttatgctgcccatctttatgcctattgcttatatctacggctggatttataatcggtcttgtaaaaagtgcgttaactgcgggctcgcctaccaccccttctccaattgtggaagccattgcgtgtgtggcgcgatctttcaaacctctgatcgcatgagaatgcaccgggagtccgggctgtgcagcggattcaaatccctgcgcgtcgccagagtgctctgtaagtctaaaagctccagcctggttatcgctattctttcttccctgctcatcctgagcttcgtgacccctattgagggccttgacctggaagagaagaagtactctctcagcgatctgcccgacatctatacaaaagaactgaacacgctctccgagaagattgccatcaatttttacatttctatcaccaacatgctgatcacaattatccttctgattgtcgctttctgcagccactgtatcaccaacaaaattgtgaagtataaagcctttctctgcacagaatgtgatatgtaccatacctataagaatatccggtacaacggggacttctgcaataagtgtggatcctgcacgtgcggcacaatggaggatcctaactataccaccatgcacaaagtcagcgacctgtgtcttgcggagccgaagcgcatcattcagaaaaagctgatgatcattctcatcatttttgtgatcatcgaaaatggcgcctgcctggcttctgccgaggaaaaatgtttcaaggagcatgactacaacattgaatgcatcgggcccctgattacaatgagaccttgtaccaagaaaacaatccaggaggttgctcggacgctcgtgaccgataagcagattgcccaagaggacacagaaaagatcgagctgcttcccgattccatcgtccaggcctggaatatgattgacaaccagctgaattacgatcaaatgtttctcatggaatatgctttcctgaagcgcgagtgcagctttttcgaagagtttgagcacaactctggagtgaatcagatcatgtggagaaccattgcgaaaacaggccatttcgacatctgtgccattcggtccagccagagattttgcaagtgtatgtccgaatctgtttactgcaaggatgctaactgggacatcgccaatgagatgaacgatacctatagcttcaaacctctgttctaccgccacgacgtgaaactttattccaagatttttaaggccgctttccaggggacgaccctcaaaacatacgaaaagtttctgaatgccaaaaacaagaccgagctgatcaacatgctcaagaaactgggaaagcggttcccctataataaccttctgatgggctttctcaaattcggggagctgctgtttgatcttacactcttcgacgcgctgccgaaggacaaaacctctagaacgagctccacaaccgctaagcgcgaatacgagaatctgcaagatgccaaggtcggagaacctacaagcgagtgtaaagacatgaagctcctgcagtgcatctctccccggtaccaggtgtccgtgggcagcgttattaaatgcggcgataccgaaaagaaaatctatgactttcacacccctgtctacaaacttgccacagatgagacgaagtggtgtagattcgacaagcattgcctgcacgagtgggtgcccattgataacgctcgcctcgaaatgctgaagaaactgaattgttggtataccgaccccacagagatggtggatatctacaccacatctcggaagtcctgcagaatgattaacaaagggacctgtaatatcaagaacgcccctatgacggtcatgcagtgcgacgatgaccttatcttttatacagatcatcgcagctctgctgacacccaaggagacattggcgaatactgtctcagccagaattgcgatgtgtcccggtatccgatcaacgttatggacgggatgacctgtacatgggagtacaataccgtgaagcccaaatacctgagcaagacagaactgaaaacgctcgaggagtataagagaaccctgcaggataaactttctcacaacctggaagtctaccacttccatatgacagccaattttcctcacattaagcccgtgtataaatacatcaccgcgggaggcgttgagacatccgacgggattgaaggcgccttcatcctcgtggatctgcctgctctgagcggaacctccgtcggccttacggtgctctctaaggacgatgttcccctgatggacgtgatcatttatatcaagagcgccgtcattaaagctacctacaaccatatctatgatacagggccgaccattggaatcaatgtgaagcacgaggaactgtgcacaggcccttgtccccagaacattcctcatcaagagcagtggctcaccttctcccaggagcgcacatctcggtgggggtgcgaagagtttggatgcctggccgtgggcgaagggtgtgtctacggcagctgccaggacatcatcaaaaaggagaccagagtttacaaaaaggtgtccgaggaaattaacgagatcacgttctgtattatctttcaaacaaatacctattgccagaccatgaacgcgattgaaccccagatcacaccttctcttgaggtgcaactggaaggactcgataccaagatcctgcccaatattctggcccttcagaaccacaaactgtacagcggccagatcaatgacctcgggtccttcggactggcttgtggcaacgtccagcaagtgaataagacgatttatggggccggacagccgaaatttgattacctctgccacggcgctaagcggaaagacatcattgttcgcaagtgttataacaataacttcgggagctgcaagctgcttacaatcgaggacaatctgatcgtggaggataactacaataccattaacgtcatcaatacaaaacatctcattggcaccgtgaagtctaaactgaacctgggagacatcagatataaactttttaacaagaagcctgagttcgaactggaagcccactgtgttggctgcgtggggtgttttgccaattacaactgcgagattaagatcgaatccacaattgatatgacctgccccatcagcggaccctgtgagttctttcataataacatcttcattcaggctgagcacacgaaatacgcgatgaagatgatctgcaaaaagcagcctgaccaaaccacagagttcaccatttgtgataaaaagtatcattttatcattgacacagtcgaaaagcacgatcagatcgaaatcgacgtgggcgatcagacctcttacattctcgagaaagacaatcggtgcgggacgtggatgtgtaaggttctggatgaaggactctccgtgatcttcgagccgctgaaacttctgctcggcaactattttcacatggccattgtcatcattatcgggctgatcgctctggccgtgattatctacattcttctgcccatgttcatgaagctcagagacacactgaaagccaatgagatcgcttatcagaaggaaatgaaaattaagtga

SEQ ID NO: 14201 - RNA, 4305 nt, synthetic construct
  misc_feature 1..4305: note = derived and/or modified CDS sequence (opt5) from ILEV(KO/2)__AY859372.1__GP
  source 1..4305: mol_type = other RNA
atgctgttccccatcattctcctgatgatccagcttgtgagctccacccctctgtctacaagatgctttcacgagggcacgctcgtcaaggaaaagattagcaccacatccatctctgagttctgtctgaaagacgatgttagcatgattaaatccgaaatcacctaccaaaagaacgacacaggggtgtatggacattctaaaatctaccggaattggattgtgaaggagtggaaggcctgcaacccggtccccagcgctggcgggtccatcaatgtgattgaagttaacgaggatatgagccttgccaccaaaaattatatctgtacacgcgactgcgtgattaccgtcgataaggaggacgcgcagatcgtgtttcagacggataacctgaatcacttcgaagtttctggaaccacactctccagcggctggtttaaaaccaaggcttctgtgacactggacagaacctgtgagcatattaaagtctcctgcgggaagaagacggtgcagttccacgcctgttttcggaaccatatgagctgcgtgcgcttctttcacaatacaatcctgcctggatacatggccacctctatctgtcaaaacattgaactcatcattatcattgtcctgacaatcgctatcttcattatgcttgttatcctgaccaaaacctatatttgctacctcctgatgcccctttttatgcctatcgcctattgttacggctgggcttacaataagtcctgcaaaaagtgcaactgttgcggcctggcctatcaccccttcacaaattgtgggagcttttgcgtgtgtggactcaaattcgaggcgtccgatagaatgcggattcatcgcgagtctggcctgtgccaggggtacaagagcctgagagtggcccggcgcctctgtaaatccaagggaagctctttcgtcatctccatcctgcttagcctgtttattctctctttcgtgacgcctatcgaaggcaccatgacaaactatccggaggaaagaaagtacaccctggaggaaattgctgacgttatcgaggggttttatcaggaggccaaaattaaggaatacatcgtgttctatagctccatttttggatctttcatccttatcagctccatgctgattctctacaaactgcagaatatcacatactttctgagcaagttcaacgtcatgtattgctctgagtgttccatgtaccacagcaaaaagaacattaagtatctcggcgattttaccaataaatgcggcttctgtacgtgcggggaactggaggacgctgaaggactttctatccataaggtgacaaaacggtgcacctacgcctatcaaatgacctggacaaagattatcctggcgaccctcctgatccttctgattggccagaacacactcctggttgtgtccgcccaggctgattgttgggagaaaacggagatcaccattgactgcatcgggcccatttttgcccctaatacatgtatcaagcaggaagagaagacctacgctaaagaagcccaaacactggtcgaccagaacaagatcagccaggccgatgctaaacaagtggacatgctcggagcgaccattgatgacgccatcaaggctattcgctcccagaaaacgtataccacaatgcacatgctggaggccatcttcctttctaagtactgcgattactatagcctgtttgaacacaattccggctactctcaggggaagtggagactcattgccaaaaccgagagcttcgacatctgttcccggcatacaacccaccatttctgccgctgtatgagcgatgagacgaagtgcaaaaacggagactgggattttgctggcgaaatgaactctacatatcactccaagagcaatttcctgctgcatgaccttagactcttttacaaaatctattctgccgcgttccccggcctgtccgaggctatgctgtacaagtttctcagcgaaaaagataccacaaatgccattaagctgcttgagaagctgttcaccaaatattcttacaacaatctcctggtcgggatcctgcggtttggaaagttcctttttagcatgtccattttcaacaccacagagctcggcggggcccagaaagctatgatcctgagacctacggacgaactgcgcaccacatacagcggaaagcaagagtctctctccaatagcgtggttggcgaacagacctccgactgtgtgaacatgaaaaagatttcttgcatcagcccccggtttaatattccgctgtcctctatgatcgcctgtgggaaccagcctaactatcagatctacaaggagcccagcaaatattacaagtccaataacaaacctaatacatggtgcaacaaggatattcactgccttaatgacttcgaatctatcgatcaaagcgctctggacagactcaaaaccatgacgtgttttctgattgatcccatcacaaccgaggacgtctattccattgccatccacagctgcaaggtgaaggataaaggccagtgtaccatccgcgacaagaaatggaacattatcaagtgcgattctgagctgctttactatacagaccatcgggaaggagaggataccggcaatgaaattgggcactactgtctctcccataaatgcggaacagacagataccccatcaaccctgagattatcaaggattgtatctgggaatttcgcagccggaagtctgagtatattaatagagttgacctggagtccctggaagagttcaaacgcgcgctcagcgacaagctgacgcacacccttacaatctacaactttaaaccgaccgccaatctgccccacattaagcctatctataaatacattacagctctcggcgtggaaaactctgatgggctggaggccgcttatatcctgacctccattcccgcccttggaggcacgagcatcgggtacaatatcatgaccaaggacaacttccctgtcatggatgtgattatctatgtgaaatccgcggttattcagacaacctacaatcatatctacgacacaggccccaccattggaatcaacagcaagcacgatgaaaagtgcacaggctcttgtccgcagaacatcacccatgaccaaaattggctcacgtttagccaggagcgggcctccagatgggggtgcgaggagttcggatgtctggctattaacacaggctgcgtctttgggtcttgccaggatatgatccgcagcgacaccaaagtgtataagaaagccctggaagaaaccgtggtcctcacagtgtgtattaattaccctggaaacaccttctgcacggaggttaattccgtggagacaaagatgaccgatgacgtcgaactgcagtttaaaacagtggataccaagacacttcccaacctgctcgctgttaccaatcacaagctgtattctggccaaatcaacgacctggggagcttctcccagatgtgtggcaatgtgcagaaaacgaactctaccgtcatgggagccggcacagtgaagtttgattacatttgccatggggccagccggaaagacatcatcattagacggtgttatatgaataactacgcttcctgcagccttctgaaggaggaaaaagacctcatcttcgcggataatcacgagaccattacagtttctaactccaagcacctggtgggagaactccaaatcaagctgatgcttggcgacattcgctataaactgtttgccgagagacctgagctcgaagtcgatgctaagtgtgtggggtgccccagctgtttcgagtcttactcctgcaatttccagatcgtgaccaacattgacacggtctgtacactggaaggaccttgcaccatctttcataaccggatcattatcagctccacaaaacagtcttacggcattaagatgagctgccccaccaaaccgaatcacatcgagaagttcaagatttgtaaccatgaatatgatatcctgtttgacaccgttgccaaaaatgataagatcgagattgacacaggggatcagacgcttttcgtgagagagaaagacacccgctgcaagacatggctgtgtcgggtgaaagatgaaggcatctccgtcatttttgagcctctcagagccttctttggaagctacttctctatcattttctatatcatcctggctgccattctcatcttcgtgggcgtttacatttttctgcccatgttcatgcgccttagagacgtgctgaagcggaacgaacacctctatctgcaagagatcaagcataaatga

SEQ ID NO: 14202 - RNA, 4305 nt, synthetic construct
  misc_feature 1..4305: note = derived and/or modified CDS sequence (opt5) from ILEV(R5964)__KF234074.1__GP
  source 1..4305: mol_type = other RNA
atgctgttccccatcattctcctgatgatccagcttgtgagctccacccctctgtctacaagatgctttcacgagggcacgctcgtcaaggaaaagattagcaccacatccatctctgagttctgtctgaaagacgatgttagcatgattaaatccgaaatcacctaccaaaagaacgacacaggggtgtatggacattctaaaatctaccggaattggattgtgaaggagtggaaggcctgcaacccggtccccagcgctggcgggtccatcaatgtgattgaagttaacgaggatatgagccttgccaccaaaaattatatctgtacacgcgactgcgtgattaccgtcgataaggaggacgcgcagatcatttttcagacggataacctgaatcacttcgaagtgtctggaaccacactctccagcggctggtttaaaaccaaggcttctgttacactggacagaacctgtgagcatatcaaagtgtcctgcgggaagaagacggtccagttccacgcctgttttcggaaccatatgagctgcgtgcgcttctttcacaatacaatcctgcctggatacatggccacctctatttgtcaaaacatcgaactcattatcattatcgtgctgacaatcgctattttcatcatgcttgtcattctgaccaaaacctatatctgctacctcctgatgcccctttttatgcctattgcctattgttacggctgggcttacaataagtcctgcaaaaagtgcaactgttgcggcctggcctatcaccccttcacaaattgtgggagcttttgcgtttgtggactcaaattcgaggcgtccgatagaatgcggatccatcgcgagtctggcctgtgccaggggtacaagagcctgagagtggcccggcgcctctgtaaatccaagggaagctctttcgtgatctccattctgcttagcctgtttatcctctctttcgtcacgcctattgaaggcaccatgacaaactatccggaggaaagaaagtacaccctggaggaaatcgctgacgtgattgaggggttttatcaggaggccaaaatcaaggaatacattgttttctatagctccatctttggatctttcatccttattagctccatgctgatcctctacaaactgcagaatattacatactttctgagcaagttcaacgtgatgtattgctctgagtgttccatgtaccacagcaaaaagaacatcaagtatctcggcgattttaccaataaatgcggcttctgtacgtgcggggaactggaggacgctgaaggactttctattcataaggtcacaaaacggtgcacctacgcctatcaaatgacctggacaaagatcatcctggcgaccctcctgattcttctgatcggccagaacacactcctggtggtttccgcccaggctgattgttgggagaaaacggagattaccatcgactgcattgggcccatctttgcccctaatacatgtatcaagcaggaagagaagacctacgctaaagaagcccaaacactggtggaccagaacaagattagccaggccgatgctgagcaagtcgacatgctcggagcgaccatcgatgacgccattaaagctatccgctcccagaagacgtataccacaatgcacatgctggaagccattttcctttctaaatactgcgattactatagcctgtttgagcacaattccggctactctcaggggaagtggagactcatcgccaagaccgagagcttcgacatctgttcccggcatacaacccaccatttctgccgctgtatgagcgatgaaacgaaatgcaagaacggagactgggattttgctggcgagatgaactctacatatcactccaaaagcaatttcctgctgcatgaccttagactcttttacaagatttattctgccgcgttccccggcctgtccgaagctatgctgtacaaatttctcagcgagaaggataccacaaatgccatcaaactgcttgagaagctgttcaccaagtattcttacaacaatctcctggtggggattctgcggtttggaaaattcctttttagcatgtccatcttcaacaccacagaactcggcggggcccagaaggctatgattctgagacctacggacgagctgcgcaccacatacagcggaaaacaagaatctctctccaatagcgtcgtgggcgagcagacctccgactgtgttaacatgaagaaaatctcttgcattagcccccggtttaatatcccgctgtcctctatgatcgcctgtgggaaccagcctaactatcagatttacaaggaacccagcaagtattacaaatccaataacaagcctaatacatggtgcaacaaagatatccactgccttaatgacttcgagtctattgatcaaagcgctctggacagactcaagaccatgacgtgttttctgatcgatcccattacaaccgaggacgtgtattccatcgccatccacagctgcaaagtcaaggataagggccagtgtaccattcgcgacaaaaagtggaacatcattaaatgcgattctgaactgctttactatacagaccatcgggagggagaagataccggcaatgagatcgggcactactgtctctcccataagtgcggaacagacagataccccattaaccctgaaatcatcaaagattgtatttgggagttccgcagccggaagtctgagtatatcaatagagtggacctggaatccctggaggagttcaagcgcgcgctcagcgacaaactgacgcacacccttacaatttacaactttaagccgaccgccaatctgccccacatcaaacctatttataagtacatcacagctctcggcgttgaaaactctgatgggctggaagccgcttatattctgacctccatccccgcccttggaggcacgagcatcgggtacaatattatgaccaaagacaacttccctgtgatggatgtcatcatttatgtgaagtccgcggtgatccagacaacctacaatcatatttacgacacaggccccaccatcggaatcaacagcaaacacgatgagaagtgcacaggctcttgtccgcagaacattacccatgaccaaaattggctcacgtttagccaggagcggacatccagatgggggtgcgaagagttcggatgtctggccatcaacaccggctgcgtttttgggtcttgccaggatatgattcgcagcgacaccaaggtctataaaaaggctctggaagagacagtggtgctcaccgtctgtatcaattaccctggaaacacgttctgcacagaggttaattccgtggaaaccaaaatgacagatgacgtggagctgcagtttaagaccgtcgatacaaaaacccttcccaacctgctcgccgtgacgaatcacaagctgtattctggccaaattaacgacctggggagcttctcccagatgtgtggcaatgttcagaagaccaactctacagtgatgggagctggcaccgtcaaatttgattacatctgccatggggccagccggaaggacatcattatcagacggtgttatatgaataactacgcctcctgcagccttctgaaagaagagaaggacctcattttcgctgataatcacgaaacaatcaccgtgtctaactccaaacacctggttggagagctccaaattaagctgatgcttggcgacatccgctataagctgtttgcggagagacctgaactcgaggtggatgccaaatgtgtcgggtgccccagctgtttcgaatcttactcctgcaatttccagattgtgacgaacatcgacacagtgtgtaccctggagggaccttgcacaatctttcataaccggattatcattagctccaccaagcagtcttacggcatcaaaatgagctgccccaccaagccgaatcacattgaaaaattcaagatctgtaaccatgagtatgatatcctgtttgacacagtcgctaagaatgataaaattgagatcgacacgggggatcagacccttttcgttagagaaaaggacacacgctgcaaaacctggctgtgtcgggtgaaggatgagggcatttccgtgatctttgaacctctcagagccttctttggaagctacttctctattatcttttatatcattctggccgctatcctcattttcgtcggcgtgtacatctttctgcccatgttcatgcgccttagagacgttctgaaacggaacgagcacctctatctgcaagaaattaagcataagtga

SEQ ID NO: 14203 - RNA, 4305 nt, synthetic construct
  misc_feature 1..4305: note = derived and/or modified CDS sequence (opt5) from MAGV__AY286443.1__GP
  source 1..4305: mol_type = other RNA
atggagctgctcatcattatcctgcttctgggcagcgccgcttcctctcccattagcaccagatgcttccacgggggacagctcatcgccgaatccaagtctgcgacaagcatttccgagttttgtctgaaagacgatgtgtctatgatcaagagcgaagtcacgtacatcaaaaacgacaccggcatttatgggcataataaggttttccggtcctggacaatcaaagattggaagctctgcaaccctattccgaccgctggaggcagcatcaatgtgattgaggtgaactctgacctgtccctcgccacacgcgcctacgtctgtagcagagattgcaccatcacaattgacaaggaagatgctcaaatcatctttcagaccgacaaactgaatcacttcgaggtgtctgggacgaccctgtccagcggatggtttaagacaaaagcctctgttaccctcgatcggacatgtgagcatattaaggtgacctgcggcaaaaagtccctgcagttccacgcttgttttaagcatcacatgagctgcatccgcttctttcaccatacgattcttcccggcacaatggtctcctctatgtgtcagaacatcgaactgattatcatcattgggctcaccctggtgatcttcattcttatggttatcctgacaaaaacctatatttgctacctcctgatgcctgtgtttatgcccgtcgcctatatctacggatgggcgtataataagagctgtaaaaagtgcaactgctgtggcctggcctaccaccctttcaccaattgcgggtcccattgtgtgtgcggactcaaatttgaggctagcgacagaatgcggctgcaccgcgaatctggcctttgtcaagggtacaagtccctgagaatcgcccggatgctctgcaaaagcaagggatctagcctggtgatttccggccttctgtctatgctcctgctgagcttcatcacacccattgagggcacgctcaccaactatcctaatgagaagcagtacacactggaagagatcgctgatgtcgttgaagggattatcaccgagcagcaccttaaagaatatgtggtgttctacacatccctgtttggaggcctcattctgcttctgaccctcatcctgagcatcacgattaacaaggtcacagacctgctcgcctctaccaatgtgatctattgtgaggagtgctccatgtaccatagcaaaaaggggattaaatataacggagatttcaccaataagtgtggcttttgcacatgttctgaacaggaggacgttgaaggggtgatcattcacaaggtctcccgcaaatgcacctacaagtaccaactgaaatgggtgagagttatcatgatcattcttgcgctgctcctgacaatccagaacacggtgctgattgtcgccgctgaggtggactgctggaccaagaaaagcatcgaaattgattgtatcggaccgcttctcaacatcggctcctgcacagacaagtctagccggacctatgagacagaggtcaataagctggtgcgccagtccaaagttacccatgccgatgctgaacagatttctatcctgggcagcacgctcgacaacgccattaaggccgtgagatcccaaaagacctacgagacaatgcacttcctggaaaccgtctttcttatgaagaattgtgattattacaacagcttcgagcataattctgggtattcccagacaaaatggcggctgatcgctaagaccagccactttgacatttgctctcgccactccacgcatcacttctgtagatgcgtgaacgaaggaacaaagtgtcagaatggcgattgggactttgcgggggagatgaacgatacctacaatagcaaaaacgacttctatctccatgatctggacctgttttacacacttctcgagaatgccttccccggaaccaccgaatctctgttttaccaactgctccagaagaaaaacacaacgggcgctagcaagctgcttgggaaactgatcaccaagtatggcaataacaatatgttcgttgagatctggaaattcggacagtacctcctgaagctgccttatattaacgacacagaactttccaccgatagaaagagcacaatcattaaatctcagcaagtgctctcccggagccagaccggccgccaggagtccctgtctagcgccacgcccgggacagccaccaaggagtgctccaacgctaaagacatcggatgtatttctcctcggtttggcatccccattgggaatctgaccgcctgcggagatagcccgaactacaaggtctataaaacacctgaaaagatctacaagtccaataacagaggcgaggtgtggtgttctgacgatgtgcactgcctcaccgacttcgaacccgcggaggaagaggttgtcaatcgcatcaaacagatgacatgctttctgacggatgtgaccacaaagaccgacgtgttcagcgtcgctatttccacatgtaaaatggtggataagggggtttgcaccgtgaacgacgccaaatggaatatccttaagtgtaacagcggcctgtattactttacggatcaccggggaggccaagacaccgggaatgatttcggagagtactgcatttctcattcctgtaacacagaaagatttcctatcaatcccgacgtcctcaaggactgcatttgggagtatcacagccgcaaatctaagtacatctccaccgtgagcctggaatctctggatgagttccggagagccatgtccgacaaacttagccatacactcatgatctataactttaagcccaccgctaatctgcctcacattaaaccgacatacaagttcatcaccgccaacggcattgaaaattccgatgggatcgacagcgcttatattctgtctagcatccccgccctcggaggcatgtccgttgggtacaacatccagacgaaggataactttcctctgcttgacattatcgtgttcattaaatctgcgatcattaagacaacctataatcatatctacgataccggccccacaattggaatcaacacccagcacgacgagcactgtacgggcccttgccccacactgatcccgcataaagagaattggctcacctttagccaggaacgcacatcccggtgggggtgtgaggagttcggatgcctggccattaacaccggctgtgtcttcgggtcttgccaagatatcattcaccctgaagctaaggtgtacagaaaagccatcgaagaggaggttgtgctgacagtctgcattacctttcccggaaatacgtattgtaccgaaatcaacgctatcgagcctaagattacagacgaaatcgagcttcagttcaaaaccgtggatacaaagaccctgcccaatctcctgatggtgcagaaccataagctctacagcggccagattaatgacctggggtccttttctcaaggctgcggaaacgtccagaaaacgaatcagagcgttatcggcgccgggacagcgaagttcgattatgtgtgtcacggagcctcccgcaaagacgtgattgtccggagatgctacaacaataactatgagagctgtaaacttctgaaagaagagacctctctcatctttgctgacaatcatgaaacactggaggtggccaacaccaagcacctgatcggcgaacttcaattcaagattatgctgggggatatccggtacaaatcctttgctgagagccctgagctcgaagttgacgccaagtgcgtgggatgtccctcttgcttcgagtcctatagctgtaactttcagattgtcaccaatatcgatacagtgtgctccgttgacggcccgtgtacgctgttccacaaccgcctcattatctctgccaccaaacagagctacggctttaagatgtcctgccctagaaaacccgaacccacagaggagttccagatttgcaatcggaagtacaacgtgctgttcaccacaatcgataagaatgacaaaatcgaaattaacaccggggatcaaacgagctatatctacgagaaggacaatagatgtaaaacatggctttgccgcgtccgggatgaaggaatttctgtgatctttgagcctctgaaggctttctttggctcctatttcagcattatcttttacgttgtggtcgggatcattgtgcttttcctgaccatctatatttttctgccgatgttctttaaacttagagacatcctgaagcgcaacgaatacctctatctgcaggagctcaagcataaatga

SEQ ID NO: 14204 - RNA, 4305 nt, synthetic construct
  misc_feature 1..4305: note = derived and/or modified CDS sequence (opt5) from MAGV(ts8)__AY286444.1__GP
  source 1..4305: mol_type = other RNA
atggagctgctcatcattatcctgcttctgggcagcgccgcttcctctcccattagcaccagatgcttccacgggggacagctcatcgccgaatccaagtctgcgacaagcatttccgagttttgtctgaaagacgatgtgtctatgatcaagagcgaagtcacgtacatcaaaaacgacaccggcatttatgggcataataaggttttccggtcctggacaatcaaagattggaagctctgcaaccctattccgaccgctggaggcagcatcaatgtgattgaggtgaactctgacctgtccctcgccacacgcgcctacgtctgtagcagagattgcaccatcacaattgacaaggaagatgctcaaatcatctttcagaccgacaaactgaatcacttcgaggtgtctgggacgaccctgtccagcggatggtttaagacaaaagcctctgttaccctcgatcggacatgtgagcatattaaggtgacctgcggcaaaaagtccctgcagttccacgcttgttttaagcatcacatgagctgcatccgcttctttcaccatacgattcttcccggcacaatggtctcctctatgtgtcagaacatcgaactgattatcatcattgggctcaccctggtgatcttcattcttatggttatcctgacaaaaacctatatttgctacctcctgatgcctgtgtttatgcccgtcgcctatatctacggatgggcgtataataagagctgtaaaaagtgcaactgctgtggcctggcctaccaccctttcaccaattgcgggtcccattgtgtgtgcggactcaaatttgaggctagcgacagaatgcggctgcaccgcgaatctggcctttgtcaagggtacaagtccctgagaatcgcccggatgctctgcaaaagcaagggatctagcctggtgatttccggccttctgtctatgctcctgctgagcttcatcacacccattgagggcacgctcaccaactatcctaatgagaagcagtacacactggaagagatcgctgatgtcgttgaagggattatcaccgagcagcaccttaaagaatatgtggtgttctacacatccctgtttggaggcctcattctgcttctgaccctcatcctgagcatcacgattaacaaggtcacagacctgctcgcctctaccaatgtgatctattgtgaggagtgctccatgtaccatagcaaaaaggggattaaatataacggagatttcaccaataagtgtggcttttgcacatgttctgaacaggaggacgttgaaggggtgatcattcacaaggtctcccgcaaatgcacctacaagtaccaactgaaatgggtgagagttatcatgatcattcttgcgctgctcctgacaatccagaacacggtgctgattgtcgccgctgaggtggactgctggaccaagaaaagcatcgaaattgattgtatcggaccgcttctcaacatcggctcctgcacagacaagtctagccggacctatgagacagaggtcaataagctggtgcgccagtccaaagttacccatgccgatgctgaacagatttctatcctgggcagcacgctcgacaacgccattaaggccgtgagatcccaaaagacctacgagacaatgcacttcctggaaaccgtctttcttatgaagaattgtgattattacaacagcttcgagcataattctgggtattcccagacaaaatggcggctgatcgctaagaccagccactttgacatttgctctcgccactccacgcatcacttctgtagatgcgtgaacgaaggaacaaagtgtcagaatggcgattgggactttgcgggggagatgaacgatacctacaatagcaaaaacgacttctatctccatgatctggacctgttttacacacttctcgagaatgccttccccggaaccaccgaatctctgttttaccaactgctccagaagaaaaacacaacgggcgctagcaagctgcttgggaaactgatcaccaagtatggcaataacaatatgttcgttgagatctggaaattcggacagtacctcctgaagctgccttatattaacgacacagaactttccaccgatcggaaaagcacaatcattaaatctcagcaagtgctctccagaagccagaccggccgccaggagtccctgtctagcgccacgcccgggacagccaccaaggagtgctccaacgctaaagacatcggatgtatttctcctcggtttggcatccccattgggaatctgaccgcctgcggagatagcccgaactacaaggtctataaaacacctgaaaagatctacaagtccaataacagaggcgaggtgtggtgttctgacgatgtgcactgcctcaccgacttcgaacccgcggaggaagaggttgtcaatcgcatcaaacagatgacatgctttctgacggatgtgaccacaaagaccgacgtgttcagcgtcgctatttccacatgtaaaatggtggataagggggtttgcaccgtgaacgacgccaaatggaatatccttaagtgtaacagcggcctgtattactttacggatcaccgggacggacaagataccggcaatgacttcggggagtactgcatttctcattcctgtaacacagaaagatttcctatcaatcccgacgtcctcaaggattgcatttgggagtatcacagccgcaaatctaagtacatctccaccgtgagcctggaatctctggacgagttccggagagccatgtccgataaacttagccatacactcatgatctataactttaagcccaccgctaatctgcctcacattaaaccgacatacaagttcatcaccgccaacggaattgaaaattccgacggcatcgatagcgcttatattctgtctagcatccccgccctcgggggaatgtccgttggctacaacatccagacgaaggacaactttcctctgcttgatattatcgtgttcattaaatctgcgatcattaagacaacctataatcatatctacgacaccgggcccacaattggcatcaacacccagcacgatgagcactgtacgggaccttgccccacactgatcctccataaagagaattggctgacctttagccaggaacgcacatcccggtggggctgtgaggagttcgggtgcctggccattaacaccggatgtgtcttcggctcttgccaagacatcattcacccggaagctaaggtgtacagaaaagccatcgaagaggaggttgtgcttacagtctgcattacctttcctgggaatacgtattgtaccgaaatcaacgctatcgagcccaagattacagatgaaatcgagctgcagttcaaaaccgtggacacaaagaccctccctaatctgctcatggtgcagaaccataagctgtacagcggacagattgatgaccttggctccttttctcaagggtgcggcaatgtccagaaaacgaaccagagcgttatcggagccggcacagcgaagttcgactatgtgtgtcacggggcctcccgcaaagatgtgattgtccggagatgctacaataacaattatgagagctgtaagctgctcaaagaagagacctctctgatctttgctgacaaccatgaaacactggaggtggccaataccaagcaccttatcggagaactgcaattcaagattatgctcggcgatatccggtacaaatcctttgctgagagccccgagctggaagttgacgccaagtgcgtggggtgtccttcttgcttcgagtcctatagctgtaactttcagattgtcaccaacatcgatacagtgtgctccgttgacggaccctgtacgcttttccacaatcgcctgattatctctgccaccaaacagagctacggctttaagatgtcctgcccgagaaaacctgaacccacagaggagttccagatttgcaaccggaagtacaatgtgcttttcaccacaatcgataagaacgacaaaatcgaaattaataccggcgatcaaacgagctatatctacgagaaggacaacagatgtaaaacatggctgtgccgcgtccgggatgaagggatttctgtgatctttgagcccctcaaggctttctttggatcctatttcagcattatcttttacgttgtggtcggcatcattgtgctgttcctgaccatctatatttttcttcctatgttctttaaactgagagacatcctcaagcgcaatgaatacctgtatctccaggagctgaagcataaatga

SEQ ID NO: 14205 - RNA, 4311 nt, synthetic construct
  misc_feature 1..4311: note = derived and/or modified CDS sequence (opt5) from MAGV(AG83-1746)__KX100113.1__GP
  source 1..4311: mol_type = other RNA
atgaagatgatcctgctcattatcattctgtgcgtgaaccttgccgctgccaatcccgtcgcgaccagatgtttccacggcgggcagctgatcgctgagacacggagcgccacgtccatttctgaattttgcctcaaagacgatgttagcatgatcaagtccgagatcacctacacaaagaacgacaccggaattttcggccattctaagatctataaaagctggctgattaaggattggaaactttgtaatcctgtgccgacagccgggggatccatcaacgtgattgaagtcaattctgacctgagcctcaccacaaaggcttacgtgtgctcccgcgattgtaccatcacgattgacaaggaggaagcccaaatcatctttcagaccgataaactgaaccacttcgaggttagcggcacaaccctgtcttccgggtggtttaagacaaaagctagcgtgaccctcgacagaacgtgcgagcatattaaggtcacatgtggaaagaaaaccctgcagttccacgcctgctttcggcatcacatgtcttgtgtgcgcttctttcacaatacaatccttcccggcaccatggttaactccatgtgccagaatattgaactgatcattatcctcggcctgacccttatcattttcacactgatggtgatcctcacgaagacctatatttgttacatcctgatgcctctgtttatgcccattgcgtatgcctacgggtgggcttataacaaaagctgcaagaaatgcaattgttgcggactcgcctaccatcctttcacaaactgtggctctcactgcgtctgtgggctgaagtttgaggcttccgatagaatgcggatccatcgcgaaagcggactttgccaaggctacaaatccctgagaatcgcccggctcctgtgtaagtctaaggggagctcccttattatcagcaccctgctctctatgctgctgctctccttcattacacccatcgagggaaccatgacgaattatcctgagacacgccagtacagcctggaagagattgcggacgtggtggaaggccttctgtctgagcagaacatcaaagaatatgtcgttttctacaccagcctctttggctccctgattcttctgctcgccttcatcctgtctatcaccctgacaaaggtgaccaatgctctcgccaaaacaaacgtgatttattgcgaggagtgtagcatgtaccacgctaagaaagggatcaagtataacggagattttacgaataagtgcggcttctgtacctgcgacgaacaggaggatgaagaggggattatcattcacaaagtctccaagaaatgcacatacagataccaactgcagtgggccaagatcatcatgattatccttgtgatgctgctcatgatgcagaacaccattctgatcgttgccgctgaaacagactgttggaccaaaaatagcctggagcttgactgcattggaccgctcctgacgatctctgattgttccaacaaggagagcaagaattatgaagaggaagcggccaaactggtgtctcagtccaagatcacccaagctgacgccgagcaggtcacaattctcggcaacaccatcgatacagccctgaaagctattcggagccagaagacctaccaaacgatgcatcttctggaatccgtgtttctcatgaaaaattgcgactattactctagcttcgagcacaactccgggtattctcaggccaagtggcgcctgatcgcgaagacaagccattttgatatttgttccagacacagcatgcatcacttctgccggtgtgttgctgacggaaccaaatgccagaatggcaactgggattttgccggcgagatgaataacacatactctaccaagaatgacttctatctgcacgatcttaacctctttttcaccctgcatgaaacagcctttcccgggacgaccgagtccctgttctaccagctcatcgctaaaaagaatacaaccggagccagcaaactgcttggcaagctgatcacaaaatacgggaacaacaaactcttcgtgggaatttggaagtttggccaatatctgctgacccttccttacgtcaatacgacagaactctctaaaacccgcaaggagaccatcctgaaaccccaccagattctgacaagatcccaagggggccggcctgagagcatgtctagcgctgaagtgggacagaccgccaaggagtgtgcgaacgccaaaaatgtcggctgcatctcccccagattcggggtgccgattggaaacctcacagcttgtggcaatagccctaactataagatctacaagacgcccaataaaatttataagtctaacaatcgcggggaagtttggtgctccgaggacgtgcattgcctggccgattttgaacctgctgacaccgaggtcgtgaacaaagttaagaaaatgacatgtttccttagcgacgtgaatacccgggccgatatcttttccatcgcgatttctgcctgcagaatggtcgacaagggagtgtgtacagtgaacggcgctaagtggaatatcctgaaatgcgagagcgggctctactatttcaccgatcaccgcgaaggccaggacacgggaaacgattttggcgagtactgtatttcccactcttgcaataccgaacggtaccccatcaaccccgacattctgaaggagtgtatctgggaatatcatagcagaaaatccaagtacatctctacaattaacctggagagccttgaggagttcaaacgcgccatgtccgataagctcagccacaccctgatggtttataattttaagcctacagctaacctgccgcatatcaaaccctcttacaagttcattaccgccaatgggatcgagaactccgacggactcgaaagcgcctatattctgtcttccatccctgctatcggcgggatgagcattggatacaatatccagacaaaagataactttccccttctggacctcattgtcttcgtgaagtctgcggtgatcaaaaccacgtataatcacatttacgatacaggccctaccatcgggattaacaccaatcatgacgagcactgcacaggcccctgtccgaccatcatccctcacaaggaaaactggctgacgttttcccaggagcggacaagcagatggggatgcgaggagttcggctgtctggccattaataccgggtgcgtcttcggatcctgccaggatgtgatccatcccgaaacaaaaatttaccgcaaggctgttgaagaggaggtggtccttaccgtgtgtatcaactttcctggcaatacattctgcaccgaaattaacgccatcgagcccaagatcacggacgaaattgagctgcaatttaaaaccgttgacacaaagaccctccctaatctgctcgccgtgcagaaccacaaactgtatagcgggcagatcaacgatcttggatctttcagccagggctgtgggaatgtccaaaagacaaaccagtccattctgggcgctggaaccgtgaaatttgactacgtttgccatggcgcctctcggaaggatatcattgtgagacgctgttatacgaataactacgacagctgcaagctcctgaaagaagaacggtccctgatcttcgcggataatcacgagacacttgaagtcgctaacaccagacatctgatcggggagctccagtttaagattatgctgggagacatccggtataaagccttcgccgaaaagcccgagctcgaaattgatgctaaatgtgtgggctgcccgtcttgttttgagagctactcctgctctttccaaatcgtgacaagcattgacaccgtctgttccgttgaggggccttgcaccctgtttcacaatcgcatcattatcacagccgcgaagcagagctatggagtgaagatgtcttgcaaaacgaagcccggccccgtggaagagttcagaatctgtaaccggaattacagagtctccttcgctaccattgataaaaacgacaagatcgaaattaatacaggcgatcagaccagctacatcgtggagaaagactctcgctgcaagacatggctttgtcgggttagagatgaagggatttccgtgatctttgagcctctgaaggccttctttggaagctatttctccgtcgccttttacatcattatcggcattgctgccctcttcctgatcatttatatctttctgccgatgttctttaaacttcgcgacgtgctgaagaaaaacgagtacctctatctgcaggaactcaagcacaaatga

SEQ ID NO: 14206 - RNA, 4305 nt, synthetic construct
  misc_feature 1..4305: note = derived and/or modified CDS sequence (opt5) from MAGV(BeAr 7272)__KX100104.1__GP
  source 1..4305: mol_type = other RNA
atggagctgctcatcattatcctgcttctgggcagcgccgcttcctctcccattagcaccagatgcttccacgggggacagctcatcgccgaatccaagtctgcgacaagcatttccgagttttgtctgaaagacgatgtgtctatgatcaagagcgaagtcacgtacatcaaaaacgacaccggcatttatgggcataataaggttttccggtcctggacaatcaaagattggaagctctgcaaccctattccgaccgctggaggcagcatcaatgtgattgaggtgaactctgacctgtccctcgccacacgcgcctacgtctgtagcagagattgcaccatcacaattgacaaggaagatgctcaaatcatctttcagaccgacaaactgaatcacttcgaggtgtctgggacgaccctgtccagcggatggtttaagacaaaagcctctgttaccctcgatcggacatgtgagcatattaaggtgacctgcggcaaaaagtccctgcagttccacgcttgttttaagcatcacatgagctgcatccgcttctttcaccatacgattcttcccggcacaatggtctcctctatgtgtcagaacatcgaactgattatcatcattgggctcaccctggtgatcttcattcttatggttatcctgacaaaaacctatatttgctacctcctgatgcctgtgtttatgcccgtcgcctatatctacggatgggcgtataataagagctgtaaaaagtgcaactgctgtggcctggcctaccaccctttcaccaattgcgggtcccattgtgtgtgcggactcaaatttgaggctagcgacagaatgcggctgcaccgcgaatctggcctttgtcaagggtacaagtccctgagaatcgcccggatgctctgcaaaagcaagggatctagcctggtgatttccggccttctgtctatgctcctgctgagcttcatcacacccattgagggcacgctcaccaactatcctaatgagaagcagtacacactggaagagatcgctgatgtcgttgaagggattatcaccgagcagcaccttaaagaatatgtggtgttctacacatccctgtttggaggcctcattctgcttctgaccctcatcctgagcatcacgattaacaaggtcacagacctgctcgcctctaccaatgtgatctattgtgaggagtgctccatgtaccatagcaaaaaggggattaaatataacggagatttcaccaataagtgtggcttttgcacatgttctgaacaggaggacgttgaaggggtgatcattcacaaggtctcccgcaaatgcacctacaagtaccaactgaaatgggtgagagttatcatgatcattcttgcgctgctcctgacaatccagaacacggtgctgattgtcgccgctgaggtggactgctggaccaagaaaagcatcgaaattgattgtatcggaccgcttctcaacatcggctcctgcacagacaagtctagccggacctatgagacagaggtcaataagctggtgcgccagtccaaagttacccatgccgatgctgaacagatttctatcctgggcagcacgctcgacaacgccattaaggccgtgagatcccaaaagacctacgagacaatgcacttcctggaaaccgtctttcttatgaagaattgtgattattacaacagcttcgagcataattctgggtattcccagacaaaatggcggctgatcgctaagaccagccactttgacatttgctctcgccactccacgcatcacttctgtagatgcgtgaacgaaggaacaaagtgtcagaatggcgattgggactttgcgggggagatgaacgatacctacaatagcaaaaacgacttctatctccatgatctggacctgttttacacacttctcgagaatgccttccccggaaccaccgaatctctgttttaccaactgctccagaagaaaaacacaacgggcgctagcaagctgcttgggaaactgatcaccaagtatggcaataacaatatgttcgttgagatctggaaattcggacagtacctcctgaagctgccttatattaacgacacagaactttccaccgatagaaagagcacaatcattaaatctcagcaagtgctctcccggagccagaccggccgccaggagtccctgtctagcgccacgcccgggacagccaccaaggagtgctccaacgctaaagacatcggatgtatttctcctcggtttggcatccccattgggaatctgaccgcctgcggagatagcccgaactacaaggtctataaaacacctgaaaagatctacaagtccaataacagaggcgaggtgtggtgttctgacgatgtgcactgcctcaccgacttcgaacccgcggaggaagaggttgtcaatcgcatcaaacagatgacatgctttctgacggatgtgaccacaaagaccgacgtgttcagcgtcgctatttccacatgtaaaatggtggataagggggtttgcaccgtgaacgacgccaaatggaatatccttaagtgtaacagcggcctgtattactttacggatcaccgggacggacaagataccggcaatgacttcggggagtactgcatttctcattcctgtaacacagaaagatttcctatcaatcccgacgtcctcaaggattgcatttgggagtatcacagccgcaaatctaagtacatctccaccgtgagcctggaatctctggacgagttccggagagccatgtccgataaacttagccatacactcatgatctataactttaagcccaccgctaatctgcctcacattaaaccgacatacaagttcatcaccgccaacggaattgaaaattccgacggcatcgatagcgcttatattctgtctagcatccccgccctcgggggaatgtccgttggctacaacatccagacgaaggacaactttcctctgcttgatattatcgtgttcattaaatctgcgatcattaagacaacctataatcatatctacgacaccgggcccacaattggcatcaacacccagcacgatgagcactgtacgggaccttgccccacactgatcccgcataaagagaattggctcacctttagccaggaacgcacatcccggtggggctgtgaggagttcgggtgcctggccattaacaccggatgtgtcttcggctcttgccaagacatcattcaccctgaagctaaggtgtacagaaaagccatcgaagaggaggttgtgctgacagtctgcattacctttcccgggaatacgtattgtaccgaaatcaacgctatcgagcctaagattacagatgaaatcgagcttcagttcaaaaccgtggacacaaagaccctgcccaatctcctgatggtgcagaaccataagctctacagcggacagattaatgatctgggctccttttctcaagggtgcggcaacgtccagaaaacgaatcagagcgttatcggagccggcacagcgaagttcgactatgtgtgtcacggggcctcccgcaaagacgtgattgtccggagatgctacaacaataactatgagagctgtaaacttctgaaagaagagacctctctcatctttgctgataatcatgaaacactggaggtggccaacaccaagcacctgatcggagaacttcaattcaagattatgctgggcgacatccggtacaaatcctttgctgagagccctgagctcgaagttgatgccaagtgcgtggggtgtccctcttgcttcgagtcctatagctgtaactttcagattgtcaccaatatcgacacagtgtgctccgttgatggaccgtgtacgctgttccacaaccgcctcattatctctgccaccaaacagagctacggctttaagatgtcctgccctagaaaacccgaacccacagaggagttccagatttgcaatcggaagtacaacgtgctgttcaccacaatcgacaagaatgataaaatcgaaattaacaccggcgaccaaacgagctatatctacgagaaggataatagatgtaaaacatggctttgccgcgtccgggacgaagggatttctgtgatctttgagcctctgaaggctttctttggatcctatttcagcattatcttttacgttgtggtcggcatcattgtgcttttcctgaccatctatatttttctgccgatgttctttaaacttagagatatcctgaagcgcaacgaatacctctatctgcaggagctcaagcataaatga

SEQ ID NO: 14207 - RNA, 4311 nt, synthetic construct
  misc_feature 1..4311: note = derived and/or modified CDS sequence (opt5) from MAGV(CbaAr 426)__KX100110.1__GP
  source 1..4311: mol_type = other RNA
atgaagatgatcctgctcattatcattctgtgcgtgaaccttgccgctgccaatcccgtcgcgaccagatgtttccacggcgggcagctgatcgctgagacacggagcgccacgtccatttctgaattttgcctcaaagacgatgttagcatgatcaagtccgagatcacctacacaaagaacgacaccggaattttcggccattctaagatctataaaagctggctgattaaggattggaaactttgtaatcctgtgccgacagccgggggatccatcaacgtgattgaagtcaattctgacctgagcctcaccacaaaggcttacgtgtgctcccgcgattgtaccatcacgattgacaaggaggaagcccaaatcatctttcagaccgataaactgaaccacttcgaggttagcggcacaaccctgtcttccgggtggtttaagacaaaagctagcgtgaccctcgacagaacgtgcgagcatattaaggtcacatgtggaaagaaaaccctgcagttccacgcctgctttcggcatcacatgtcttgtgtgcgcttctttcacaatacaatccttcccggcaccatggttaactccatgtgccagaatattgaactgatcattatcctcggcctgacccttatcattttcacactgatggtgatcctcacgaagacctatatttgttacatcctgatgcctctgtttatgcccattgcgtatgcctacgggtgggcttataacaaaagctgcaagaaatgcaattgttgcggactcgcctaccatcctttcacaaactgtggctctcactgcgtctgtgggctgaagtttgaggcttccgatagaatgcggatccatcgcgaaagcggactttgccaaggctacaaatccctgagaatcgcccggctcctgtgtaagtctaaggggagctcccttattatcagcaccctgctctctatgctgctgctctccttcattacacccatcgagggaaccatgacgaattatcctgagacacgccagtacagcctggaagagattgcggacgtggtggaaggccttctgtctgagcagaacatcaaagaatatgtcgttttctacaccagcctctttggctccctgattcttctgctcgccttcatcctgtctatcaccctgacaaaggtgaccaatgctctcgccagaacaaacgtgatttattgcgaggagtgtagcatgtaccacgctaaaaaggggatcaaatataacggagattttacgaataagtgcggcttctgtacctgcgacgaacaggaggatgaagaggggattatcattcacaaggtctccaaaaagtgcacataccggtaccaactgcagtgggccaaaatcatcatgattatccttgtgatgctgctcatgatgcagaacaccattctgatcgttgccgctgaaacagactgttggaccaagaatagcctggagcttgactgcattggaccgctcctgacgatctctgattgttccaacaaagagagcaagaattatgaagaggaagcggccaagctggtgtctcagtccaaaatcacccaagctgacgccgagcaggtcacaattctcggcaacaccatcgatacagccctgaaggctattcgcagccagaaaacctaccaaacgatgcatcttctggaatccgtgtttctcatgaagaattgcgactattactctagcttcgagcacaactccgggtattctcaggccaaatggagactgatcgcgaagacaagccattttgatatttgttcccggcacagcatgcatcacttctgccgctgtgttgctgacggaaccaagtgccagaatggcgattgggactttgccggcgagatgaacaatacatactctaccaaaaacgatttctatctgcacgaccttaatctctttttcaccctgcatgaaacagcctttcccgggacgaccgagtccctgttctaccagctcatcgctaagaaaaacacaaccggagccagcaagctgcttggcaaactgatcacaaagtacggaaattctaaactcttcgtggggatttggaagtttggccaatatctgctgacccttccttacgtcaacacgacagaactctccaagaccagacgggagaccatcctgaaaacacaccagattctgaccagaagccaagggggccgctctgagagcatgtccagcgctgaagtgggacagatcgccaaggagtgtgcgaacgccaaaaatgtcggctgcatttctccccggttcgggatccctattggaaacctcacagcttgtggcaattcccccaactataagatctacaaaacgccgaataagatctataagagcaacaatagaggggaagtgtggtgctccgaggatgttcattgcctggccgactttgaacctgctgacaccgaggtggtcaacaaagtgaagaaaatgacatgtttcctttctgatgttaatacccgcgccgacatttttagcatcgcgatttccgcctgccggatggtggataagggagtctgtacagtgaacggcgctaaatggaatatcctgaagtgcgagtctgggctctactatttcaccgaccacagagaaggccaggatacgggaaacgactttggcgagtactgtattagccactcctgcaataccgaacgctaccccatcaaccctgatatcctgaaggagtgtatttgggaatatcattctcggaaaagcaagtacatctccacaattaatctggagagccttgaggagttcaaaagagccatgtctgacaagctctcccacaccctgatggtgtataactttaaacccacagctaacctgccccatatcaagcctagctacaagttcattaccgccaatgggatcgaaaactctgatggactcgaatccgcctatatcctgagctctattccggctatcggcgggatgtccattggatacaatatccagacaaaagacaactttccccttctggatctcattgttttcgtcaagagcgcggtgatcaaaaccacgtataatcacatttacgacacaggccctaccatcgggatcaacaccaatcatgatgagcactgcacaggcccctgtcctaccattatcccccacaaggaaaactggctgacgttttcccaggagcgcacaagccggtggggatgcgaggagttcggctgtctggccattaataccgggtgcgtgttcggatcttgccaggacgtcatccatccggaaacaaaaatttacagaaaggctgtggaagaggaggttgtgcttaccgtctgtatcaactttcctggcaatacattctgcaccgaaatcaacgccattgagcccaaaatcacggacgaaattgagctgcaatttaagaccgtggatacaaagaccctccctaatctgctcgccgttcagaaccacaaactgtatagcgggcagatcaatgaccttggatccttctctcagggctgtgggaacgtgcaaaagacaaaccagagcattctgggcgctggaaccgtcaaatttgattacgtgtgccatggcgcctcccgcaaggacatcatcgttcggagatgttatacgaataactacgattcttgcaaactcctgaaggaggaacggagcctgattttcgcggacaatcacgagacacttgaagtggctaacacccgccatctgatcggggagctccagtttaagattatgctgggagatatcagatataaagccttcgccgaaaagcccgagctcgaaattgacgctaaatgtgtcggctgcccttcctgttttgagtcttacagctgcaatttccaaatcgtgacatccattgataccgtgtgtagcgtcgaggggccctgcaccctgtttcacaaccggatcatcattacagccgcgaagcagtcttatggagttaaaatgtcctgcaagacgaagccgggccctgtggaagagttcaccatctgtaatagaaactaccgcgtgagcttcgctacaattgacaaaaatgataagatcgaaattaacaccggcgaccagacatcttacatcgtcgagaaagattcccggtgcaagacctggctttgtagagtgcgcgacgaagggatcagcgttatttttgagcccctgaaagccttctttggatcctatttctctatcgccttttacattatcattggcatcgctgccctcttcctgatcatttatatctttctgcccatgttctttaaacttagagacgtgctgaagaaaaatgagtacctctatctgcaggaactcaagcacaaatga

SEQ ID NO: 14208 - RNA, 4305 nt, synthetic construct
  misc_feature 1..4305: note = derived and/or modified CDS sequence (opt5) from MAGV(CoAr 3363)__KX100107.1__GP
  source 1..4305: mol_type = other RNA
atgctgagcctcctgatccttgccttcctgggcctctccacctctaaccccattgctacaagatgctttcacgggggacagctgatcgccgagagcaagtccgcgacgtctattagcgagttctgtcttaaagacgatgtgtccatgctgaagtctgaagtcgtttacaccaaaaatgacacaggcctctttgggcataacaaggtgttccggagctggaccatcaaagattggaagctgtgcaatcctattccgacagctggaggcaccatcaacgtgatcgaagtcaataaggacctgtccctcatgacaaaaacctatatttgtagccgcgattgcacgatcaccattgacaaggaggaagcccaaatcatttttcagacagataaactgaaccacttcgaggtgtctgggaccacactttccagcggatggtttaagtctaaagcctccgttaccctggacagaacgtgtgagcatgtgaaggtcacatgcggcaagaaaagcctccagttccacgcttgttttaagcatcacatgtcttgcgtgcggttctttcacaataccatcctgcccggcaacatgattacatccatgtgtcagaatatcgaacttatcattatcctggggctcaccctggccattttcatcctgatggttatgctcaccaaaacatacatttgctatctgcttatgcctatctttatgcccatcgcttacctgtatggatgggcctacaacaagagctgtaaaaagtgcaattgctgtggcctcgcgtatcatcctttcacgaactgcgggtcccactgtgtgtgcggactgaaattcgaggcctctgatcgcatgcggattcatagagaaagcggcctttgtcaagggtacaagtccctgcgcatcgctagactcctgtgcaagagcaaaggatcttccctggtcattagcggcctcctgtctatgcttatcctgagctttgtgacccccattgagggcacaatcacctcctaccctgagtctcggaagtatacactcgaagagatcaccgacgtggtcgaagggctggttagcgagcagaatattaaagaatacatcgtgttctatacgtccctttttggaagcctgattctcctgctggccttcatcatgtctattacactctccaagatcaccagcattctggctcgcagaaacgtgatctactgtgaggagtgctctatgtatcactccaaacggggcatcaagtacaatggggattttaccaacaagtgtggattctgcacatgtaacgaacaggaggacgccgaaggccttgtcattcacaaagtgagcaagcgctgcacctataaatgccagctgaagtgggcgaaagttctcatgatcacactggtgctgcttctcattgcccaaaatacgatcctgattgtcgctgccaagaccgattgttggacaaagaaatccctggacatcgactgcatcgggccgatgctcgatattggatcttgtaccaacaagaatacaagaagctacgacaccgaggctcagaaactggtgacgcagtccaaggtttctcagcttgatgccgaccaagccagcctgctcggctccagcatcgattctgctattaaagcgatccggacccagaagacataccccaccatgcatctgctggaaacaatttttcttatgaagaactgcgactattacacctccttcaatcacaacagcggctattctcaggcccgctggagactcatcgctaaaacggggcattttgatatctgttcccggcacagcacacatcacttctgcagatgtatttctgacggaaccaagtgccaaaatggcgattgggactttgccggggagatgaacgagccttacaatagcaaaaacgatttctatctgcacgacctgaatctcttttacacaatcttcgaaaacgccttccccggaaccaccgagtccctgttttatcagcttattcagaagcgcgacacaacgggcgctagcaaagtgctggggaagctcatcaccaaatacggcaataacaatatgttcgtcggagtgtggaagtttggccagtacctgctgacacttccttatattaacaacaccgaactctctcaaaatcggaagcagacaatcctggccacccaggagcccctgtccagaagccatccggggcgccaggaatccatgtctagcgcgatccaaggatccgtcacgaaagagtgtcacaacgctaaggatgtgggctgcatttctcctcggttcgggatccccattggaaatctcacagcctgtggcgacagccctaactacaaaatctataagacccccgagaaactgtacaagtccaataacaagggggaagtttggtgctctaatgatgtgcattgccttaacgactttgagcccgccgatgaagaggtcgtgaataaagttaagaaactgacctgtttcctcacagacgtgctggtcaagaccgatatttttagcgtggctgcctccacatgcaaaatggctgacaagggcatctgtacggtgaacgatgccaagtggaatattatcaaatgcgacagcggactgtattacttcaccgatcacagagagggccaggacacagggaacgattttggagaatattgtatctctcactcctgcaataccgagcgcttccctattaacccggacatccttaaggactgtacatgggaatttcatagccggaaatctaagtacatttccaccatcagcctcgagtctctggaagagttcagacgcgcgatggccgagaaactgtcccacacgctcaccatttacaattttaagcccacagctaacctgcctcatatccggcccacctataagttcatcacagccaacggcgttgaaaatagcgatgggattgagtccgcttacatccttagctctattcctgccctgagcggaatctccgtcggctataacgtgcagaccaaagacaatttccccctcctggatattatcgtgtttatcaagtctgcggtcattagaacaacctacaaccacatctatgacacggggccgacaattggcatcaatacccagcatgatgaacactgcaccggaccttgtcccgccgtggttcctcacaaagagaactggattacattcagccaagaacgcacctcccggtggggctgcgaggagtttgggtgtctggctatcaatacgggatgcgtgttcggctcttgccaggacattatccatcccgaaacaaaggtctacagaaaagccgtggaggaagaggttgtgcttaccgtctgtatcaactttcctgggaataactattgcacagaaattaatgctatcgagcccaagattaccgatgagatcgaactgcagttcaaaacagtggacaccaagacgctcccgaacctgctcgccgttcagaatcacaagctgtacagcggacaaattaacgatcttggctccttttctcaggggtgtggcaatgtgcagaaaaccaaccatagcatcctgggaatgggcacagccaagttcgactacgtctgccacggggcttcccggaaagatgtgatcgtgcgcagatgttataacaataactttgacagctgcaagctcctgaaagaggaaacctctctgattttcgcggataatcatgagacacttgaggtcgcccacaccaagcacctgatcggagaactccaatttaagattatgctgggcgacatccggtacaaatccttcgctgagagccctgaactcgagattgacgccaagtgtgttgggtgcccctcttgtttcgaatcctatagctgcaactttcagatcgtgacgaatatcgatacagtgtgttccgtcgagggaccctgcaccctgttccataacagaattatcatttctgccaataaacagagctacggccttaagatgtcctgccagacaaaacctaaccaaaatgaggaatttatcatttgtaaccgcaagtatagcgtgctgttcaccaccatcgacaagaatgataaaattgaggttaacacaggcgaccagacgtcttacatctatgaaaaggattcccggtgcaaaacctggctctgtagagtgcgcgacgaggggatcagcgtcctgtttgaaccgctgaaggctttctttggatcttacttcagcattatcttttacgtggttattggcatcattgtgcttttcctgatcgtctatatctttctccccatgttctttaaactgaaggatgtgctcaagaaaaatgagtacctgtatcttcaggagctgaagcacaaatga

SEQ ID NO: 14209 - RNA, 4305 nt, synthetic construct
  misc_feature 1..4305: note = derived and/or modified CDS sequence (opt5) from MAGV(OBS 6657)__KX100116.1__GP
  source 1..4305: mol_type = other RNA
atggagctgctcatcattatcctgcttctgggcagcgccgcttcctctcccgtgagcaccagatgcttccacgggggacagctcattgccgaatccaagtctgcgacaagcatctccgagttttgtctgaaagacgatgtctctatgattaagagcgaagttacgtacaccaaaaacgacacaggcatctatgggcataataaggtgttccggtcctggaccatcaaagattggaaactttgcaaccctattccgacagctggaggcagcatcaatgtgattgaggtcaactctgacctgtccctcgccaccaaggcctacgtgtgtagccgcgattgcacaatcaccattgacaaggaagatgctcaaatcatttttcagacggacaagctgaatcacttcgaggtttctgggaccacactgtccagcggatggtttaaaaccaaggcctctgtgacactcgatagaacctgtgagcatatcaaagtcacgtgcggcaagaagtccctgcagttccacgcttgttttaaacatcacatgagctgcatccggttctttcaccatacaattcttcccggcaccatggtgtcctctatgtgtcagaacatcgaactgattatcattatcgggctcacactggttcttttcatcctgatggtgattctcaccaagacctatatctgctacctgctgatgcctatttttatgcccatcgcctatatttacggatgggcgtataataaaagctgtaagaaatgcaactgctgtggcctcgcctaccaccctttcacaaattgcgggtcccattgtgtctgcggactgaagtttgaggctagcgaccgcatgagaatccaccgggaatctggcctttgtcaagggtacaaatccctgcgcatcgccagaatgctctgcaagagcaagggatctagcctggtgatttccggccttctgtctatgctcctgctgagcttcatcacgcccattgagggcaccctcacaaactatcctaatgagcggcagtacaccctggaagagatcgctgatgtggtcgaagggattcttacagagcagcacctgaaagaatatgttgtgttctacacctccctctttggaggcctgatccttctgctcacgctgattctgagcatcacaatcaacaaggtgaccgacctcctggcctctaccaatgtcatttattgtgaggagtgctccatgtaccatagcaaaaaggggatcaaatataacggagatttcacaaataagtgtggcttttgcacctgttctgaacaggaggacattgaaggggtggttatccacaaggtgtcccgcaaatgcacatacaagtaccaacttaaatgggtcagagtgattatgatcatcctggcgctcctgctgacgcttcagaacaccgttctcattgtggccgctgaggtcgactgctggacaaagaaaagcatcgaaattgattgtatcggaccgctgctgaacattgggacctgcacagacaagtcctctcggacctatgagacggaggtgaataagctcgtccgccagagcaaagtgacccaggccgatgctgaacaagtttccatcctgggctctacacttgacagcgccatcaaggccattagatcccagaaaacctacgagacaatgcatttcctggaaaccgtgtttctcatgaagaactgtgattattacagctctttcgagcacaattccggctatagccagacgaaatggcggctgatcgctaagacatctcattttgacatttgctcccgccacagcgcgcaccatttctgtagatgcgtcaacgaaggaaccaagtgtcaaaatggcgattgggactttgcccgggagatgaacgatacatacaattctaaaaacgacttctatctgcacgatcttgacctcttttacaccctgttcgagaatgcttttcccgggaccacagaaagcctgttctaccagctcctgcagaagaaaaacacgaccggagcctccaaacttctgggcaagctcatcacaaagtatgggaataacaatctgttcgtgggcatttggaaatttggacagtacctgcttaagctcccttatatcaacgacaccgagctgagcacagatagaaagtctaccatcatgaaatcccaacagatgctgagccgctcccagacgggccggcaggaatctctcagctccgccacacccgggaccgctaccaaggagtgctctaatgccaaagacattggatgtatcagccctagattcggcattcccatcgggaacctgacagcgtgcggagattccccgaactacaagatttataaaacccctgagaagatctacaagtctaataacaaaggcgaagtttggtgtagcgacgatgtgcattgccttgctgactttgagcccgccgaagaggaagtcgtgaatcgcattaagcaaatgacatgcttcctgacggatgtgaccacaaaaaccgacgtgttttccgtcgccatcagcacatgtaagatggctgataaaggggtgtgcaccgtgaacgacgccaagtggaatatcctcaagtgtaactctggcctgtattacttcacggatcaccgggacggacaggataccggcaatgactttggggagtactgcatttcccacagctgtaacacagagagattccctatcaatcccgacgtcctgaaagattgcatttgggaatatcattctcgcaagtccaaatacatcagcaccatttctcttgagtccctcgacgaatttcggagagctatgagcgataagctgtcccacacactgatgatctataacttcaaacccaccgccaatctccctcatatcaagccgacatacaagtttattaccgcgaacggaatcgagaatagcgacggcattgattctgcctatatcctgagctccattcccgctcttgggggaatgtctgtgggctacaacgttcagacgaaagacaatttccctctgctcgatatcatcgtgtttattaagagcgccatcattaaaacaacctataaccacatctacgacaccgggcccacaattggcatcaacacccagcatgatgaacactgtacgggaccttgccccacactgattccgcacaaggagaattggctgaccttctcccaagagcgcacatctcggtggggctgtgaagagttcgggtgccttgctatcaacaccggatgtgtctttggcagctgccaggacatcattcatcctgaagccaaagtgtacagaaaggcgatcgaggaagaggttgtgctgacagtctgcattaccttccccgggaatacgtattgtaccgagatcaacgccattgaacctaaaatcacagatgagatcgaactccagtttaagaccgtggacacaaagaccctgcccaatctcctgatggttcagaaccacaaactttactccggacaaattaatgatctgggctctttcagccaggggtgcggcaacgtgcagaagacgaatcaatccgtcatcggaacaggcaccgctaaatttgactatgtgtgtcatggggccagccgcaaggacgtgattgtccggagatgctacaacaataactatgagtcttgtaaactcctgaaggaggaatccagcctgatcttcgctgataatcacgagacacttgaagttgccaacaccaagcatctgattggagagctccagtttaaaatcatgctgggcgacatccggtacaagtctttcgccgaatcccctgagctcgaggtggatgctaaatgcgtggggtgtcccagctgctttgaatcctattcttgtaatttccagattgtcaccaacatcgacacagtgtgcagcgttgatggaccgtgtacgctgtttcacaaccgccttattatctccgcggccaagcagagctacggcctgaaaatgtcttgctccagacggcctgagcaaaccgaagagttccagatttgcaatagaaagtacagcgttctcttcacaaccatcgacaagaacgataaaattgaaatcaatacaggcgaccagacctcttatatctacgagaaggataaccgctgtaaaacgtggctgtgccgggtcagagacgaggggattagcgtgatctttgaacccctgaaggctttctttggatcctatttctctattatcttttacgttattgtgggcatcatcgtccttttcctgattatctatatttttctccccatgttctttaaactgcgcgatatcctcaagagaaatgagtacctgtatcttcaggaactgaagcacaaatga

SEQ ID NO: 14210 - RNA, 4302 nt, synthetic construct
  misc_feature 1..4302: note = derived and/or modified CDS sequence (opt5) from NORV(0234)__EU004188.1__GP
  source 1..4302: mol_type = other RNA
atgatctggttcattctgctcctggccatcgctcccagctttggcacccctattgccacaagatgcttccacgggggacagcttatcgcggaggctaagtcccaaacgtctattagcgaattttgtctgaaagacgatgtgtccatgatcaagtctgaggtcacctacacaaagaacgacaccggcatcttcgggcatagcaaggtttatcggtcctggacaattaaagattggaagctctgcaatccggtgcccaccgtgggaggctctatcaacgtcattgaagtgacagccgacctgagcctttccaccaaggcctacgtttgtagccgcgattgcacgatcaccattgacaaagagggggctcagatcgtgtttcagacagataagctgaatcacttcgaagtctctggaaccacactctccagcggctggtttaaaaccaaggcctctgtgacgctggacagaacatgtgagcatattaaagttacctgcggcaagaagacactgcagttccacgcttgttttaaacatcacatgtcctgcatccggttctttcacaacaccatcctccctgggagcatggtggcctctatgtgtcaaaatattgagctgatcattatccttggactgaccctcattatcttcatcctgatggcgattcttacaaagacgtatatctgctacctgctcatgcccatttttatgcctatcgcctatgcttacggctgggcctataacaaatcctgtaagaaatgccattgctgtgggctggcttaccaccccttcaccaattgcggaagccattgtgtctgcggcctgaagttcgaagcctccgatcgcatgcggattcacagagagtctgggctctgtcagggatacaaaagcctgcgcgtggcgagacttctgtgcaagtccaagggcagctctctcgtgatctccatcctgcttagcatgctgattctctcttttgtcacacctatcgaaggcaccctgacaaactatccggagagccggcgctacaccctggaggaaattgccgacgttgtggaggggatcattgctgaacaggatctcaaagagtatatcgtgttctacacgtccctgtttggatctcttattctgctcctggccttcatccttagcgtcacactgaccaaggtgctcgacctgctggctaaaaccaatgttatctattgtgaagagtgctccatgtaccaccccagaaagggcattaaatataacggggattttacaaataagtgtggattctgcacctgtgacgagcaggaagacgtggagggcgtcatcattcataaggtgagcaaaaagtgcacataccggtaccaagttaaatgggccaagatcattatgatcatcgtggtcattctcctgatggcccagaacacgatccttattgtggctgcggaaaccgattgctggaccaaaaagtctctggagctcgactgtatcgggcctctgctgaatattggatcctgcagcggcaaggaagcccgcacatatgagacagaggtcaaaaagctcgtgtctcagtccaaagttacccacatcgatgctgaacatatcagcattcttggcgccacgatcgactccgccattaagtctatcagagctcagaaaacctacgccacaatgcatctgctggagaccgtgtttctcatgaagaactgtgattattacacagtcttcgaacacaatagcgggtattcccaagcgaagtggcggctgattgctaaaaccaaccactttgacatctgctctcgccacagcgcccatcacttctgtagatgcatcaacgatgagacgaagtgtcagaatggaaactgggactttgccggcgaaatgaataacacatactccaccaaaaaggatttctatcggcatgaccttgatctgttttacacaattttcgagaatgctttccccgggagcaccgagtctctcttttaccatctgctgcagaccaaaaacacaacgggagcctccagaatccttgaaaagctcagcaccaaattcggcaataacaatatgtttgtggggatttggaagttcggccaatatctgctgacactcccttacgttaacgagaccgaactgtctccctcccgccagagcacaatccttaccaattctaacagcctgtcccggagcacgggaagacaggagtctctctccagcgctattccgggccctaatacaaaggagtgctccaacgcccgcgacgtggggtgtatctctccccggtttggcattcctatcggaaatctgaccgcgtgcggggaaagcccctcctataaaatctacaagacccccgagaaactgtataagtctaacaacaaaggagaaatttggtgtagcgacgatgtccactgccttaagaatttcgagcctgccacagaagagatcgtgaacagaattaagcagatgacctgctttctcacagacgtgtccacgaaaaccgatatcttctctattgctacaagcacctgtcgcatggttgacaagggcgtctgcacagtgaatgatgccaaatggaacatcctgaagtgtgactccgggctgttttacttcaccgatcaacgggagggccaggacacgggaaatgattttggcgaatattgcatcagccactcttgtaacaccgagagattcccgattaatcccgacatcctcaaagattgcacatgggaataccactcccgcaagagcaagtacatttctaccatctccctggagagccttgacgaatttcggagagctatgtctgataaactgtcccatacactcatgatttataacttcaagcctaccgccaatctgccccacatcaaacctacatacaagttcatcaccgcgaacgggattgagaatagcgacggactggactccgcctatatcgtgagctctattcccgctcttggcgggatgagcgtcggatacaacgtgcagacgaaagataattttccgctcctggacatcattgttttcatcaagtccgccgtgattcgcacaacctataaccatatctacgataccggccctacaatcgggattaatacccagcacgacgagcactgtacgggcgcttgccccacacaaatccctcataaggataactggctgaccttttctcaggaacggacaagcagatggggatgtgaggaatttggctgcctcgccattaacaccgggtgtgtctttggatcctgccaggacatcattcaccccgagacaaaagtgtatcggaaggccatggaagaggaggttatcctgaccgtgtgcgtcacgttccctggcaatacctactgtacagaaatcaacgctattgagcccaaaatcaccgatgaaattgagcttcagtttaagacagtggacaccaaaacgctgccgaatatcctcgcggttcaaaaccataagctgtactctgggcagattaatgatctgggcagcttctcccagggatgcgggaacgtgcagaaaacaaatcaatctatccttggcaccggaacagccaagtttgactatgtctgtcacggcgctagccgcaaggatatcattgtgagacggtgctacaacaataaccatgactcctgtaaactgctcaaggaggaaaccagcctgatcttcgccgataatcacgagaccctcgtggtcgccaacacaaaacacctgattggggaacttcagtttaagatcatgctgggagacattagatataaatctttcgctgagtcccctgaactcgagatcgacgccaagtgcgttggctgtcccagctgcttcgagtcttactcctgtaattttcagattatcacgaacatcgataccgtgtgcagcgtgtccgggccctgtacactgttccataatcgcctgattatcaccgcgacaaagcaatcttatggaattaaaatgagctgccctaccaagccggaaggcacggagacatttgaaatctgcaacaaacagtacaagattttctttaccaccatcgacaaaaacgataagatcgagattaatacaggcgaccagacctcctatatctacgaaaaggataaccggtgtaaaacatggctttgcagagtccgcgacgaggggattagcgtgctgttcgagcccctcagagctttcttcggatcttacttttccatcattttctatgccgttgtgggcatcatcattctgtttctcgccgtctacatcttcctgcctatgatttttaaacttcgggatatgctgaaaaagaatgaatatctctacctgcaggagagcaaacacaagtga

SEQ ID NO: 14211 - RNA, 4305 nt, synthetic construct
  misc_feature 1..4305: note = derived and/or modified CDS sequence (opt5) from PLAV(75V3066)__KX100122.1__GP
  source 1..4305: mol_type = other RNA
atgctgttcctcctgatccttgcctttctgggcttcagcacctccaaccccattgctacaagatgctttcacgggggacagctcatcgccgagtctaagagcgcgacgtccatttctgagttctgtctgaaagacgatgtgagcatgcttaagtccgaagtcgtttacatcaaaaatgacaccggcctgtttgggcataacaaggtgttccggtcttggacaattaaagattggaagctctgcaatcctatcccgaccgctggaggcacaatcaacgtgattgaagtcaataaggacctgagcctgatgaccaaaacatatatctgttcccgcgattgcaccattacgatcgacaaggaggaagcccaaattatctttcagaccgataaactcaaccacttcgaggtgagcgggacaaccctgtcttccggatggtttaagagcaaagcctctgttacacttgacagaacctgtgagcatgtgaaggtcacgtgcggcaagaaatccctgcagttccacgcttgttttaagcatcacatgagctgcgtgcggttctttcacaatacaattctccccggcaacatgatcacctctatgtgtcagaatatcgaactgattatcattcttgggctgacactcgccatcttcattctgatggttatgctgaccaaaacctacatctgctatctcctgatgcctatcttcatgcccattgcttacctttatggatgggcctacaacaagtcctgtaaaaagtgcaattgctgtggcctggcgtatcatccttttacaaactgcgggagccactgtgtgtgcggactcaaattcgaggcctccgatcgcatgagaatccatcgggaatctggcctgtgtcaagggtacaagagccttcgcattgctagactgctctgcaagtccaaaggaagctctctggtcatctccggcctgctcagcatgctgattctttcttttgtgacgcccatcgagggcaccatcacaagctaccctgagtcccggaagtataccctggaagagattacagacgtggtcgaagggctcgtttctgagcagaatatcaaagaatacattgtgttctataccagcctgtttggatcccttatcctgctcctggccttcattatgagcatcacgctgtctaagattacatccatcctcgctaaacgcaacgtgatctactgtgaggagtgcagcatgtatcactctaagagaggcattaagtacaatggggattttaccaacaaatgtggattctgcacctgtaacgaacaggaggacacagaaggcctggtcatccacaaggtgtccaaacggtgcacctataagtaccagcttaaatgggccaaggttctgatgattacactcgtgctgctgcttatcgcgcaaaatacgattctcatcgtcgccgctgagaccgattgctggacaaagaaaagcctggacatcgactgtattgggccgatgctggatatcggatcctgcaccaacaagaatacacgctcttacgacgccgaagctcagaaactcgtgagccagtccaagatttctcagctggatgccgaccaagttagccttctgggcaactccatcgatagcgccattaaagctatcagagcgcagaagacctatcccacgatgcatctcctggagaccatctttctgatgaagaattgtgactactatacaaacttcaatcacaactctggctactcccaggccaaatggcggcttattgctaagaccgggcattttgatatctgcagccgccactctacacatcacttctgtagatgcattaatgacggaaccaaatgtcaaaacggcgattgggactttgccggggagatgaatgaaacgtataactccaagaatgatttctacagccacgacctcaacctgttctatacaatctttgagaatgccttccctggaaccacagaatctctgttttaccagctcattcagaaaaagaacaccaccggcgctagcaaagtgctggggaaacttatcacaaagtacggcaacaataacatgttcgtcggagtgtggaagtttggccagtatctgctcacgctgccctacatcaataacaccgagctgtcccaaaatcggagacttacaattctcgccacccaggaaatcctgagccgctctcattccgggcggcaggagagcatgtccaacgcgattcagggatctatcacaaaggagtgccacaatgctaaaggcgtcgggtgtattagccctagattcggaatccccattggcaacctgaccgcctgcggggactccccgaattataagatctacaaaacgcctgaaaagctctataagtctaacaataaaggcgaggtgtggtgtagcaacgatgttcattgcctgaatgactttgaacccgccgatgaggaggtgatcaacaagattaaaaagctgacatgcttcctgaccgacgtctccgtggaagttgatatcttttctgtggctgccagcacctgtaaaatggctgacaagggagtctgcacagtgaatggcgccaagtggaacattatcaaatgtgattccgggctctactatttcaccgaccaccgcgagggacaagatacaggcaacgactttggggaatactgcattagccactcttgtaatacggagcggttccctatcaaccccgataccctgaaggactgcacatgggaatttcattccagaaaaagcaagtacatctctaccatttccctggagagccttgaggagttccgccgggcgatggccgaaaaactctctcacacactgaccatctataatttcaagcccacggctaacctgcctcatattagaccgacctacaagtttatcacagccaatggagtggaaaactccgatggcattgagagcgcttatatcctctccagcatccccgcccttgggggcatttctgttggatacaatgtccagaccaaagacaacttccctcttctggacatcattgtgtttatcaagagcgcggtgattcgcacaacctataatcacatctacgatacaggccccaccattgggatcaacacgcagcatgacgaacactgtacaggaccttgccccgccgtcgtgccgcacaaagagaattggatgaccttctcccaggagcggacctctagatggggctgtgaagagtttgggtgcctcgctatcaacacaggatgtgttttcggcagctgccaagatattatccatcctgaaaccaaggtgtatcgcaaagccgtcgaggaagaggtggttctgacggtgtgcattaattttcccgggaactcctactgtacagagatcaatgctattgaacctaagatcaccgacgagatcgaactgcagttcaaaacagtcgataccaagacacttcccaacctgctcgccgtgcagaaccacaagctgtactctggccagattaatgacctcggcagcttttcccaaggatgcgggaacgttcagaaaaccaatcattctatcctgggaatgggcacggtgaagttcgattatgtctgtcacggggccagccggaaagacgtgaccgtgagacggtgctacaacaataactttgattcctgtaaacttctgaaggaggagacaagcctcattttcgctgacaatcatgaaaccctggaggtcgcgcacacaaagcacctgatcggagaacttcagttcaagattatgctgggcgatatccgctataaatcttttgccgagtcccctgaactcgagatcgacgctaagtgcgttggctgtcccagctgcttcgagtcttactcctgtaactttcaaattgtgaccaatatcgatacggtgtgcagcgtcgaagggccgtgtacactgttccataacagaattatcatttccgccaataaacagtcttatggactcaagatgagctgccagaccaaacctaaccagaatgaggaatttatcatttgcaaccggaagtactccgtgctgttcacaaccatcgacaagaatgacaaaatcgaggttaacaccggcgatcaaacaagctatatttacgaaaaggactctagatgtaaaacgtggctttgccgcgtgcgggatgaggggatctccgtcctgtttgagcccctcaaggccttctttggaagctacttctctattatcttttatgtggttgtgggcattatcgtcctgttcctgatcgtgtacatttttcttcccatgttcttcaaactgaaggacgttctcaagagaaatgaatatctgtacctccaggagctgaaacacaagtga

SEQ ID NO: 14212 - RNA, 4305 nt, synthetic construct
  misc_feature 1..4305: note = derived and/or modified CDS sequence (opt5) from PLAV(75V5758)__KX100128.1__GP
  source 1..4305: mol_type = other RNA
atggagctgctcatcattatcctgcttctgggcagcgccgcttcctctcccgtgagcaccagatgcttccacgggggacagctcattgccgaatcccggtctgcgacaagcatctccgagttttgtctgaaggacgatgtctctatgattaaaagcgaagttacgtacaccaagaacgacacaggcatctatgggcataataaagtgttccgctcctggaccatcaaggattggaaactttgcaaccctattccgacagctggaggcagcatcaatgtgattgaggtcaactctgacctgtccctcgccaccaaggcctacgtgtgtagcagagattgcacaatcaccattgacaaggaagatgctcaaatcatttttcagacggacaaactgaatcacttcgaggtttctgggaccacactgtccagcggatggtttaagaccaaagcctctgtgacactcgatcggacctgtgagcatatcaaggtcacgtgcggcaaaaagtccctgcagttccacgcttgttttaagcatcacatgagctgcatccgcttctttcaccatacaattcttcccggcaccatggtgtcctctatgtgtcagaacatcgaactgattatcattatcgggctcacactggccatcttcattcttatggttatcctgaccaaaacctatatttgctacctcctgatgcctgtgtttatgcccatcgcgtatatttacggatgggcctataataagagctgtaaaaagtgcaactgctgtggcctggcttaccaccctttcacaaattgcgggtcccattgtgtctgcggactcaaatttgaggccagcgacagaatgcggatccaccgcgaatctggcctgtgtcaagggtacaagtcccttagaatcgctcggatgctgtgcaaaagcaagggatctagcctcgtgatttccggcctgctttctatgctgctcctgagcttcatcacgcccattgagggcaccctgacaaactatcctaatgagaagcagtacaccctcgaagagatcgccgatgtggtcgaagggattatgacagagcagcacctgaaagaatatgttgtgttctacacctccctttttggaggcctgatcctcctgcttacgctgattctcagcatcacaatcaacaaggtgaccgacctgctggcgtctaccaatgtcatttattgtgaggagtgctccatgtaccatagcaaaaaggggatcaaatataacggagatttcacaaataagtgtggcttttgcacctgttctgaacaggaggacgtggaaggggttgtgattcacaaggtctcccgcaaatgcacatacaagtaccaactcaaatgggtgagagttatcatgattatcctggcccttctgctcacgatccagaacaccgtgctgattgtcgctgccgaggtggactgctggacaaagaaaagcatcgaaattgattgtatcggaccgctgcttaacattggctcctgcaccgacaagtctggcaagacatatgagaccgaggtcaataaactcgtgcggcagagcaaggttacgcaggctgatgccgaacaaatctccgtgctggggaacaccctggactctgccatcaaagctattcgcagccagaagacatacgagaccatgcatttcctcgaaacagtctttctgatgaaaaattgtgattattactccagcttcgagcacaactctggatattcccagaccaagtggagacttatcgcgaagacgagccattttgacatttgctctcggcactccgcccaccatttctgtcgctgcgtgaatgaaggcacaaaatgtcaaaacggggattgggactttgctggagagatgaataacacctacaatagcaagaacgatttctatctgcacgacctcgatctgttttacacactgttcgagaatgcctttcccggcaccaccgaatctcttttctaccagctcctgcagaaaaagaacacaacgggggccagcaaactgctcggcaagctgatcaccaaatatggaaataacaatatgttcgttggcatttggaagtttgggcagtaccttctgaagctcccttatatcaacgacacagagctgtccgctgacagaaaaagcaccatcatgaagtctcaacaggtgctgtcccggagccagacaggaagacaggaatccctttctagcgccacccccggcacggcgacaaaagagtgctccaacgctaaggatattgggtgtatctctcctcgcttcggcattcccatcggaaatctcaccgcctgcggggacagcccgaactacaaaatttataagacccctgagaagatctacaaatccaataacaagggcgaagtctggtgttctgatgacgtgcattgcctggccgattttgagcccgctgaagaggaagtggttaatcggattaaacaaatgacatgcttcctgaccgacgtcacaacgaagaccgatgtgtttagcatcgccgtgtccacatgtaaaatggtcgacaagggagtgtgcaccgttaacgatgctaagtggaatatcctcaaatgtaacagcggcctgtattacttcacagaccacagagatgggcaggacaccggaaatgattttggcgagtactgcatttctcactcctgtaacacggagcgcttccctatcaatcccgacgtgcttaaggactgcatttgggaatatcatagccggaaatctaagtacatctccaccattagcctggagtctctcgatgaatttagacgcgccatgtccgacaaactgagccacacactgatgatctataacttcaagcccaccgcgaatcttcctcatatcaagccggcctacaaatttattacagctaacgggatcgaaaattccgatggaattgacagcgcctatatcctctctagcattcccgctctgggcgggatgtccgtcggctacaacgtgcagaccaaggataacttccctctgctcgacatcatcgtttttattaaatctgccatcattaagacaacctataatcacatctacgatacgggacccacaattggcatcaacacccagcatgacgagcactgtaccgggccttgccccacactgattccgcacaaagagaattggcttaccttcagccaagagcggacgtccagatggggatgtgaagagttcggctgcctggcgatcaacacagggtgtgtgtttggatcttgccaggatatcattcatcctgaagccaaggtctaccgcaaagctatcgaggaagaggtggttctcaccgtgtgcattacattccccggcaatacctattgtacagagatcaacgccattgaacctaagatcaccgacgagatcgaactgcagtttaagacggtcgataccaaaacactgcccaatcttctgatggtgcacaaccataagctctacagcgggcagattaatgacctgggctccttctctcaaggatgcggcaacgtgcagaaaaccaatcagagcgtcatcggggctggaacagttaagtttgattatgtgtgtcacggcgcctcccggaaagacgtgattgtcagacgctgctacaacaataactatgagagctgtaagctcctgaaggaggaaacctctcttatcttcgccgacaatcatgagacgctggaagtggctaacacaaaacacctcattggggagctgcaatttaagatcatgctgggagatatccggtacaaatccttcgcggaaagccctgagcttgaggttgacgccaagtgcgtgggctgtccctcttgctttgaatcctatagctgtaacttccagattgtcaccaatatcgatacagtgtgctccgttaacggcccgtgtaccctgtttcacaatagactcattatctctgctaccaaacagagctacgggctgaagatgtcctgcagccggaagcctgagcccacagaagagttccagatttgcaaccgcaaatactctgtcctcttcacgaccatcgacaagaatgataaaattgaaatcaacacaggagaccaaacctcctatatctacgagaaggataatagatgtaaaacatggctgtgccgggtgagagacgagggcattagcgtgatctttgaaccccttaaggccttctttgggtcttatttcagcattatcttttacgttattgtgggaatcatcgtcctgttcctcattgtgtatatctttctgcctatgttctttaagctgcgcgatattcttaaacggaacgagtacctgtatctccaggaactgaagcataaatga

SEQ ID NO: 14213 - RNA, 4317 nt, synthetic construct
  misc_feature 1..4317: note = derived and/or modified CDS sequence (opt5) from POTV(89-3380)__EU004189.1__GP
  source 1..4317: mol_type = other RNA
atggagccccctatgaagctgttcctcatcctggccaccgctgtggccgcggtctacagccttccggcttccagatgcttttctgacggcattatcattaaagaaaagcaggatagcaaagccgtttccgagttctgtctgaaggacgatgtgtctatgatcaaaagccacgtggtctattccaagaacgaatctgggatttttgccaatagccaaatcctccggaagtggatcattaaagactggaagctgtgcagcccccttcctacagctggaggccagatcaacgtgattgagatcaatcatgatctgacgctcagcaccaaaacatacgtttgtaccacagactgcaccattgggatcgataaggaaaacgcccagattacattccagaccaataaactgaactattttgaggtgtctggaacgaccatctccagcggctggttcaagtctaagacatccgtcagcctggaccaaacctgtgagcacctcaaagtgtcttgcgggaagaaatccatgcagtttcatgcttgtttcaagcagcacatgagctgcatccgctacctgcataaaacagcccttcccggatatatggcggcctccatttgttctaatatcgaactgattatcatgaccacgctcacactggctatttttatccttctgtgcatcattaccaagacatacatctgttatctcctgatgcctctgttcatgcccattgcctacatctacggctggctctataacaaaagctgcaagaagtgcaattgttgcggcctgtcctaccacccttttaccaactgtgggagctattgcgtttgtggagctaaattcgagacctctgatagaatgcggattcaccgcgaatccggcctttgccaggggtacaagagcctgagagtggcccggaaactctgtaagtctaaaggaagctccctggtcatctctgtgacacttagcgtgtttatcttctccttcattacgccgatcggcggggtcattatcaatgacaagctgagcgaggagaagtattctattaaccaaatgatggatgcgatcgttgacctcgaaaatttttcccataacgtgagcggaacccaacaggtgatttctgtcatcttcctgctgatctcctgcctctttctgcttctgacataccgcctcaataaaattatccagcacctggccagaagcggccttctgttctgtgaggaatgctccatgtatcattctaagaaagatattaagtacaacggcgactttaccaacaaatgtgggttctgcacatgcggacaacccgaggaccctgaaggcctcaatctgcacatcctgagccagaactgtacctacaagcagcaatttaagtgggtgaaaattatcatctccattctcctgtctcttatcattatcgagagctccatgattctggctgccgctgagacggattgcttcagcgaaaagcagatctctgagttttgtctcgggcccctgctgtccatcagctcttgcgaagacaaaaattcccggacattcaagggagaggcccagaaacttgttgccctcaagaagattaccagcgatgaagctatgctgatcgagtctatgggcgcgaaagtggaggacgccctgaagatgattcaggctcagaaaagccctgattccatgtataccatggaatacgtctttctcaacacatattgtgactactatagcctgttcgagcacaattctgggtactcccagatcaagtggcgctatattcttaaaacccatcagtttgatgcctgcgccagacacagcaacaatcatttctgtcggtgcatgtccgacggaatgcactgtccctctctggattgggacatcgctgatgaactcaacaatacatacatcacgaagccgaacttctttaaacatgactacaatctgctgcttgacgtgattaccgccgcgttccctggcacaggcgctgtttttgtgatcgatgcctgcaagaaggccaacgctaccgccattaaaacattcagcaataacatcattgctcgctttccctataataacctcctgaagggggtcatgaaattcctgcagtacatctccaagcacccttcttttaaaaagtatcaacccgacaccagacactacgatctcattcccgtggcccctacggcgcggggacgcagcctgggcagatccaactcttatagcgacgcccaggtcgggccgcccaccaaggattgtcagaaacttaaggaggtgggatgcctgtcccctaaattcggcctccccctggaaagcatcatctcttgcgggtccagccctaattacaagctgtataaaaagccccagaagtactacaaatctaacaataaggagaacacatggtgttccaaagacgttcattgccttcacgattttgagccgattaccgaagacgtgctcgagaaggtcaaagtgatgacatgttgggaaatcgagcctggcaccattgaggatatcttcacgattgctagcgaaacatgcaagatcaatgaccggggagtttgtgaggtgaacgccgctaagtggaaaatcgtcaagtgcgaaaccggcctgtattactatacagatcatagagagggggacgataccggatctgacctgggccactactgtctcacccacaaatgcgccgggggacgctatcccattaatcctgaaatcctgcaaaactgtatttgggagtttcattcccagaagtcccagtacatcaatcaggtggaccttgagcaaattgaagagtataaaaaggcgctgacagaaaaactcacgcacaccctgaaccattacaatttcctgcccacaaagaaccttcctcacatctcccccaattacaagtatgtgaccctcaacggccaggagacaagcgatgggatcgaaaattcttacattgttagcgagatcccggccattgctggcacctccatcggactgaaagtccagacgaagaacaacggcaatatttttgacctgatcatttatgtgaaacgggccgatatcatcgcttcttacaaccatatttatgacacagggcctaccatcggacacaatgtggagcacgaagaactctgcaccggccaatgtccccagcatattcccgccaaggccaactggctgacattcagccaggaaagaacctcccgctgggggtgcgaggagttcggatgccttgctatcaatacaggctgtgtctacgggtcttgccaggatattatcaaacctgtggcgaaggtttatagaaagagcacggaggagaaagtggaactggagctctgtatcgtcctgccggaccggaacttttgcaccacactgaatgcccttgaacccaagattaccgaggagatcgaactgcaattcaaaacaattgatcaggtgtccctccctaacatcgttctgctccgcgaccacaagctgtttaaaggccagattaatgatcttggaaccttcggccagaactgtgggaatgtgcaaaagacgaaccagtctatcctgggagctggcaccgtccggtttgactacctctgccatagcgcctccagaaaggatatcattatccgccggtgttacaataacaattatgacagctgcaaccatctgcagctggccgagtctcttattttcctggataaccacgaaacactcgaggtgagaaaacccaatcacatcctggggaccctctccatgaagctgatgcttggagactttcagtacaaaacattcgctaaggacattgaactggattttaccggccgctgtgttgggtgcatcggctgtttcgagggatttgtgtgcgagatgcacattacaaccacggtcgaagccacatgcaacctcgaggcgagctgtcaattcttccataatcagctgcacatcaaacctgacgtgctgaagtattacaccaagatgacctgccagacagatgaatatatcccctctaaaattaagatctgtaacaaagagtacaagattaccatcggcaaagtgcggaagaatgacaagattgaaatcgataactccgaccaaacgagctatatcaaagagaaggatgagagatgcaaaacatggctttgtcgggtccgcgacgaagggatttccgttatctttgagcctctgctcaatattttcggaaactacggcagaatcgctgtggccgtgatttctgccatcctggctctcatcgtcctggtgtacattcttatgcccatctgcatgaagattcgggatatcctgaaaaccaatgaaaaggagtttctgattgaaagcaaatataagtga

SEQ ID NO: 14214 - RNA, 4311 nt, synthetic construct
  misc_feature 1..4311: note = derived and/or modified CDS sequence (opt5) from TENV(TSV-FE3-66FB)__FJ943508.1__GP
  source 1..4311: mol_type = other RNA
atggagatcttctttattgccctgctcgctatcgccaacagcgtcaattccacacccctggcgaccagatgcttccacggcgggcagcttattgctgaatctaagagcgccacgtccctgtctgagttttgtctcaaagacgatgtgagcatgatcaagtccgaaatttactatgttaaaaacgagaccggaatcttctctcataataaggtgctgcggagctggacaatcaaagactggaagttttgcaaccctgtgccgaccgccggcgggtccattaatgtcatcgaagtgaacagcgatatgtctcttgctacaaagacctacgtttgttcccgcgactgcacaattaccatcgatagagaggaggcccaaattatcttccagacggaaaaactgaatcactttgaggtgagcggaaccacactctcttccggctggttcaagagcaaggcttctgtcaccctggaccggacatgtgaacatctgaaggtgacctgcgggaaaaagtccctccagtttcacgcctgtttcaagcatcacatgagctgcattcgctttttccacaacacgatgctgcccggaagaatcgttaattccatgtgtcagaacatcgagcttattatcattctgggcctcacaatcgtgatttttatcctgatggtcatccttaccaaaacatatatttgctacatcctgatgcctctcttcatgcccattgcgtatatctacggctgggcctataataagtcttgtaaaaagtgcaactgctgtgggctggcttaccatcctttcaccaattgcggaagccactgtgtgtgcggcctgaaatttgaggcctccgatcggatgcgcattcatagagaaagcgggctctgtcaaggatacaagtctctgcggatcgctcgccttctgtgcaaatccaagggcagctctctcgtgatcagcattctgctttccatgctgctcctgtctttcgtcacccccatcgagggggccctgacaaactatcctcagagcaagctctactccctggaagagattgcggacgttgtggaaggacttatcacggagcacaatgtgaaagagtatattgtcttttacaccagcctgttcggcggcctcatcctgcttctggcctttattctctctatcatgctgacaaaggtgacctccatgctggctagaacaaacgttatctattgtgaagagtgcagcatgtaccactctaaaaccgggattaagtataacggagatttcacgaataaatgtggcttttgcacatgtgacgaacaggaggatgccgaagggatcattatccataaggtgtccaagaaatgcacctacaagtaccagctcaaatgggctcggattatcatgatcattctgatcgtccttctgaccacacaaaacaccattctcatcgtggccgccgaggttgactgctgggagcgcgctacactgagccaggaatgtattggaccgctgcagaagatcgaggattgccagaataaagaagagaagacgtatatgtccgaagcgaacaaacttgtgtctcaaagcaaaatcacccaggccgacgctgaccaggtctccgtgctcggcgatacaattgactctgccatcaaggccattagaagccaaaagacctaccagacaatgcatctgctggagaccgtcttcctcatgaagaattgtgattattactccacgtttgagcacaacagcgggtattctcaggctaaatggcggctgatggccaagaccaatcacttcgacatctgctcccgccatagcaaccaccacttttgtagatgcgtgacagaaggaaccaagtgtcagaatggcgattgggacttcgcgggcgagatgaactctacatacaataccaaatccgatttttatcaacatgaccttaacctgttcttcagcctctacgaatctgcttttcccgggacggccgagagcctgttctaccagctgatttccgagaagaatacaaccggagccagccagcttctcggccagatcatcaaaaagtttgctaacaataacatgctgattggggtttggaaattcggacaatatctgctcacactgccttacgtgaacaccaccaaactttctaaatcccgggaagagacaatcctgacgaatcaccagagactcgtccgcagctataccggccggcagcagtccatggccaacgctgaagtgggggagtctacaaagaattgcctgaacgccaagaatgttggctgtattagccccagatttggagtgcctatcggcaacctgaccgtctgcggggaatccacaaattacaaagtgtataagacccccgcgaaaatttacaagtctaacaatcgcccgaaaacgtggtgtagcgaggatgtgcattgcctttccaacttcgagcctgcctctgctgaagttgtcaataagatcaagcggatgacatgctttctcaccgacgtgaccacaaacgtggatgtcttcagcattgccatctccacctgtaaaatggctgacaagggagtgtgcacagttaatgacgccagatggagcatcctgaaatgtgattctggcctgctctattttacggaccaccgcgaggggcaagataccggaaacgacttcggcgaatactgcatttcccacaattgtaacacagagcggtaccccatcaaccctgatattatcaaggactgcatttgggaatatcatagcagaaaatctaagtacatctccgcgatcaatctggagagccttgaggaatttcgccgggccatgtctgagaagctgtcccacaccctcgtgatttataacttcaaacccacagctaatctgccccatatcaagcctagctacaaatccattaccgtcaacgggatcgaaaatagcgatggcattgagtctgcctatatcctgagcaacatcccggctattggaggcatgtccgtggggtacaatgttcttacgaaggacggatttcccctcctggatatcattatcttcattaaatctgccgtgatcaagaccacatataaccacatttacgacaccggccctacaatcgggatcaataccctgcatgatgaaaagtgtacaggaccctgccctagcattatcccccacaaagagaactggctcaccttctcccaggagagaacgtctcgctggggctgtgaagagtttgggtgcctggccattaatacaggctgtgtcttcggaagctgccaggacatcattcggccggaaaccaagatctacagaaaagctgtggaggaggaagttatccttaacgcgtgcattaattttcctggcaacacctattgtacagagatcaatgccattgaacccaagatcaccgatgagattgaactgcagttcaaaacggtggacacaaagaccctccctaacctgctggctgtccaaaaccacaaactttactccgggcagatcaatgacatcggaacattttctcagggctgcgggaacgtgcaaaagaccaatcagacaatgctgggaaccggcacggtgcggttcgattatgtctgtcatggggccagccgcaaggacattatcgttagacggtgctacaacaataactatgagtcctgtaaactcctgaaggaggagaaaagcctcatttttgccgataatcacgaaaccctggaagtggctaacacaagacatcttctgggcgagctccagttcaagatcatgctgggagacattcgctacaaagcctttgcggaaaagcccgagctggagatcgatgctaagtgcgtgggctgtccttcttgcttcgaatcctatagctgtaattttcagattgtctctaacgtggacaccgtttgctacatcgaggggccctgtacacttttccacaatcggatcattatcaaaaccatgaagcaagcctacggaattaaaatgtcctgcaagacgaaaccggcccctagcgaagagttcaagatctgcggcagaacatataacgtggcttttaataccgtcgaaaagaacgataaaattgagatcaatacaggggaccagacctcctacatctctgagaaggatgaccgctgtaaaacctggctgtgcagagtgcgggatgaaggaattagcgttatcttcgagcccctcaagaacctgtttggcaattatttcaacattgccttttacatcattatcggcctcatcgcgctgttccttacaatttatatctttctgcccatgttctttaaactccgcgacgtgctgaagagaaacgaatacctgtatcttcaggagctgaagcataaatga

SEQ ID NO: 14215 - RNA, 4311 nt, synthetic construct
  misc_feature 1..4311: note = derived and/or modified CDS sequence (opt5) from TENV(TSV-FL06)__FJ943506.1__GP
  source 1..4311: mol_type = other RNA
atggagatcttctttattgccctgctcgctatcgccagctccgtgaactctacacccctggcgaccagatgcttccacggcgggcagcttattgctgaaagcaagtccgccacgtctctgagcgagttttgtctcaaagacgatgtctccatgatcaagtctgaaatttactatgttaaaaatgagaccggaatcttcagctacaacaaggtgctgcggtcctggacaatcaaagactggaagttttgcaatcctgtgccgaccgccggcgggagcattaacgtcatcgaagttaattctgatatgtcccttgctacaaagacctatgtgtgtagccgcgactgcacaattaccatcgatagagaggaggcccaaattatcttccagacggaaaaactgaaccattttgaggtgtctggaaccacactctccagcggctggttcaagtctaaggcttccgtcaccctggaccggacatgtgaacacctgaaggtgacctgcgggaaaaagagcctccagtttcatgcctgtttcaagcaccatatgtcctgcattcgctttttccacaatacgatgctgcccggaagaatcgttaactctatgtgtcagaatatcgagcttattatcattctgggcctcacaatcgtgatttttatcctgatggtcatccttaccaaaacatacatttgctatatcctgatgcctctcttcatgcccgtggcgtacatttatggctgggcctacaacaagagctgtaaaaagtgcaattgctgtgggctggcttaccaccctttcaccaactgcggatcccattgtgtgtgcggcctgaaatttgaggccagcgatcggatgcgcatccacagagaatctgggctctgtcaaggatataagtccctgcggattgctcgccttctgtgcaaaagcaagggctctagcctcgtcatctccatcctgctttctatgctgctcctgagcttcgttacccccattgagggggccctgacaaattaccctcagtccaagctctatagcctggaagagatcgcggacgtggtggaaggacttattacggagcataacgtcaaagagtacatcgtgttttatacctctctgttcggcggcctcattctgcttctggcctttatcctctccattatgctgacaaaggttaccagcatgctggctagaacaaatgtgatctactgtgaagagtgctctatgtatcactccaaaaccgggatcaagtacaacggagatttcacgaacaaatgtggcttttgcacatgtgacgaacaggaggatgccgaagggattatcattcacaaggtcagcaagaaatgcacctacaagtatcagctcaaatgggctcggatcattatgatcatcctgattgtgcttctgaccacacaaaataccatcctcattgttgccgccgaggtggactgctgggagcgcgctacactgtcccatgaatgtatcggaccgctgcagaagattgaggattgccagaacaaagaagagaagacgtacatgtctgaagcgaataagctggtcagccagtccaaaatcacccaagccgacgctgaccaggtgtctgtcctcggcgatacaatcgacagcgccattaaggccatcagatcccagaaaacctatcaaacaatgcaccttctggagaccgtgttcctcatgaagaactgtgattactatagcacgtttgagcataattctgggtactcccaggctaaatggcggctgatggccaagaccaaccacttcgacatttgcagccgccattctaatcaccacttttgtagatgcgttacagaaggaaccaagtgtcagaacggcgattgggacttcgcgggcgagatgaactccacatataataccaaaagcgatttttaccagcatgaccttaatctgttcttctctctctacgaaagcgcttttcccgggacggccgagtccctgttctatcaactgatcagcgagaagaacacaaccggagcctctcagcttctcggccagattatcaaaaagtttgctaataacaatatgctgatcggggtgtggaaattcggacagtacctgctcacactgccttatgtcaacaccaccaaactttccaaaagccgggaagagacaacgctgaccaaccaccaaagactcgtgcgctcctacacaggccggcagcagtctatggccaatgctgaagttggggagagcaccaagaactgcctgaatgccaagaacgtgggctgtatttcccccagatttggagtccctatcggcaatctgacagtgtgcggggaatctaccaactataaagtgtacaagacgcccgcgaaaatttataagagcaataaccgcccgaaaacatggtgttccgaggatgttcattgcctttctaatttcgagcctgccagcgctgaagtcgtgaacaagatcaagcggatgacctgctttctcaccgacgtgacaaccaatgtcgatgtgttctccattgccatcagcacatgtaaaatggctgacaagggagtttgcacggtgaacgacgccagatggtctattctgaaatgtgattccggcctgctctactttaccgaccaccgcgaggggcaggatacaggaaatgacttcggcgaatactgcatcagccacaactgtaataccgagcggtatcccatcaaccctgatattatcaaggactgcatttgggaatactattctagaaaatccaagtacatcagcgcgattaacctggagtctcttgaggaatttcgccgggccatgtccgagaagctgagccatacactcgtcatctataatttcaaacccaccgctaacctgccccacatcaagccttcctacaaaagcattacggtgaatgggatcgaaaactctgatggcattgagagcgcctatatcctgtccaatattccggctatcggaggcatgtctgttgggtacaacgtgcttaccaaggacggatttcccctcctggatatcattatcttcattaaaagcgccgtcatcaagacaacctacaatcatatttatgacacaggccctaccatcgggattaacacactgcacgatgaaaagtgtaccggaccctgcccttccatcatcccccataaagagaattggctcacgttctctcaagagagaacaagccgctggggctgtgaagagtttgggtgcctggccattaacaccggctgtgtgttcggatcctgccaggacatcattcggccggaaaccaagatctacagaaaagctgttgaggaggaagtgattcttaatgcgtgcatcaactttcctggcaatacatattgtaccgagatcaacgccttcgaacccaagattacggatgagatcgaactgcagtttaaaacagtcgacaccaagacactccctaatctgctggctgtgcagaaccacaaactttactctgggcaaattaacgacatcggaaccttcagccagggctgcgggaatgtgcagaagacaaaccaaaccatgctgggaacgggcaccgtccggtttgattatgtttgtcacggggcctcccgcaaggacattatcgtgagacggtgctacaataacaattatgagagctgtaaactcctgaaggaggaaaaatctctcatcttcgccgataaccatgagacactggaagtggctaataccagacaccttctgggcgagctccagtttcgcattatgctgggagacatccggtacaaggccttcgcggaaaaacccgagctggagattgatgctaagtgcgtcggctgtccttcctgctttgaaagctactcttgtaacttccagatcgtgtccaatgttgacacagtgtgctatattgaggggccctgtacccttttccataacagagtcatcattaagacgatgaaacaggcctacggaatcaagatgagctgcaaaacaaagccggccccttccgaagagtttaaaatctgcggccgcacctataatgtggctttcaacacagttgaaaagaatgataagattgagatcaacaccggggaccaaacctcttacattagcgagaaagatgacagatgtaagacatggctgtgccgggtgcgcgatgaaggaatctccgtcatttttgagcccctcaaaaatctgttcggcaactattttaatatcgccttctacatcattatcggcctcattgcgctgtttcttacgatctatattttcctgcccatgtttttcaagctcagagacgtgctgaaacggaacgaatacctgtaccttcaggagctgaagcacaagtga

SEQ ID NO: 14216 - RNA, 4305 nt, synthetic construct
  misc_feature 1..4305: note = derived and/or modified CDS sequence (opt5) from TLAV(61D240)__KX100119.1__GP
  source 1..4305: mol_type = other RNA
atgctgttcctcctgatccttgcctttctgggcttcagcacctccaaccccattgctacaagatgctttcacgggggacagctcatcgccgagtctaagagcgcgacgtccatttctgagttctgtctgaaagacgatgtgagcatgcttaagtccgaagtcgtttacaccaaaaatgacacaggcctgtttgggcataacaaggtgttccggtcttggaccatcaaagattggaagctctgcaatcctattccgacagctggaggcaccatcaacgtgatcgaagtcaataaggacctgagcctgatgacaaaaacctatatttgttcccgcgattgcacgatcaccattgacaaggaggaagcccaaatcatttttcagacagataaactcaaccacttcgaggtgagcgggaccacacttaattctggatggtttaagtccaaagccagcgttacccttgacagaacgtgtgagcatgtgaaggtcacatgcggcaagaaatctctgcagttccacgcttgttttaagcatcacatgtcctgcgtgcggttctttcacaacaccatcctccccggcaatatgattacaagcatgtgtcagaacatcgaactgatcattatccttgggctgaccctcgccattttcatcctgatggttatgctgaccaaaacatacatttgctatctcctgatgcctatcttcatgcccatcgcttacctttatggatgggcctacaataagtcttgtaaaaagtgcaactgctgtggcctggcgtatcatccttttacgaattgcgggtcccactgtgtgtgcggactcaaattcgaggccagcgatcgcatgcggattcatagagaatccggcctgtgtcaagggtacaagtctcttcgcatcgctagactgctctgcaagagcaaaggatccagcctggtcatttctggcctgctctccatgctgatccttagctttgtgacccccattgagggcacaatcacctcttaccctgagagccggaagtatacactggaagagatcaccgacgtggtcgaagggctcgtttccgagcagaacattaaagaatacatcgtgttctatacgtctctgtttggaagccttattctgctcctggccttcatcatgtccattacactgagcaagatcacctctattctcgctcgcagaaatgtgatctactgtgaggagtgctccatgtatcacagcaaacggggcatcaagtacaacggggattttaccaacaagtgtggattctgcacatgtaatgaacaggaggacgccgaaggcctggtcattcacaaagtgtctaagcgctgcacctataaataccagcttaagtgggcgaaagttctgatggtgacactcgtcctgctgcttatcgcccaaaacacgattctcatcgtggctgccgggaccgattgctggacaaagaagtccctggacattgactgtatcggaccgatgctggatatcggcagctgcaccaataaaaacacaagaaattacgacaccgaggctcagaagctcgtttcccagtctaaagtgagccagctggatgccgaccaagcctcccttctgggcaactctattgatagcgctatcaaggcgattcgggcccagaaaacgtatcccaccatgcatctcctggaaacaatctttctgatgaagaattgtgactactatacctccttcaaccacaatagcgggtactctcaggctaagtggcgccttattgccaaaacaggacattttgatatctgctccagacacagcacccatcacttctgtcggtgcatcaacgacggcacgaagtgtcaaaatggggattgggactttgccggagagatgaacgagacatataattctaaaaacgatttctactcccacgacctcaatctgttctataccatttttgaaaacgctttccctggcacaaccgagagcctgttttaccagctcatccagaagaaaaacaccacaggggcctctaagattctgggcaaacttatcacgaagtacggaaataagaacatgttcgtcggcgtgtggaaatttgggcagtatctgctcaccctgccctacattaataacacagaactgagccaaaatagacgccagaccatccttgcgacacaggagtccctcagccggtctcattccggaagacaggaaagcatgtcctctgctatccaaggcagcgtcaccaaggagtgccacaacgccaaagacgtggggtgtatttcccctcgcttcggaatccccattggcaatctgacggcctgcggggattctccgaactataagatctacaaaacacctgagaagctgtataagagcaataacaaaggcgaagtttggtgttccaatgacgtgcattgcctcaacgattttgagcccgctgacgaagaggtcgtgaataaggttaaaaagctgacctgcttccttaccgatgtgtctgtcaaaacagacatttttagcgtggccgcttccacctgtaagatggccgataagggagtgtgcacagttaacgacgcgaaatggaatatcattaagtgtgatagcggcctgtactatttcacggaccaccgggaggggcaggataccggaaacgactttggcgaatactgcatctctcactcctgtaacacagagagattccctatcaatcccgatattctcaaagactgcacctgggaatttcatagccgcaagtctaaatacatctccacaattagcctggagtctctggaagagttccggagagccatgaccgagaagctgtcccacacgctcaccatctataacttcaagcccacagctaatctgcctcatattcgcccgacctacaaatttatcacagccaacggggtcgaaaatagcgacggaatcgagtccgcttatattctgagctctatccccgccctcggcgggattagcgtgggctacaacgtgcagaccaaggataatttccctctgcttgacatcattgtctttatcaaatccgcggtgatccggacaacctataaccacatttacgatacgggacccacaatcggcattaatacccagcatgacgaacactgtaccgggccttgccccgccgttgtgccgcacaaggagaactggatcacattctctcaagaaagaaccagccgctggggatgtgaggagtttggctgcctggctattaatacggggtgtgtcttcggatcctgccaggatatcattcatcctgaaacaaaagtgtatcggaaggccgttgaggaagaggtgatcctcaccgtctgcatcaactttcccggcaataactactgtacagaaattaatgctatcgagcctaaaattaccgacgagatcgaactgcagttcaagacagtggataccaagacgctgcccaaccttctggccgttcagaaccacaaactctactctgggcaaattaatgacctgggcagcttttcccagggatgcggcaacgtgcagaagaccaatcattctatcctcgggatgggaacagccaaattcgattatgtctgtcacggcgctagcagaaaggacgtgatcgtgcggcgctgctacaacaataactttgattcctgtaaactgcttaaggaggaaaccagcctgattttcgcggacaatcatgagacactcgaggtcgcccacaccaagcacctgatcggggaactgcaattcaaaattatgcttggagatatcagatataagtcttttgctgagtcccctgaactggagattgacgccaaatgcgttggctgtcccagctgcttcgaatcttactcctgtaactttcagatcgtgacgaatatcgacacagtgtgcagcgtcgagggcccgtgtaccctcttccataaccggattatcatttccgccaataagcagtcttatgggctgaaaatgagctgccagacaaagcctaaccaaaatgaggaatttatcatttgcaacagaaagtactccgttctcttcaccaccatcgataaaaatgacaagattgaggtgaacacaggagatcagacgagctatatctacgaaaaagactctcgctgtaagacctggctgtgccgggtgagagatgagggcatctccgtcctttttgaacccctgaaggctttctttgggagctacttctctattatcttttatgtggttgtgggaattatcgtcctcttcctgattatctacatctttctgcccatgttcttcaaacttaaggacgtgctgaaacgcaatgagtatctctacctgcaggagctcaagcacaaatga

SEQ ID NO: 14217 - RNA, 4305 nt, synthetic construct
  misc_feature 1..4305: note = derived and/or modified CDS sequence (opt5) from NRIV(9800535)__AY593725.1__GP
  source 1..4305: mol_type = other RNA
atgctgctcctgcttgtgctgctcatcccctgctacgtcagcgcctcccctgttgtgaccagatgtttccacggcgggcagctgattgctgagaagaaatctcaaacagccgtgagcgaattttgccttaaggacgatgtctccacgatcaaatctgagattacctatgaaaagaacaatacaggactgttcgcgcatagcaaagtgctccggaactggatcattaaggactggaagaattgtaacccggttcccaccgctggcgggtccatcaatgtgatcgaggtcaacacagatctgtctctgaccacaaaaacctacgtgtgcagccgcgactgtacgattaccgttgataaggaagacgcccagatcatttttcagacagagaaactcaatcacttcgaggtgtccggaaccacactgagctctggctggtttaagaccaaagcctccgtcacgcttgatagaacatgcgaacatatcaaggtgacctgtgggaagaaaacactgcagttccacgcttgctttaagcatcacatgagctgtattcggttctttcacggaaccatcctccctggcaccatggccacatctatttgccaaaacatcgagctgatcattatcatttcccttacgctgatcattttcatcctcatgatcattctgaccaaaacatatatctgttacctgctcatgcccctgtttatgcctattgcttatttctacggctggagctataataagtcttgcaaaaagtgctcctgttgcgggcttgcctaccatccctttaccaactgtggaagccactgcgtgtgtggcctgaaattcgaagcgtccgaccgcatgagaatccatcgggagtctgggctctgccagggatacaagagcctgcgcgtcgccagacttctgtgtaagtccaaaggcagctctctcgttatttccatcctgctgagcatgctcatcctgtctttcgtgacacctattgaggggacccttacgaattatccggaaagccggaagtacgatctggaggaaatcgctgacgtgctcgagggatttattgtcgaaaaaggcatcaaggagtatgtggttttctacacatccatttttggcgccctgcttctgctcatcgctctggtgattaccatcaccctgaacaaagtcacagagtatctcaccaatatcaacgtgctgtactgctatgaatgttctatgtaccacagcaagaagaatattaaatacatcggggatttcacaaacaagtgcggattttgtacgtgcggcgagcttgaagaccaggaggggctgaaaattcacaaggtttcccgcaaatgcatctataagtaccagctcacctggagcaagattatcatgacaatcctggtgtgtctgcttattgcccaaaacaccatcctcattgtcgcggcctctgatgactgctggaccaaaaagtccctggaaatggagtgtatcggacccctgcaacaggtggacacatgcgatgacaaagctagcagatcttattccggcgaggcccggaagctcgtccgcgctagcaaaatttccgatctggacgccgcccaggtggggcttctgggatctacgatcgaaagcgctatcgcgtccattagaaagcagcggacctaccctacaatgcatctcctggagtctgttttcctgggcaagcactgtgattattacaaaacctttgaacataatagcggctattcccaggccaagtggcgccttacagctaaaacccaccatttcgacatctgcagcagacactctacgcaccatttttgtcggtgcatttccgatgggacaaagtgtcagaacggagacctcgatttcgccggcgagatgaatagcacctaccaatctaaaaaggactttttcgaacacgattttaaactgttctgcacactggtggagaacgccttccccgggaccaccgagtccctcttttacgaaatgctgagcaagaagaatacaacgggaatcaaacagcttctggacaagctcaccagaaaattcggcaacaataacatgtttgtcgggatttggaagttcggccagtatctgatgtctctgccttacatcaatgagacaagccttacccccgctcagatctccaaaattctcgaagtgacagaccaacatcaccgcagcatctctggacggcaggagtccctggccagcgcgaccccgggctccaagtctaaggagtgtgggcacgctaaaaaggttagctgcatttcccctagattttctgtgcccatggaaggactgatggcctgcggcgatagccctaactataaaatctacaagacgcccacaaaactctataagtccaataacaagggggaggtctggtgttctggagacgtgcattgcagccaggaactgtcccccgccagccaggagtctgtggatcgcattaaacaaatcacctgtttccttaccgaacctgaggtttccgacgatgtctttagcattgctatctctacatgcaaggtgcaggacaaaggcgtgtgtaccgtcaatgaggatcggtggaacgtgatcaagtgcgactccgggctgatttactatacagatcagagagacggccaggatacgggaaatgacttcggcgaatactgtctcagccactcttgccgcatcgagcggtttccgattaaccccgccatcattagagattgtctgtgggaataccattcccgcaaaagcaagtatatcacctccctggaccttgagaacctcgaagagttcaagcgggctatcagcgagaaactgtctcacacactgattgtttacaattttaagcctaccgccaacctcccccatatcaaacctgtgtataagtacattacagtccaaggggtggaaaatagcgacggagttgattccgcgtatatcgccgcttctatgcccgccctgagcggcacctccattgggtacaacatcatgtctagagacaatttcccgctttttgatatcattatcttcattaaaagcgctatcattaaggccacgtataaccacatctacgacaccggacctacaattggcatcaatgtgatgcacgatgagcattgcaccgggcagtgtcccacagacatccctcacaaagaaaactggattaccttcgcgcaggagcgcacatcccggtggggctgcgaagagtttggatgcctggccgtcaataccggctgtgtgttcgggtcttgccaggatatcattagacccgagacgaaggtttaccggaaggctgtggaagagagcgtcctcctgacagtgtgtatcacctatcctggaaaaaccttttgcacagaaattaacgccatcgagcccaagatcaccgacgagctggaacttcaattcaaaacggtggatacaaagaccctgccgaatattctcgctgtccagaaccataaactgtactccggccagatcaatgacctcgggagcttttctcaaggatgtggcaacattcagcgcacaaattccagcatcattgggaccggcacagccaagttcgattatgtttgccacggagcctctagaaaggacatcatcgtgcggagatgttacaacaacaattatgagtcctgcaaactgcttaaggaagaacagagcctgatgtttgctgataaccatgaaaccattgacgtggcgaatgtccgccacctcctgggcgacctgcagttcaaacttatgctgggggatctccggtacaagtcctttgccgagaaccctgacctggagatcgaagctaaatgtgtgggatgcccctcttgtttcacgagctattcctgcagctttaagattgcctctaatatcgataccgtttgctccattgagggcccctgtacaaccttccacaacagactcatgatcacaagcaccaagcaagactacgggattaaaatgtcttgcaagacgaaacctaaggaaacagaggagttccagatctgtaaaaagacctacacagtgctgtttaccaccgtcgagaagaatgataaaatcgagattagcacaggagaccagacgtccttcatccaggaacgcgatgacagatgcaagacctggctttgtcgggtgcgcgatgagggcatttctgttatctttgaaccgattagagccttctttggcagctatttctccatcgctttttacgtggtcatctctattatcgtgctgttcctcgccatttatatctttctgcccatggttttcaaactgcgggacgtgcttaagcgcaacgagtacctgtatctccaagaaattaaacataagtga

SEQ ID NO: 14218 - RNA, 4305 nt, synthetic construct
  misc_feature 1..4305: note = derived and/or modified CDS sequence (opt5) from NRIV(GSA/TS7/5170/WT)__KM514677.1__GP
  source 1..4305: mol_type = other RNA
atgctgctcctgcttgtgctgctcatcccctgctacgtcagcgcctcccctgttgtgaccagatgtttccacggcgggcagctgattgctgagaagaaatctcaaacagccgtgagcgaattttgccttaaggacgatgtctccacgatcaaatctgagattacctatgaacggaacaatacaggactgttcgcgcatagcaaggtgctccgcaactggatcattaaagactggaagaattgtaacccggttcccaccgctggcgggtccatcaatgtgatcgaggtcaacacagatctgtctctgaccacaaagacctacgtgtgcagcagagactgtacgattaccgttgataaagaagacgcccagatcatttttcagacagagaagctcaatcacttcgaggtgtccggaaccacactgagctctggctggtttaaaaccaaggcctccgtcacgcttgatcggacatgcgaacatatcaaagtgacctgtgggaagaagacactgcagttccacgcttgctttaaacatcacatgagctgtattcgcttctttcacggaaccatcctccctggcaccatggccacatctatttgccaaaacatcgagctgatcattatcatttcccttacgctgatcattttcatcctcatggtgatcctgaccaagacatatatttgttacctgctcatgcccctgtttatgcctatcgcttatttctacggctggagctataataaatcttgcaagaaatgctcctgttgcgggcttgcctaccatccctttaccaactgtggaagccactgcgtctgtggcctgaagttcgaagcgtccgacagaatgcggattcatcgcgagtctgggctctgccagggatacaaaagcctgagagttgcccggcttctgtgtaagtccaagggcagctctctcgtgatctccattctgctgagcatgctcatcctgtctttcgtgacacctatcgaggggacccttacgaattatccggaaagccgcaaatacgatctggaggaaattgctgacgtcctcgagggatttatcgtggaaaagggcattaaagagtatgttgtgttctacacatccatctttggcgccctgcttctgctcatggctctggtcattaccatcaccctgaacaaggtgacagagtatctcaccaatattaacgttctgtactgccacgaatgttctatgtatcacagcaaaaagaatatcaagtacatcggggatttcacaaacaaatgcggattttgtacgtgcggcgagcttgaagaccaggaggggctgaagattcataaagtgtccagaaagtgcatctaccggtatcagctcacctggagcaaaattatcatgacaattctggtctgtctgcttatcgcccaaaacaccatcctcattgtggcggcctctgatgactgctggacaaagaagtccctggaaatggagtgtatcggacccctgcagcaggtcgatacctgcgacgacaaagctagccgctcttactccggcgaggccaagaaactcgtgagagctagcaagatttccgatctggacgccgcccaggttgggcttctgggatctacgatcgaaagcgctattgcgtccatccggaaacaacgcacctatcctacaatgcacctcctggagtctgtgttcctgggcaagcattgtgattactataagacctttgaacacaatagcggctactcccaggccaaatggagacttacagctaagacccatcacttcgacatctgcagccggcactctacgcatcacttttgtagatgcatttccgatgggacaaaatgtcagaacggagactgggatttcgccagcgagatgaatagcacctatcaatccaagaaagactttttcgaacatgattttaaactcttctgcacactggtcgagaacgccttccccggcaccaccgagagcctgttttacgaaatgctctctaaaaagaatacaacggggatcaagaacctgcttgacaaactgacccgcaagttcggaaataacaatatgtttgtgggcatttggaaattcgggcagtacctcatcagcctgccttatgttaacgagacatccctgacccccgctcaggtgagcaagattcttgaagtcacagaccagcaccaccggtctatctccggcagacaagagagcctcgcctccgcgacctctggaagcaaatccaaggagtgtggccatgctaagaaagtgtcttgcatcagcccgcgcttttccgtgcctatggaagggctgatggcctgcggagattctcccaattacaagatttataaaacgcctgccaagctgtacaaaagcaacaataagggcgaggtttggtgttccggggacgtccactgcagccaggaactctctcccgcttcccaggagagcgtggatcggatcaagcagattacatgtttcctgaccgaacccgaggtgtctgacgatgtcttttccatcgccatttctacctgcaaagtgcaagacaagggagtttgtacagtgaacgaggatagatggaatgtcatcaaatgcgactctggccttatttattacaccgatcagcgcgacgggcaggatacaggcaacgacttcggagaatattgtctgtcccatagctgccggatcgagagatttcctatcaacccgacgattatctccgattgtctctgggaataccacagccgcaagtctaaatacattaccagcctggacctggagaatcttgaagagttcaagcgggctatctccgagaagctctctcatacactgattgtgtataactttaaacccaccgccaatctgcctcacatcaagcccgtttacaaatatatcacagtgcagggcgtcgaaaacagcgacggggtggattccgcgtacatttctgccagcatgcctgctctctccggaacctctatcggctataatattatgagcagagacaacttccccctgtttgatatcattatcttcatcaagtccgccattatcaaagctacgtacaatcacatttatgacaccgggccgacaatcggaattaacgttatgcatgatgagcactgcaccggccaatgtcctacagacatcccccataaggaaaattggattaccttcgcccaggagcgcacaagccggtgggggtgcgaagagtttggctgccttgcggtgaacaccggatgtgtcttcggctcttgccaggatatcatcagacctgagacgaaagtgtaccggaaggccgtggaagagtccgtcctgctcacagtttgtattacctaccccgggaagaccttttgcacagaaatcaatgctattgagcctaaaatcaccgacgagctggaactgcagttcaagacggtggatacaaaaacccttcccaacattctggccgtgcaaaatcacaagctctatagcggacagatcaacgacctgggctctttttcccaggggtgtggaaatatccaaaagacaaacagctccattatcggcaccgggacagctaagttcgattacgtctgccatggcgcctctcgcaaggacattatcgtgagacggtgttataacaataactacgagagctgcaaactcctgaaggaagaacagtcccttatgtttgccgataatcacgaaaccattgacgttgctaacgtgagacatctgctcggagacctgcagttcaaactgatgcttggcgatctgcgctataagagctttgcggagaatccggacctcgagatcgaagccaaatgtgtcgggtgcccttcttgtttcacgtcctacagctgctcttttaagatcgctagcaacattgataccgtgtgctccatcgagggaccctgtacaaccttccacaatcggctgatgattacatctaccaagcaggactatggcatcaaaatgagctgcaagacgaaacccaaggaaacagaggagttccaaatttgtaaaaagacctacacagttctctttaccaccgtggagaagaacgataaaatcgagatttccacaggggaccagacgtctttcatccaggaaagagatgaccgctgcaagacctggctgtgtagagtccgggatgagggaatcagcgtgatttttgaacctatccgcgccttctttggctcctacttcagcattgccttttatgttgtggtcatcattatcgtgcttttcctggctatctacatttttctcccgatggtgttcaaactgagagacgtcctgaagcggaatgagtatctttacctgcaggaaatcaaacacaagtga

SEQ ID NO: 14219 - RNA, 4305 nt, synthetic construct
  misc_feature 1..4305: note = derived and/or modified CDS sequence (opt5) from NRIV(TND/S1/19801/WT)__KM514679.1__GP
  source 1..4305: mol_type = other RNA
atgctgctcctgcttgtgctgctcatcccctgctacgtcagcgcctcccctgttgtgaccagatgtttccacggcgggcagctgattgctgagaagaaatctcaaacagccgtgagcgaattttgccttaaggacgatgtctccacgatcaaatctgagattacctatgaacggaacaatacaggactgttcgcgcatagcaaggtgctccgcaactggatcattaaagactggaagaattgtaacccggttcccaccgctggcgggtccatcaatgtgatcgaggtcaacacagatctgtctctgaccacaaagacctacgtgtgcagcagagactgtacgattaccgttgataaagaagacgcccagatcatttttcagacagagaagctcaatcacttcgaggtgtccggaaccacactgagctctggctggtttaaaaccaaggcctccgtcacgcttgatcggacatgcgaacatatcaaagtgacctgtgggaagaagacactgcagttccacgcttgctttaaacatcacatgagctgtattcgcttctttcacggaaccatcctccctggcaccatggccacatctatttgccaaaacatcgagctgatcattatcatttcccttacgctgatcattttcatcctcatggtgatcctgaccaagacatatatttgttacctgctcatgcccctgtttatgcctatcgcttatttctacggctggagctataataaatcttgcaagaaatgctcctgttgcgggcttgcctaccatccctttaccaactgtggaagccactgcgtctgtggcctgaagttcgaagcgtccgacagaatgcggattcatcgcgagtctgggctctgccagggatacaaaagcctgagagttgcccggcttctgtgtaagtccaagggcagctctctcgtgatctccattctgctgagcatgctcatcctgtctttcgtgacacctatcgaggggacccttacgaattatccggaaagccgcaaatacgatctggaggaaattgctgacgtcctcgagggatttatcgtggaaaagggcattaaagagtatgttgtgttctacacatccatctttggcgccctgcttctgctcatggctctggtcattaccatcaccctgaacaaggtgacagagtatctcaccaatattaacgttctgtactgccacgaatgttctatgtatcacagcaaaaagaatatcaagtacatcggggatttcacaaacaaatgcggattttgtacgtgcggcgagcttgaagaccaggaggggctgaagattcataaagtgtccagaaagtgcatctaccggtatcagctcacctggagcaaaattatcatgacaattctggtctgtctgcttatcgcccaaaacaccatcctcattgtggcggcctctgatgactgctggacaaagaagtccctggaaatggagtgtatcggacccctgcagcaggtcgatacctgcgacgacaaagctagccgctcttactccggcgaggccaagaaactcgtgagagctagcaagatttccgatctggacgccgcccaggttgggcttctgggatctacgatcgaaagcgctattgcgtccatccggaaacaacgcacctatcctacaatgcacctcctggagtctgtgttcctgggcaagcattgtgattactataagacctttgaacacaatagcggctactcccaggccaaatggagacttacagctaagacccatcacttcgacatctgcagccggcactctacgcatcacttttgtagatgcatttccgatgggacaaaatgtcagaacggagactgggatttcgccagcgagatgaatagcacctatcaatccaagaaagactttttcgaacatgattttaaactcttctgcacactggtcgagaacgccttccccggcaccaccgagagcctgttttacgaaatgctctctaaaaagaatacaacggggatcaagaacctgcttgacaaactgacccgcaagttcggaaataacaatatgtttgtgggcatttggaaattcgggcagtacctcatcagcctgccttatgttaacgagacatccctgacccccgctcaggtgagcaagattcttgaagtcacagaccagcaccaccggtctatctccggcagacaagagagcctcgcctccgcgacctctggaagcaaatccaaggagtgtggccatgctaagaaagtgtcttgcatcagcccgcgcttttccgtgcctatggaagggctgatggcctgcggagattctcccaattacaagatttataaaacgcctgccaagctgtacaaaagcaacaataagggcgaggtttggtgttccggggacgtccactgcagccaggaactctctcccgcttcccaggagagcgtggatcggatcaagcagattacatgtttcctgaccgaacccgaggtgtctgacgatgtcttttccatcgccatttctacctgcaaagtgcaagacaagggagtttgtacagtgaacgaggatagatggaatgtcatcaaatgcgactctggccttatttattacaccgatcagcgcgacgggcaggatacagctaacgacttcggcgaatattgtctgtcccatagctgccggatcgagagatttcctatcaacccgacgattatctccgattgtctctgggaataccacagccgcaagtctaaatacattaccagcctggacctggagaatcttgaagagttcaagcgggccatctccgagaagctctctcatacactgattgtgtataactttaaacccaccgcgaatctgcctcacatcaagcccgtttacaaatatatcacagtgcagggagtcgaaaacagcgacggcgtggattccgcctacatttctgctagcatgcctgccctctccgggacctctatcggatataatattatgagcagagacaacttccccctgtttgatatcattatcttcatcaagtccgctattatcaaagccacgtacaatcacatttatgacaccggcccgacaatcgggattaacgttatgcatgatgagcactgcaccggacaatgtcctacagacatcccccataaggaaaattggattaccttcgcgcaggagcgcacaagccggtggggctgcgaagagtttgggtgccttgccgtgaacaccggctgtgtcttcggatcttgccaggatatcatcagacctgagacgaaagtgtaccggaaggctgtggaagagtccgtcctgctcacagtttgtattacctaccccggcaagaccttttgcacagaaatcaatgccattgagcctaaaatcaccgacgagctggaactgcagttcaagacggtggatacaaaaacccttcccaacattctggctgtgcaaaatcacaagctctatagcgggcagatcaacgacctgggatctttttcccagggctgtgggaatatccaaaagacaaacagctccattatcggaaccggcacagccaagttcgattacgtctgccatggggcctctcgcaaggacattatcgtgagacggtgttataacaataactacgagagctgcaaactcctgaaggaagaacagtcccttatgtttgctgataatcacgaaaccattgacgttgcgaacgtgagacatctgctcggcgacctgcagttcaaactgatgcttggagatctgcgctataagagctttgccgagaatccggacctcgagatcgaagctaaatgtgtcggctgcccttcttgtttcacgtcctacagctgctcttttaagatcgccagcaacattgataccgtgtgctccatcgaggggccctgtacaaccttccacaatcggctgatgattacatctaccaagcaggactatggaatcaaaatgagctgcaagacgaaacccaaggaaacagaggagttccaaatttgtaaaaagacctacacagttctctttaccaccgtggagaagaacgataaaatcgagatttccacaggcgaccagacgtctttcatccaggaaagagatgaccgctgcaagacctggctgtgtagagtccgggatgaggggatcagcgtgatttttgaacctatccgcgccttctttggatcctacttcagcattgctttttatgttgtggtcatcattatcgtgcttttcctggccatctacatttttctcccgatggtgttcaaactgagagacgtcctgaagcggaatgagtatctttacctgcaggaaatcaaacacaagtga

SEQ ID NO: 14220 - RNA, 4305 nt, synthetic construct
  misc_feature 1..4305: note = derived and/or modified CDS sequence (opt5) from NRIV(9800521)__JX857326.1__GP
  source 1..4305: mol_type = other RNA
atgctgctcctgcttgtgctgctcatcccctgctacgtcagcgcctcccctgttgtgaccagatgtttccacggcgggcagctgattgctgagaagaaatctcaaacagccgtgagcgaattttgccttaaggacgatgtctccacgatcaaatctgagattacctatgaaaagaacaatacaggactgttcgcgcatagcaaagtgctccggaactggatcattaaggactggaagaattgtaacccggttcccaccgctggcgggtccatcaatgtgatcgaggtcaacacagatctgtctctgaccacaaaaacctacgtgtgcagccgcgactgtacgattaccgttgataaggaagacgcccagatcatttttcagacagagaaactcaatcacttcgaggtgtccggaaccacactgagctctggctggtttaagaccaaagcctccgtcacgcttgatagaacatgcgaacatatcaaggtgacctgtgggaagaaaacactgcagttccacgcttgctttaagcatcacatgagctgtattcggttctttcacggaaccatcctccctggcaccatggccacatctatttgccaaaacatcgagctgatcattatcatttcccttacgctgatcattttcatcctcatgatcattctgaccaaaacatatatctgttacctgctcatgcccctgtttatgcctattgcttatttctacggctggagctataataagtcttgcaaaaagtgctcctgttgcgggcttgcctaccatccctttaccaactgtggaagccactgcgtgtgtggcctgaaattcgaagcgtccgaccgcatgagaatccatcgggagtctgggctctgccagggatacaagagcctgcgcgtcgccagacttctgtgtaagtccaaaggcagctctctcgttatttccatcctgctgagcatgctcatcctgtctttcgtgacacctattgaggggacccttacgaattatccggaaagccggaagtacgatctggaggaaatcgctgacgtgctcgagggatttattgtcgaaaaaggcatcaaggagtatgtggttttctacacatccatttttggcgccctgcttctgctcatggctctggtgatcaccattaccctgaacaaagtcacagagtatctcaccaatatcaacgtgctgtactgccacgaatgttctatgtatcacagcaagaagaatatcaaatacattggggatttcacaaacaagtgcggattttgtacgtgcggcgagcttgaagaccaggaggggctgaaaatccataaggtttcccgcaaatgcatttacaagtatcagctcacctggagcaagatcattatgacaatcctggtgtgtctgcttatcgcccaaaacaccattctcatcgtcgcggcctctgatgactgctggaccaaaaagtccctggaaatggagtgtattggacccctgcaacaggtggacacatgcgatgacaaagctagcagatcttactccggcgaggcccggaagctcgtccgcgctagcaaaatctccgatctggacgccgcccaggtggggcttctgggatctacgattgaaagcgctatcgcgtccatcagaaagcagcggacctatcctacaatgcacctcctggagtctgttttcctgggcaagcattgtgattactataaaacctttgaacacaatagcggctactcccaggccaagtggcgccttacagctaaaacccatcacttcgacatttgcagcagacactctacgcatcacttttgtcggtgcatctccgatgggacaaagtgtcagaacggagactgggatttcgccggcgagatgaatagcacctatcaatctaaaaaggactttttcgaacatgattttaaactcttctgcacactggtggagaacgccttccccgggaccaccgagtccctgttttacgaaatgctcagcaagaagaatacaacgggaattaaacagctgcttgacaagctgaccagaaaattcggcaacaataacatgtttgtcgggatctggaagttcggccagtacctcatgtctctgccttatgtgaatgaggctagcctgacacccgcccagatttccaaaatccttgaagttaccgaccaacaccaccgcagcatctctggacggcaggagtccctcgcgagcgctacaccgggctccaagtctaaggagtgtgggcatgccaaaaaggtgagctgcatttcccctagattttctgtccccatggaaggactgatggcctgcggcgatagccctaactacaaaatctataagacccccacgaaactgtacaagtccaataacaagggggaggtgtggtgttctggagacgtgcactgcagccaggaactctcccccgctagccaggagtctgttgatcgcattaaacaaatcacatgtttcctgaccgaacctgaggtctccgacgatgtgtttagcattgccatctctacctgcaaggtgcaggacaaaggcgtctgtacagtgaatgaggatcggtggaacgttattaagtgcgactccgggcttatctattacaccgatcagagagacggccaggatacaggaaatgacttcggcgaatattgtctgagccattcttgccgcatcgagcggtttccgattaaccccgctatcattagagattgtctctgggaataccactcccgcaaaagcaagtacatcacgtccctggacctggagaaccttgaagagttcaagcgggccattagcgagaaactctctcataccctgatcgtgtataattttaagcctacagcgaacctgccccacatcaaacctgtctacaagtatattaccgtgcaaggggttgaaaatagcgacggagtggattccgcctacatcgctgcctctatgcccgctctcagcggcacatccattgggtataacatcatgtctagagacaatttcccgctgtttgatattatcatcttcattaaaagcgccatcattaaggcgacctacaaccacatctatgacacgggacctaccattggcatcaatgtcatgcatgatgagcactgcacagggcagtgtcccaccgacattcctcataaagaaaactggatcacattcgcccaggagcgcacctcccggtggggctgcgaagagtttggatgccttgctgtgaatacaggctgtgttttcgggtcttgccaggatatcattagacccgagaccaaggtgtaccggaaggccgtcgaagagagcgtgctgctcacggtgtgtatcacataccctggaaaaaccttttgcaccgaaattaacgctatcgagcccaagattacagacgagctggaactgcaattcaaaaccgtcgatacgaagacacttccgaatatcctggccgttcagaaccacaaactctattccggccagatcaatgacctggggagcttttctcaaggatgtggcaacattcagcgcaccaattccagcatcattgggacaggcaccgccaagttcgattacgtgtgccatggagcttctagaaaggacatcattgtgcggagatgttataacaacaattacgagtcctgcaaactcctgaaggaagaacagagccttatgtttgcggataaccacgaaacaatcgacgtcgccaatgtgcgccatctgctcggcgacctgcagttcaaactgatgcttggggatctgcggtataagtcctttgctgagaaccctgacctcgagatcgaagccaaatgtgttggatgcccctcttgtttcaccagctactcctgcagctttaagattgccacgaatatcgataccgtgtgctctattgagggcccctgtacaaccttccacaacagactgatgatcacatccaccaagcaagactatgggattaaaatgagctgcaagacgaaacctaaggaaacagaggagttccagatctgtaaaaagacctacacagtcctctttaccaccgtggagaagaatgataaaattgagatctctacaggagaccagacgagcttcatccaggaacgcgatgacagatgcaagacctggctgtgtcgggttcgcgatgagggcatttccgtgatctttgaaccgattagagctttctttggctcttacttcagcatcgccttttatgtcgtgatttccatcatcgttcttttcctggcgatttacatctttctccccatggtgttcaaactgcgggacgtcctgaagcgcaacgagtatctttacctgcaagaaattaaacacaagtga

SEQ ID NO: 14221 - RNA, 4305 nt, synthetic construct
  misc_feature 1..4305: note = derived and/or modified CDS sequence (opt5) from NRIV(Adrar)__KJ716849.1__GP
  source 1..4305: mol_type = other RNA
atgctgctcctgcttgtgctgctcatcccctgctacgtcagcgcctcccctgttgtgaccagatgtttccacggcgggcagctgattgctgagaagaaatctcaaacagccgtgagcgaattttgccttaaggacgatgtctccacgatcaaatctgagattacctatgaaaagaacaatacaggactgttcgcgcatagcaaagtgctccggaactggatcattaaggactggaagaattgtaacccggttcccaccgctggcgggtccatcaatgtgatcgaggtcaacacagatctgtctctgaccacaaaaacctacgtgtgcagccgcgactgtacgattaccgttgataaggaagacgcccagatcatttttcagacagagaaactcaatcacttcgaggtgtccggaaccacactgagctctggctggtttaagaccaaagcctccgtcacgcttgatagaacatgcgaacatatcaaggtgacctgtgggaagaaaacactgcagttccacgcttgctttaagcatcacatgagctgtattcggttctttcacggaaccatcctccctggcaccatggccacatctatttgccaaaacatcgagctgatcattatcatttcccttacgctgatcattttcatcctcatggtgatcctgaccaaaacatatatttgttacctgctcatgcccctgtttatgcctatcgcttatttctacggctggagctataataagtcttgcaaaaagtgctcctgttgcgggcttgcctaccatccctttaccaactgtggaagccactgcgtctgtggcctgaaattcgaagcgtccgaccgcatgcggattcatagagagtctgggctctgccagggatacaagagcctgcgcgttgccagacttctgtgtaagtccaaaggcagctctctcgtgatctccattctgctgagcatgctcatcctgtctttcgtgacacctatcgaggggacccttacgaattatccggaaagccggaagtacgatctggaggaaattgctgacgtcctcgagggatttatcgtggaaaaaggcattaaggagtatgttgtgttctacacatccatctttggcgccctgcttctgctcatggctctggtcattaccatcaccctgaacaaagtgacagagtatctcaccaatattaacgttctgtactgccacgaatgttctatgtatcacagcaagaagaatatcaaatacatcggggatttcacaaacaagtgcggattttgtacgtgcggcgagcttgaagaccaggaggggctgaaaattcataaggtgtcccgcaaatgcatctacaagtatcagctcacctggagcaagattatcatgacaattctggtctgtctgcttatcgcccaaaacaccatcctcattgtggcggcctctgatgactgctggacaaagaagtccctggaaatggagtgtatcggacccctgcagcaggtcgatacctgcgacgacaaagctagcagatcttactccggcgaggccaagaaactcgtgcgggctagcaagatttccgatctggacgccgcccaggttgggcttctgggatctacgatcgaaagcgctattgcgtccatccgcaagcaaagaacctatcctacaatgcacctcctggagtctgtgttcctgggcaaacattgtgattactataagacctttgaacacaatagcggctactcccaggccaaatggcggcttacagctaagacccatcacttcgacatctgcagccgccactctacgcatcacttttgtagatgcatttccgatgggacaaaatgtcagaacggagactgggatttcgccggcgagatgaatagcacctatcaatctaagaaagactttttcgaacatgattttaaactcttctgcacactggtcgagaacgccttccccgggaccaccgagtccctgttttacgaaatgctcagcaagaaaaatacaacgggaatcaagaaactgcttgacaagctgacccggaaattcggcaacaataacatgtttgtggggatttggaagttcggccagtacctcatctctctgccttatgttaatgagacaagcctgacccccgctcaggtgtccaagattcttgaagtcacagaccagcaccacagaagcatctctggacgccaagagtccctcgccagcgcgaccccgggctccaaatctaaggagtgtgggcatgctaaaaaggtgagctgcatctcccctcggttttctgtgcccatggaaggactgatggcctgcggcgatagccctaactacaaaatttataagacgcccgccaagctgtacaaatccaataacaagggggaggtttggtgttctggagacgtccactgcagccaggaactctcccccgctagccaggagtctgtggatagaatcaaacagattacatgtttcctgaccgaacctgaggtgtccgacgatgtctttagcatcgccatttctacctgcaaggtgcaagacaaaggcgtttgtacagtgaatgaggatcgctggaacgtcatcaagtgcgactccgggcttatttattacaccgatcagcgggaaggccaggacacaggaaatgatttcggcgagtattgtctgagccattcttgcagaatcgaacgctttccgatcaaccccgctattatctccgactgtctctgggagtaccacagccggaagtccaaatacattacgagcctggatctggaaaaccttgaggagttcaagagagccatctctgaaaaactcagccataccctgattgtgtataattttaagcctacagcgaacctgccccacatcaaacctatctacaagtatattaccgttcagggggtggaaaattccgacggagtcgactctgcctacatcgctgccagcatgcccgctctctccggcacatctattgggtataacatcatgagccgcgataatttcccgctgtttgacattatcatcttcattaaatccgccatcattaaggcgacctacaaccacatctatgatacgggacctaccattggcatcaatgtgatgcatgacgagcactgcacagggcaatgtcccaccgatattcctcataaggagaactggatcacattcgcccaggaacggacctctagatggggctgcgaggagtttggatgccttgctgttaatacaggctgtgtgttcgggagctgccaggacatcattcgctccgaaaccaaagtctaccggaaggccgtggaggaaagcgtgctgctcacggtctgtatcacataccccggaaaaaccttttgcaccgagattaacgctatcgagcctaagattacagatgaactggagctgcagttcaaaaccgttgacacgaagacacttcccaatatcctggccgtgcaaaaccacaagctctattctggccagatcaatgatctggggtcctttagccagggatgtggcaacattcaaaagaccaatctctctatcattgggacaggcaccgccaagttcgactacgtgtgccatggagcttccagaaaagatatcattgtccggcgctgttataacaacaattacgaaagctgcaagctgcttaaagaggaacagtccctgatgtttgcggacaaccacgagacaatcgatgtggccaatgttagacacctcctgggcgacctgcagttcaaacttatgctgggggacctccggtataagtcttttgctgagaacccggatctggaaatcgaggccaaatgtgtgggatgccctagctgtttcacctcctacagctgctcttttaagattgcctccaatatcgacacggtctgcagcattgaaggcccctgtaccacattccataacagactcatgatcacctctacaaaacaggattatgggattaagatgagctgcaaaaccaagcccaaggagacggaagagttccaaatctgtaaaaagacatacaccgtgctgtttacaaccgttgagaaaaatgacaagattgaaatctccaccggagatcagacatctttcatccaggagaaagacgatcgctgcaagacgtggctttgtcgggtgagagacgaaggcattagcgtcatctttgagcctattcgcgctttctttggctcctacttctctatcgccttttatgtggttattagcatcatcgtgctgttcctcgcgatttacatctttctgccgatggtcttcaagctgagagatgtgcttaaacggaacgaatatctgtacctccaggagattaagcacaaatga

SEQ ID NO: 14222 - RNA, 4305 nt, synthetic construct
  misc_feature 1..4305: note = derived and/or modified CDS sequence (opt5) from NRIV(DakArD28542)__JX857317.1__GP
  source 1..4305: mol_type = other RNA
atgctgctcctgcttgtgctgctcatcccctgctacgtcagcgcctcccctgttgtgaccagatgtttccacggcgggcagctgattgctgagaagaaatctcaaacagccgtgagcgaattttgccttaaggacgatgtctccacgatcaaatctgagattacctatgaaaagaacaatacaggactgttcgcgcatagcaaagtgctccggaactggatcattaaggactggaagaattgtaacccggttcccaccgctggcgggtccatcaatgtgatcgaggtcaacacagatctgtctctgaccacaaaaacctacgtgtgcagccgcgactgtacgattaccgttgataaggaagacgcccagatcatttttcagacagagaaactcaatcacttcgaggtgtccggaaccacactgagctctggctggtttaagaccaaagcctccgtcacgcttgatagaacatgcgaacatatcaaggtgacctgtgggaagaaaacactgcagttccacgcttgctttaagcatcacatgagctgtattcggttctttcacggaaccatcctccctggcaccatggccacatctatttgccaaaacatcgagctgatcattatcatttcccttacgctgatcattttcatcctcatggtgatcctgaccaaaacatatatttgttacctgctcatgcccctgtttatgcctatcgcttatttctacggctggagctataataagtcttgcaaaaagtgctcctgttgcgggcttgcctaccatccctttaccaactgtggaagccactgcgtctgtggcctgaaattcgaagcgtccgaccgcatgcggattcatagagagtctgggctctgccagggatacaagagcctgcgcgttgccagacttctgtgtaagtccaaaggcagctctctcatcatttccatcctgctgagcatgctcatcctgtctttcgtgacacctattgaggggacccttacgaattatccggaaagccggaagtacgatctggaggaaatcgctgacgtgctcgagggatttattgtcgaaaaaggcatcaaggagtatgtggttttctacacatccatttttggcgccctgttccttctgatggctctcgtgatcaccattaccctgaacaaagtcacagagtatctgaccaatatcaacgtgctctactgccacgaatgttctatgtatcacagcaagaagaatatcaaatacattggggattttacaaacaagtgcggattctgtacgtgcggcgagctggaagaccaggaggggcttaaaatccataaggtttcccgcaaatgcatttacaagtatcagctgacctggagcaagatcattatgacaatcctcgtgtgtctgctgatcgcccaaaacaccattcttatcgtcgcggcctctgatgactgctggacaaagaagtccctcgaaatggagtgtattggacccctgcaacaggtggatacctgcgacgacaaagctagcagatcttactccggcgaggccaagaaactggtccgggctagcaagatctccgatctcgacgccgcccaggtggggctgcttggacctacgattgaatctgctatcgcgagcatccgcaagcaaagaacctattccacaatgcatctgctcgagtctgtttttctgggcaaacactgtgattactataagaccttcgaacacaatagcggctactcccaggccaaatggcggctgacagctaagacccatcactttgacatttgcagccgccactctacgcatcacttctgtagatgcatctccgatgggacaaaatgtcagaacggagactgggattttgccggcgagatgaatagcacctatcaatctaagaaagacttctttgaacatgatcttaaactcttctgcacactggtggagaacgccttccccgggaccaccgagtccctgttttacgaaatgctcagcaagaaaaatacaacgggagtcaagaaactgcttgacaagctgacccggaaattcggcaacaataacatgtttgtggggatttggaagttcggccagtacctcatgtctctgccttatgttaatgagacaagcctgacccccgctcaggtggccaagatccttgaagtcacagaccagcaccacagatccattagcggacgccaagagtctctcgcgtccgctaccccgggcagcaaatccaaggagtgttctcatgccaaaaaggtgagctgcatctcccctcggttttctgtgcccatggaagggctgatggcctgcggagatagccctaactacaaaatctataagacgcccgctaagctgtacaaatccaataacaagggcgaggtttggtgttctggggacgtccactgcagccaggaactctcccccgccagccaggagtctgtggatagaattaaacagatcacatgtttcctgaccgaacctgaggtgtccgacgatgtctttagcattgctatctctacctgcaaggtgcaagacaaaggagtttgtacagtgaatgaggatcgctggaacgtcattaagtgcgactccggccttatctattacaccgatcagcgggacgggcaggatacaggcaatgacttcggagaatattgtctgagccattcttgcagaattgagcgctttccgatcaaccccgccatcatttccgattgtctctgggaataccacagccggaagtccaaatacatcacgagcctggacctggagaaccttgaagagttcaagagagcgatttctgagaaactcagccataccctgatcgtgtataattttaagcctacagccaacctgccccacattaaacctgtttacaagtatatcaccgtgcagggcgtcgaaaattccgacggggtggattctgcttacatcgccgctagcatgcccgccctctccggaacatctattggctataacatcatgagccgcgacaatttcccgctgtttgatattatcattttcatcaaatccgcgatcattaaggccacctacaaccacatctatgacacggggcctaccattggaatcaatgttatgcatgatgagcactgcacaggccaatgtcccaccgacattcctcataaggaaaactggatcacattcgctcaggagcggacctctagatgggggtgcgaagagtttggctgccttgccgtgaatacaggatgtgtcttcggcagctgccaggatattatccgccccgagaccaaagtgtaccggaaggctgtggaagagtccgtcctgctcacggtttgtatcacataccctgggaaaaccttttgcaccgaaattaacgccatcgagcccaagattacagacgagctggaactgcagttcaaaaccgtggatacgaagacacttccgaatatcctggccgtgcaaaaccacaagctctatagcggacagattaatgacctgggctctttttcccaggggtgtggaaacatccagaaaaccaatagctctatcattggcacagggaccgctaagttcgattacgtctgccatggcgcgtccagaaaagacatcattgtgcggcgctgttataacaacaattacgagagctgcaagctcctgaaagaagaacagtcccttatgtttgccgataaccacgaaacaatcgacgttgctaatgtgagacatctgctcggagacctgcagttcaagctgatgcttggcgatctgcggtataagtcttttgccgagaaccctgacctcgagattgaagccaaatgtgtcgggtgccccagctgtttcacctcctacagctgctcttttaagatcgcttccaatatcgatacggtgtgcagcattgagggaccctgtaccacattccacaacagactgatgatcacctctacaaaacaggactatggcattaagatgagctgcaaaaccaagcctaaggaaacggaggagttccaaatctgtaaaaagacatacaccgttctctttacaaccgtggagaaaaatgataagattgagatctccaccggggaccagacatctttcattcaggaacgcgatgaccggtgcaaaacgtggctgtgtagagtccgcgatgagggaatcagcgtgatctttgaaccgattagagccttctttggctcctacttctctatcgcgttttatgttgtggtcagcattatcgtgcttttcctggctatttacatctttctccccatggtgttcaagctgcgggacgtcctgaagcgcaacgagtatctttacctgcaggaaatcaaacacaagtga

SEQ ID NO: 14223 - RNA, 4305 nt, synthetic construct
  misc_feature 1..4305: note = derived and/or modified CDS sequence (opt5) from NRIV(SUD-HKV141)__JX857323.1__GP
  source 1..4305: mol_type = other RNA
atgctgctcctgcttgtgctgctcatcccctgctacgtcagcgcctcccctgttgtgaccagatgtttccacggcgggcagctgattgctgagaagaaatctcaaacagccgtgagcgaattttgccttaaggacgatgtctccacgatcaaatctgagattacctatgaaaagaacaatacaggactgttcgcgcatagcaaagtgctccggaactggatcattaaggactggaagaattgtaacccggttcccaccgctggcgggtccatcaatgtgatcgaggtcaacacagatctgtctctgaccacaaaaacctacgtgtgcagccgcgactgtacgattaccgttgataaggaagacgcccagatcatttttcagacagagaaactcaatcacttcgaggtgtccggaaccacactgagctctggctggtttaagaccaaagcctccgtcacgcttgatagaacatgcgaacatatcaaggtgacctgtgggaagaaaacactgcagttccacgcttgctttaagcatcacatgagctgtattcggttctttcacggaaccatcctccctggcaccatggccacatctatttgccaaaacatcgagctgatcattatcatttcccttacgctgatcattttcatcctcatggtgatcctgaccaaaacatatatttgttacctgctcatgcccctgtttatgcctatcgcttatttctacggctggagctataataagtcttgcaaaaagtgctcctgttgcgggcttgcctaccatccctttaccaactgtggaagccactgcgtctgtggcctgaaattcgaagcgtccgaccgcatgcggattcatagagagtctgggctctgccagggatacaagagcctgcgcgttgccagacttctgtgtaagtccaaaggcagctctctcatcatttccatcctgctgagcatgctcatcctgtctttcgtgacacctattgaggggacccttacgaattatccggaaagccggaagtacgatctggaggaaatcgctgacgtgctcgagggatttattgtcgaaaaaggcatcaaggagtatgtggttttctacacatccatttttggcgccctgttccttctgatggctctcgtgatcaccattaccctgaacaaagtcacagagtatctgaccaatatcaacgtgctctactgccacgaatgttctatgtatcacagcaagaagaatatcaaatacattggggattttacaaacaagtgcggattctgtacgtgcggcgagctggaagaccaggaggggcttaaaatccataaggtttcccgcaaatgcatttacaagtatcagctgacctggagcaagatcattatgacaatcctcgtgtgtctgctgatcgcccaaaacaccattcttatcgtcgcggcctctgatgactgctggaccaaaaagtccctcgaaatggagtgtattggacccctgcaacaggtggacacatgcgatgacaaagctagcagatcttactccggcgaggccaagaaactggtccgggctagcaagatctccgatctcgacgccgcccaggtggggctgcttggacctacgattgaatctgctatcgcgagcatccgcaagcaaagaacctattccacaatgcacctcctcgagtctgtttttctgggcaaacattgtgattactataagaccttcgaacacaatagcggctactcccaggccaaatggcggctgacagctaagacccatcactttgacatttgcagccgccactctacgcatcacttctgtagatgcatctccgatgggacaaaatgtcagaacggagactgggattttgccggcgagatgaatagcacctatcaatctaagaaagacttctttgaacatgatcttaagctgttctgcacactggtggagaacgccttccccgggaccaccgagtccctgttttacgaaatgctcagcaagaaaaatacaacgggagtcaagaaactgcttgacaagctgacccggaaattcggcaacaataacatgtttgtggggatttggaagttcggccagtacctcatgtctctgccttatgttaatgagacaagcctgacccccgctcaggtggccaagatccttgaagtcacagaccagcaccacagatccattagcggacgccaagagtctctcgcgtccgctaccccgggcagcaaatccaaggagtgtgggcatgccaaaaaggtgtcttgcatcagccctcggttttccgtgcccatggaaggactgatggcctgcggcgattctcctaactacaaaatctataagacgcccgctaagctgtacaaaagcaataacaagggggaggtttggtgttccggagacgtccactgctctcaggaactcacacccgccagccaggagtccgtggatagaattaaacagatcacctgtttcctgaccgaacctgaggtgagcgacgatgtcttttctattgctatctccacatgcaaggtgcaagacaaaggcgtttgtaccgtgaatgaggatcgctggaacgtcattaagtgcgacagcgggcttatctattacacagatcagcgggacggccaggatacgggaaatgacttcggcgaatattgtctgtctcattcctgcagaattgagcgctttccgatcaaccccgccatcattagcgattgtctctgggaataccactctcggaagtccaaatacatcaccagcctggacctggagaaccttgaagagttcaagagagcgatttccgagaaactcagccatacactgatcgtgtataattttaagcctaccgccaacctgccccacattaaacctgtttacaagtatatcacagtgcagggggtcgaaaattctgacggagtggatagcgcttacatcgccgcttccatgcccgccctctctggcaccagcattgggtataacatcatgtcccgcgacaatttcccgctgtttgatattatcattttcatcaaatctgcgatcattaaggccacgtacaaccacatctatgacaccggacctacaattggcatcaatgttatgcatgatgagcactgcaccgggcaatgtcccacagacattcctcataaggaaaactggatcaccttcgctcaggagcggacaagcagatggggctgcgaagagtttggatgccttgccgtgaataccggctgtgtcttcgggtcctgccaggatattatccgccccgagacgaaagtgtaccggaaggctgtggaagagtctgtcctgctcacagtttgtatcacctaccctggaaaaaccttttgcacagaaattaacgccatcgagcccaagattaccgacgagctggaactgcagttcaaaacggtggatacaaagacccttccgaatatcctggccgtgcaaaaccacaagctctatagcggccagattaatgacctggggtcctttagccagggatgtggcaacatccagaaaacaaattcttccatcattgggaccggcacagctaagttcgattacgtctgccatggagcgagcagaaaagacatcattgtgcggcgctgttataacaacaattacgagtcttgcaagctcctgaaagaagaacagtcccttatgtttgccgataaccacgaaaccatcgacgttgctaatgtgagacatctgctcggcgacctgcagttcaagctgatgcttggggatctgcggtataagagctttgccgagaaccctgacctcgagattgaagccaaatgtgtcggatgcccctcctgtttcacgtcttacagctgctcctttaagatcgtgagcaatatcgataccgtttgctctattgagggcccctgtacaaccttccacaacagactgatgatcacatccaccaaacaggactatgggattaagatgagctgcaaaacgaagcctaaggaaacagaggagttccaaatctgtaaaaagacctacacagtgctctttaccaccgtcgagaaaaatgataagattgagatctctacaggagaccagacgagcttcattcaggaacgcgatgaccggtgcaaaacctggctgtgtagagtgcgcgatgagggcatctccgttatctttgaaccgattagagctttctttggctcttacttcagcatcgccttttatgtggtcgtgtccattatcgtgcttttcctggcgatttacatctttctccccatggtcttcaagctgcgggacgttctgaagcgcaacgagtatctttacctgcaggaaatcaaacacaagtga

SEQ ID NO: 14224 - RNA, 4305 nt, synthetic construct
  misc_feature 1..4305: note = derived and/or modified CDS sequence (opt5) from NRIV(SUD-HKV66)__JX857320.1__GP
  source 1..4305: mol_type = other RNA
atgctgctcctgcttgtgctgctcatcccctgctacgtcagcgcctcccctgttgtgaccagatgtttccacggcgggcagctgattgctgagaagaaatctcaaacagccgtgagcgaattttgccttaaggacgatgtctccacgatcaaatctgagattacctatgaaaagaacaatacaggactgttcgcgcatagcaaagtgctccggaactggatcattaaggactggaagaattgtaacccggttcccaccgctggcgggtccatcaatgtgatcgaggtcaacacagatctgtctctgaccacaaaaacctacgtgtgcagccgcgactgtacgattaccgttgataaggaagacgcccagatcatttttcagacagagaaactcaatcacttcgaggtgtccggaaccacactgagctctggctggtttaagaccaaagcctccgtcacgcttgatagaacatgcgaacatatcaaggtgacctgtgggaagaaaacactgcagttccacgcttgctttaagcatcacatgagctgtattcggttctttcacggaaccatcctccctggcaccatggccacatctatttgccaaaacatcgagctgatcattatcatttcccttacgctgatcattttcatcctcatggtgatcctgaccaaaacatatatttgttacctgctcatgcccctgtttatgcctatcgcttatttctacggctggagctataataagtcttgcaaaaagtgctcctgttgcgggcttgcctaccatccctttaccaactgtggaagccactgcgtctgtggcctgaaattcgaagcgtccgaccgcatgcggattcatagagagtctgggctctgccagggatacaagagcctgcgcgttgccagacttctgtgtaagtccaaaggcagctctctcatcatttccatcctgctggctatgctcatcctgagcttcgtgacacctattgaggggacccttacgaattatccggaatctcggaagtacgatctggaggaaatcgccgacgtgctcgagggatttattgtcgaaaaaggcatcaaggagtatgtggttttctacacaagcatttttggcgctctgttccttctgatggccctcgtgatcaccattaccctgaacaaagtcacagagtatctgaccaatatcaacgtgctctactgccacgaatgttccatgtatcactctaagaagaatatcaaatacattggggattttacaaacaagtgcggattctgtacgtgcggcgagctggaagaccaggaggggcttaaaatccataaggttagccgcaaatgcatttacaagtatcagctgacctggtccaagatcattatgacaatcctcgtgtgtctgctgatcgcgcaaaacaccattcttatcgtcgccgctagcgatgactgctggacaaagaagtctctcgaaatggagtgtattggacccctgcaacaggtggatacctgcgacgacaaagcctccagaagctactctggcgaggctaagaaactggtccgggcctccaagatcagcgatctcgacgccgctcaggtgcgcctgcttgggcctacgattgaatccgcgatcgcctctatcagaaagcaacggacctatagcacaatgcatctgctcgagtccgtttttctgggaaaacactgtgattactataagaccttcgaacacaattctggctacagccaggctaaatggcgcctgacagccaagacccatcactttgacatttgctccagacacagcacgcatcacttctgtcggtgcatctctgatgccacaaaatgtcagaacggcgactgggattttgctggggagatgaatagcacctatcaaagcaagaaagacttctttgaacatgatcttaaactcttctgcacactggtggagaacgccttccccggaaccaccgagtctctgttttacgaaatgctctccaagaaaaatacaacgggcgtcaagaaactgcttgacaagctgaccagaaaattcgggaacaataacatgtttgtgggaatttggaagttcggccagtacctcatgagcctgccttatgttaatgagacatctctgacccccgctcaggtggcgaagatccttgaagtcacagaccagcaccaccgcagcatttccgggcggcaagagagcctcgcctctgccaccccgggctccaaaagcaaggagtgtggacatgctaaaaaggtgtcctgcatctctcctagatttagcgtgcccatggaaggcctgatggcctgcggggattcccctaactacaaaatctataagacgcccgctaagctgtacaaatctaataacaagggagaggtttggtgtagcggcgacgtccactgctcccaggaactcacacccgcctctcaggagagcgtggatcgcattaaacagatcacctgtttcctgaccgaacctgaggtgtccgacgatgtctttagcattgcgatctctacatgcaaggtgcaagacaaaggggtttgtaccgtgaatgaggatcggtggaacgtcattaagtgcgactccggacttatctattacacagatcagagagacggccaggatacggggaatgacttcggcgaatattgtctgagccattcttgccgcattgagcggtttccgatcaaccccgccatcatttccgattgtctctgggaataccacagcagaaagtctaaatacatcacctccctggacctggagaaccttgaagagttcaagcgcgctattagcgagaaactctcccatacactgatcgtgtataattttaagcctaccgccaacctgccccacattaaacctgtttacaagtatatcacagtgcagggagtcgaaaatagcgacggcgtggattctgcttacatcgccgcgagcatgcccgccctctccgggacctctattggatataacatcatgagccgggacaatttcccgctgtttgatattatcattttcatcaaatccgctatcattaaggccacgtacaaccacatctatgacaccggccctacaattgggatcaatgttatgcatgatgagcactgcaccggacaatgtcccacagacattcctcataaggaaaactggatcaccttcgctcaggagagaacatctcgctggggctgcgaagagtttgggtgccttgccgtgaataccggctgtgtcttcggaagctgccaggatattatccggcccgagacgaaagtgtacagaaaggccgtggaagagtccgtcctgctcacagtttgtatcacctaccctggcaaaaccttttgcacagaaattaacgctatcgagcccaagattaccgacgagctggaactgcagttcaaaacggtggatacaaagacccttccgaatatcctggcggtgcaaaaccacaagctctattctgggcagattaatgacctgggatccttttcccagggctgtgggaacatccagaaaacaaatagctctatcattggaaccggcacagccaagttcgattacgtctgccatggggcttcccggaaagacatcattgtgcgcagatgttataacaacaattacgagagctgcaagctcctgaaagaagaacagtctcttatgtttgccgataaccacgaaaccatcgacgttgccaatgtgcggcatctgctcggcgacctgcagttcaagctgatgcttggagatctgagatataagtcctttgctgagaaccctgacctcgagattgaagccaaatgtgtcggctgccccagctgtttcacgtcctactcttgcagctttaagatcgcgtccaatatcgataccgtgtgcagcattgaggggccctgtacaaccttccacaaccgcctgatgatcacatctaccaaacaggactatggaattaagatgtcctgcaaaacgaagcctaaggaaacagaggagttccaaatctgtaaaaagacctacacagttctctttaccaccgtggagaaaaatgataagattgagatcagcacaggcgaccagacgtctttcattcaggaacgggatgacagatgcaaaacctggctgtgtcgcgtcagagatgaggggatcagcgtgatctttgaaccgattcgggctttctttggatcctacttctctatcgccttttatgttgtggtcagcattatcgtgcttttcctggccatttacatctttctccccatggtgttcaagctgcgcgacgtcctgaagagaaacgagtatctttacctgcaggaaatcaaacacaagtga

SEQ ID NO: 14225 - RNA, 4344 nt, synthetic construct
  misc_feature 1..4344: note = derived and/or modified CDS sequence (opt5) from BWAV(M459)__NC_034490.1__GP
  source 1..4344: mol_type = other RNA
atggccatgttcgagctgatcgtgctcctggcttttagctacgtcaccggcgttccccaggaacttacaagatgcttcaccgggggatccgtggtgcggcaacactggtctaagaacgccattagcgagctgtgtctcaaagacgatgtctccatcattaagtctgaaatcgagtataaaaagaatgaaacgggcacatttgcgctgagcaaaatttaccgcaagtggatcaccacagactgggagaagtgccagcctcagaaatccaccgggggacatatctctgtgcttgaggttagacacgatctgacactcgctagcgccacctatatttgtggcaacccgtgcacgatcaatgtggaccgggaaatggcccaggtccatctgcaaaccgagggggtgaaccacttcgaaatttccggaacaaccatcaagagcggctggtttaaaacaaccacgtacattacactggatcagacctgtgagcatctcaaggtttcttgcggcaaacagtccgtgcagttccacgcttgttttaagcaacacatggcctgcgtccgcttcctgcatagaacaatccttcccgggaatatggctaacagcatttgtcagaatatcgagatcattatcctgctcgccctgaccctttctatttttatcctgctctgcattctgaccaagacatatatctgttacatcctgctccctattttcatccccatttcctatatctacggatacttttataaccggagctgcaaaaagtgctctcagtgtggcctggtgtaccaccctttcacggaatgcgggcgcaattgtgtgtgcggagcgagatatgacacctccgagcggatgaaacttcatcgcctgagcggcctctgtcccgggtacaagtccctgaaagccgctagagtcctttgcaagtctaaaggaagcgcctccattctgagcatcctcatctctctgctgattctcacatttgttacccctatcaacggcctgatgcttaaggatacagacattaccaatctgaagatcgatacgctcccggacgatatgctggaacttattcacaacgtggactatctgaaactcatcctggagattaatatcacaatcttcggcttcattctgatcattatcctctttatgctgcttatgttctaccggtatcagcacatttttatctccatctacgtgattgattgtaaggaatgcaacatgtaccatagcaaatctgggctgcgctataatggagacttcaccaacaagtgtatgacctgcacatgtggcgaggtcgacgatatggaggggctcaacaaacacaagaagagatacaattgcctgatcaaatataagaccacaattctgcaacactttttccttagcatcctcgtgtgcctgattctgaaagaatccgttctctttgctgccgcgcagtctgaggaaatcatcaagtgtctggagcaggaaagccttacgtccaaatgcaccggacccctgctcaagacacctcaatgtaccgagcagcagaagaacctgctgttcattgagatcgccaaacagatggaaaaggacaatattatcacaagccttgataacgctctcattgccaaactgcccaatgagatcgctggctctatggccatcctggacaccaagaaatactatcatgaacaaattacgctcgagtacgccatcctgtccaagtattgcgattactacaagaaatatgaagggaacaccggatacagccagacaacctggcggacatatcttcgctctcaggacctggagatttgtctcatcctgccttaccagtttttctgcagatgttttaagtccggcaccggctgcattgatacgaaaatggagatcaagagcacaatggacacctattactcctctcatcaaacaaaattcgatagcgacctgaattatatgcttcacgtgattcacctcgcttttcgggggtccgcgacctcttacatcgccaagtgtctgatcgaaaagaactacaccgagacaattagctatctgacgaagatccaggaaaagtaccccaataaccagctcctgaaagtcgctattttcttcaccaatcatcttctgaaccagtccctcgtggagaattttgaggttagcacagaatggtctagatataagcactccaccgcccaaccggagcatgaatggaaaaagggaagcgagctgaaaatgctggatcctaacaaacttaagacaggccccgccatccagacctgcctccacattaaagacctgcactgtatctctcctcgctcccgggctcccacgagcgggatcattacatgcggactgaatgaccaggcctgcgtgtacagaaagcccgataaaaagatctatgcgtctcatatgacccagcacggcttctgtgtcatggacgggcattgcctcaaaccttttgaaccgattagcggcgagatgctgcaaatcattaagaagtccaaatgttggaccgaggatatcgaagaccttatcacagagggacaggataagggccgcattagctgccagcccatcgacgtggggaactgtaacgtctctggaaatctgtggaccattacactctgctccgataaaaagttctactatacggacaacaaacacgtgcatgataatagcaaggacatcggctactactgtatggaagagaactgcaagattcctcggtttcccatccaccctgatttcgttaaagactgtgaatgggatctgaatcacattaagatcgaccatctgaaacaaatcaacattgaggacatcaattcctataagaaaattcttaccgagaagctgacaaccgctctcaactcttttaaatacaaggggaatgaaaacctgccccacagcatcccgaagtataaatacattacaatccagggaacccagacgatcgatggcattgagaatgccttcatcgaagtggagattcctgccctctccgggtctgctaccggctttaagatcagctccagagacggaattgaactgttcgatgccatcctttatgtcaaacaggcttcttttagctccgtgtacaagaaactgtatgttacaggccccaccatcgggattaacacaaagcatgacgagcgctgcaccggagcctgtcctatgacactcccccacagctacggctggctgaccttctctaaggagcggacgtcccaatgggggtgcgaagagtacggatgcctggcgatcagcgatggctgtgtgtttgggtcttgccaggacattatcaaagatgaccttacaatttatagaaaggaaaccgaggagctgtccctcgccgaaatctgtattaccttcatgcataatacattctgcaccagcatcgattctacgacacctaccatcacagacattctggaggctcagtttaaaaccgtcgaatccttcaagctccccaacacagtgggcctgaaaatgcacaaactttacatcggaaccattaatgatatcggcgtgtataagaaggcctgtgggaacgttcagaagtacaacaatacgattctgggaagcggctccccgaaatttgactatgtctgccacctcgctaagcgcaaagatgtgatcctgcggaagtgtttcgacaacgactacaatagctgcaagctgcttaaagtggccaacgatctgagaatcgaggaagacggggagaagctcaaagtcattaattataagaaagtgatgggaaccctgaagtttaaggcgatcttcggcgatattaaatacaagtcttttacacaagacgttgatatcgacgccgaggctacctgtgtggggtgcctcaactgtttcgaaaatattaactgcgagatcaaagtccagagccctctggaaacaacctgcgaggtggaatcctcttgtgatctttttacgacacgcatcctgttccatcaggacattcacaagtacgccctgaaactcatctgcagcaaggaggcttcctctaaattttggattcggttctgtaataaggagatcaagagctccatttctctgatcaacgccgcccccattcttgaactggctcccatcgatcagaccagctatgttaaagaggaagacgagagatgcggcacatggatgtgtcgggtggcgcaagaaggaatcggcgtcattttcgagccttttaagaatctcttcgggtcctacctgggaatcttttatattatcattatcgtgatcattctcctggttcttttcgtgtacatctttctgccgatgattctgaaactcaaggagatcctgcagaaaaacgaagtcgcctatcagcgcgatatgaagattagatga

SEQ ID NO: 14226 - RNA, 4344 nt, synthetic construct
  misc_feature 1..4344: note = derived and/or modified CDS sequence (opt5) from BWAV(UgAr1888)__KJ867186.1__GP
  source 1..4344: mol_type = other RNA
atggccatcttcaagctgattgtgctcctggcttttagctacgccaccggcgtcccccaggagctttccagatgcttcacagggggatctgttgtgcggcaacactggagcaaaaacgcgatctccgaactgtgtctcaaggacgatgtgtctattatcaaaagcgagattgaatataagaaaaatgagacgggcacctttgctctgaacaagatctaccgcaagtggatcacaaccgactgggaaaaatgccagcctcagaagtccacagggggacatatttctgtccttgaggtgagacacgatctgaccctcgccagcgccacatatatctgtggcaatccgtgcaccattaacgttgaccgggagatggctcaggtgcatctgcaaacggaaggggtcaatcacttcgagatctccggaaccacaattaaaagcggctggtttaagaccacaacctacatcacgctggatcagacatgtgaacatctcaaagtgtcttgcggcaagcagtccgttcagttccacgcctgttttaagcaacacatggcttgcgtgcgcttcctgcatagaaccattcttcccgggaacatggccaatagcatctgtcagaacatcgagattatcattctgctcgcgctgacactttctatctttattctgctctgcatcctgaccaaaacctatatctgttacattctgctccctatcttcattcccatctcctatatttacggatacttttataatcggagctgcaagaaatgctctcagtgtggcctggtctaccaccctttcacagagtgcgggcgcaactgtgtgtgcggagccagatatgacacgtccgaacggatgaagctccatcgcctgagcggcctctgtcccgggtacaaatccctgaagaccgctagagtgctttgcaaatctaagggaagcgcctccatcctgagcatcctcatttctctgctgatcctcacatttgtcacccctattaatggcctgatgcttaaggatacagacatcaccaacctgaaaattgatacgctcccggacgatatgctggagcttatccacaatgttgactatctgaagctcattctggaaatcaacatcatgattttcggcttcatcctgattatcattctctttatgctgcttatgttctaccggtatcagcacatctttatctccatttacgtgatcgattgtaaagagtgcgacatgtaccatagcaagtctgggctgcgctataatggagacttcacaaacaaatgtatgacctgcacctgtggcgaagtggatgacatggaggggctcaacaagcacaagaaaagatacaattgcctgattaagtataaaacaaccatcctgcaacattttagcctttccatgctcgtctgcctgattctgaaggagtctgtgcttttcgctgccgcgcagcccgaagagatcatcaaatgtctggaacaggagagccttacatccgaatgcacgggacctctgctcaagacaccccaatgtaccgagcagcagaagaacctgctgtttatggagattgccaaacagatggaaaaggataatgttatcaccagccttgacaacgctctcattgccaaactgcctaatgagatcgctggctctatggccattctggatacaaagaaatactatcacgaacaaatcaccctcgagtacgccatcctgtccaagtattgcgactactacaagaaatatgaagggaacacgggatacagccagaccacatggcggacctatcttcgctctcaggatctggagatttgtctcatcctgccctaccagttcttttgcagatgtttcaagtccggcacaggctgcattgacaccaaaatcgagtttaagagcacgatggatacatattactcctctcatcaaaccaaattcgacagcgatctgaattatatgcttcacgtgattcacctcgcttttcgggggtccgcgacatcttacatcgccaagtgtctgattgaaaagaactacaccgagaccatcagctatctgacaaagatccaggaaaagtacccgaataaccagctcctgaaagtcgctattttcttcacgaatcatcttctgaaccagtccctcgtggagaattttgaggttagcaccgaatggtctagatataagcactccgccacacaacctgagcatgaatggaaaaagggaagcgagctgaaaatcctggactctaacaaacttaagaccggccccgccattcagacatgcctccacatcaaagacctgcactgtatttcccctcgcagccgggctcccacctctgggatcatcacgtgcggactgaatgatcaggcctgcgtgtacagaaagcccaacaaagaaatttatgcgagccatatgacacagcacggcttctgtatcatggacgggcattgcctcaagccttttgagccgatttccggcgagatgctgcaaatcattaaaaagagcaagtgttggaccgaagatatcgaggaccttatcaccgaaggacaggataaaggccgcatttcttgccagcccatcgacgtcgggaactgtaatgtgtccggaaacctgtggacaattaccctctgcagcgataagaaattctactatacagacaataagcacgtccatgattcctctaaagacgtgggctactactgtatggaggaaaactgcaagatccctcggtttcccattcaccctgatttcgttaaggactgtgagtgggatctgaatcacatggagatcgaccatctgaaacaaattaacatcgaagacatcaatagctataagaaaattcttacggagaagctgatcaccgctctcaactcctttaaatacaaggggaatgaaaacctgccccactctattccgaaatatgagtacatcacaattcagggaacccagacaatcgatggcatcgaaaatgccttcattgaggtggagatccctgccctcagcgggtccgctaccggctttaagatttctagcagagacggaatcgaactgttcgatgccattctttatgtcaagcaggcttcctttagctctgtgtacaaaaagctgtatgttacgggccccaccatcgggatcaacacaaaacatgacgagcgctgcaccggagcctgtcctgtgacactcccccactcctacggctggctgaccttcagcaaggaacggacatctcaatgggggtgcgaggagtacggatgcctggcgatttccgatggctgtgtctttgggagctgccaggacatcattaaagatgaccttaccgtgtatagaaaggaaacggaggaactgtctctcgccgagatctgtattacattcatgcataataccttctgcacctccatcgatagcacaacccctacgattacagacatcctggaagctcagtttaagaccgtggagtccttcaaactccccaacacagttggcctgaagatgcacaaactttacatcggaaccattaatgatatcggcgtctataagaaagcctgtgggaacgtgcagaagtacaacaatacaattctgggaagcggctctccgaagtttgactatgtgtgccacctcgctaaacgcaaggatgtcatcctgcggaaatgtttcgacaacgactacaatagctgcaagctgcttaaagtggccaacgatctgagaattgaggaagacggggagaagctcaaggttatcaattataaaaaggtgatgggaaccctgaaatttaaggcgatcttcggcgatgtcaaatacaagtcctttacgcaagacgtggatattgacgccgaagctacctgtgttgggtgcctcaactgtttcgagaatatcaactgcgaaattaaggtgcagtctcctctggagacaacctgcgaggtcgaaagctcctgtgatctttttacaacccgcatcctgttccatcaggacattcacaaatacgccctgaagctcatctgctctaaagaggctacgagcaagttttggatccggttctgtaaaaaggaaattaaatcctctatcagcctgattaatgccgcccccatccttgagctggctcccattgatcagacatcctatgtgaaggaagaggacgagagatgcggcacctggatgtgtcgggttgcgcaagaaggaatcggcgtgattttcgagccttttaagaacctcttcgggagctacctgggaatcttttatatcattatcattgtcatcattctcctggtgcttttcgtgtacatctttctgccgatgatcctgaaactcaaggaaattctgcagaaaaatgaggtcgcctatcagcgcgatatgaaggttagatga

SEQ ID NO: 14227 - RNA, 4332 nt, synthetic construct
  misc_feature 1..4332: note = derived and/or modified CDS sequence (opt5) from BWAV/PGAV(SAAr1)__KJ867177.1__GP
  source 1..4332: mol_type = other RNA
atgatctgcatttgtatcttcgtggccatttttcccgctatctacgccattcctgacagctattccagatgcttcaccggcgggacagtcgttaaggagatgtggtctaaagatgcggtgacggaactgtgtatcaaggacgatgtgagcatcgtcaaaaccgagacatcctacaagaaaaacggaaccggcacatttgctctcaataaggtgacccggaagtggctgatgacagactgggaaaaatgcaagccgcagaaatctagctccgggcacattaacgttatcgaggtgcgcgatgaccttaccctggccacgtctacctatatttgtagctccagctgcacaatcaatgtcgatagagaaaccgcccaaattcagctcaacacagactctatcaatcatttcgagattgctggaaccacgatcaagacaggctggtttaaatccaccacactggtggcccttgatcagacctgtgagcacctgaaggttagctgcgggaagcagtctgtgcaattccatgcttgttttaaccagcacatgtcctgcgtccggttcctccatcgcaccatcctgcccggaaatatggccaaaagcatttgtcagaacatcgaaattatcattctggtgggcctcatcatcctgatttttcttctgctctgcatcctgacaaagacgtacatttgctatatccttctgcctattttcatccccctctcttacgcgtatggctacttttacaataaagcctgtaagaaatgctcccagtgtgggctggtgtatcaccctttcaccgagtgcggaagcaactgtgtctgcggcgctagatacgacacatccgaacggatgaagctgcaccgcatctctgggctctgtcccggatataaaagcctgagaaccgcccgggttctttgcaagtccaagggcagcgcttctattctgtccatcctcattagcatcctgattcttatgtttgtgacacctatcaatgggtacatgattaccaacgagttcgatgagggaaaactgacggtggactctctcccggatgacatgctgagcatgatctcccgcctgtctgccctccaattcatctttacactgaatattgcgtgtagcgtccttgtgaccctgctgacctgcctcttccttatcatcttttatagattccagcatcggtttctgtccaagtacgccattaactgtacagaatgcgacatgtatcaccagaaaaagggcctcatttacaatggcgatttcaccaacaaatgcatgacatgtacgtgcggggaggttaacgacatggaaggactgaataagcataagaaacgctacaactgtctgatcaagtataaagctgcctggtttctcaatctgaccatcacaattatctgccttatgctgattaaggatggcagcatgatggctgccgccgagaccaacatcgaaacatgtatggctaaaccctctctcaccacggactgcaccgggcctttcctgaagattacaaagtgtgatgagtcccagaaagcgctgccctttcaagagatcgccaagcagcttgtgaaaagcaatgtcctcaccctgctggacaagcacatcgtggaaaaactccctaacgagattgctggatctctgtccatccttgataagaagcagcactaccatgaacaactggccgttgagtatggcattctcagcaaatactgcgactattacgaactgtataagtccaattctgggtacagccagtccacatggggaacctacctgagatctcacgatttcgagatctgtcttctcctgccctatcagtacgtgtgccggtgttttaaaagcggcacgggctgcacagacaccaagttcgagtttgaacagaaaatgaacgagacatataattccaagaacgatatgtacaatagcgacttcaccctggccctcaccgtcctgcatcttgctatgcgcgggacagcctctacgtatattatcgacaacgtgctgcagaaaaattactccaacgtcatcgaatatctcaataccacaaagaacaacttcaagagcaatcaagtgtttggagttctggtggatttcaccatttacctgcttagacacgcgtcttacgctaaatataacctcccgcagtccctgaagaaatttcggagcgtctctagcgacctgacaaccatctccggcagaagctctgggcagaatattgtgtccgatctccatcaaggagacgttatcaagacgtgcctgaacattaaacagcttaattgtatcagccctaagtcccgcacaaccaccacaaacctgattacctgcggctctagccagatctccgtgtacaatctcccccgggggcagctgtatgagtctgtcacaacggaacacggcacctgtgccggagatggccactgcctgacagacttcatgcctatcaacagcgattttcttgccaccctcaagaaatccaagtgttggacaaccgacattcccaatatcattaaactggtggagtctgatgggaagatcagctgccaacccattgacgtgggatcctgtaacgttagcggcaatatctggacgatcaccaaatgctctgataacaagtactattacacagacaataagcatgtccacgatgacgagaaagacattgggcattattgtatggaagagacctgcaagttcgtgagatttcctatcaacgataaattcgtgtccaattgtgaatgggacctgaaccacattgagatcaacaagctcaatcaggtcgagctggataacattaatgcttacaaaaaggtgcttacagaaaagctgaccagctctctctccgtttttaaatacaagctgacacagaacctgccgcacgtgatccccaaattcaagtatatcaccattcagggaacgcaaacagtcgacggcatcgagaatagctttattgaagtggagatccctgccctttctggggctgcctccggcttcaaaattatgaccaaggaaaacaatgagctgtttgatgcgatcctctacgttaaacaggccagcttctccagcatttataagaagatctacaccacaggacccaccatcggcattaacacgaaacatgacgagaagtgcacaggggcttgccctgtgaatctgccccactctaccggatggctcacattcgccaaagaacgcaccagcacatggggctgtgaggaatatgggtgcctggctatcaacgatggatgtgtctttggctcctgccaggacattatcaaggatgagatgtacattttcaaaaaggaaaccgaggaggtggcccttgttgaaatctgtatctcttttaatcataagacgttctgcaccgacgtggatagcacaaccccgattatcacagacaccctggaggcgcaatttaaaacggtcgaatcctataagctccctaaccacgtggccctgaaacagcataagctgtacgtggggcagattaatgatttcggcgtctacaaaaaggcttgtggaaacgttcagaagatcaataacacaatttatggcgaggggacaccccggtttgactacctttgccacctggccaaaagaaaggacgtgctcgtgcgcaaatgtttcgataacgactataattcttgcagcctgctcaccatcgctgatgacctgcggcttgaagaggatggagagaagctgaaagtcatcaactacagaaaggtgctcggctccatgaagtttaaagccctgttcggggacattcgctataagtcttttaccgaagatatcgagctggacgttgaagccagctgtgctggatgcattaattgcttcgataacatccactgtgagattaaacttaccaatggcctggacacatcctgcagcttcgagtcttcctgtgatgcgtttaacagccggatcctcttcaattctaaccaacatgtgtactccacgaagctgatttgcaccaaagaacagacaaaggcctttgagatcaagatctgtgggaaaaccattaaggctgacctcgtcgtgacagaagccaaacctatcctggagcttacccccattgaccagacgagctatatcaaggaagaggatacaagatgcggcacctggttctgtcgcctgaccaaagagggattttccgttctgctcgaacctttcaagaatctgtttggctcttaccttgggattgcctacacaatcatcattgctctgctctgcctgttcgtgtttatctatattatcctccccatgattatgaaactgaaggaggtccttaagcagaacgaaatcgcctaccaaaaagagcagaagaaacggtga

SEQ ID NO: 14228 - RNA, 4332 nt, synthetic construct
  misc_feature 1..4332: note = derived and/or modified CDS sequence (opt5) from BWAV/PGAV(191B-07)__KJ867180.1__GP
  source 1..4332: mol_type = other RNA
atgatctacatttatatcttcgtggccatttttcccgctatctacgccattcctgacagctattccagatgcttcaccggcgggacagtcgttaaggagatgtggtctaaagatgcggtgacggaactgtgtatcaaggacgatgtgagcatcgtcaaaaccgagacatcctacaagaaaaacggaaccggcacatttgctctcaataaggtgacccggaagtggctgatgacagactgggaaaaatgcaagccgcagaaatctagctccgggcacattaacgttatcgaggtgcgcgatgaccttaccctggccacgtctacctatatttgtagctccagctgcacaatcaatgtcgatagagaaaccgcccaaattcagctcaacacagactctatcaatcatttcgagattgctggaaccacgatcaagacaggctggtttaaatccaccacactggtggcccttgatcagacctgtgagcacctgaaggttagctgcgggaagcagtctgtgcaattccatgcttgttttaaccagcacatgtcctgcgtccggttcctccatcgcaccatcctgcccggaaatatggccaaaagcatttgtcagaacatcgaaattatcattctggtgggcctcacaatcctgatctttcttctgctctgcattctgacgaagacctacatctgttatattcttctgcctatcttcattcccctctcttacgcgtacggctatttttacaataaagcctgcaagaaatgctcccagtgtgggctggtgtatcaccctttcacagagtgcggaagcaactgtgtctgcggcgctagatacgacacctccgaacggatgaagctgcaccgcatctctgggctctgtcccggatataaaagcctgagaacagcccgggttctttgcaagtccaagggcagcgcttctatcctgtccattctcatcagcattctgatccttatgtttgtgacccctattaatgggtacatgatcacgaacgagttcgatgagggaaaactgacagtggactctctcccggatgacatgctgagcatgatttcccgcctgtctgccctccaattcatctttaccctgaatatcgcgtgtagcgtccttgtgaccctgctcacatgcctgttccttattatcttttatagattccagcatcggtttctgtccaagtacgccattaactgtaccgaatgcgacatgtaccaccagaaaaagggcctcatctataatggcgatttcacaaacaaatgtatgacgtgtacctgcggggaggttgacgatatggaaggactgaacaagcataagaaacgctacaattgcctgattaagtataaagctgcctggtttctcaacctgacaatcaccatcatttgccttatgctgatcaaggacggcagcatgatggctgccgccgagtctaatattgaaacatgtatggctaaaccctccctcaccacggattgcaccgggcctttcctgaagatcacaaagtgtgacgagagccagaaagcgctgccctttcaagagattgccaagcagcttgtgaaatctaacgtcctcaccctgctggataagcacatcgtggaaaaactccctaatgagatcgctggatccctgagcattcttgacaagaagcagcactaccatgaacaactggccgttgagtatggcatcctctccaaatactgcgattattacgaactgtacaagtctaacagcgggtattcccagtctacatggagaacctacctgcggagccacgacttcgagatttgtcttctcctgccctatcagtacgtgtgccgctgttttaaatccggaacgggctgcacagataccaagttcgagtttgaacagaaaatgaatgagacatataacagcaagaatgacatgtacaactctgacttcaccctggccctcaccgtcctgcatcttgctatgagaggcacagcctccacgtatatcattgataatgtgctgcagaaaaactacagcaatgtcatcgaatacctcaacaccacaaagaataacttcaagtctaaccaagtgtttggggttctggtggacttcaccatctatctgcttcggcacgcgtcctacgctaaatataatctcccgcagagcctgaagaaatttagatctgtcagctccgatctgacaaccattagcggacggtcttccggccagaacatcgtgagcgacctccatcaaggggatgttattaagacgtgtctgaatatcaaacagcttaactgcatttcccctcgctctagaacaaccaccacaaatctgattacctgcggaacaagccagatctccgtgtacaacctcccccgcggccagctgtatgagtctgtcacgaccgaacacgggacatgtgccgacgatggccactgcctgaccgacttcatgcctatcaatagcgattttcttgccacactcaagaagtccaaatgttggaccacggacatccccaacattatcaagctggtggagtctgatggaaaaattagctgccaacccatcgacgtgggctcctgtaatgttagcgggaacatttggaccatcacaaagtgctctgataataaatactattacaccgacaacaagcatgtccacgacgatgctaaggacatcggacattactgtatggaggaaacatgcaaattcgtgcggtttcctattaatgataagttcgtgtccaactgtgagtgggacctgaatcacatcgaaattaacaaactcaaccaggtcgagctggataatatcaacgcctataagaaagtgcttaccgagaagctgacaagctctctctccgtttttaagtacaaactgacccagaatctgccgcacgtgattcccaagttcaaatatatcacgatccagggcacacaaaccgtcgacgggattgaaaacagctttatcgaggtggaaattcctgctctttctggagccgcgtccggcttcaagatcatgaccaaagagaataacgaactgtttgatgccattctctacgttaagcaggctagcttctccagcatctataaaaagatttacacaaccgggcccacgatcggcatcaatacaaagcatgacgagaaatgcaccggagcctgtcctgtgaacctgccccacaatacaggctggctcaccttcgctaaggagagaacatctacctgggggtgcgaagagtatggatgcctggccattaacgatggctgtgtctttgggagctgccaggacatcattaaagatgaaatgtacatcttcaagaaagagacggaagaggtggcgcttgttgagatttgtatctcctttaatcataagaccttctgcacagacgtggattctaccacaccgatcattaccgacacgctggaagcccaatttaagacagtcgagagctacaaactccctaaccacgtggctctgaagcagcataaactgtatgtgggacagatcaatgacttcggcgtctacaagaaagcctgtgggaacgttcagaagattaataacaccatctatggcgaaggaacaccccgctttgattacctttgccacctggctaagcggaaagacgtgctcgtgagaaagtgtttcgataacgactataattcctgctctctgctcaccattgccgatgacctgcgccttgaggaagatagcgagaaactgaaggtcatcaactaccggaaagtgctcggctccatgaagtttaaggccctgttcggggacatcagatataaatcttttaccgaggatattgaactggacgttgaggctagctgtgcgggatgcatcaattgtttcgataacattcactgcgaaatcaaacttacaaatggcctggacacgtcctgcagcttcgagtcttcctgtgacgcctttaacagccgcattctcttcaattctaaccaacatgtgtactccaccaaactgatctgcacaaaggagcagaccaaggcttttgaaattaagatctgtgggaagacaatcaaagccgatctcgtcgtgaccgaggccaagcctattctggaacttacgcccatcgaccagacaagctacattaaagaggaagatacccggtgcggaacctggttctgtagactgacaaaggagggcttttccgttctgctcgagcctttcaaaaatctgtttgggtcttatcttggcatcgcttacaccgtgattatcgccctgctctgcctgttcgtctttatctatattatcctccccatgattatgaagctgaaagaagtgcttaagcagaacgagatcgcgtaccaaaaggaacagaaaaagcggtga

SEQ ID NO: 14229 - RNA, 4326 nt, synthetic construct
  misc_feature 1..4326: note = derived and/or modified CDS sequence (opt5) from CEV(283)__KX817313.1__GP
  source 1..4326: mol_type = other RNA
atgatcttcatgctgattctctttgccgtggctgccgcgagccccgtctaccagagatgcttccaagacggcgctatcgttaagcagaacccttccaaagaggccgtgaccgaagtgtgtctgaaggatgacgtctctatgattaaaacagaggcccggtatacgaagaatagcaccggggtgttttccaacaatgttgctatccgcaaatggcttgtgtctgattggcacgactgcagaccgcggaaggtcgtgggaggccatattaacgttatcgaagtgggggatgacctgacactccacaccgagagctacgtctgttccgccgattgcacaatcggagtggacaaggaaaccgctcaggtgcgcctgcagacagataccacgaatcatttcgagattgccggcaccacagtcaaatctgggtggtttaagagcaccacatatatctcccttgaccaaacctgtgagcacctgaaagttagctgcggacccaagtctattcagttccatgcgtgttttaaccagcacatgtcctgcgtgagattcctccaccggacgatcctgcctggcagcattgccaattctatctgtcagaacgtggaaattatcatcctggtcacactcgctctgcttatttttatcctgctctccattatcagcaaaacctacatttgctatctgcttatgcccatcttcatccctattgcctacatctatggcctgatttacaataagtcttgtaagaaatgcaagctctgcgggctggtgtaccatccctttacagagtgtggaacccactgcgtttgtggcgctcgctatgatacctccgacagaatgaaactgcatcgggccagcgggctctgccctggatacaagtccctgcgcgcggccagagtgatgtgtaaatctaagggcccggctagcatcctttccattatcacagccgtcctgatcctcacgttcgtgacccccattaacgctatgatggttggggaaagcaaagagacatttgagctggaagaacttcctgatgacatgctggaaatggccaataacctcaatacctattacatgctgtgcgtggccaactatgctgtcacatggtctctgctcatcgtggcgctgattatcggacttctgttcaagaagtaccaacaccggttcctcgacatttatgccatgtactgtgaggaatgcgatatgtaccacgaccgctccggcatcaaatggaatggcgattttaccaacaagtgtgggcattgcacgtgtggacagtatgaggacgctagcggcctgcttgtccacagaaaaacatacaactgcctgattcagtataagtctaaatggatcatgaatttcctcgtgacctacgttatcctggtgctgctcaaggatagcgtcgtgattgttcaggccaagggggtggacttttccgagtgcatcgaagccgagaaagtccggtggaactgtaccggacccttcgtgaatctgggcaactgcgaaaagaaacaaaagaaagagccttattctaatattgctgcccagcttaaggggctgggagcgatcagcattctcgatgtgcccatcatcgcttccattccggaagacatcgccggcgccctgcgctacattgaggatcagagaagctatcattctcaactgacagttgagtacgctatgcttacccggtactgtgactattacacacagttttccgataacagcggctattctcagacgacctggagagtctacctccgctcccacgacttcgaagcctgcgtgctgtatcctaatcagcatttttgtcggtgcgtgaagcacggggacaaatgtagctcctctaactgggatttcgctagcgagatgaagaattactattccggaaaacaatctaagtttgacaaagatctgaacctcgccctgacaagccttcaccatgcgttcagaggcacctccagctcttacatcgccgggctgctctccagcaaggctaatgacgaactggtccagtacacatctaagattcgcgagaaatttcccggaaacgccctgcttaaggctgtgatcgattatatcgcctacatgaaaggcctcaccgaaatgtccaatttcaagaaagacgagttttgggatgagctggtttatgtgcctgaccccacgaagccccctaaactgagccggtctagcgggaccgtctacgatttcaagtccgcgacaagcaacctcggcgaaaagaattgcaaagacgtgaagggagttgtgtgtctgtctccgagatccggcgtcacctatgatagcattatcgcctgcggggagggatcctctcccaacatttaccgcatccctaaaacaggcgtgtatcagagcaactccgaaccctctaattactgtgttagcgactcccactgccttgaggatttcgaggtgattaaccaggaggagctggacgctatcaagaaatctcggtgctgggaagtcgactacctctatgccaatcctagcaagcaatccgatgggatcagaagctgtcgcatgcgggacgctggacattgcaacgtgaccacgaatagatggcccattatccagtgtgatgacaacaagtactattactctgagctgcagcgcgattatgacaaagaacaggatattggccacttttgcctgtccccgcggtgtacaaccgtgagattccctatccaccccaagcatgtcagcaattgcgactggcaagtttctcactccacagtggataaagtggacgtccataaccttgaggatattgagcagtaccggaaggccatcacccagaaactccagaatagcctgtctatttttaagtatgcccgcaccaagaacctgcctcacatcaaacccatctacaagtacattacaatcgaagggacggagaccgctgaaggcattgagtccgcgtatatcgaaagcgagattcctgccctcgctggaacatccatcggcttcaaaatcaataccaaggaggggaaacatctgcttgacgtgattgcctacgttaagcaagccagctattctagcctgtacaacaagatgtatgtgacaggacccaccgtcggcatcaatacgaaacacgatgaactctgtacagggccgtgccctgtgaacgttccccactccgacggatggctgacctttgctagagagcggacctctagctggggctgtgaagagttcgggtgcctggccatttccgacggctgtgtgtttggatcttgccaggatcttatcaaggaggaactcgcggtctacagaaaagagacagaagaggctaccaatgtggaactgtgcctgacattcagcgacaagacgtattgtaccgagctcaaccccattacacctatcatcaccaacctgtttgaggttcagttcaaaacagtggaaacctactcccttccgcgcgtcgtggccgtgcaaaatcatgagattcggatcggccagattaacgatctggggatctactctaagggatgcggcaatgtccagaaagttaacaatacgatttatgggaacggagtgcccaagtttgactacctctgtcacctggccagcagaaaggaagtgatcgtccgcaaatgcttcgataatgactttcaggcttgtaagttcctgcaatcccctcccagctatagacttgaggaagatgacggctctattaccgtgatcgattacaaaaagatcctggggacaattaaaatgaaggccatcctcggcgacgttaagtataaaaccttcgcggagaacattgatatcacagctgagggagtgtgcaccggctgtgtcaattgctttgaaaacattcattgtgagctgacaatccacaccacgatcgaagcctcctgccctgtgacaagcccctgtaccctcttccatgaccggattctgatcacccctgacgagcacaagtacgccatgaaagttatttgcacagaaaagcagaccgggacgcttccctttaaaatctgcaattctaaggtggatgctacactgaccctcgtcgaggccaagccgattctggagctggcttccgtggaccagacagcctatatccgcgaaaaagatgagagatgtaagacctggatgtgccgggtccgcgacgaaggaatccaggtgattcttgagcctttcaaaaacctgtttggcagctacatcgggattttctacacatccatcctcattgttatcaccatttttatcatcatttatgtgatcctgcccatttgtttcaagctcaaagatacgctgcaaaagcacgaagacgcgtacaagagagagatgaaaatccggtga

SEQ ID NO: 14230 - RNA, 4326 nt, synthetic construct
  misc_feature 1..4326: note = derived and/or modified CDS sequence (opt5) from CEV(BFS283)__AF123483.1__GP
  source 1..4326: mol_type = other RNA
atgatcttcattctgatcctctttgccgtggctgccgcgagccccgtctaccagagatgcttccaagacggcgctattgttaagcagaacccttccaaagaggccgtgaccgaagtgtgtctgaaggatgacgtctctatgatcaaaacagaggcccggtatacgaagaatagcaccggggtgttttccaacaatgttgctattcgcaaatggcttgtgtctgattggcacgactgcagaccgcggaaggtcgtgggaggccatatcaacgttatcgaagtgggggatgacctgacactccacaccgagagctacgtctgttccgccgattgcacaattggagtggacaaggaaaccgctcaggtgcgcctgcagacagataccacgaatcatttcgagatcgccggcaccacagtcaaatctgggtggtttaagagcaccacatatatttcccttgaccaaacctgtgagcacctgaaagttagctgcggacccaagtctatccagttccatgcgtgttttaaccagcacatgtcctgcgtgagattcctccaccggacgattctgcctggcagcatcgccaattctatttgtcagaacgtggaaatcatcattctggtcacactcgctctgcttatctttattctgctctccatcattagcaaaacctacatctgctatctgcttatgcccatcttcattcctatcgcctacatttatggcctgatctacaataagtcttgtaagaaatgcaagctctgcgggctggtgtaccatcccattacagagtgtggaacccactgcgtttgtggcgctcgctatgatacctccgacagaatgaaactgcatcgggccagcgggctctgccctggatacaagtccctgcgcgcggccagagtgatgtgtaaatctaagggcccggctagcatcctttccatcattacagccgtcctgatcctcacgtttgtgacccccattaacgctatgatggttgggggaagcaaagaaacattcgagctggaggaacttcctgatgacatgctggagatggccaataacctcaatacctattacatgctgtgcgtgacaaactatgccgtcacctggtctctgctcatcattgctctggcgatcggccttctgtttaagcggtaccaacaccgcttcctcgacatttatgccatgtactgtgaagagtgcgatatgtaccacgacagatccggcatcaagtggaatggggatttcacgaacaaatgtggacagtgcacatgtggccagtatgaagacgctagcgggctgcttgtgcatcggaagacctacaactgcctgatccagtataaatctaagtggattatgaattttctcatcacctacgtcattctggtgctgctcaaagatagcgttgtgatcgtccaagccaagggaacagacttctccgagtgcattgatgccgacaagatcaaatggaactgtaccggcccctttgtgaatctggggaactgcgagaagaaacagaagaaagaaccttattctaatatcgctgcccagcttaagggactgagcgcgatttccatcctcgatgttcccattatcgctagcattccggaggacatcgccggcgccctgcgctacatcgaagatcaaagatcttatcactcccagctgacagtggagtacgctatgcttacgcggtactgtgactattacacccagttcagcgacaactctggctattcccagacaacctggagagtctacctccgcagccatgtgtttgaagcctgcattctgtatcctaatcaacacttctgtcggtgcgtgaagcatggggataaatgttcctctagcaactgggactttgcttccgagatgaagaattactattctggaaaacagaacaagttcaataaagatctgaacctcgccctgacaagccttcaccacgcgtttagaggcacctccagctcttacatcgccgggctgctctccacgaaggctaatgacgagctggttcagtacaccagcaagattcgcgaaaaattccccggaaacgccctgcttaaggctatcattgattatatcgcctacatgaaaggcctcacagagatgtctaattttaagaaagacgaattttgggatgagctggtctatgtgcctgaccccaccaagccccctaaactgtcccgggggagcgaaacagtgtacgattttaagtctgcgaccagcaacctcggcgagaagaactgcaaagacgtcaagggagtggtttgtctgtccccgagaagcggcgtgacgtatgattctatcattgcctgcggggagggatccagccccaatatctacaaaattcctaagacaggcgtctatcagtccaactctgaacccagcaattactgtgtgtccgactctcattgccttgaggatttcgaagttatcagccaagaggagctggacgctattaaaaagtcccgctgctgggaagtggactacctctatgccaaccctcccaagcagtctgatggggtccggagctgtagaatgaaagacgctggacactgcaatgtgaccacaaaccgctggccgatcattcagtgtgatgacaataagtactattactccgagctgcagcgggattatgacaaagaacaagatatcggccatttctgcctgagccctagatgtgccaccgttcgctttcccatccaccctaagcacatttctaactgcgactggcaggtctcccatagcaccgtggataaagtgaatgtgcacaaccttgaggacatcgaacagtaccggaaggccattacacagaagctccaaaattctctgtccatcttcaaatatgctagaacgaagaacctgccccatattaaacctatctacaagtacatcaccattgaggggacagagaccgcggaaggcatcgagagcgcctatattgaatctgagatccccgctctcgccggaacatccattggctttaaaatcaataccaaggaagggaagcatctgcttgatgtcatcgcctacgttaaacaggctagctattccagcctgtacaacaagatgtatgtgacgggaccgacagtgggcattaataccaaacacgacgagctctgtaccgggccttgccccgtcaacgtgccccactctgatggatggctgacattcgcccgggagcgcaccagctcctggggctgtgaagagtttgggtgcctggcgatctctgacggctgtgttttcggaagctgccaggaccttattaaggaggaactcacagtgtacagaaaagaaacggaggaggctaccaacgtcgaactgtgcctgacatttgccgataagacctattgtacagagctcaatcctgtgaccccgatcattacgaacctgttcgaagttcaatttaaaaccgtggagacatactcccttccccgggtcgtggccgttcagaatcacgagatcagaattggccagatcaacgacctgggggtgtactctaagggatgcggcaatgtccagaaggtgaacaataccatctatgggaacggagtgcctaaattcgattacctctgtcatctggctagccgcaaggaagtcattgttcggaaatgctttgacaatgatttccaagcctgtaagtttctgcagtctcccccttcctatagacttgaggaagacgatggcagcatcacagtgattgactacaaaaagatcctggggaccattaagatgaaagcgatcctcggcgatgtgaagtataaaacattcgctgagaacatcgacattaccgccgaaggagtctgcacgggctgtatcaattgcttcgagaacattcactgtgagctgacaatccataccaccattgaagcctcctgccccgtgacaagcccttgtaccctctttcacgatcgcatcctgatcacgcccgacgagcataagtacgctattaaagttatctgcacagaaaagcagaccgggacacttccgttcaagatttgcaattctaaaatcgacgccaccctgacactcgtggaggctaagcctattctggaactggcccccgtcgatcagaccgcgtatatcagagagaaagacgagcggtgtaagacgtggatgtaccgcgtgagagatgaaggcattcaagttatccttgagccttttaaaaacctgttcggatcctacatcgggattttctataccagcatcctcgtggtcattgccatgttcatcattgtgtacgtcatcctgcccatctgctttaagctcaaggacacactgcagcggcacgaagatgcttataaacgcgagatgaagattagatga

SEQ ID NO: 14231 - RNA, 4329 nt, synthetic construct
  misc_feature 1..4329: note = derived and/or modified CDS sequence (opt5) from CHATV(Mohko ILO8-3)__KF719222.1__GP
  source 1..4329: mol_type = other RNA
atgatgatcttcattctgatcctctttgccgtgagcgctgcctcccccgtctaccagagatgcttccaagacggcgcgattgttaagcagaacccttctaaagaggctgtgaccgaagtgtgtctgaaggatgacgtcagcatgatcaaaacagaggcccggtatgtgaagaatgccacggggatttactccaacaatgttgctatccgcaaatggcttgtgtctgattggcacgactgcagaccgcggaaggtcagcggaggccatatcaacgtgattgaagttggggatgacctgtccctccacaccgagtcttatgtgtgtagcgccgattgcacaatcggagtcgacaaggaaaccgctcaggtgcgcctgcagacagataccacaaatcattttgagattgccggcaccacggtgaaatccgggtggttcaagagcaccacatacatcacccttgaccaaacatgtgagcacctgaaagtctcttgcggacccaagtccgttcagtttcatgcgtgtttcaaccagcacatgagctgcgtgagatttctccaccggaccattctgcctggctctatcgccaattccatttgtcagaacatcgaaatcattatcctggtgacgctcacactgcttattttcgtcctgctcagcatcctgtctaaaacctatatttgctaccttctgatgcccatctttatccctattgcttatatctacggcattatctacaataagtcctgtaagaaatgcaagctctgcgggctggtgtatcatcccttcacagagtgtggaacccactgcgtttgtggcgcccgctacgataccagcgacagaatgaaactgcatcggtcctctgggctctgccctggatataagagcctgcgcgctgccagagtgatgtgtaaatccaagggcccggcgagcattctttctatcatcacagccattctggtcctcacgtttgtgacccccatcaactccatggttattggggaaagcaaagaggtgttcgagctggaggaacttcctgatgacatgctggaaatggctctcaagatcaatctgtactattttgtctgcgtgattaactacgccgtcacatggtctctggtgatcgttgctctcctgattgcccttatcttcaagaaatatcaacaccggttcctgaatctctacgccatgtactgtgaggaatgcgacatgtatcacgatcgcatcggactgaagagaaacggcgactttaccaataaatgtcggcagtgcacatgtggccagtacgaggatgctaccgggcttatgacgcatcgcaagacatataactgcctggtgcagtacaaaagcaagtggattctcaacttcctgatcacctatatgattctgaccctcatcaaggactccgcgattatcgtccaagccgctggaacagatttttctgcctgcctggaggcccagagcgtggactggaattgtaccggccccttccttaacctggggaattgccagaaacaacagaagaaagaatcctacgctaacatcgccacacagctcaagggactgcaggcgattagcgttctggatgtgcctatgatcgctaatattcccgaggacatcgccggcgcccttagatatattgaagagaaagatacgtttcacgtccaactcaccgctgaatacgccatgctgacacggtactgtgactattacacccagttcgctgataactctgggtattcccagacaacctggagagtgtacctgcgcagccatgactttgacgcctgcatcctctatccgaatcagcacttctgtcggtgcgtgaagcatggagataagtgttcttccagcaactgggactttgcgaatgagatgaaaaactactattccggcaagcaaaataaattcgataaggacctgaaccttgccctgatggctgttcaccacgcctttagaggcacgtctagcgcttacatcgccaccatgctctccaaaaagtctaataacgatctggtcacatacaccaataagattaaagagaagttccctgggaacgcgctgcttaaagccatcatggactatattagctacatgaagggactctccgaaatgacaaactttaaatatgatgagttctgggacgatctgctgcataagcccagccctaccaatgctcctcccctctctcgcgactccgaacccagctacaacttcaaatctgtgatctccagccggtctgtcaagagctgcaagaatgtgaaaaacgtggtttgtctgtccccgagaagcggcgtgtcttatgattccattcttgcctgcggggagcccaatggacctagcgtctacaagaaaccctccgacggcgtgtttcagtctaacagcgataagacgatgtattgtctggctgactcccactgcctcgaagacttcgaggttgtgtctcaggaggaactggatgccatcaaaaagagcaagtgctgggtcacagagtaccctaatgtgaaactgtccaaactttctgacgggatcaccagctgtcgcatgaaggattccggcaagtgcaacgttgccgctaatcggtggcccattatccagtgtgaaaacgacaaattttactatagcgagctccaaaatgattacgacaagacacaggatattggacatttctgcctgtctccgggctgttccaccatcagatttcctattaaccagaagcacatcagcaattgcaactggcaagtgtctcgctccagcattgcgaaaatcgacgtccacgatatcgaggacattgatcagtatcggaaggccatcacccagaaactgcagacagggctctctctgttcaagtacgctaaaacgaagaatcttccccatattaagcctatctataaatacattaccatcgaaggaacagagaccgccgaaggcatcgagtccgcctatattgaaagcgagatccccgctctggccgggacatccattggatttaagatcaacagcaaagagggcaagcacctcctggacattgtggggtacgtgaaatctgcgagctactcctctgtctataccaagctgtacagcacgggccctacatccggaatcaacaccaaacatgatgaactttgtaccggcccctgcccggttaatatcaaccaccaaacagggtggctcaccttcgctaaggagagaacatctagctggggatgtgaagagtttggctgcctggccatttccgacgggtgtgtgttcggatcttgccaggacatcgtgcgcgatgaactgagcgtctatcggaaggagacggaggaagtgaccgacgttgagctctgcctgacattttccgataaaacctactgtacaaatcttaaccctattacccccatcattacggacctgttcgaagtgcagtttaagaccgtcgagacatatagcctccccagaatcgtggccattcagaatcatgaagttaaaatcggccaaatcaacgatctgggggtgtactctaagggctgcggaaatgtccagaaagtgaacggcaccgtttatgggaatggagtgcctaagttcgactacctgtgtcaccttgcttcccggaaggaggtcattgtgcgcaaatgcttcgataacgactaccaggcctgtaagtttctgcagacaccggcgagctatagactcgaggaatcttccggcaccgtgacagtcatcgattacaaaaagattctggggaccatcaaaatgaaggctattctcggagacgttaagtataaaacgttcgccgataatgtggacatgacagccgagggcagctgcgctgggtgtatcaactgctttgaaaatatccactgtgagctgacccttcataccacaattgacgcctcctgccccgtgacctctccttgtacggtcttccacgatcggatcctgattacacccaacgagcataagtacgctatgaaagtgatctgcaccgaaaagcctggcaatacactcaccattaaaatctgcggaacaaagatcgacgccagcctggcgctgattgatgccaagcccatccttgagctggctcctgttgaccaaaccgcctatattagagaaaaagatgagcgctgtaagacgtggatgtgccgggtgagagacgaaggcctccaggtcatcctggagccctttaaaaacctcttcgggtcctacattggaatcttttataccttcattatctgtatcattgtgctgcttatcgttatttacatcgtgctgccgatttgctttaagctccgcgatacactgagacagcacgaggacgcttacaaacgggaaatgaagatccgctga

SEQ ID NO: 14232 - RNA, 4329 nt, synthetic construct
  misc_feature 1..4329: note = derived and/or modified CDS sequence (opt5) from CHATV(Mohko M07-1)__KF719225.1__GP
  source 1..4329: mol_type = other RNA
atgatgatcttcattctgatcctctttgccgtgagcgctgcctcccccgtctaccagagatgcttccaagacggcgcgattgttaagcagaacccttctaaagaggctgtgaccgaagtgtgtctgaaggatgacgtcagcatgatcaaaacagaggcccggtatgtgaagaatgccacggggatttactccaacaatgttgctatccgcaaatggcttgtgtctgattggcacgactgcagaccgcggaaggtcagcggaggccatatcaacgtgattgaagttggggatgacctgtccctccacaccgagtcttatgtgtgtagcgccgattgcacaatcggagtcgacaaggaaaccgctcaggtgcgcctgcagacagataccacaaatcattttgagattgccggcaccacggtgaaatccgggtggttcaagagcaccacatacatcacccttgaccaaacatgtgagcacctgaaagtctcttgcggacccaagtccgttcagtttcatgcgtgtttcaaccagcacatgagctgcgtgagatttctccaccggaccattctgcctggctctatcgccaattccatttgtcagaacatcgaaatcattatcctggtgacgctcacactgcttattttcgtcctgctcagcatcctgtctaaaacctatatttgctaccttctgatgcccatctttatccctattgcttatatgtacggcatcatttacaataagtcctgtaagaaatgcaagctctgcgggctggtgtatcatcccttcacagagtgtggaacccactgcgtttgtggcgcccgctacgataccagcgacagaatgaaactgcatcggtcctctgggctctgccctggatataagagcctgcgcgctgccagagtgatgtgtaaatccaagggcccggcgagcatcctttctattatcacagccatcctggtcctcacgtttgtgacccccattaactccatggttatcggggaaagcaaagaggtgttcgagctggaggaacttcctgatgacatgctggaaatggctctcaagattaatctgtactattttgtctgcgtgatcaactacgccgtcacatggtctctgattatcgtggctctcctgattgcccttatcttcaagaaatatcaacaccggttcctgaatctctacgccatgtactgtgaggaatgcgacatgtatcacgatcgcatcggactgaagagaaacggcgactttaccaataaatgtcggcagtgcacatgtggccagtacgaggatgctaccgggcttatgacgcatcgcaagacatataactgcctggttcagtacaaaagcaagtggattctcaacttcctgatcacctatatggtgctgaccctcattaaggactccgcgatcattgtccaagccgctggaacagatttttctgcctgcctggaggcccagagcgtggactggaattgtaccggccccttccttaacctggggaattgccagaaacaacagaagaaagaatcctacgctaacatcgccacacagctcaagggactgcaggcgatcagcgttctggatgtgcctatgattgctaatatccccgaggacattgccggcgcccttagatatatcgaagagaaagatacgtttcacgtccaactcaccgctgaatacgccatgctgacacggtactgtgactattacacccagttcgctgataactctgggtattcccagacaacctggagagtgtacctgcgcagccatgactttgacgcctgcattctctatccgaatcagcacttctgtcggtgcgtgaagcatggagataagtgtgggtcttccaacagagactttgcgaatgagatgaaaaactactatagcggcaagcaaaataaattcgataaggacctgaaccttgccctgatggctgttcaccacgcctttcgcggcacgtcctctgcttacatcgccaccatgctcagcaaaaagtccaataacgatctggtcacatacaccaataagatcaaagagaagttccctggaaacgcgctgcttaaagccattatggactatatctcttacatgaagggcctcagcgaaatgacaaactttaaatatgatgagttctgggacgatctgctgcataagccctcccctaccaatgctcctcccctcagccgggactctgaaccctcctacaacttcaaaagcgtgatttcttccagaagcgtgaagtcttgcaagaatgtcaaaaacgtggtttgtctgagcccgcgctccggggtgagctatgattctatccttgcctgcggagagcccaatggcccttccgtctacaagaaacccagcgacgggatttttcagtccaactctgataagacgatgtattgtctggctgacagccactgcctcgaagacttcgaggtggtttcccaggaggaactggatgccatcaaaaagtctaagtgctgggtgacagagtaccctaatgtcaaactgagcaaactttccgacggcatcacctcttgtcggatgaaggatagcggaaagtgcaacgtggccgctaatagatggcccattatccagtgtgaaaacgacaaattttactattccgagctccaaaatgattacgacaagacacaggatattggccatttctgcctgagcccggggtgttctaccatccgctttcctattaaccagaagcacatctccaattgcaactggcaggttagccggtcttccattgcgaaaatcgacgtgcacgatatcgaggacattgatcaatatagaaaggccatcacccagaaactgcagacaggactcagcctgttcaagtacgctaaaacgaagaatcttccccatattaagcctatctataaatacattaccatcgaaggcacagagaccgccgaagggatcgagtctgcctatattgaatccgagatccccgctctggccggaacaagcattggctttaagatcaactccaaagaggggaagcacctcctggacattgtcggctacgtgaaaagcgcgtcttacagctccgtgtataccaagctgtactctacgggacctacaagcggcatcaacaccaaacatgatgaactttgtaccgggccctgcccggtcaatatcaaccaccaaacaggatggctcaccttcgctaaggagcgcacatcctcttggggctgtgaagagtttgggtgcctggccattagcgacggatgtgttttcggctcctgccaggacatcgtgcgggatgaactgtctgtgtatagaaaggagacggaggaagtcaccgacgtggagctctgcctgacatttagcgataaaacctactgtacaaatcttaaccctattacccccatcattacggacctgttcgaagttcagtttaagaccgtggagacatattccctcccccggatcgtcgccattcagaatcatgaagtgaaaatcgggcaaatcaacgatctgggcgtttacagcaagggatgcggcaatgtgcagaaagtcaacgggaccgtgtatggaaatggcgttcctaagttcgactacctgtgtcaccttgcttctcgcaaggaggtgattgtcagaaaatgcttcgataacgactaccaggcctgtaagtttctgcagacaccggcgtcctatcggctcgaggaaaatagcgggaccgtgacagtgatcgattacaaaaagattctgggaaccatcaaaatgaaggctattctcggcgacgtcaagtataaaacgttcgccgataacgttgacatgacagccgaggggtcttgcgctggctgtatcaattgctttgaaaacatccactgtgagctgacccttcataccacaattgacgcctcctgccccgtgaccagcccttgtacggtgttccacgatagaatcctgattacacccaatgagcataagtacgctatgaaagtcatctgcaccgaaaagcctggaaacacactcaccattaaaatctgcggcacaaagatcgacgcctccctggcgctgattgatgccaagcccatccttgagctggctcctgtggaccaaaccgcctatattcgcgaaaaagatgagcggtgtaagacgtggatgtgcagagttcgcgacgaagggctccaggtgatcctggagccctttaaaaacctcttcggatcttacattggcatcttttataccttcattatctgtatgatcgtcctgcttattgtgatctacattgttctgccgatctgctttaagctcagagatacactgcggcagcacgaggacgcttacaaacgcgaaatgaagattagatga

SEQ ID NO: 14233 - RNA, 4329 nt, synthetic construct
  misc_feature 1..4329: note = derived and/or modified CDS sequence (opt5) from CHATV(Mohko M07-2-83)__KF719228.1__GP
  source 1..4329: mol_type = other RNA
atgatgatcttcattctgatcctctttgccgtgagcgctgcctcccccgtctaccagagatgcttccaagacggcgcgattgttaagcagaacccttctaaagaggctgtgaccgaagtgtgtctgaaggatgacgtcagcatgatcaaaacagaggcccggtatgtgaagaatgccacggggatttactccaacaatgttgctatccgcaaatggcttgtgtctgattggcacgactgcagaccgcggaaggtcagcggaggccatatcaacgtgattgaagttggggatgacctgtccctccacaccgagtcttatgtgtgtagcgccgattgcacaatcggagtcgacaaggaaaccgctcaggtgcgcctgcagacagataccacaaatcattttgagattgccggcaccacggtgaaatccgggtggttcaagagcaccacatacatcacccttgaccaaacatgtgagcacctgaaagtctcttgcggacccaagtccgttcagtttcatgcgtgtttcaaccagcacatgagctgcgtgagatttctccaccggaccattctgcctggctctatcgccaattccatttgtcagaacatcgaaatcattatcctggtgacgctcacactgcttattttcgtcctgctcagcatcctgtctaaaacctatatttgctaccttctgatgcccatctttatccctattgcttatatgtacggcatcatttacaataagtcctgtaagaaatgcaagctctgcgggctggtgtatcatcccttcacagagtgtggaacccactgcgtttgtggcgcccgctacgataccagcgacagaatgaaactgcatcggtcctctgggctctgccctggatataagagcctgcgcgctgccagagtgatgtgtaaatccaagggcccggcgagcatcctttctattatcacagccatcctggtcctcacgtttgtgacccccattaactccatggttatcggggaaagcaaagaggtgttcgagctggaggaacttcctgatgacatgctggaaatggctctcaagattaatctgtactattttgtctgcgtgatcaactacgccgtcacatggtctctgattatcgtggctctcctgattgcccttatcttcaagaaatatcaacaccggttcctgaatctctacgccatgtactgtgaggaatgcgacatgtatcacgatcgcatcggactgaagagaaacggcgactttaccaataaatgtcggcagtgcacatgtggccagtacgaggatgctaccgggcttatgacgcatcgcaagacatataactgcctggttcagtacaaaagcaagtggattctcaacttcctgatcacctatatggtgctgaccctcattaaggactccgcgatcattgtccaagccgctggaacagatttttctgcctgcctggaggcccagagcgtggactggaattgtaccggccccttccttaacctggggaattgccagaaacaacagaagaaagaatcctacgctaacatcgccacacagctcaagggactgcaggcgatcagcgttctggatgtgcctatgattgctaatatccccgaggacattgccggcgcccttagatatatcgaagagaaagatacgtttcacgtccaactcaccgctgaatacgccatgctgacacggtactgtgactattacacccagttcgctgataactctgggtattcccagacaacctggagagtgtacctgcgcagccatgactttgacgcctgcattctctatccgaatcagcacttctgtcggtgcgtgaagcatggagataagtgtgggtcttccaactgggactttgcgaatgagatgaaaaactactatagcggcaagcaaaataaattcgataaggacctgaaccttgccctgatggctgttcaccacgcctttagaggcacgtcctctgcttacatcgccaccatgctcagcaaaaagtccaataacgatctggtcacatacaccaataagatcaaagagaagttccctggaaacgcgctgcttaaagccattatggactatatctcttacatgaagggcctcagcgaaatgacaaactttaaatatgatgagttctgggacgatctgctgcataagccctcccctaccaatgctcctcccctcagccgcgactctgaaccctcctacaacttcaaaagcgtgatttcttcccggagcgtgaagtcttgcaagaatgtcaaaaacgtggtttgtctgagcccgagatccggggtgagctatgattctatccttgcctgcggagagcccaatggcccttccgtctacaagaaacccagcgacgggatttttcagtccaactctgataagacgatgtattgtctggctgacagccactgcctcgaagacttcgaggtggtttcccaggaggaactggatgccatcaaaaagtctaagtgctgggtgacagagtaccctaatgtcaaactgagcaaactttccgacggcatcacctcttgtcgcatgaaggatagcggaaagtgcaacgtggccgctaatcggtggcccattatccagtgtgaaaacgacaaattttactattccgagctccaaaatgattacgacaagacacaggatattggccatttctgcctgagcccggggtgttctaccatcagatttcctattaaccagaagcacatctccaattgcaactggcaggttagccggtcttccattgcgaaaatcgacgtgcacgatatcgaggacattgatcaatatcgcaaggccatcacccagaaactgcagacaggactcagcctgttcaagtacgctaaaacgaagaatcttccccatattaagcctatctataaatacattaccatcgaaggcacagagaccgccgaagggatcgagtctgcctatattgaatccgagatccccgctctggccggaacaagcattggctttaagatcaactccaaagaggggaagcacctcctggacattgtcggctacgtgaaaagcgcgtcttacagctccgtgtataccaagctgtactctacgggacctacaagcggcatcaacaccaaacatgatgaactttgtaccgggccctgcccggtcaatatcaaccaccaaacaggatggctcaccttcgctaaggagagaacatcctcttggggctgtgaagagtttgggtgcctggccattagcgacggatgtgttttcggctcctgccaggacatcgtgcgcgatgaactgtctgtgtatcggaaggagacggaggaagtcaccgacgtggagctctgcctgacatttagcgataaaacctactgtacaaatcttaaccctattacccccatcattacggacctgttcgaagttcagtttaagaccgtggagacatattccctccccagaatcgtcgccattcagaatcatgaagtgaaaatcgggcaaatcaacgatctgggcgtttacagcaagggatgcggcaatgtgcagaaagtcaacgggaccgtgtatggaaatggcgttcctaagttcgactacctgtgtcaccttgcttctcggaaggaggtgattgtccgcaaatgcttcgataacgactaccaggcctgtaagtttctgcagacaccggcgtcctatagactcgaggaaaatagcgggaccgtgacagtgatcgattacaaaaagattctgggaaccatcaaaatgaaggctattctcggcgacgtcaagtataaaacgttcgccgataacgttgacatgacagccgaggggtcttgcgctggctgtatcaattgctttgaaaacatccactgtgagctgacccttcataccacaattgacgcctcctgccccgtgaccagcccttgtacggtgttccacgatcggatcctgattacacccaatgagcataagtacgctatgaaagtcatctgcaccgaaaagcctggaaacacactcaccattaaaatctgcggcacaaagatcgacgcctccctggcgctgattgatgccaagcccatccttgagctggctcctgtggaccaaaccgcctatattagagaaaaagatgagcgctgtaagacgtggatgtgccgggttagagacgaagggctccaggtgatcctggagccctttaaaaacctcttcggatcttacattggcatcttttataccttcattatctgtatgatcgtcctgcttattgtgatctacattgttctgccgatctgctttaagctccgcgatacactgagacagcacgaggacgcttacaaacgggaaatgaagattcgctga

SEQ ID NO: 14234 - RNA, 4326 nt, synthetic construct
  misc_feature 1..4326: note = derived and/or modified CDS sequence (opt5) from CHATV(LEIV-15854)__HQ734820.1__GP
  source 1..4326: mol_type = other RNA
atgatcttcattctgatcctctttgccgtgagcgctgcctcccccgtctaccagagatgcttccaagacggcgcgattgttaagcagaacccttctaaagaggctgtgaccgaagtgtgtctgaaggatgacgtcagcatgatcaaaacagaggcccggtatgtgaagaatgccacggggatttactccaacaatgttgctatccgcaaatggcttgtgtctgattggcacgactgcagaccgcggaaggtcagcggaggccatatcaacgtgattgaagttggggatgacctgtccctccacaccgagtcttatgtgtgtagcgccgattgcacaatcggagtcgacaaggaaaccgctcaggtgcgcctgcagacagataccacaaatcattttgagattgccggcaccacggtgaaatccgggtggttcaagagcaccacatacatcacccttgaccaaacatgtgagcacctgaaagtctcttgcggacccaagtccgttcagtttcatgcgtgtttcaaccagcacatgagctgcgtgagatttctccaccggaccattctgcctggctctatcgccaattccatttgtcagaacatcgaaatcattatcctggtgacgctcacactgcttattttcgtcctgctcagcatcctgtctaaaacctatatttgctaccttctgatgcccatctttatccctattgcttatgtgtacggcatcatttacaataagtcctgtaagaaatgcaagctctgcgggctggtttatcatcccttcacagagtgtggaacccactgcgtgtgtggcgcccgctacgataccagcgacagaatgaaactgcatcggtcctctgggctctgccctggatataagagcctgcgcgctgccagagtcatgtgtaaatccaagggcccggcgagcatcctttctattatcacagccatcctggtgctcacgtttgttacccccattaactccatggtgatcggggaaagcaaagaggtcttcgagctggaggaacttcctgatgacatgctggaaatggctctcaagattaatctgtactattttgtgtgcgtcatgaactacgccgtgacatggtctctggttatcgtggctctcctgattgcccttatcttcaagaaatatcaacaccggttcctgaatctctacgccatgtactgtgaggaatgcgacatgtatcacgatcgcattggactgaagagaaacggcgactttaccaataaatgtcggcagtgcacatgtggccagtacgaggatgctaccgggcttatgacgcatcgcaagacatataactgcctggtccagtacaaaagcaagtggatcctcaacttcctgatcacctatatggtgctgaccctcattaaggactccgcgatcattgttcaagccgctggaacagatttttctgcctgcctggaggcccagagcgtggactggaattgtaccggccccttccttaacctggggaattgccagaaacaacagaagaaagaatcctacgctaacatcgccacacagctcaagggactgcaggcgattagcgtcctggatgtgcctatgatcgctaatatccccgaggacattgccggcgcccttagatatatcgaagagaaagatacgtttcacgtgcaactcaccgctgaatacgccatgctgacacggtactgtgactattacacccagttcgctgataactctgggtattcccagacaacctggagagtttacctgcgcagccatgactttgacgcctgcattctctatccgaatcagcacttctgtcggtgcgtcaagcatggagataagtgttcttccagcaactgggactttgcgaatgagatgaaaaactactattccggcaagcaaaataaattcgataaggacctgaaccttgccctgatggctgtgcaccacgcctttagaggcacgtctagcgcttacatcgccaccatgctctccaaaaagctgaataacgatctgattacatacaccaataagatcaaagagaagttccctgggaacgcgcttctcaaagccatcatggactatatttcttacatgaagggactgagcgaaatgacaaactttaaatatgatgagttctgggacgatctgctccataagccctcccctaccaatgctcctcccctgagccgcgactctgaaccctcctacaacttcaaaagcgtgatctcttcccggagcgtcaagtcttgcaagaatgtgaaaaacgttgtgtgtcttagcccgagatccggcgccagctatgattctattctggcttgcggggagcccaatggaccttccgtctacaagaaacccagcgacggcgtgtttcagtccaactctgataagacgatgtattgtctcgccgacagccactgcctggaagacttcgaggttgtgtcccaggaggaactggatgccatcaaaaagtctaagtgctgggtcacagagtaccctaatgtgaaacttagcaagctctccgacgggattacctcttgtcgcatgaaagatagcggcaagtgcaacgttgctgcgaatcggtggcccatcatccagtgtgaaaacgacaaattttactattccgagctgcaaaatgattacgacaagacacaggatattggacatttctgcctgagcccgggctgttctaccatcagatttcctattaaccagaagcacatctccaattgcaactggcaagtgagccggtcttccattgccaaaatcgacgtccacgatattgaggacatcgatcagtatcgcaaggctatcacccagaaactccagacagggctgagccttttcaagtacgccaaaacgaagaatctgccccatattaagcctatctataaatacattaccatcgaaggaacagagaccgccgaaggcattgagtctgcttatatcgaatccgagatccccgccctcgcggggacaagcattggatttaagatcaactccaaagagggcaagcaccttctggacattgtggggtacgtgaaaagcgcttcttacagctccgtctataccaagctgtactctacgggccctacaagcggaatcaacaccaaacatgatgaactctgtaccggcccctgcccggttaatattaaccaccaaacagggtggctgaccttcgccaaggagagaacatcctcttggggatgtgaagagtttggctgcctggccatcagcgacgggtgtgtgttcggatcctgccaggacatcgtgcgcgatgaactctctgtctatcggaaggagacggaggaagtgaccgacgttgagctgtgccttacatttagcgataaaacctactgtacaaatctgaaccctattacccccatcattacggacctcttcgaagtgcagtttaagaccgtcgagacatattccctgcccagaatcgtggctgttcagaatcatgaagtgaaaattggccaaatcaacgatctggggatttacagcaagggctgcggaaatgtccagaaagtgaacggcaccgtttatgggaatggagtgcctaagttcgactacctttgtcacctggcctctcggaaggaggtcatcgtgcgcaaatgcttcgataacgactaccaggcgtgtaagtttctccagacaccggcttcctatagactggaggaaaatagcggcaccgtgacagtcatcgattacaaaaagattctcgggaccatcaaaatgaaggccattctgggagacgttaagtataaaacgttcgccgataacgtggacatgacagctgagggctcttgcgccgggtgtatcaattgctttgaaaacattcactgtgagcttaccctgcataccacaatcgacgcttcctgccccgtgaccagcccttgtacggtcttccacgatcggatcctcattacacccaatgagcataagtacgccatgaaagtgatctgcaccgaaaagcctggcaacacactgaccattaaaatctgctccacaaagattgacgcgtctctggcccttatcgatgctaagcccatcctggagctcgcccctgttgaccaaaccgcttatattagagaaaaagatgagcgctgtaagacgtggatgtgccgggtgagagacgaaggactgcaggtcatcctcgagccctttaaaaacctgttcggcagctacattgggatcttttataccttcattatctgtgtgattgttcttctgatcgtgatctacattgtcctcccgatctgctttaagctgcgcgatacactgagacagcacgaggacgcctacaaacgggaaatgaagattcgctga

SEQ ID NO: 14235 - RNA, 4326 nt, synthetic construct
  misc_feature 1..4326: note = derived and/or modified CDS sequence (opt5) from CHATV(LEIV-17756)__EU621834.1__GP
  source 1..4326: mol_type = other RNA
atgatcttcattctgatcctctttgccgtgagcaccgcttcccccgtctaccagagatgcttccaagacggcgccattgttaagcagaacccttctaaagaggcggtgacagaagtgtgtctgaaggatgacgtcagcatgatcaaaacggaggctcggtatattcgcaatgccaccgggacattttccaacaatgtggccatcagaaagtggatcgtttctgattggcacgactgccggccgaaaaaggtgagcggaggccatattaacgtcatcgaagtgggggatgacctttccctgcacaccgagtcttacgtttgtagcgctgattgcacaattggagtggacaaggaaaccgcccaggtccgcctccagacagataccacgaatcatttcgagatcgctggcaccacagtgaaatccgggtggtttaagagcaccacatatattaccctggaccaaacgtgtgagcaccttaaagtgtcttgcggacccaagtccgtccagttccatgcctgttttaaccagcacatgagctgcgttagattcctgcaccggacaatcctccctggctctattgcgaatagcatctgtcagaacatcgaaattatcattctggtgaccctgacactcctgatctttgtgcttctgagcattctctctaaaacctacatctgctatctgcttatgcccatcttcattcctatcgcctacatttatggcatcatttacaataagtcctgtaagaaatgcaagctgtgcgggctcgtctaccatccctttaccgagtgtggaacacactgcgtgtgtggcgctcgctatgatacgagcgacagaatgaaactgcatcggtcctctgggctgtgccctggatacaagagcctccgcgccgctagagttatgtgtaaatccaagggcccggccagcatcctgtctatcattaccgcgatccttgtgctgacattcgtcacccccattaactccatggtggttggggaaagcaaagaggtgtttgagctcgaagaactgcctgatgacatgcttgaaatggccctgaagatcaatttctattacttcgtctgcgtgatgaactatgctgtcacatggggactcattgtggttgccctgctgatcggcctcatttttaagaaataccaacaccggttcctgaatctttatgctatgtactgtgaggaatgcgacatgtaccacgatcgcaccggcctgaagagaaacggggactttacgaataaatgtcggcagtgcacatgtggacagtatgaggatgccaccggcctcatgacccatcgcaagacatacaactgcctggtgcagtataaatctaagtggatccttaacttcctgatcacctacatggtcctcacactgattaaggacagcgccatcgtggttcaagctacggggaccgatttttcctcttgcctggagacacagagcgtgaattggaactgtaccggacccttcctcaatctgggcaactgccagaaacaacagaagaaagaatcctatgcgaatattgccacacagcttaaggggctgcaggctatcagcgtcctcgacatgcctatgattgcctctatccccgaggatatcgccggagctctgagatacattgaggagcgggaaacctttcacgtgcaactgacggccgagtatgcgatgcttaccagatactgtgactactatacacagttcgctgataactccggctacagccagaccacatggcgcgtgtatctccggtctcatgactttgatgcctgcatcctgtacccgaatcagcacttctgtagatgcgttaaacatggcgacaagtgttccagctccaactgggactttgccaatgagatgaagaactattactctgggaaacaaaataagttcgataaagacctgaacctcgctctgatgaccatgcaccacgcctttcgcggaacgagctccgcttatattgccgcgcttctgtctaagcggagcaatgatgacctcgtcgcctacacaaacaaaatcaaggaaaagttccctggcaatgctctgctgaaagccgtgatggattacatttcctatatgaagtccctttctgagatgtccaacttcaaatacgacgaattttgggatgacctcctgcataagcccaaccctaccaaagctcccagcctgtctagaggggatgagcccgcctataatttcaagctcgcgatctccagccgctctatgaaaagctgcaagaacgtgaagtccgtcgtgtgtctgagccctcggtctggagtttcctacgacagcatccttgcctgcggcgaaccgaatgctccctccgtgcacagaaaaccttctgatggggtctttcagagcaactccgacaagacaatgtattgtctggccgattctcattgcctcgaggacttcgaggtggttagccaggaggaactggacgctattaaaaagtccgaatgctgggtgaccgagtaccccaatgtcaaactgtctaaacttagcgatggcatcaagtcctgtcgcatgaaggacagcggaaagtgcaacgtggccaccaatcggtggcctattatccagtgtgagaacgataaattttattactctgaactccaaaatgactacgataagacacaggacattggccacttctgcctgtcccccgggtgtagcacgatcagatttccgatcaaccagaaacacatttctaattgcaactggcaggtttcccgcagctctatcgccaagattgatgtgcataatatcgaggacattgaacaatatcggaaggctatcacccagaaactgcagacatccctcagcctgttcaagtacgcgagaaccaaaaaccttcctcacattaagcccatctataaatacatcacaattgagggaaccgaaacggccgagggcatcgagtccgcttatattgaaagcgagatccctgccctggccgggacatctattggatttaagatcaatagcaaggaaggcaaacatctcctggatgtcatcgggtacgtgaagtccgcttcttatagctccgtgtacaccaaactgtactctaccggccccacaagcggaattaacaccaagcacgacgagctttgtacaggcccttgccccgccaacatcaaacatcaaacggggtggctcaccttcgcgcgggaacgcacatcctcttggggatgtgaggagtttggctgcctggctattagcgatgggtgtgtcttcggatcctgccaggacatcgttagagatgaactgagcgtgtatcggaaggagaccgaagaggtgacagacgtcgaactctgcctgaccttttctgacaaaacgtactgtaccaatcttaacccgattacacctatcatcaccgatctgttcgaggtgcagttcaagacagttgagacctattccctccccagaattgtggccatccagaatcacgaaattaagatcggccaaattaacgacctgggggtctacagcaaaggctgcggaaatgtgcagaaggttaacggcacagtgtatgggaatggagtccccaaatttgattacctgtgtcaccttgcctctcgcaaggaggtgatcgttcggaaatgcttcgacaacgattatcaggcttgtaagtttctgcagacccctgcctcctacagactcgaagagaatagcggcacggtgacagtcattgactacaagaaaatcctggggaccatcaagatgaaagcgattctcggagatgtgaagtataaaaccttcgctgacaacgtggatatcacagccgagggctcctgcaccgggtgtattaattgctttgaaaacatccattgtgagctgacgattcacacaaccatcgacgcctcttgcccggtcacaagcccctgtaccgttttccatgatcgcatccttgtgacacctaatgaacacaagtacgctatgaaggtgatttgcaccgagaaacccggctccacgctggccatcaagatttgcaacaccaaaatcgacgctagcctcgccctgattgacgcgaagcctatcctggaacttgcccccgtcgatcaaacagcttatatcagagagaaagacgagcggtgtaagacctggatgtgccgcgtgagagatgaaggactgcaggttattctcgagccttttaagaatctgttcggctcttacatcgggatcttttatacattcgtgatttccattatcgccctcctgattgtcatctacatcattcttcccatctgttttaaactgcgggacaccctccgcaagcatgaagatgcttataaaagagagatgaagattcggtga

SEQ ID NO: 14236 - RNA, 4326 nt, synthetic construct
  misc_feature 1..4326: note = derived and/or modified CDS sequence (opt5) from CHATV(LEIV-18733)__HQ734821.1__GP
  source 1..4326: mol_type = other RNA
atgatcttcattctggtgctcctggccgtcagcaccgcttcccccgtttaccagagatgctttcaagacggcgccatcgtgaagcagaacccttctaaagaggcggtgacagaagtctgtcttaaggatgacgtgagcatgattaaaacggaggctcggtatatgaagaatgccaccgggacattctccaacaatgttgccatccgcaaatggctggtgtctgattggcacgactgcagaccgaagaaggtcagcggaggccatattaacgtgatcgaagttggggatgacctctccctgcacaccgagtcttacgtgtgtagcgctgattgcacaatcggagtcgacaaagaaaccgcccaggtgcggcttcagacagataccacgaatcattttgagattgctggcaccacagtgaagtccgggtggttcaaaagcaccacatatatcaccctggaccaaacgtgtgagcacctcaaggtctcttgcggacccaaatccgttcagtttcatgcctgtttcaaccagcacatgagctgcgtgcgctttctgcacagaacagtgctgcctggctctattgctaattccatctgtcagaacattgaaatcattatcctcgtcaccctgacacttctgatcttcgtgctcctgagcattctttctaagacctacatctgctatctgctcatgcccatttttatccctattgcctacgtttatggcatcatctacaataagtcctgtaaaaagtgcaaactgtgcgggctggtgtaccatcccttcaccgagtgtggaacacactgcgtctgtggcgctcggtatgatacgagcgaccgcatgaagctccatagatcctctgggctgtgccctggatacaaaagccttcgggccgctcgcgtgatgtgtaagtccaaaggcccggccagcattctgtctatcattaccgcgatcctcgttctgacatttgtgacccccattaactccatggtcatcggggaaagcaaggaggtgttcgagcttgaagaactgcctgatgacatgctcgaaatggccctgaagatcaatttttattacttcgtctgcgtgattaactatgctgttacatggggactgatcgtggtcgccctcctgattggccttgtgttcaaaaagtaccaacacagatttctgaatctctatgctatgtactgtgaggaatgcgacatgtaccacgatcggaccggcctgaaacgcaacggggacttcacgaataagtgtagacagtgcacatgtggacagtatgaggatgccaccggccttatcacccatcggaaaacatacaactgcctggttaagtataagtctaaatggattctcaactttctgatcacctacatggtgctgacactcattaaggacagcgccatcgtcgtgcaggctgcggggacggatttctccgcctgcctggaggctcaatctgtggactggaattgtaccggaccctttcttaacctgggcaattgccagaaacagcaaaagaaagaaagctatgccaacatcgccacacagctcaaggggctgcaggctatttccgttctggatatgcctatgatcgccagcattcccgaggacatcgcgggagcgcttcgctacattgaagagaaggaaaccttccacgtccagctcacagccgagtatgccatgctgaccagatactgtgattactatacgcaatttgctgacaattctggctactcccagaccacatggcgggtgtatctgagaagccatgatttcgacgcctgcatcctctacccgaaccagcacttttgtcgctgcgtgaaacatggcgacaagtgttcttccagcaattgggatttcgctaacgagatgaaaaattattactccgggaagcagtctaaatttgacaaggatctgaaccttgccctgatgaccgtccaccacgcgttccggggaacaagctccgcctatatcgctaccatgctctctaagaaaagcaataacgacctggtggcctacacgaataagattaaagaaaagtttcctggcaacgctctgcttaaagccgttatggattacatctcctatatgaaaagcctctctgagatgacaaatttcaagtacgacgagttctgggatgacctgctgtatagacccaaccctaccaaggcgccctccctcagccgcgagtctgaaacatcctacaactttaagctggtgattagccccaaatctatgaaaagctgcaagaatgtcaagtccgtggtttgtcttagccctcggtctggggcctcctatgatagcatcctggcttgcggagagccgaacggcccctccgtgtacagaaaaccttctgggggcgtcttccaaagcaattccgacaagaccatgtattgtctcgccgattctcattgcctggaggactttgaagtgattggacaggaggaactggatgctatcaagaaaagcgtttgctgggccgtggagtaccccgacgtcaccctttccaagctctctgacggcgtgaaaagctgtcgcatgaaggattccgggaaatgcaacgtggccgctaatcggtggcctatcattcagtgtgagaacgacaagttctactatagcgaactgcagaatgattacgacaagacacaagatatcggacacttttgcctgtctcccggctgttccacggtcagattcccgattaaccagaaacatatcagcaattgcaactggcaggtttctcgctccagcattgcgaagatcgacgtgcacgatatcgaggacattgatcagtatcggaaagccatcacccaaaagctccagacatctctgtccctttttaaatacgctaagaccaagaatctgcctcacattaaacccatctataagtacattacaatcgaagggaccgagacggccgaaggaattgagagcgcctatatcgagtccgaaatccctgctctcgccggcacaagcgtggggttcaaaattaactctaaggagggcaaacatctgctggacatcattggatacgtcaagagcgcgtcctactctagcgtgtataccaaactttactccaccggccccacatctgggatcaataccaagcacgatgaactctgtacaggaccttgccccgctaacattaatcatcagaacggctggctgacgtttgccaaggagagaaccagctcctgggggtgtgaagagttcggatgcctggccatctctgacggctgtgtttttgggagctgccaagatatcgtgcgcgacgagctctccgtctatcggaaagaaacagaggaagtgaccgacgttgagctgtgccttacattcagcgataagacctactgtacgaacctgaatccgattacccctatcattacagacctctttgaagtgcagttcaaaaccgtcgagacatattctctgcccagaatcgtggctattcagaaccacgagatcaagatcggccagattaatgatctgggagtttactccaaaggctgcgggaacgtgcaaaaggtcaatggaaccgtgtatggcaacggggtgcccaagttcgactacctttgtcatctggccagccggaaagaagtcatcgttcgcaagtgctttgataatgactaccaggcgtgtaaattcctccagacccctgcttcttatagactggaggaaaactccggaacaattacggtgatcgattacaagaaaattctcggcacaatcaagatgaaggccattctgggggacgtgaaatataagacctttgccgataatgtcgacatcaccgtggagggcagctgcgctggatgtatcaactgcttcgagaatattcactgtgaacttacaatccacaccacgattgaggcctcctgcccggttacatctccctgtaccgtgtttcatgatcggatcctgattacacctaacgaacacaaatacgctatgaaggtcgtgtgcaccgagaaacccggcaatacactcaccctgaaggtttgcaacacgaaggtggacgccagcctggcgcttatcgacgccaaacctatcctggaactcgctcccgtcgatcagaccgcctatattagagagaaggacgagcgctgtaaaacatggatgtgccgggtgagagatgaagggctgcaagtcatcctcgagcctttcaagaatctgtttggatcctacattggcatcttctataccattatcatcagcattatcgtgcttctgattgttatctacattatcctccccgtgtgttttaaactgcgcgacacactgagacagcatgaagatgcttacaagcgggagatgaaggtccgctga

SEQ ID NO: 14237 - RNA, 4326 nt, synthetic construct
  misc_feature 1..4326: note = derived and/or modified CDS sequence (opt5) from CHATV(LEIV-22712)__HQ734822.1__GP
  source 1..4326: mol_type = other RNA
atgatcttcattctgatcctctttgccgtgagcgctgcctcccccgtctaccagagatgcttccaagacggcgcgattgttaagcagaacccttctaaagaggctgtgaccgaagtgtgtctgaaggatgacgtcagcatgatcaaaacagaggcccggtatacgaagaatgccaccgggacattttccaacaatgtggctattcgcaaatggcttgtttctgattggcacgactgcagaccgaagaaggtgagcggaggccatatcaacgtcatcgaagtgggggatgacctgtccctccacaccgagtcttacgtttgtagcgccgattgcacaattggagtggacaaagaaaccgctcagatccggctgcagacagataccacgaatcatttcgagattgccggcaccacagtcaagtccgggtggtttaaaagcaccacatatatcacccttgaccaaacgtgtgagcacctgaaggtgtcttgcggacccaaatccgtgcagttccatgcgtgttttaaccagcacatgagctgcgtccgcttcctccacagaacagttctgcctggctctattgccaattccatctgtcagaacattgaaatcatcattctggtgaccctcacactgcttatctttgtgctgctcagcattctgtctaagacctacatctgctatcttctgatgcccattttcatccctatcgcttacgtctatggcattatctacaataagtcctgtaaaaagtgcaaactctgcgggctggtgtaccatccctttaccgagtgtggaacacactgcgtttgtggcgcccggtatgatacgagcgaccgcatgaagctgcatagatcctctgggctctgccctggatacaaaagcctgcgggctgcccgcgtgatgtgtaagtccaaaggcccggcgagcgtcctttctattatcaccgccattctggtgctcacattcgttacccccatcaactccatggtggtcggggaaagcaaggaggtgtttgagctggaagaacttcctgatgacatgctggaaatggctctcaagatcaatttctattacttcatttgcgtcatgaactatgccgtgacatggggactgatcgttgtgggcctgctcattggcctggtctttaaaaagtaccaacacagattccttaatctgtatgctatgtactgtgaggaatgcgacatgtaccacgatcggaccgggctcaaacgcaacggagactttacgaataagtgtagacagtgcacatgtggccagtatgaggatgccaccgggctgatcacccatcggaaaacatacaactgccttgtgcagtataagtctaagtggattctgaacttcctcatcgcctacatgaccctgacactgattaaagacagcgctatcatcgttcaagcgacgggaaccgattttatttcctgcctcgagacacagtctgtgaattggaactgtaccggccccttcctgaatcttgggaactgccagaagcaacagaaaaaggaaccttatgccaatatcgctacacagctgaaaggactccaggccattagcgtcctggacatccccatgattgccaacatcccggaggatatcgctggcgccctgcgctacattgaagagaaggaaacctttcacgtgcaacttacggcggagtatgctatgctcaccagatactgtgactactatacacagttcgccgataattccggctacagccagaccacatggcgggtgtatctgagatctcatgactttgatgcctgcatcctgtaccctaaccagcacttctgtcgctgcgttaagcatggggacaaatgttccagctctaattgggactttgctaacgagatgaagaattattactccggaaaacaaagcaagttcgataaagacctcaacctggcccttatgaccatgcaccacgcttttcggggcacgtcctctgcctatattgcgacactgctcagcaagaagctgaatgatgacctggccgcttacaccaacaaaatcaaggaaaaattccccgggaatgcccttctcaaggctatgatggattacatttcctatatgaaatctctgagcgagatggccaacttcaagtacgacgaattttgggatgacctgctccataaacctgatcccacaaaggcgcccctgctttccagaggaagcgagcctgtctataacttcaagctggtggtgtcttcccgcagcgtcaaatcttgcaagaatgtgaaatccgttgtgtgtctcagcccgcggtctggcgtcagctacgactccgtgctggcctgcggggaacccaacggccctagcgtttatagaaagccctctgatggagtgtttcagtccaatagcgacaaaaccatctactgtctggctgattcccactgccttgaggacttcgaggtcatctctcaggaggagctcgacgccattaaaaagagcgaatgctgggtgatcgagtatcctaacgttaagctgaccaagccctccgatggcattaaatcttgtcgcatgaaggacagcgggaaatgcaatgtggctacaaaccggtggccgatcattcagtgtgagaataacaatttttactactccgaactgcaaaacgattatgacaagacgcaggatatcggacatttctgcctctctcctggctgtagcaccatcagataccccattaatcagaagcacatctccaactgcaattggcaggtcagccactcttccattgccaaaatcgacgtgcataacattgaggatatcgaacaatatcgcaaggccattacacagaaactgcagaccagcctttctctgtttaagtacgctaaaacaaagaatctccctcacatcaagcccatctataaatacattaccatcgaggggacggaaacagcggagggaattgagtccgcctatatcgaaagcgagattcctgctctggccggcacctctatcgggttcaagatcaactccaaagaaggcaagcatctgcttgacgtgattggatacgtcaaaagcgcctcctacagctctgtttatagcaagctctactccaccggccccacatctgggatcaacaccaaacacgatgagctgtgtacaggaccgtgccctgaaaatattaagcatcaaacgggctggctgacctttgctcgggagagaacaagctcctgggggtgtgaggagttcggatgcctcgccatctctgacggctgtgtgtttgggagctgccaggatattgtgaaggacgagctgtccgtctatcgcaaagaaaccgaggaagtgacagatgttgagctttgcctgaccttctctgacaagacgtactgtaccaacctcaatcccatcacacccatcattaccaacctgtttgaggtgcagttcaaaacagtcgaaacctatagcctgcctcggatcgtggcgattcagaatcacgagatcaagattggccaaatcaacgaccttggagtttactccaaaggctgcgggaatgtgcagaaggtcaacggaacagtgtatggcaatggggttccgaagttcgattacctgtgtcacctcgctagcagaaaagaagtgattgtccggaagtgctttgacaacgattaccaggcctgtaaattcctgcagacccccgcctcttatcgcctcgaggaaaattccggagctatcacggtgatcgactacaagaaaattctgggcacaatcaagatgaaggccattcttggggatgtgaaatataagacctttgcggacaacgtcgatatcaccgctgaaggcagctgcacaggatgtattaattgcttcgagaacatccattgtgaactgaccatccacacgacaattgaggcctcttgccctgttacctccccctgtacagtgtttcatgacagaatcctcgtgacccctaatgaacacaaatacgccatgaaggtcgtgtgcacagagaaacccggcagcaccctggttattaaggtgtgcaacacgaagatcgatgcttccctggcccttattgacgctaaacctatcctggagctcgcccccgtcgatcaaaccgcgtatatccgggaaaaggacgagagatgtaaaacatggatgtgccgcgtgcgggacgaagggctgcaggttattctcgagccgttcaagaacctgtttggatcttacatcggcattttctatacctttatcattagcatcattgtgcttctgatcgtcatctacattatcctccctatttgtttcaaactgagagatacactgcgcaagcatgaagacgcctacaagagagagatgaaaatccggtga

SEQ ID NO: 14238 - RNA, 4332 nt, synthetic construct
  misc_feature 1..4332: note = derived and/or modified CDS sequence (opt5) from INKV(KN3641)__U88059.1__GP
  source 1..4332: mol_type = other RNA
atggaggtgctgaacctcatctggctgcttaccctgtgcagcgcctcccccgtcttccagagatgttttcaagacggcgctattgttaagcagaatccttctaaagaagccgtgacagaggtgtgcctcaaggatgacgtcagcatgatcaaaacggaagcgaagtacattaaaaacaccacagggaccttcgctaataacatcgccatgcggaagtggctggtggccgattggcacgactgtcgcccgcagaagtcctctggaggccatattaatgttatcgaggtgggggatgaccttagcctgcacacagaatcctatatctgctctgctgattgtgtcattaccgtggacaaagagacagcccagatcagactccaaaccgataacacgaatcattttgaggttgctggaaccacagtgaagtccggctggttcaaatccaccacatacattaccctggaccagacgtgcgaacacctgaaggtcagctgtgggcccaaatctatccagtttcatgcctgcttcaaccagcacatgtcctgtgtgcggtttctccaccgcacaattctgcctggaagcatcgccaattctatttgccaaaacatcgagatcattatccttgtgaccctgtccctcgtcattttcatctttctgacaattgttagcaagacctatgtgtgttaccttctgatgcccatcttcatccctattgcgtatatctacggctggatttataataagtcttgcaaaaagtgcagactctgtggcctggtgtaccatccctttaccgaatgcgggacacactgtgtctgcggagctcggtacgagacgtccgatcgcatgaaactgcatagagccagcggcctctgtcctgggtataagaacctgcgggctgcccgcgtgatgtgcaaatccaagggaccggcgtctgttcttagcatcatgaccgccgtgctgattctcacattcgtcacccccatctccgctatggtgatcggcgagagctctgaagtttacacactgggggaccttcctgatgacatggtggagatggccgaaagagtcaatatttattaccagatcattatcattaactattccatcacctgggtgtttctgctcctgggactgattatcgcttacttcttccggaaatatcagcaccgctttctcagcttctacgccatgtactgtaaggagtgcgacatgtatcacgaaagagccggcctgacgtactggggcgattttacaaataagtgtcggcagtgcacctgtgggcaattcgaggacgtcaccggacttatggtgcataaaaagtcttataactgcatcattaaatacaaggctaaatggatccgcgatatgctgattacatatctcctgatcatgcttattaaggacagcctgctctttgttggcgcgaccgggacagatttcgccgcttgcatcgacgagaagacggtgacctggaacagaacaggaccctttctgaatctgggccggtgtgataaatcccagaagaaaaccgggtacacagacatcgccgatcagctcaagggactgggcgccatttctgtccttgacatccctatgattaaaaagatgcccgatgaaatcagcggctccctgaagtgcattgacgacctcgagacccaccatgaacaactgacggctgagtatgccttcctgaccagatactgtgattactatacacagtacaccgacaacagcgggtattctcagacagtgtggcgcacctaccttcggtcccacgattttggagcgtgcgttgtgtatccgaatcagcatttctgtagatgcgtcaaacacggcgacaagtgtaacagcgctaaatgggattttgccaatgaaatgaagacgttctacacagggcaaaaagccaagtttaacaaggacctcaatctggctctgctcgtgctgcacaaagccttccgcggaaccggcacatcttatatcgctgagtccatggcccggaaggataacagaagcatgacccatttcgcgcttgagatcaaaaagaaatttcctaccaatgccctgctcacagctctgattgactacatctcctacctgcagtctcccgccgaaatgagcacgttcgagcttgatgaagactgggaggattttaagtataaacctgaacccaccgagagcccccagctccgctctcaccggacagaccagtacaacttcaagaatgctgatagcaactccaatgtgaaggtttgcaaaaacattcaaaaggtcagctgtatctctcctagatcccgcgccaaatttgagaatattatcgcgtgcggggaacatgccaacccgagcgtgtataccatgcccaacgtgtctatctaccagtccaatagcgagcggtctcactattgtattgctgacagccactgcctggaagagtacgaggtcgtggaaacagagctgctcaacgccctgaagaaatccaagtgctgggctagagaaatggacgatatcgttcttcataaacaggtggacggcctgcgcagctgtcggatgaaggataccggaaattgcaacgtccaggagaatgactggacgattgtgctctgtgaaaacggcaattattactactctgaggcccacagagattatgacaaggatcaagacgttgggcatttctgcctgtcccctcggtgtagcacaatccgctaccccatttccaaaagacacatcaagaactgcgattggcagatttctcatagcaccatcgacaaaatctccgtgcaggagctggccgatattgaacagtataagaaggctatctctcaaaaacttcagaccagcctctccatttttaagtacgtcaaaacaaagaatctgcctcacatcaaacccgcgtataagtacattaccgtggagggagttgaaacagtggagggcatcgaaaacgccttcatcgagtctgagattccggctctggccgggacggccatcggatttaagattaatagccgggaaggcaactatctcatggacgtcatcgggtacgtgaaatccggcagctactctgctacctatacaaagctgtacattaccggacctacaatcggcgtgaataccaaacacgatgagaagtgtacggggccctgccctgccatcattgaccataaagaaggatggcttaccttcgcgaagggcagaacatccacctgggggtgtgaggaatttggatgcctggctgtcagcgacggctgtgttttcgggtcttgccaggatatcattaaagacgagctcgccgtgcaccgcaagacaaccgaggaacccacaaccgtggagctgtgcctgacgttttccgataagacatattgtaccaaccttaatgccatcacccctattatcacagacaaattcgaagtccaattcaagaccgtggagagctacacgctcccccggattatcgctatcaaaaaccatgagattaaggttggccagatcaacgatctgggagtgtattctaaaggctgcgggaatgtccagaagattaacggaacaaattacggcaacgggctgccgaagtttgactatctctgtcacctggccggaagaaaagaagtgatcattcgcaagtgcttcgataatgactaccaggcgtgtaaatttcttcaatcccctcccagctacagactggaggaacatcagggcaccgttacagtgatcgattataagaaaatcctcgggaccattaagatggaggctatcctgggcgacgtcaagtaccggaactatcagtccaatattgaaatcaacgccaaaggaacatgcgccggctgtattaattgcttcgagaacatccactgtgagtttaccatccacacgaccgtggaagctagctgccccattgttacagattgggtgtctttccatgaccgcatcctgattacccctgacgagcacaagtacgcccttaaagtcgtgtgtcaggaaaagccgaaactgagcctcaagtttaagatctgcaatacaaacattgatgcttccatgaccgtggtcgactctaaacccatcctggagctcgcccctgttgatcaaacgacatatattagagaacgggacgagcgctgcaagacctggatgtgtagagtgcgggatgaggggttccaggtgatcctggaaccctttaaaaatcttttcggaagctacatcggcatcttttatacagggattctgtgcattgtctgtctcctgatcgtgatttacatcatcctgcctatttgcttcaaacttcgcgacaccctgagacagctcgaggatgcgtacaagaaggaagttaagatccggtga

SEQ ID NO: 14239 - RNA, 4332 nt, synthetic construct
  misc_feature 1..4332: note = derived and/or modified CDS sequence (opt5) from INKV(SWAR83-161)__U88060.1__GP
  source 1..4332: mol_type = other RNA
atggaggtgctgaacctcatctggctgcttaccctgtgcagcgcctcccccgtcttccagagatgttttcaagacggcgctattgttaagcagaatccttctaaagaagccgtgacagaggtgtgcctcaaggatgacgtcagcatgatcaaaacggaagcgaagtacattaaaaacgctaccgggacattcgccaataacatcgccatgcggaagtggctggtggctgattggcacgactgtcgcccgcagaagtcctctggaggccatattaatgttatcgaggtgggggatgaccttagcctgcacaccgaatcctatatctgctctgccgattgtgtcattacagtggacaaagagaccgctcagatcagactccaaacagataacaccaatcattttgaggttgccggaacgaccgtcaagagcggctggttcaaatccacaacctacattacactggaccagacctgcgaacacctgaaggtgagctgtgggcccaaatctatccagtttcatgcgtgcttcaaccagcacatgtcctgtgtgcggtttctccaccgcacgattctgcctggaagcatcgccaattctatttgccaaaacatcgagatcattatccttgtgacactgtccctcgctattttcatctttctgaccattgtcagcaagacatatgtttgttaccttctgatgcccatcttcatccctattgcctatatctacggctggatttataataagtcttgcaaaaagtgcaaactctgtggcctggtgtaccatccctttaccgaatgcgggacccactgtgtgtgcggagctagatacgagacatccgatcggatgaagctgcatcgcgccagcggcctctgtcctgggtataaaaacctgagagcggcccgggtcatgtgcaagtccaaaggaccggcttctgtgcttagcatcatgacggccattctgatcctcaccttcgttacacccatctccgctatggtgattggcgagagctctgaagtctacaccctggacgagcttcctgatgacatggtgcagatggccgaacgcgttaatatctattaccagattatcattatcaactattccattacatgggcctttctcctgttcgggctggtgctggcttacttctttaagaagtatcagcacagattcctcagcttttacgcgatgtactgtaaagagtgcgacatgtatcacgaacgggccggactgacctactggggcgatttcacgaataagtgtcgccaatgcacatgtggccagtttgaggacgtcaccgggcttatggtgcataaaaagtcttataactgcatcatcaaatacaaggctaagtggattagagatatcctgattacctatctcatcattatgctgatcaaagacagccttctgttcgtcggagccacaggcaccgattttgccgcttgcatcgacgagaagacagtgacgtggaactgtaccgggcccttcctcaatctgggaaaatgcgataagtcccagaaaaagattggctacgccgacatcgcggatcaactgaaggggctcggagctatttctgttctggacatccctatgattaaacggatgcccgatgaaatcagcggctcccttaagtatatcgacggcctggagacataccacgaacagctcaccgccgagtacgcctttctgacacgctattgtgactactatacccagtacacggataacagcgggtattctcagaccgtgtggagaacatacctgcggtcccatgacttcggagcttgcgtcgtgtatccgaatcaacacttttgtagatgcgttaaacatggcgataagtgtaacagcgccaaatgggacttcgctaatgaaatgaagaccttttacacagggcagaaggccaaattcaacaaggatcttaatctcgcgctgctggtgctccacaaagccttccgcggaaccggcacgtcttacattgctgagtccatggcccggaaggacaacagaagcatgacacactttgctctggagatcaaaaagaaattccctaccaatgcccttctgacagcgctcattgattatatctcctacctgcagtctctggccgaaatgagcacctttgagcttgacgaagattgggaggacttcaagtataagcccgaacctaccgaggctccccagctccgctcccatcggacagatcaatacaactttaaaaatgccgactctaacagcaatgtcaaggtgtgcaaaaacattcagaaggtgtcctgtatcagccccagatctcgcgctaaattcgagaatatcattgcctgcggggaacacgccaacccttccgtttatatgatgccgaacgtcagcatctaccagtctaattccgagcggagccattattgtattgctgattctcactgcctggaagagtacgaggtggtggaaagcgagctgctcaacgcgctgaagaagtccaaatgctgggccaaggaaatggacgacatcgtccttcacaaacagagcgatggcctgagatcttgtcgcatgaaggacacgggaaattgcaacgtgcaagagaatgattggaccattgttctctgtgaaaacggcaattactattactccgaggctcatcgggactatgataaagaccaggatgtggggcacttttgcctgagccccagatgttccacaatccgctaccctattaacaagcggcatatcagaaattgcgactggcagatctctcacagcaccattgataagatctccgtccaggagctggccgacattgaacaatataaaaaggccatctctcagaaacttcagacaagcctctccattttcaagtacgtgaaaaccaagaacctgccccatatcaagcctgcttataaatacatcacggttgagggaattgaaacagtggagggcatcgaaaatgcctttattgagtctgagatccccgcgctggctgggaccgccattggattcaagatcaacagccgggaaggcaattacctcatggatgtcatcgggtatgtgaaatccgccagctactctgctacctatacaaagctgtacaccacaggcccgacgattggagttaacaccaaacacgacgagaagtgtacaggcccttgtccccctatcattgatcacaaagaagggtggcttacctttgccaaggagcgcacatccacctggggatgcgaagagttcggctgcctggcggtgagcgacgggtgtgtctttggatcttgccaagacatcattaaggatgagctcgctgtgtatagaaaaacgaccgaagaactgacaaccgtggaactgtgccttacattctccgacaagacctactgtacaaatctcaacgccatcacccccattatcacggataaattcgaggtccagtttaagacagttgagagctataccctgcctcggatcattgccatcaaaaaccatgaaattaaggtgggccagatcaatgacctgggggtgtactctaagggctgcggaaacgtccagaaaattaatggcaccaactacgggaatggagtgcccaagttcgattatctctgtcacctggcttccagaaaagaggttatcatccgcaagtgctttgacaacgattaccaagcctgtaaattccttcagagcccgccttcctatcggctggaggagcatcagggcacagtgaccgtcattgactacaagaagatcctcgggattatcaaaatgaaggctattctgggagatgtgaaatataagaattaccagagcaacatcgaaatcaatgccgagggcacgtgcgcggggtgtattaactgctttgagaatatccactgtgagttcacaattcataccacagttgaagcctcttgccccatcgtgaccgactgtgtcagctttcacgatcgcattctgatcacacccgacgaacacaaatatgctcttaaggtggtttgccaagagaagcctaaactgtccctcaagttcaaaatttgcaacaccaatatcgacgcctctatgacgatcgtggatagcaagccgattctggaactcgctcccgtcgaccagaccacatacatcagagagaaagatgagagatgtaagacctggatgtgccgggtgcgcgacgaaggctttcaggtgattctggagcctttcaagaacctttttggatcctacatcggcattttctatacagggatcctgtgtatcatttgcctcctgatcgtcatttacatcattctgcccatctgtttcaaacttagagataccctgcggcagcatgaagacgcctataagaaagagatgaagatccgctga

SEQ ID NO: 14240 - RNA, 4332 nt, synthetic construct
  misc_feature 1..4332: note = derived and/or modified CDS sequence (opt5) from INKV(Lovanger)__KU681435.1__GP
  source 1..4332: mol_type = other RNA
atggaggtgctgaacctcatctggctgcttaccctgtgcagcgcctcccccgtcttccagagatgttttcaagacggcgctattgttaagcagaatccttctaaagaagccgtgacagaggtgtgcctcaaggatgacgtcagcatgatcaaaacggaagcgaagtacattaaaaacgctaccgggacattcgccaataacatcgccatgcggaagtggctggtggctgattggcacgactgtcgcccgcagaagtcctctggaggccatattaatgttatcgaggtgggggatgaccttagcctgcacaccgaatcctatatctgctctgccgattgtgtcattacagtggacaaagagaccgctcagatcagactccaaacagataacaccaatcattttgaggttgccggaacgaccgtcaagagcggctggttcaaatccacaacctacattacactggaccagacctgcgaacacctgaaggtgagctgtgggcccaaatctatccagtttcatgcgtgcttcaaccagcacatgtcctgtgtgcggtttctccaccgcacgattctgcctggaagcatcgccaattctatttgccaaaacatcgagatcattatccttgtgacactgtccctcgctattttcatctttctgaccattgtcagcaagacatatgtttgttaccttctgatgcccatcttcatccctattgcctatatctacggctggatttataataagtcttgcaaaaagtgcaaactctgtggcctggtgtaccatccctttaccgaatgcgggacccactgtgtgtgcggagctagatacgagacatccgatcggatgaagctgcatcgcgccagcggcctctgtcctgggtataaatccctgagagcggcccgggtcatgtgcaagtctcgcggaccggctagcgtgctttccatcatgacggccattctgatcctcaccttcgttacacccatcagcgctatggtgattggcgagtcttccgaagtctacaccctggacgagcttcctgatgacatggtgcagatggccgaaagagttaacatctattaccagattatcattatcaattatagcattacatgggcctttcttctcttcgggctggtgctggcttacttctttaaaaagtatcagcaccggttcctctctttttacgcgatgtactgtaaggagtgcgacatgtatcacgaacgcgccggactgacctactggggcgatttcacgaacaaatgtagacaatgcacatgtggccagtttgaggacgtcaccgggcttatggtgcataagaaaagctataattgcatcatcaagtacaaagctaagtggattcgggatatcctgattacctatctcatcattatgctgatcaaggactcccttctgttcgtcggagccacaggcaccgattttgccgcttgcatcgacgagaaaacagtgacgtggaactgtaccgggcccttcctcaacctgggacgctgcgataagtctcagaaaaagattggctacgccgacatcgcggatcaactgaaagggctcggagctattagcgttctggacatccctatgattaagagaatgcccgatgaaatctccggcagccttaagtatatcgacggcctggagacataccacgaacagctcaccgccgagtacgcctttctgacacggtattgtgactactatacccagtacacggataattctgggtattcccagaccgtgtggagaacatacctgcgcagccatgacttcggagcttgcgtcgtgtatccgaaccaacacttttgtcggtgcgttaaacatggcgataagtgtaattctgccaaatgggacttcgctaacgaaatgaagaccttttacacagggcagaaagccaagttcaataaggatcttaacctcgcgctgctggtgctccacaaagccttcagaggaaccggcacgtcctacattgctgagagcatggcccgcaaggacaatcggtccatgacacactttgctctggagatcaaaaagaaattccctaccaacgcccttctgacagcgctcattgattatatctcttacctgcagagcctggccgaaatgtccacctttgagcttgacgaagattgggaggacttcaagtataaacccgaacctaccgaggctccccagctcagatctcatcgcacagatcaatacaattttaagaacgccgacagcaattccaacgtcaaggtgtgcaaaaatattcagaaggtgagctgtatctctccccggtccagagctaaattcgagaacatcattgcctgcggggaacacgccaatcctagcgtttatatgatgccgaacgtctctatctaccagtccaacagcgagcgctctcattattgtattgctgatagccactgcctggaagagtacgaggtggtggaatccgagctgctcaatgcgctgaagaaaagcaagtgctgggccaaggaaatggacgacatcgtccttcacaaacaggctgatggcctgcggtcttgtagaatgaaggacacgggaaactgcaatgtgcaagagaacgattggaccattgttctctgtgaaaatggcaactactattactccgaggcccatcgcgactatgataaagaccaggatgtggggcacttttgcctgagcccccggtgttccacaatcagataccctattaataagcggcatatccgcaactgcgactggcagatctctcacagcaccattgataaaatctccgtccaggagctggccgacattgaacaatataagaaggctatctctcagaaacttcagacaagcctctccattttcaagtacgtgaaaaccaagaatctgccccatatcaaacctgcctataagtacatcacggttgagggagtggaaacagtcgagggcattgaaaacgcgtttatcgagtctgagattcccgctctggccgggaccgccatcggattcaagattaatagcagagaaggcaactacctcatggatgtgatcgggtatgttaaatccgctagctactctgccacctatacaaagctgtacaccacaggcccgacgatcggagtgaataccaaacacgacgagaagtgtacaggcccttgtccccctattatcgatcacaaagaagggtggcttacctttgcgaaggagcggacatccacctggggatgcgaagagttcggctgcctggctgtcagcgacgggtgtgtgtttggatcttgccaagacattatcaaagatgagctcgtggtctatagaaagacgaccgaagaactgacaaccgttgaactgtgccttacattctccgacaagacctactgtacaaacctcaatgccattacccccatcattacggataaattcgaggtgcagtttaagacagtggagagctataccctgcctcgcatcatcgccattaaaaaccatgaaatcaaggtcggccagattaacgacctgggggtgtactctaaaggctgcggaaatgttcagaagatcaacggcaccaattacgggaacggatggcccaagttcgattatctctgtcacctggcttcccggaaagaggtgattatcagaaagtgctttgacaatgattacaaagcctgtaagttccttcaaagcccgccttcctatcgcctggaggagcatcagggcacagtcaccgtgatcgactacaaaaagattctcgggacgatcaagatgaaagctattctgggagatgttaagtataaaaactaccagagcaatatcgaaattaacgccgagggcacatgcgcggggtgtatcaattgctttgagaacatccactgtgagttcaccattcatacaaccgtggaagcctcttgccccatcgtcacagactgtgtgagctttcacgatcggattctgatcacccccgacgaacacaagtatgctcttaaagttgtgtgccaggagaagcctaagctgtccctcaaattcaagatttgcaatacgaacatcgacgcctctatgaccattgtcgatagcaaaccgatcctggaactcgctcccgtggaccaaacaacctacatcagagagaaggatgagcgctgtaaaacatggatgtgcagagtgcgggacgaaggctttcaggtcattctggagcctttcaagaatctttttggatcctacatcggcattttctataccgggatcctgtgtattatctgcctcctgatcattatctacattatcctgcccatttgtttcaagctgcgcgatacgctgagacagcatgaagacgcctataaaaaggagatgaaaatccggtga

SEQ ID NO: 14241 - RNA, 4332 nt, synthetic construct
  misc_feature 1..4332: note = derived and/or modified CDS sequence (opt5) from INKV(Lovanger)__KX554936.1__GP
  source 1..4332: mol_type = other RNA
atggaggtgctgaacctcatctggctgcttaccctgtgcagcgcctcccccgtcttccagagatgttttcaagacggagctattgttaagcagaatccttctaaagaagccgtgacagaggtgtgcctcaaggatgacgtcagcatgatcaaaacggaagcgaagtacattaaaaacgctaccgggacattcgccaataacatcgccatgcggaagtggctggtggctgattggcacgactgtcgcccgcagaagtcctctggaggccatattaatgttatcgaggtgggggatgaccttagcctgcacaccgaatcctatatctgctctgccgattgtgtcattacagtggacaaagagaccgctcagatcagactccaaacagataacaccaatcattttgaggttgccggaacgaccgtcaagagcggctggttcaaatccacaacctacattacactggaccagacctgcgaacacctgaaggtgagctgtgggcccaaatctatccagtttcatgcgtgcttcaaccagcacatgtcctgtgtgcggtttctccaccgcacgattctgcctggaagcatcgccaattctatttgccaaaacatcgagatcattatccttgtgacactgtccctcgctattttcatctttctgaccattgtcagcaagacatatgtttgttaccttctgatgcccatcttcatccctattgcctatatctacggctggatttataataagtcttgcaaaaagtgcaaactctgtggcctggtgtaccatccctttaccgaatgcgggacccactgtgtgtgcggagctagatacgagacatccgatcggatgaagctgcatcgcgccagcggcctctgtcctgggtataaatccctgagagcggcccgggtcatgtgcaagtctcgcggaccggctagcgtgctttccatcatgacggccattctgatcctcaccttcgttacacccatcagcgctatggtgattggcgagtcttccgaagtctacaccctggacgagcttcctgatgacatggtgcagatggccgaaagagttaacatctattaccagattatcattatcaattatgggattacatgggcctttcttctcttcggactggtgctggcttacttctttaaaaagtatcagcaccggttcctcagcttttacgcgatgtactgtaaggagtgcgacatgtatcacgaacgcgccggcctgacctactggggcgatttcacgaacaaatgtagacaatgcacatgtgggcagtttgaggacgtcaccggacttatggtgcataagaaatcttataattgcatcatcaagtacaaagctaagtggattcgggatatcctgattacctatctcatcattatgctgatcaaggacagccttctgttcgtcggcgccacagggaccgattttgccgcttgcatcgacgagaaaacagtgacgtggaactgtaccggacccttcctcaacctgggccgctgcgataagtcccagaaaaagattgggtacgccgacatcgcggatcaactgaaaggactcggcgctatttctgttctggacatccctatgattaagagaatccccgatgaaatcagcggctcccttaagtatattgacgggctggagacataccacgaacagctcaccgccgagtacgcctttctgacacggtattgtgactactatacccagtacacggataatagcggatattctcagaccgtgtggagaacatacctgcgctcccatgacttcggcgcttgcgtcgtgtatccgaaccaacacttttgtcggtgcgttaaacatggggataagtgtaatagcgccaaatgggacttcgctaacgaaatgaagaccttttacacaggacagaaagccaagttcaataaggatcttaacctcgcgctgctggtgctccacaaagccttcagaggcaccgggacgtcttacatcgctgagtccatggcccgcaaggacaatcggagcatgacacactttgctctggagattaaaaagaaattccctaccaacgcccttctgacagcgctcatcgattatatttcctacctgcagtctctggccgaaatgagcacctttgagcttgacgaagattgggaggacttcaagtataaacccgaacctaccgaggctccccagctcagatcccatcgcacagatcaatacaatctgaagaacgccgactctaatagcaacgtcaaggtgtgcaaaaatatccagaaggtgtcctgtatcagcccccggtctagagctaaatttgagaacattatcgcctgcggcgaacacgccaatccttccgtttatatgatgccgaacgtcagcatttaccagtctaactccgagcgcagccattattgtatcgctgattctcactgcctggaagagtacgaggtggtggaaagcgagctcctgaatgcgcttaagaaatccaagtgctgggccaaggaaatggacgacattgtcctgcacaaacaggctgatggactccggagctgtagaatgaaggacacgggcaactgcaatgtgcaagagaacgattggaccatcgttctgtgtgaaaatgggaactactattactctgaggcccatcgcgactatgataaagaccaggatgtgggacacttctgcctgagcccccggtgttccacaattagataccctatcaataagcggcatatccgcaactgcgactggcagatttcccactctaccatcgataaaattagcgtccaggagcttgccgacatcgaacaatataagaaggctatttcccagaaactccagacatctctgagcatctttaagtacgtgaaaaccaagaatctgccccatatcaaacctgcctataagtacattacggttgagggcgtggaaacagtcgaggggatcgaaaacgcgttcattgagtccgagatccccgctctcgccggaaccgccattggctttaagatcaattctagagaagggaactacctgatggatgtgatcggctatgttaaaagcgcttcctacagcgccacctatacaaagctgtacaccacaggaccgacgattggcgtgaataccaaacacgacgagaagtgtacagggccttgtccccctatcattgatcacaaagaaggatggctgaccttcgcgaaggagcggacatctacctggggctgcgaagagtttgggtgcctcgctgtctccgacggatgtgtgttcggcagctgccaagacatcattaaagatgagctggccgtgtatagaaagacgaccgaggaactgacaaccgtcgaactttgcctcacattttctgacaagacctactgtacaaacctgaatgccatcacccccattatcacggataaattcgaggttcagttcaagacagtggagtcctataccctgcctcgcatcattgctatcaaaaaccatgaaattaaggtggggcagatcaacgacctcggcgtctacagcaaaggatgcggcaatgtgcagaagattaacgggaccaattacggaaacggcctgcccaagtttgattatctttgtcacctggcctctcggaaagaggttatcatcagaaagtgcttcgacaatgattaccaggcttgtaaatttctccaatccccgcctagctatcgcctggaggaacatcaggggacagtgaccgtcattgactacaagaaaatcctgggaacgattaagatgaaggccatccttggcgatgtgaaatataagaactaccagtccaatattgaaatcaacgcggaggggacatgcgccggctgtatcaattgcttcgagaacattcactgtgaatttaccatccatacaaccgttgaggctagctgccccattgtgacagactgtgtctctttccacgatagaatcctgattacccccgacgaacacaaatatgccctcaaggtggtttgccaagagaaacctaagctgagcctcaagtttaaaatctgcaatacgaacattgacgcttccatgaccatcgtggattctaagccgatcctggaacttgcccccgtcgaccagacaacctacattcgggagaaagatgagcgctgtaagacatggatgtgcagagtgcgggacgaaggattccaggtgatcctggagccttttaaaaatctcttcggcagctacattgggatcttttataccggcattctgtgtatcatctgcctgcttattgtcatctacattatcctgcccatttgtttcaagctccgcgatacgctgagacagcatgaagacgcctataagaaagagatgaagatccggtga

SEQ ID NO: 14242 - RNA, 4335 nt, synthetic construct
  misc_feature 1..4335: note = derived and/or modified CDS sequence (opt5) from JSV__AF123487.1__GP
  source 1..4335: mol_type = other RNA
atggaggtgctgaacctcatctggctgcttgccctgtgcagcgcttcccccgtcttccagagatgttttcaagacggagccattgttaagcagaatccttctaaagaagcggtgaccgaggtgtgcctcaaggatgacgtcagcatgatcaaaacagaagctaagtacgtgaaaaacacgaccgggacattcgccaataacattgccatgcggaagtggctggttgctgattggcacgactgtcgcccgcagaagtcctctggaggccatatcaatgtgattgaggtcggggatgaccttagcctgcacaccgaatcctatatctgctctgccgattgtgtgatcacagttgacaaagagaccgctcagattagactccaaacagataacaccaatcattttgaggtggccggaacgaccgtcaagagcggctggttcaaatccacaacctacatcacactggaccagacctgcgaacacctgaaggtgagctgtgggcccaaatctattcagtttcatgcgtgcttcaaccagcacatgtcctgtgtgcggtttctccaccgcacgatcctgcctggaagcattgccaattctatctgccaaaacattgagatcatcattcttgtcacactgtccctcgttatcttcatttttctgagcatcgtgtctaagacctatgtgtgttaccttctgatgcccattttcatccctatcgcttttatttatggctggatctacaataagtcctgcaaaaagtgcaaactctgtggcctggtctatcatcccttcacagaatgcgggacccactgtgtgtgcggagccagatacgagaccagcgatcggatgaagctgcatcgcgcttccggcctctgtcctgggtacaaatctctgagagccgcgcgggttatgtgcaagagcaaaggaccggcctccattcttagcatcatgacagctattctgatcctcacgtttgtgacccccatctctgccatggtcattggcgagtccagcgaagtgtatacactggacgatcttcctgacgacatggttcagatggctgagcgcgtgaacatctactatcagattatcattatcaattacggggtcacctgggccttcctgctcctgggactgattctcgcctatttctttaagaagtaccagcacaaattcctggatttttatgctatgtactgtgaagagtgcgacatgtaccacgaaaagtctggccttacacattggggcgatttcaccaacaaatgtagacaatgcacgtgtgggcagtttgaggacgtggcgggactgatgatccaccggaaaagctataattgcctcgtcaaatacaaggcccgctggatcagagatattctgatcatgtatcttgctatgattctgatcaaggactccctcctgttcgtgggcgcctctgggacagattttgccgcttgcattgacgagaaagttgtgacctggaactgtaccggacccttcctgaacctcggccggtgcgataagagccagaaaaagacaaattacgaagggatcgccaaccaactgaaaggacttggcgtcatctccgtgctggacattcctatgatcaagaatatgcccgatgagattagcggctctctcaagtatatcgactccctggaaacctaccatgagcagctgacagcggaatatgcttttcttacgcgctactgtgactactatacccagtacacagataacagcgggtattctagaaccgtttggcggacatacctcagatcccacgacttcggagcctgcgtggtctatccgaatcatcacctgtgtcgctgcgtgaaatacggcgataagtgtaacagcgccaaatgggactttgctaatgagatgaagaccttctatacggggcagaaagtgaagtttaacaaggatctgaatctcgccctgcttgttctgcacaaggctttccggggaaccggcacagcctacgtcgcggaggccatggctagaaaggacaacgggtccatggcccatttcgctctcgaaattcgcaaaaagtttcctaccaatgccctgctggcggcccttatcgattacatcgtgtatctccaatctctggctgagattgccacattcgaactggacgaggattgggaagactttaaatacaagcccgagcctaccgagagcacgccccaggctcggtcccacagaaacgatcagtataatttcaaaaacgccgaatctaatagcaacacaaaggtgtgcaagaacgtccagaaagtgctctgtatcagcccccgctccaaggccaaatttgagaatattatcgcttgcggcgaacatgcgaacccttctgtttacatgatgccgaatgtgtccatttatcaaagcaactctgagcggtcccactactgtatcgccgacagccactgcctggagaagtatgaagtcgtggagaccgaacttctgaatgctctcaaaaagtctaagtgctgggccaaagagatggatgacatcgttctgcataagcagagcgacggactgagatcctgtcgcattaaagatacaggcaactgcaatgtgcaggaaaacgactggaccatcgtcctttgtgagaatgggaactactactatagcgaggtgcacaaggattacgacaaagatcaggacgttggacatttctgcctctctccccggtgtaccacaattagatatcctatctcccgccggcacattagaaagtgcgaatggcaaatcagccattccacgattgataagatctctgtgcaggagctggccgacatcgaacagtacaaaaaggctattagccagaaactgcaaacctccctctctatctttaagtatgtccggaccaaaaatctgccccacattaagcctgcctacaagtatatcacagtggagggcgtggaaacaattgaggggatcgagaacgcgttcatcgaaagcgagattcccgctcttgccggaaccgccatcggctttaaaattaattcccgcgaagggaactacctgatggatgtcatcggctacgttaagtctgctagctattccgccgtgtacacgaaactctatacaaccggaccgaccattggcatcaatacaaagcacgacgagaaatgtaccgggccttgccccgcggtgatcgatcataaggacggatggctgacattcagcaaagaaagaacgtctacctggggctgtgaggagtttgggtgcctggctgtctccgatggatgtgtgttcggcagctgccaggacattatcaaggacgaacttgccgtttaccggaagacaaccgaggaactcacaaccgtggagctgtgcctgacgttttctgataaaacctattgtacaaacctcaacgccattacccctatcattacagacaagttcgaggtccagttcaaaaccgtggaatcctacacactgcccagagttatcgctattaagaatcacgagatcaaagtggggcaaatcaacgatcttggcgtctatagcaagggatgcggcaatgtgcagaaggttaacgggaccaattacggaaacggctctcctcgctttgactacctgtgtcatctcgcctcccggaaagaagtgattctgagaaagtgcttcgataatgactatcaggcttgtaaatttctgcagagcccctccagctaccgccttgaggaacaccaagggacggtcacagtgatcgattataagaaaattctgggaaccatcaagatgaaggccattctcggcgacgtgatctacatcaactatcagaataacattgagatcaatgcggaggggacctgcgccggctgtattgattgcttcgaaaacatccattgtgagtttacaattcacaccacggtcgaggcttcttgcccgatcacaaccgaatgtgttagcttccacgacagaatcctgattacacctgatgaacataaatacgccctcaagatcgtgtgccacgacaaacccaaggtgtccctgaaatttaagatttgcaataccaacgtcgacgctgccatgacaatcgtggattctaagcccattcttgagctggcccctgttgaccagaccacgtatatccgggagaaagatgaacgctgtaagacctggatgtgcagagtgcgggacgagggattccaggtcattctcgaaccgtttaaaaatctgttcggcagctacatcgggatcttttacacaggcattctgtccatcatttgtcttctgatcgtggtttatattatcctccccatctgcttcaagctgcgcgataccctcagacaacatgaggacgcttaccggaaagaaatgaagattcgctga

SEQ ID NO: 14243 - RNA, 4335 nt, synthetic construct
  misc_feature 1..4335: note = derived and/or modified CDS sequence (opt5) from JSV(BFS 4474)__KX817319.1__GP
  source 1..4335: mol_type = other RNA
atggaggtgctgaacctcatctggctgcttgccctgtgcagcgcttcccccgtcttccagagatgttttcaagacggcgccattgttaagcagaatccttctaaagaagcggtgaccgaggtgtgcctcaaggatgacgtcagcatgatcaaaacagaagctaagtacgtgaaaaacacgaccgggacattcgccaataacattgccatgcggaagtggctggttgctgattggcacgactgtcgcccgcagaagtcctctggaggccatatcaatgtgattgaggtcggggatgaccttagcctgcacaccgaatcctatatctgctctgccgattgtgtgatcacagttgacaaagagaccgctcagattagactccaaacagataacaccaatcattttgaggtggccggaacgaccgtcaagagcggctggttcaaatccacaacctacatcacactggaccagacctgcgaacacctgaaggtgagctgtgggcccaaatctattcagtttcatgcgtgcttcaaccagcacatgtcctgtgtgcggtttctccaccgcacgatcctgcctggaagcattgccaattctatctgccaaaacattgagatcatcattcttgtcacactgtccctcgttatcttcatttttctgagcatcgtgtctaagacctatgtgtgttaccttctgatgcccattttcatccctatcgcttttatttatggctggatctacaataagtcctgcaaaaagtgcaaactctgtggcctggtctatcatcccttcacagaatgcgggacccactgtgtgtgcggagccagatacgagaccagcgatcggatgaagctgcatcgcgcttccggcctctgtcctgggtacaaatctctgagagccgcgcgggttatgtgcaagagcaaaggaccggcctccattcttagcatcatgacagctattctgatcctcacgtttgtgacccccatctctgccatggtcattggcgagtccagcgaagtgtatacactggacgatcttcctgacgacatggttcagatggctgagcgcgtgaacatctactatcagattatcattatcaattacggggtcacctgggccttcctgctcctgggactgattctcgcctatttctttaagaagtaccagcacaaattcctggatttttatgctatgtactgtgaagagtgcgacatgtaccacgaaaagtctggccttacacattggggcgatttcaccaacaaatgtagacaatgcacgtgtgggcagtttgaggacgtggcgggactgatgatccaccggaagtcttataattgcctcgtcaaatacaaggcccgctggatcagagatattctgatcatgtatcttgctatgattctgatcaaggactccctcctgttcgtgggcgcctctgggacagattttgccgcttgcattgacgagaaagttgtgacctggaactgtaccggacccttcctgaacctcggccggtgcgataagagccagaaaaagacaaattacgaagggatcgccaaccaactgaaaggacttggcgtcatctccgtgctggacattcctatgatcaagaatatgcccgatgagattagcggctctctcaagtatatcgactccctggaaacctaccatgagcagctgacagcggaatatgcttttcttacgcgctactgtgactactatacccagtacacagataacagcgggtattctaaaaccgtttggagaacatacctccggtcccacgacttcggagcctgcgtggtctatccgaatcagcatttttgtagatgcgtgaagtacggcgataaatgtaacagcgccaagtgggacttcgctaatgagatgaaaaccttttatacggggcaaaaggtgaagttcaacaaagatctgaatctggccctcctggttcttcacaaggctttccgcggaaccggcacagcctacgtcgcggaggccatggctcggaaagacaacgggtccatggcccactttgctctggaaattagaaagaaattccctaccaatgccctcctggcggccctgatcgattacatcgtgtatcttcagtctctcgctgagattgccacatttgaactggacgaggattgggaagacttcaagtacaaacccgagcctaccgagagcacgccccaggctcgctcccatcggaacgatcagtataattttaagaacgccgaatctaatagcaacacaaaggtgtgcaaaaacgtccaaaaggtgctgtgtatctcccccagaagcaaagccaagttcgagaatattatcgcttgcggcgaacacgcgaacccttctgtttacatgatgccgaatgtgtccatttatcagagcaactctgagcgctcccattactgtatcgccgacagccactgcctcgagaaatatgaagtcgtggagaccgaactgcttaatgctctgaagaagtctaaatgctgggccaaggagatggatgacatcgttctccacaaacagagcgacggactgcggtcctgtagaattaaggatacaggcaactgcaatgtgcaggaaaacgactggaccatcgtcctgtgtgagaatgggaactactactatagcgaggtgcataaagattacgacaaggatcaagacgttggacacttttgcctttctccccgctgtaccacaattcggtatcctatctccagacgccatattcggaagtgcgaatggcagatcagccactccacgattgataaaatctctgtgcaggagctcgccgacatcgaacagtacaagaaagctattagccaaaagctgcagacctccctgtctatcttcaaatatgtcagaacaaagaatctcccccatattaagcctgcctacaaatatatcaccgtggagggcgtggaaacaattgaggggatcgagaacgcgtttatcgaaagcgagattcccgctctggccggaaccgccatcggcttcaagattaattcccgggaagggaactaccttatggatgtcatcggctacgttaaatctgctagctattccgccgtgtacacgaagctgtatacaaccggaccgaccattggcatcaatacaaaacacgacgagaagtgtaccgggccttgccccgcggtgatcgatcacaaagacggatggctcacatttagcaaggaacgcacgtctacctggggctgtgaggagttcgggtgcctggctgtctccgatggatgtgtgtttggcagctgccaggacattatcaaggacgaactggccgtttacagaaaaacaaccgaggaacttacaaccgtggagctctgcctgacgttctctgataagacctattgtacaaacctgaacgccattacccctatcattacagacaaattcgaggtccaatttaagaccgtggaatcctacacactcccccgggttatcgctattaaaaatcatgagatcaaggtggggcagatcaacgatctgggcgtctatagcaagggatgcggcaatgtgcagaaagttaacgggaccaattacggaaacggctctcctagattcgactacctttgtcacctggcctcccgcaaggaagtgattctccggaaatgctttgataatgactatcaggcttgtaagttcctgcaaagcccctccagctacagactggaggaacatcaggggacggtcacagtgatcgattataaaaagattcttggaaccatcaagatgaaagccattctgggcgacgtgaagtacaaaaactatcagaataacatcgagatcaatgcggaggggacctgcgccggctgtattgattgctttgaaaacatccactgtgagttcacaattcataccacggtcgaagctagctgcccgatcacaaccgagtgtgttagctttcacgaccgcattctcatcacacctgatgaacacaagtacgccctgaaaatcgtgtgccatgacaagcccaaggtgtccctcaaattcaagatttgcaataccaacgtcgacgctgccatgacaatcgtggattctaaacccattctggagcttgcccctgttgaccagaccacgtatatcagagagaaggatgaacggtgtaaaacctggatgtgccgcgtgagagacgagggatttcaagtcattctggaaccgttcaagaatctctttggcagctacatcgggattttctacacaggaatcctgtccatcatttgtctgcttatcgtggtttatattatcctgcccatttgcttcaagctccgggataccctgcgccagcacgaggacgcttacagaaaagaaatgaagatccggtga

SEQ ID NO: 14244 - RNA, 4323 nt, synthetic construct
  misc_feature 1..4323: note = derived and/or modified CDS sequence (opt5) from LUMV__AF123484.1__GP
  source 1..4323: mol_type = other RNA
atgatcctggtgcttttctttgtcgccctgagcgctgccggccccgtttaccagagatgcttccaagacggggcgattgtgaagcagtccccttctaaacaggctgtgaccgaggtctgtcttaaggatgacgtgagcatgatcaaaacagaagcccggtattttaagaacacgaccggaatttacgccaataacgttgctatccgcaaatggctggtggccgattggcacgactgcagaccgaagaaggtctccggcgggcatattaatgtgatcgaggttggagatgacctcacactgcacaccgaagcgtatgtgtgtaacgccgattgcatcattggcgtcgacaaagagacagctcaggtgcggcttcaaaccgatacaaccaatcatttcgaaatcgccgggacgaccgtgaagtctggatggtttaaaagcacaacctacattacactgggccagacctgtgagcacctcaaggtctcctgcggccccaaatctatccagttccatgcttgttttaaccagcacatgagctgcgttcgcttcctgcacagaacgattctgcctgggtccatcgccaatagcgtgtgtcaaaacattgagatcatcattctcacagtgctgacccttctgatctttacactcctgtctattctttccaagacctatatctgctacattctgatgcccatcttcatccctctcgcttatatttacggactgatctacaataagagctgtaaaaagtgcaaactgtgcggcctcgtctatcatccctttaccgaatgtgggacacactgcgtgtgtggagcccggtacgacacgtctgatcgcatgaagctgcatagagcgtccggcctttgccctgggtataaaagcctgcgggccgctcgcgttatgtgtaagtctaaaggaccggcctccgtgctcagcattatcaccgctgtcctgattcttacattcatcacccccatcaacgccatgattgccggcgagacacaggaaacctttaagctggaggacctccctgatgacatgctgtccatggctatgaagatcaatatgtactatattatgtgcatgctgaactacgtggcgacgtggtctttcatcttctgtgccctcattatcgctctgatttttaaaaagtatcagcacaaattccttagctactacgccatgtattgccaggagtgtgacatgtaccacgatagatccggcctgaagtataatgggggatttacaaacaaatgccggcaatgtacctgcggccagtacgaagacgccaccgggctcatggctcatcgcaagacatataattgcctgatccagtacaagagcaaatggcttgttaacttcctgatcacctatattatcctcatgctgattaaggattctgtgctgatcgtccacgccgagggaacagactttgaaaaatgttccagcgatattaacatcgtgtggaattgcacgggccccttcctctctctggggaactgtgagaagaaacaaaagaaggaaagctacaatgacatcgcggctcagcttaaaggactggatgccatttccgtcctcgacatccctatgatttctaagatccccgaggatattgccggcgctctgagatttatcgaggaacagaacagctaccatgtgcagctgaccgttgagtatgccatgcttacacggtactgcgactattacacccaattctccgataatagcggctattctcagacaacctggcgcacgtacctcagatcccacgactttgaggcttgtatcctgtatccgaaccagcatttctgccggtgtgtgaaacacggggacaagtgcagcagatctaattgggattttgccaacgaaatgaaaaattactactccggaaagcagagcaagtataacaaagacctgaatctcgcgctgatgtccttccaccatgcctttcgcggcacctctagcttctacacagctaagctcctgcgggaaaagaagaccgaggagctcaaaaactatattgataagatcagaacagaataccctgggaatgccctgctgaaagctgtcattgactatatcaagtacatgatgggacttaccgaggtgtccaacttcaagcacgatgaaatgtgggacgattttattttcgagaatccctctacgcgcagctccctcagccggaactctgaatccagctatgactttaaaacaaacatcaattctgatcctaccaacacatgtaagaatatcaaagccgttacctgcctgtcccccaagagcggcgtgtctttcgacagcgtcattgcgtgtggggagtccaaccaacccagcatctaccagaaacctagaaaacaggtgtaccagtctaattccgagcaaacccatttttgcctgctcgatacacactgcctggaaggctatgagacggtgggagaagaggttcttagcgccattaagaaatccaagtgttgggagaccgacttcacagaatacatccagtttaaacagtctgatggcgtccgcagctgccggatgaaggactccggggagtgtaccgtgacaaccaacaaatggccgattatcctgtgcgaaaataacagatattactattctgagctccacaaggactacgataaggaccaggatattggacatttctgtctgagcccccgctgcaatacgatccggtatcctatcaaccaaaatcacatttccaactgtacatggcaagtgagacataataacatcgacaaaattgaagtccacgagctggaggatcttgaacagtaccgcaaggctatcacccagaaactccagacctctctgacactgtttaagtacagccggaccaaaaatctcccccatattaagcctatctataagtacatcacaattgagggcacggaaaccgccgaggggatcgaatccgcttatattgagagcgagatccccgccctggccggaacatctattggcttcaaaatcacctccaagagcgggaaacaccttctggacgtgatctcttacgttaagtccgctagctattctgcggtgtacacaaaactctataccacgggcccgaccattggagtcaacacaaagcacgatgaactgtgcaccggctcctgtcctgtgaacgttccccataatacagggtggctgacctttgccagagagcggacaagctcctggggatgcgaagagttcggctgtcttgctatcagcgacgggtgcgtgtttggatcttgccaggatattatcaaagacgaactcaccgtctaccgcgaggagacggaagagacaaccaacgtggaactgtgtctgaccttcgccgataagacatactgcaccaatctcaacgccattacgcctatcattacagaccagttcgaggttcaatttaagaccgtggaggcttatagcctgcccagaatcatcgccgtccggaatcacgaaattatggtgggccagatcaacgatattggggtgtactccaaaggctgtggaaatgtccagaagatcaacaatacaaactatggcaatggggttcctaaattcgactacctttgccatctggcgtctagaaaggaggtgattatccgcaaatgttttgacaacgattatcaggcttgcaagttcctccaaacccccgccagctaccggctggaagaggaaggaggctccgtgacagtcatcgactataagaaaattctggggaccatcaagatgaaagccattcttggagatgtgaagtacaaaacgtttgctgacaatgttgatatcaccgtggagggcgcctgtacagggtgcattaactgtttcgacaatatccactgcgagctgaccatccattctacagtcgaagcgagctgtccgattacctcctcttgcacggtgtttcacgatagaatcctcattacacctaacgagcacaagtacgctatcaaggttatttgcaacggcaaacccggaatcagcctgcccttcaagatttgtaataccaaagtggacgccgccatgacactcaccgatgctaagcagatcctggaacttgcccctgtcgaccagaccacatatatcaaagagaaggatgaacgctgcaagacgtggatgtgtagagtgcgggacgagggcctgcaggttatttttgagccgttcaaaaacctctttgggtcctacatcggaattttctataccttcgtgatctttctggtcgtgattttcatcgtgatctacattgtcctgcccatctgctttaaacttcgcgacacactgagacaacatgaagatgcttataagcgggagatgaagattcgctga

SEQ ID NO: 14245 - RNA, 4323 nt, synthetic construct
  misc_feature 1..4323: note = derived and/or modified CDS sequence (opt5) from LUMV(SAAr 1881)__KX817325.1__GP
  source 1..4323: mol_type = other RNA
atgatcctggtgcttttctttgtcgccctgagcgctgccggccccgtttaccagagatgcttccaagacggggcgattgtgaagcagtccccttctaaacaggctgtgaccgaggtctgtcttaaggatgacgtgagcatgatcaaaacagaagcccggtattttaagaacacgaccggaatttacgccaataacgttgctatccgcaaatggctggtggccgattggcacgactgcagaccgaagaaggtctccggcgggcatattaatgtgatcgaggttggagatgacctcacactgcacaccgaagcgtatgtgtgtaacgccgattgcatcattggcgtcgacaaagagacagctcaggtgcggcttcaaaccgatacaaccaatcatttcgaaatcgccgggacgaccgtgaagtctggatggtttaaaagcacaacctacattacactggaccagacctgtgagcacctcaaggtctcctgcggccccaaatctatccagttccatgcttgttttaaccagcacatgagctgcgttcgcttcctgcacagaacgattctgcctggctccatcgccaatagcgtgtgtcaaaacattgagatcatcattctcacagtgctgacccttctgatctttacactcctgtctattctttccaagacctatatctgctacattctgatgcccatcttcatccctctcgcttatatttacgggctgatctacaataagagctgtaaaaagtgcaaactgtgcggactcgtctatcatccctttaccgaatgtggcacacactgcgtgtgtggggcccggtacgatacgtctgaccgcatgaagctgcatagagcgtccggactttgccctggctataaaagcctgcgggccgctcgcgttatgtgtaagtctaaagggccggcctccgtgctcagcattatcaccgctgtcctgattcttacattcatcacccccatcaacgccatgattgccggagagacacaggaaacctttaagctggaggatctccctgacgacatgctgtccatggctatgaagatcaatatgtactatattatgtgcatgctgaactacgtggcgacgtggtctttcatcttctgtgccctcattatcgctctgatttttaaaaagtatcagcacaaattccttagctactacgccatgtattgccaggagtgtgatatgtaccacgacagatccggcctgaagtataatggcgggtttacaaacaaatgccggcaatgtacctgcggacagtacgaagatgccaccggcctcatggctcatcgcaagacatataattgcctgatccagtacaagagcaaatggcttgttaacttcctgatcacctatattatcctcatgctgattaaggactctgtgctgatcgtccacgccgaggggacagattttgaaaaatgttccagcgacattaacatcgtgtggaattgcacgggacccttcctctctctgggcaactgtgagaagaaacaaaagaaggaaagctacaatgatatcgcggctcagcttaaagggctggacgccatttccgtcctcgatatccctatgatttctaagatccccgaggacattgccggagctctgagatttatcgaggaacagaacagctaccatgtgcagctgaccgttgagtatgccatgcttacacggtactgcgattattacacccaattctccgacaatagcggctattctcagacaacctggcgcacgtacctcagatcccacgactttgaggcttgtatcctgtatccgaaccagcatttctgccggtgtgtgaaacacggcgataagtgcagcagatctaattgggactttgccaacgaaatgaaaaattactactccgggaagcagagcaagtataacaaagatctgaatctcgcgctgatgtccttccaccatgcctttcgcggaacctctagcttctacacagctaagctcctgcgggaaaagaagaccgaggagctcaaaaactatattgacaagatcagaacaaaataccctggcaatgccctgctgaaggctgtcattgattatatcaagtacatgatggggcttaccgaagtgtccaacttcaaacacgacgagatgtgggatgactttattttcgaaaatccctctacgcgcagctccctcagccggaactctgagtccagctatgattttaagacaaacatcaattctgaccctaccaacacatgtaaaaatatcaaggccgttacctgcctgtcccccaaaagcggagtgtctttcgatagcgtcattgcgtgtggcgaatccaaccaacccagcatctaccagaagcctagaaaacaggtgtaccagtctaattccgagcaaacccatttttgcctgctcgacacacactgcctggaggggtatgaaacggtgggcgaggaagttcttagcgccattaaaaagtccaaatgttgggagaccgatttcacagagtacatccagtttaagcagtctgacggagtccgcagctgccggatgaaagactccggcgaatgtaccgtgacaaccaacaagtggccgattatcctgtgcgagaataacagatattactattctgaactccacaaggattacgacaaagatcaggacattgggcatttctgtctgagcccccgctgcaatacgatccggtatcctatcaaccaaaatcacatttccaactgtacatggcaagtgagacataataacatcgataagattgaggtccacgaactggaggaccttgagcagtaccgcaaagctatcacccagaagctccagacctctctgacactgtttaaatacagccggaccaagaatctcccccatattaagcctatctataaatacatcacaattgaaggaacggagaccgccgaaggcatcgagtccgcttatattgaaagcgagatccccgccctggccgggacatctattggattcaagatcacctccaaaagcggcaagcaccttctggatgtgatctcttacgttaaatccgctagctattctgcggtgtacacaaagctctataccacggggccgaccattggcgtcaacacaaaacacgacgagctgtgcaccggatcctgtcctgtgaacgttccccataatacaggctggctgacctttgccagagaacggacaagctcctgggggtgcgaggagttcggatgtcttgctatcagcgatggctgcgtgtttgggtcttgccaggacattatcaaggatgaactcaccgtctaccgcaaggaaacggaggagacaaccaacgtggaactgtgtctgaccttcgccgacaaaacatactgcaccaatctcaacgccattacgcctatcattacagatcagttcgaggttcaatttaagaccgtggaggcttatagcctgcccagaatcatcgccgtccggaatcacgaaattatggtgggacagatcaacgacattggcgtgtactccaaagggtgtggcaatgtccagaagatcaacaatacaaactatggaaatggcgttcctaaattcgactacctttgccatctggcgtctagaaaggaggtgattatccgcaagtgttttgataacgactatcaggcttgcaaattcctccaaacccccgccagctaccggctggaagaggaagggggatccgtgacagtcatcgattataagaaaattctgggcaccatcaagatgaaagccattcttggggacgtgaagtacaagacgtttgctgataatgttgacatcaccgtggagggagcctgtacaggctgcattaactgtttcgataatatccactgcgaactgaccatccattctacagtcgaggcgagctgtccgattacctcctcttgcacggtgtttcacgacagaatcctcattacacctaacgagcacaaatacgctatcaaggttatttgcaacgggaaacccggcatcagcctgcccttcaagatttgtaataccaaagtggatgccgccatgacactcaccgacgctaagcagatcctggaacttgcccctgtcgatcagaccacatatatcaaggagaaagacgaacgctgcaagacgtggatgtgtagagtgcgggacgagggactgcaggttatttttgaaccgttcaaaaacctctttggctcctacatcgggattttctataccttcgtgatctttctggtcgtgattttcatcgtgatctacattgtcctgcccatctgctttaaacttcgcgatacactgagacaacatgaggacgcttataagcgggagatgaagattcgctga

SEQ ID NO: 14246 - RNA, 4329 nt, synthetic construct
  misc_feature 1..4329: note = derived and/or modified CDS sequence (opt5) from MELV__U88057.1__GP
  source 1..4329: mol_type = other RNA
atgatcgccctgattttcctcatcgctattgccgcggctagccccgtgtaccagagatgctttcaagacggcgggatcgtcaagcagaacccttccaaagatgccgttaccgaggtgtgtctgaaggacgatgtgtctatgattaaaacagaagccaagtatatgaaaaatgacacgggaaccttcagcaacaatgtcgctatgcggaagtggcttgtggccgattggcacgactgccgcccgcagaagtcctctggcgggcatatcaacgttatcgaggtgggagatgacctgagcctccacacagaggcttacatttgttccgccgattgcatgatctctgtcgacaaagagaccgcgcagattagactgcaaacagatagcaccacacattttgaaatcgccggcaccacggtgaagtccgggtggttcaaaagcaccacatatattacccttgaccagacatgtgagcacctgaaggtttcttgcggacccaaatccatccagtttcatgcttgtttcaatcagcacatgagctgcgtgcggtttctccaccgcaccattctgcctggctctatcgccaactccatctgtcaaaatattgagatcattatcctggtcacgctcacactgcttattttcatctttctgagcatcctctctaagacctacatttgctatatcctgatgcccatgttcattcctgtggcttacatctatggctggatttacaacaagtcctgtaaaaagtgcaaactttgcgggctggtgtaccatccctttacagaatgtggaacccactgcgtctgtggcgccagatatgagaccagcgatcggatgaagctccatcgctcctctgggctgtgccctggatacaaaagcctgagagcggcccgggttatgtgtaagtccaaaggcccggctagcatcctctctgtgctgacagccgtgcttatcctgacgttcgtcacccccatgaatgctctcacactggggtccagcgaagagaactataaacttgagaatctgcctgacgacatgctcgatatggccgaacgcattgacatctactatctgtctattatcctgaactacagcattacctggggactcgtgatcctgcttggcctgacatttattctcttcagacggttccagcaccgctttctgaattgctatgccatgtactgttccgagtgcgatatgtaccacgacaagaacggccttgttagaaatggggatttcaccaacaagtgtcggcagtgcacgtgtggacagtatgaagacgctgcgggcctgatcatccatcaaaagtcttacaactgcctcattaaatataaggccaaatggatccgcaatattctgctgacatacatcattctcatcctgatcaaggatagcgtgcttctgacctccgctgaggggcccgactttagcgtctgcattgaacagaaggccatctcttggaactgtaccggacctttcctcaatctgggcagatgcgagaaaacacagaagaaagcctcctatgctaccattgccacacaactgcggagcatcgatgcgatttctgtgcttgacatccccatgatcgctaagattccggaggatatctccggggccctcaaatacattgaaagcctgaagacgtatcacgagcagctgaccgccgaatacgctatgctcacaagatactgtgactattacacccagttttccgacaactctggatatagccagacatcctggcgcaagttcctgcggtctcatgattttgagagctgcatcatttaccctaatcaacacttctgtagatgcgttaaacaggacgaaaagtgttccagcgccaaatgggattttgcttctgagatgaagggcttctatcttaacaaacaggccaagtttaataaggacctgaacctcgcgctgtccaccttccataaagcctttcgcggcacgcccatcagctacgtgaccgagctgatctctaagaataaaaactccagccttctcatgtatgtctctgaaattaagcggaaattccctgggaatgctctgctggtggccctcctggatttcatcatgtaccttcagagcctgtccgagattagcggatttgaactcggcgacgagtgggaagatttcaagtacgaccccgagcccacagagcctgctctgatgccgagatctcaccgctccgatcaatataactttaaaaatgccgcgagcgtctccaagaccaagacatgcgaaaacatcaaacgggtgctgtgtctttctcccagaagccgcgccaccttcgacgatgttgtggcttgcggggagtttgccaatccttccgtctacatgctccccaacattacgatctatcagtctaacattgaacggagccactactgtatcgctgactcccattgcctggaggagttcgaactggtgaagcctgagctcctgacagcccttaaaaagtctacctgctgggccggagaaatcgatgacattgttctgcacaaacagagcgacggcctcagatcctgtcgcatcaaggatacagggacctgcgacgtgctgggcaatgagtggaccattgtcctgtgtgaaaacaataacttttattacagcgaggtgcatcgggattatgacaaggatcaggacatcggacacttctgcctttctcccagatgtaatattatccggtacccgatcaaccctcgccacattagaacatgcaaatggcaaatctcccatagcacgattgataagatcaccgtgcacgagctcgctgacattgaacagtacaaaaaggcgatcacacagaaactgcaaaattctctgtccatctttaagtataagcggaccaaaaacctcccccatattaagcctatctacaaatatattgccatcgagggcacagaaaccgttgaggggattgaaaatgcttacatcgagagcgagattcccgccctggccggaacggctatcggcttcaagatcaactctaaagatgggaatcaccttatggacgtcattggatatgtgaagtccgccagctactccagcacatataccaagctgtacaccacaggccctaccatcgggattaacacaaaacatgatgaaaagtgtacgggctcttgccccacccaggtgaaacacaagacaggatggctcacctttgcgaaagagagaacaagcacctggggctgtgaagagttcgggtgcctggctatctccgacggatgtgtctttggctcttgccaggatattatcaaggacgaactgacggtgtaccgcaaaaccacagacgaggttaccgagcttgaactgtgcctcacattcgccgataagacctattgtacaaatctgaacgccgtgaccccgatcattacggacaagttcgaggtccagtttaaaacagtggaaagctactccctccctcggatcattgctgttaagaatcacgagatcaaagtggggcaaattaacgatatcggagtctattctaagggctgcgggaacgtgcagaaagttaatggcaccagctacggaaacggcgtgcccaagttcgactatctgtgtcatcttgcctccagaaaggaggtcaccatccgcaaatgctttgataatgactaccaggcgtgtaagttcctgcagacaccctctagctatagactcgaagaacaccaagggaccgtgacgattatcgattacaaaaagattctgggatccatcaaaatgaaggctattctgggcgacgtgaagtacaaaaactatgccagcaatatcgatattaacgccgaagggtcttgcgctggatgtatcaattgctttgagaacatccattgtgagttcacaattcactccaccgtcgaaacaagctgccagatcgagtctgactgtacctcctttcatgatcgggttcttattacacctaatgaacacaagtacgccctgaaactcatctgccacgacaagccggctagctccctgaaattcaagatttgcaacaccaaggtggaggccgcgatgacgctcgtggacgcccgccccatcatcgaactggctcctgtcgatcagaccgcctatattagagagaaagacgaacggtgtaagacatggatgtgccgcgtgagagatgagggcatccaggttatttttgagcccttcaaaaatctttttgggtcttacatcggcattttctatgctatcgtgatctgtattatcgtcctgttcctcattgtgtacatcgttctgcctatttgctttaagctgaaagacacccttaagcaacatgaagatgcctataagcgggagatgaaaatccgctga

SEQ ID NO: 14247 - RNA, 4326 nt, synthetic construct
  misc_feature 1..4326: note = derived and/or modified CDS sequence (opt5) from SAV__AF123486.1__GP
  source 1..4326: mol_type = other RNA
atgatccccctcctgttcctggtgacccttgtcagcgccggccctgtttttcagagatgcttccaagacggggctattgtgaagcagaacccgtccaaagaggccgtgacagaagtctgtatcaaggatgacgtgtctatgattaaaacggaggcgcggtacgttcgcaatagctccggagtgttttctaacaatgtcgctctgagaaagtggctcgtgagcgattggcacgactgcaaacccaagaaggtttccggcgggcatatcaacgtgattgaagtcggaaatgatctgacccttcacacagagtcttatgtgtgtagcgccgactgcaccatcggcatcgataaagaaacagcccagattcggctgcagaccgacacaaccaaccatttcgaggtggctgggacgaccgtcaagtccggatggtttaaaagcacaacctacatcacactcgatcaaacctgtgagcacctgaaggtttcttgcggccctaaatccattcagttccatgcctgttttaatcagcacatgagctgcgtgcgcttcctgcacagaacgatcctccccggctctatggctaactccatttgtcagaatatcgaaattatcatcctgacaacccttgccctgctcatttttctgcttctgacaatcctcagcaagacctatatttgctacctgctgatgcctatcttcattcccatcgcgcatctctatgggctgatctacaacaagtcttgtaaaaagtgccaactttgcggactggtgtatcacccttttaccgagtgtggcacacattgcgtctgtggggcccggtacgaaacgtccgaccgcatgaaactccacagagctagcggactgtgcccgggctacaagtcccttcgggccgctcgcgtgatgtgtaaatctaaggggcccgccagcaatctgtccattatcaccgcggttctcacactgaccttcgtgacacctattaacggactgaccatcggcgatagcaaagaggtcctcaatcccgacgagctgcctgatgacatgcttgaaatggcccagaagctgaacatgtatcagctcatttgcatcatcaattacacggctacatggtctattatcattatcggcctggccgtgttttatattttcaagaaataccagcacagattctataactactatgctatgtactgtcaagagtgcgacatgtaccatgaacggtccgggcttaagtggaacggagattttaccaataaatgtcgccagtgcacctgtggcgagtatgaagacgccgccgggctgatcagccacagaaagtcttacaactgcctcctgcagtataaagttaagtgggtgatgaatttcctgacaatttacgtcgctctcatcatcctgaaggatagcacccttattgtgcaagcggccggaacagacttttccgattgcatcgagacggaggaactgaactggaattgtaccggccccttcctcaacctggggaattgcgagaaaaagcagaaaaaggaatcttatagcaacattgctgagcagctgaaaggacttcaggccatctccgtcctcgacattccgctgatcgcccggatccctgaagatattagcggcggcctgcgctacatcgagtctattagaacacatcacgctcaactcaccgccgagtatgcgatgctgacacggtactgtgactaccataaactttttggggataattccggatatagccagaccacgtggagaatgtacctgcgctctcacgacttcggcgcttgcatcctctatcccaaccagcacttttgtcggtgcgtgaagcatggggaaaaatgttccagctcctcttgggatttcgccagcgagatgaagaattactattccggaaaacagggcaagtttaacaaagacctgaatctggcccttcaatctattcaccatgctttcagagggaccagctccagctacatcgccacaatcctctctgaaaagcgcaacgaccagctggttgagtatatggaaaagctgcgggagaaatttattggcaatgctctcctgagagccgtgcttgatttcatcacctacatgaagtccctgacagagatgaccaactttaaacacgacgagttctgggatgagttcgtccacctccctgcgcccacgaaggcccccagcatgcgccggtctggaaacgaaaattacgactttaaagctcctacatccccggccggcaccaagagctgcaaaaacattaagaatgtggtttgtctgtctcccagaagcggggcttcctatgagggaatcgtggcctgcggcgagcctagcgcgccccagattttcaagatgccttctgaatccatctaccataacaatgccgatcagagcatgtattgtatcgctgacacacactgcctgcaagattactcccccgtcgaggacgaagaacttaacgccattaaaaagtctaaatgctgggaaaccgagtttaccaatgctgtgccgttcaagcagagcgatgggatccgctcctgtcggatgagagactctggaaactgcaatgtgacaacgaacctctggcctgttatgcagtgtgatgacggcaaattttattacagcgagcatcagaaggattatgacaaggaccaagatattgggcacttctgcctgtctccccgctgtaatatggtccggtttcctatctccgaaaagaacattctggcctgcgactggatcgtgagccatcccaatattgataagatcgacgtgcactccctcgaggatctggaacagtacaaaaaggccatcacccagaaacttcaaacaagcctgtctattttcaagtacgctaagaccatgaacctccctcacgtcaaacccatctataagtacatttccatcgagggcacagaaaccgcggagggagtggagaatgcctttattgaaagcgagatcccggctctggccggcacgtctatcgggttcaaagttaactccaaggacggaaaacatattatggatatcattggctatgtgaagacagccagctactcttccgtctataccaagctgtacaccacaagccctaccacaggggtgaacacgaaacacgacgaactttgtaccggaccctgccccaagcagatcgagcataaaaatggctggattacattttccaaggaaagaaccagctcttgggggtgtgaggagttcggctgcctcgctatcagcgatggatgtgtttttggctcctgccaggacatcattaaagatgaaatgtctgtgtatcggaaggagacagaagagaccacgatcgtcgagctgtgcctgaccttcagcgacaaaacatactgtgtggaactcaaccctgttaccccgattatcacagatctgttcgaggtgcagtttaagaccgtcgaatcctacacacttccccgcattgtggccgtgaagaatcacgaggtcatggttgggcaaatcaacgacctgggagtgtattctaaaggctgcgggaatgtgcagaaggtcaacggaaccgtgtacggcaatggggttcctaaattcgactatctctgtcatctggcgagcagaaaggaagtgattatccggaaatgctttgataacgactaccaggcttgtaagttcctgcagtccccctctagctatagacttgaggaggatgcctccacggtcagcatcattgactacaagaaaatcctgggcacaattaagatgaaagccatcctcggagatgtgcgctataagaccttttctgaatccattgacatcagcgctgaggggacctgcacaggctgtgttaattgcttcgaaaacatccactgtgagtttaccattcactctacggtggaagcctcctgccctgtcgtgagcacatgtaccctgttccatgatcggatcctcattggacccgacaatcacaaatacgcgatgaaggttatctgcacagaggctcctaagacctccctgtcttttaaaatttgcaacacaaaggtggatgccgccatcaccatcgtcgacagcaaacccattgtggagcttgctccggtggatcaaacggcctacatcagagaaaaggacgaccgctgtaaaacctggatgtgcagagtccgggatgagggcatgcaggttctgtccgaacctttcaagaatctctttgggagctatattggaatcttctacacaggcctggctgtgctgattatcgcccttattgcggtgtatatcgtcatgcccatctgtttcaaggtgaaagacattctgaagaaacatgatgacgcctaccgcagagagctcaagatccggtga

SEQ ID NO: 14248 - RNA, 4326 nt, synthetic construct
  misc_feature 1..4326: note = derived and/or modified CDS sequence (opt5) from SAV(20230)__KX817331.1__GP
  source 1..4326: mol_type = other RNA
atgatcccccttctcttcctggtgacccttgtcagcgccggccctgtttttcagagatgcttccaagacggggctattgtgaagcagaacccgtccaaagaggccgtgacagaagtctgtatcaaggatgacgtgtctatgattaaaacggaggcgcggtacgttcgcaatagctccggagtgttttctaacaatgtcgctctgagaaagtggctcgtgagcgattggcacgactgcaaacccaagaaggtttccggcgggcatatcaacgtgattgaagtcggaaatgatctgacccttcacacagagtcttatgtgtgtagcgccgactgcaccatcggcatcgataaagaaacagcccagattcggctgcagaccgacacaaccaaccatttcgaggtggctgggacgaccgtcaagtccggatggtttaaaagcacaacctacatcacactcgatcaaacctgtgagcacctgaaggtttcttgcggccctaaatccattcagttccatgcctgttttaatcagcacatgagctgcgtgcgcttcctgcacagaacgatcctccccggctctatggctaactccatttgtcagaatatcgaaattatcatcctgacaacccttgccctgctcatttttctgcttctgacaatcctcagcaagacctatatttgctacctgctgatgcctatcttcattcccatcgcgtatctctacgggctgatctataacaagtcttgtaaaaagtgccaactttgcggactggtgtaccatccttttaccgagtgtggcacacactgcgtctgtggggcccggtacgaaacgtccgaccgcatgaaactccatagagctagcggactgtgcccgggctataagtcccttcgggccgctcgcgtgatgtgtaaatctaaggggcccgccagcattctgtccatcattaccgcggttctcatcctgacattcgtgacccctattaatggactgacaatcggcgatagcaaagaggtctttaacctcgacgagctgcccgatgacatgcttgaaatggcccagaagctgaatatgtaccagctcatctgcattatcaactataccgctacgtggtctattatcattatcggcctggccgtgttctacattttcaagaaatatcagcacagattttacaattattacgctatgtactgtcaagagtgcgacatgtatcacgaacggtccgggcttaagtggaacggagatttcacaaacaaatgtcgccagtgcacctgtggcgagtacgaagacgccgccgggctgatcagccataagaaatcttataattgcctcctgcagtacaaggttaagtgggtgatgaactttctgaccatctatgtcgctctcattatcctgaaagatagcacacttattgtgcaagcggccggaaccgacttctccgattgcatcgagacagaggaactgaattggaactgtacgggcccttttctcaatctggggaactgcgagaagaaacagaagaaagaatcttacagcaatattgctgagcagctgaagggacttcaggccatctccgtcctcgacatccccctgattgccagaatcccggaagatattagcggcggcctgcggtatatcgagtctattcgcacccaccatgctcaactcacagccgagtacgcgatgctgaccagatactgtgactattacaagctgttcggggataactccggatatagccagacaacctggcggatgtacctgagatctcacgactttgaggcttgcatcctctatcctaatcgccatttctgtcggtgcgtgaaacacggcgaaaagtgttccagctcctcttgggattttgccagcgaaatgaaaaactactattccgggaagcagggaaaattcaataaggacctgaacctggcccttcagtctatccaccatgcttttagaggcacgagctccagctacattgccaccatcctctctgagaagcgcaatgaccaactggttgaatacatgaaaaagctgcgggagaaattcattgggaacgctctcctgagagccgtgcttgattttatcacatatatgaagtccctgaccgagatgacaaatttcaaacacgacgagttctgggatgaatttgtccatctccccgcgcctaccaaggcccccagcatgcgccggtctggcaacgaaaactacgacttcaaagctcccacgtcccctgccggaacaaagagctgcaagaatattaaaaacgtggtttgtctgtctccgagaagcggcgcttcctatgaggggatcgtggcctgcggagagcccagcgcgcctcagatctttaagatgccctctgaatccatttaccacaataacgccgatcagagcatgtattgtatcgctgacacccactgcctgcaggattactcccctgtcgaggacgaggaacttaatgccattaaaaagtctaaatgctgggaaacagagttcaccaacgctgtgccctttaagcaaagcgatggcatccgctcctgtcggatgagagactctgggaattgcaacgtgaccacaaatctctggccggttatgcagtgtgatgacggaaagttctattacagcgagcatcagaaagattacgacaaggaccaggatattggccacttttgcctgtcccctcgctgtaacatggtccggttccccatctctgaaaagaatattctggcctgcgactggatcgtgagccatcctaacatcgataagattgacgtgcactccctcgaggatctggaacaatataaaaaggccatcacgcagaaacttcagaccagcctgtctatttttaaatacgctaagacaatgaatctcccccatatcaaacctatttataagtacatctccatcgaggggaccgaaacagcggagggcgtcgagaacgccttcattgaaagcgagatccccgctctggccggaacctctattggctttaaagttaattccaaggacgggaagcacatcatggatattatcggatatgtgaaaacggccagctactcttccgtgtatacaaagctgtacaccaccggcccgacaaccggggtcaacacaaaacacgacgaactttgtacgggaccttgccccaagcaaatcgagcataaaaacggctggattaccttcagcaaggaaagaacatccagctgggggtgtgaggagtttggctgcctcgctatctctgatggatgtgtgttcggcagctgccaggacattatcaaagatgaaatgtccgtttaccggaaggagaccgaagagacaaccattgtggagctgtgcctgacgttctctgacaagacctattgtgtcgaactcaatcccgtgacacctatcattaccgatctgtttgaggttcagttcaaaacagtggaaagctacacccttccgcgcatcgtcgccgtgaagaaccacgaggtgatggtcgggcagatcaatgacctgggagtttattccaaaggctgcgggaacgtgcaaaaggtgaatggaacagtctacggcaacggggtgcccaaatttgactatctctgtcatctggcgtctagaaaggaagttattatccggaagtgcttcgataatgactaccaggcttgtaaatttctgcagagcccttcctcttatagacttgaggaggatgccagcaccgtgtccattatcgactacaagaaaattctgggcacgatcaagatgaaagccatcctcggagatgtccgctacaagacattcagcgaatctattgacatctccgctgaggggacctgcaccggctgtgtgaactgctttgaaaatattcactgtgagttcacaatccatagcaccgttgaagcctcttgccccgtggtctccacgtgtacactgtttcacgatcggattctcatcggacctgacaaccacaagtatgcgatgaaagtgatctgcaccgaggctcccaagacaagcctgtccttcaaaatttgcaataccaaggttgatgccgccatcacaattgtggactctaaacctatcgtcgagcttgctcccgtggatcagaccgcctacattagagaaaaggacgaccgctgtaagacgtggatgtgcagagtgcgggatgagggcatgcaagtcctgctcgaaccgtttaaaaacctgttcgggagctatatcggaattttctacaccggcctggctgttcttatcatcgccctgattgcggtgtatatcgtgatgcctatttgttttaaggtcaaagacatcctcaagaaacatgatgacgcctaccgcagagagctgaagattcggtga

SEQ ID NO: 14249 - RNA, 4329 nt, synthetic construct
  misc_feature 1..4329: note = derived and/or modified CDS sequence (opt5) from SDNV__AF123490.1__GP
  source 1..4329: mol_type = other RNA
atgatctgcattctgctcctgatcgcccttgctagcgcctcccccgtgtaccagagatgtttccaagacggcgcgattgtcaagcagtatcctgctaaagatgccgttaccgaggtgtgcctgaaggacgatgtgtctatgatcaaaacacaggccaactacatgaagaatacgaccgggacatttagcaacaatgtcgctatgcggaaatggctcgtggccgactggcacgattgtcgcccgcagaagtcctctggaggccatattaacgttatcgaagtgggggacgatctgagccttcacaccgaggcttatatctgctccgccgactgtgtcatttctatcgataaggaaacagcgcaaattagactgcagaccgacagcacaaatcatttcgaggtgtccggaaccacggttaaaagcggctggtttaagtctaccacatacatcaccctcgatcagacatgcgaacacctgaaagtgtcctgtgggcccaagagcattcagttccatgcctgctttaaccaacacatgtcttgtgtccggttcctgcaccgcaccatcctccctggatccatggctaatagcatttgccagaacatcgagatcattatcctggtgacgcttacactgatgatttttatcctcctgaccattatctctaaaacatatatctgttacattcttatgcccatcttcattcctatcgcctatatttacggctggatctacaataagtcctgcaagaaatgcaagctgtgtggcctcgtgtatcatccctttaccgagtgcgggacccactgtgtctgcggagctagatacgaaacaagcgaccggatgaaactgcatcgctcctctggcctgtgtcctgggtataagagcctcagagccgcgcgggttatgtgcaaatcccgcggaccggccagcatcctgtctattcttacggctgtgctgatcctcaccttcgtgacacccatgtccgccctggtcattggcagctctgaggaactttacaagctggatgagctccctgacgacatgatcgatatggctgagaaagtgaacctgtattacctggttattgtgctcaattatagcgccacctgggggctgcttctgctcatgggaatcctggcccttctgtttaagaagtaccagcacattttcctcaactactatgctatgtactgtacagaatgcgacatgtatcacgataaaaaggagctgacctacaatggcgactcccccacgaacgcgtggcagtgtacatgcggccaatatgaagatgccaccgggctgatcgtccatcagaaatcttacaattgtctcgtgaagtataaagttaagtggatcaagaacattctgatcatgtacattgtgcttaccctgatcaaagacagcgtcctcattgcttccgccgagggacctgattttgccacatgcatcgaagagaagaccatcacatggaactgcacgggccccttcctgaatctggggagatgtgacaaaacccagaagaaaacagattacgctaccattgccagccaacttaagggaatcgacgcgatttctatcctcgatgtgccgatgatttccaagatccctgaggacatcagcggcgctctgaaatatattgaatctctgaagacataccacgagcagctcaccgccgaatatgccatgttcacgcggtactgcgactattacacccagttttccgataacagcgggtattcccagacaacctggcgcacatacctgagatctcatgacttcgaggtctgtatcgcttaccccaatcaacacttttgccggtgtgtgaaaaacggagaaaagtgcagctccgcccagtgggatttcgctaccgagattaaaggctattacacgggccgccagaataagtttaacaaggaccttaatctggccctcatgacattccataccgcgtttagagggacagccacctcttatgttaccgagctgatcagcaaaggaaagaactccagcctgcttatgtacgcttctgccattaaatccaagttcaatggcaacgctctcctgaaagccctgctcgattttatgatgtatctgcagagccttggggaaatctctggattcaagctgacagacgagtgggaagattttaaatacgaggaagaacctacggagcaaaccctcatgccccggggccacagagggggccagtataatttcaagaacgcggcctccaatggaaagacaaaagtgtgtaagaacgtcaaaaaggtgctgtgcctgagcccccgctctcgggctacctttgacgatgttatcgcctgtggcgaacacgctaatcctagcgtgtacatgattccgaacacaaccatctaccagtccaacacggagagaagccattattgcattgccgactctcactgtcttgaagagtacgagctcgtcaaacccgaactgctgacagccctcaagaagtcccgctgctgggctggggatatcgacaccattgtgctgcataaacagagcgatggacttcggtcctgcagaatcaaggacaccggctcttgtaatgtgatggggaacgactggacaattgttctgtgcgaggataataaatattactatagcgaagtccaccaagactacgataaggaccaggatgtgggacacttctgtctctcccctcgctgcaacaccatccggtatcccatctctcctagacatattaatagctgtaaatggcagatctcccactctacaattggcaagatcagcgtgcatgagctggcggacattgaacagtacaagaaagccatctcccaaaagctgcagacgagcctttctatcttcaaatacgctaagaccaaaaacctcccccacattaagccggtctataagtacatcgccattgaggggacagagaccgtggaaggcgttgagaatgcctttatcgaatccgagattcctgctctggccggaacagcgatcggcttcaaaatcaacagcaaggaagggtatcatctgatggatattatcggatacgtgaaatctgcttcctatagctctacctacacgaagctctataccacaggccccaccattgggatcaatacaaaacacgacgagaagtgcaccggatcctgtcctggcacaattcaccataaaaccgggtggctgacgtttagcaaggagcgcacatccacctggggctgcgaagagttcggatgtcttgccgtcagcgatggctgcgtgtacgggtcttgtcaggacatcattaaggatgaactgaccgtttaccggaaaatcagcgacgaggtgacagaagtcgagctctgcctgaccttttccgataagacgtattgcacaaacctgaatgccgtgacccccatcattacagacaaattcgaggttcaatttaagaccgtggaatcttacagccttcctagaatcgtcggagtgcgcaaccacaaaattcagatcggccagattaatgacatcggggtgtattccaagggatgtggcaacgtccagaaggttaatgggacaaactacggcaacggagtgcccaaattcgattatctgtgccatctcgcttctcggaaggaggtgatcattagaaaatgttttgacaatgattaccaagcctgcaagttcctgcagaccccggcgagctatcggctcgaggagcaccagggcacggtcaccatcattaactacaaaaagatcctggggtccattaagatgaaaccttactgggtgatgcttcgctataagaattacgctaactctctggacatcaatgccgagggaacatgtagcggctgcgttgggtgttttgaaaacatccattgcgagttcaccattcacacaaccatcgaagcctcctgtcagattgagagcgattgcacgacatttcacgacagaatcctcgtgacccccaatgaacataaatatgctctgaaggtcatttgtcacgataaacccaagacaatcttcaacttcaagatttgcaataccgagatcgaggccgctatcgccattgtggacgcgaaacctatcattgaactggccccggttgatcaaaccgcttacatccgggagaaggacgaaagatgcaaaacatggatgtgtcgcgtgcgggatgagggcattcaggtccttctggaaccctttaagaacctcttcggatcttatatcggcatcttttacacgattctgatcgtgattttcatcctcgttattatcatctatattatcctgcctatttgctttaaacttcaggacaccctgaagcagcatgaggacgcctacaagagagagatgaaaatccgctga

SEQ ID NO: 14250 - RNA, 4329 nt, synthetic construct
  misc_feature 1..4329: note = derived and/or modified CDS sequence (opt5) from SDNV(BeAr103645)__KX817334.1__GP
  source 1..4329: mol_type = other RNA
atgatctgcattctgctcctgatcgcccttgctagcgcctcccccgtgtaccagagatgtttccaagacggcgcgattgtcaagcagtatcctgctaaagatgccgttaccgaggtgtgcctgaaggacgatgtgtctatgatcaaaacacaggccaactacatgaagaatacgaccgggacatttagcaacaatgtcgctatgcggaaatggctcgtggccgactggcacgattgtcgcccgcagaagtcctctggaggccatattaacgttatcgaagtgggggacgatctgagccttcacaccgaggcttatatctgctccgccgactgtgtcatttctatcgataaggaaacagcgcaaattagactgcagaccgacagcacaaatcatttcgaggtgtccggaaccacggttaaaagcggctggtttaagtctaccacatacatcaccctcgatcagacatgcgaacacctgaaagtgtcctgtgggcccaagagcattcagttccatgcctgctttaaccaacacatgtcttgtgtccggttcctgcaccgcaccatcctccctggatccatggctaatagcatttgccagaacatcgagatcattatcctggtgacgcttacactgatgatttttatcctcctgaccattatctctaaaacatatatctgttacattcttatgcccatcttcattcctatcgcctatatttacggctggatctacaataagtcctgcaagaaatgcaagctgtgtggcctcgtgtatcatccctttaccgagtgcgggacccactgtgtctgcggagctagatacgaaacaagcgaccggatgaaactgcatcgctcctctggcctgtgtcctgggtataagagcctcagagccgcgcgggttatgtgcaaatcccgcggaccggccagcatcctgtctattcttacggctgtgctgatcctcaccttcgtgacacccatgtccgccctggtcattggcagctctgaggaactttacaagctggatgagctccctgacgacatgatcgatatggctgagaaagtgaacctgtattacctggttattgtgctcaattatagcgccacctgggggctgcttctgctcatgggaatcctggcccttctgtttaagaagtaccagcacattttcctcaactactatgctatgtactgtacagaatgcgacatgtatcacgataaaaaggagctgacctacaatggcgactttacgaacaaatgtagacagtgcacatgtggccaatatgaagatgcgaccgggctgatcgtccatcagaagtcctacaattgcctcgtgaaatataaggttaagtggatcaaaaacattctgatcatgtacattatccttaccctgattaaggactctgtgctcatcgccagcgctgagggacccgatttcgccacatgcatcgaagagaaaaccattacatggaactgtacgggccctttcctgaatctggggcggtgcgacaagacccagaaaaagacagattacgccaccatcgcttcccaacttaagggaattgacgccatcagcattctcgatgtccccatgatctctaaaatcccggaggacatttccggcgcgctgaagtatatcgaaagcctgaaaacataccacgagcagctcaccgctgaatatgccatgtttacgcgctactgtgactattacacccagttctctgataactccgggtatagccagacaacctggagaacatacctgcggtcccatgactttgaggtgtgcattgcctaccctaatcaacacttctgtcgctgcgtcaagaacggagaaaaatgttctagcgctcagtgggattttgccaccgagatcaagggctattacacgggcaagcagaataaattcaacaaggaccttaatctggctctcatgacatttcataccgccttcagagggacagcgacctcctatgtgaccgagctgatttctaaaggaaagaacagctccctgcttatgtacgccagcgctatcaaatctaagtttaatggcaacgccctcctgaaagctctgctcgatttcatgatgtatctgcagtcccttggggaaatcagcggatttaagctgacagacgagtgggaagatttcaagtacgaggaagaacccacggagcaaaccctcatgcctcggggccacagagggggccagtataattttaaaaacgccgcgtctaattccaagacaaaagtttgcaagaacgtgaaaaaggtcctgtgtctgagcccccgctctcgggccaccttcgacgatgtgattgcttgcggagaacacgccaatcccagcgtttacatgatccctaacacaaccatttaccagtccaacacggagagaagccattattgtatcgctgactctcactgccttgaagagtacgagctcgtgaagccggaactgctgacagccctcaaaaagtcccgctgctgggccggcgatattgacaccatcgtcctgcataaacagagcgatgggcttcggtcctgtagaattaaggacaccggatcttgcaatgtgatgggcaacgactggacaatcgtgctgtgtgaggataataaatattactatagcgaagttcaccaagactacgataaggaccaggatgtcgggcacttctgcctctctccccgctgtaacaccatccggtatcctatttcccccagacatatcaatagctgcaagtggcagatttcccactctacaatcggaaaaattagcgtgcatgagctggctgacatcgaacagtacaagaaagcgatctcccaaaagctgcagacgagcctttctatttttaaatacgccaagaccaagaacctccctcacatcaaacccgtgtataagtacattgctatcgagggcacagagaccgtcgaaggggtggagaatgccttcattgaatccgagatcccggccctggctggcacagccatcggatttaaaattaacagcaaggaaggcaatcatctgatggatatcattgggtatgttaaatctgcgtcctacagctctacctatacgaagctctacaccacaggacctaccatcggcattaacacaaaacacgacgagaagtgtaccgggtcctgccccggaacaatccaccataagaccggctggctgacgttcagcaaagagcgcacatccacctgggggtgtgaagagtttggctgccttgctgtgagcgatggatgtgtctatggctcttgccaggacattatcaaggatgaactgaccgtgtaccggaaaatcagcgacgaggttacagaagtggagctctgcctgaccttctccgataagacgtactgtacaaatctgaacgccgtcacccctattatcacagacaaatttgaggtgcaattcaagaccgttgaatcttatagccttcccagaattgtgggggtccgcaatcacaagatccagattggacagatcaacgacatcggcgtgtactccaaagggtgcggaaatgtgcagaaggtcaacggcacaaactatgggaatggcgttcctaaatttgattacctgtgtcatctcgcctctcggaaggaggtgattatcagaaaatgcttcgacaacgattatcaggcttgtaagtttctgcaaacccccgccagctaccggctcgaggagcaccagggaacggtgaccattatcgactataagaaaattctgggctccatcaagatgaaagcgatccttggggatgtccgctacaagaattacgctaactctctggacattaatgccgagggaacatgcgccggctgtgtggggtgcttcgaaaacatccattgtgagtttaccattcacacaaccatcgaagctagctgccagattgagtccgattgtacgacattccacgacagaatcctcgttaccccgaatgaacataaatatgccctgaaggtgatttgccacgataagcctaaaacaatcctgaacttcaagatctgcaataccaaaattgaggctgccatcaccattgtcgacgcgaagcccatcattgagcttgcccccgtggatcaaacagcttacatccgggaaaaagacgagagatgtaagacgtggatgtgccgcgttcgggacgaaggaatccaggtgctgctcgagccttttaagaacctgttcggcagctatattggcatcttttacaccattctcatcgtcattttcatcctggtgatcattatctatattatccttccgatttgttttaaactgcaggatacactcaagcagcatgaagacgcctacaaaagagagatgaagatccgctga

SEQ ID NO: 14251 - RNA, 4326 nt, synthetic construct
  misc_feature 1..4326: note = derived and/or modified CDS sequence (opt5) from SSHV__EU262553.1__GP
  source 1..4326: mol_type = other RNA
atgatctgcattctgatcctcttcgccgtgaccgctgccagccccgtctaccagagatgttttcaagacggcgcgattgttaagcagaacccttccaaagaggctgtgacagaagtgtgcctgaaggatgacgtctctatgatcaaaacggaggcccggtatattaagaatgccaccggggtgttcagcaacaatgttgctatccgcaaatggcttgtgtccgattggcacgactgtagaccgaagaagatcacaggaggccatattaacgtcatcgaagtgggggatgacctgtctctccacaccgagagctacgtttgctccgccgattgtacaattggagtggacaaagaaaccgctcaggtccggctgcagacagataccacgaatcattttgagatcgccggcaccacagtgaagtctgggtggttcaaaagcaccacatatattacccttgaccaaacgtgcgagcacctgaaggtgtcctgtggacccaaaagcatccagtttcatgcgtgcttcaaccagcacatgtcttgtgtccgctttctccacagaacaattctgcctggctccatcgccaatagcatctgccagaacattgaaatcattatcctggttaccctcacactgcttattttcatcctgctctctgtgctgtccaagacctacatctgttatcttctgatgcccgtgtttattcctatcgcttacgcctatggcattatctacaataagagctgcaaaaagtgcaaactctgtgggctggtctaccatcccttcaccgagtgcggaacacactgtgtgtgcggcgctcggtatgatacgtctgaccgcatgaagctgcatagagcctccgggctctgtcctggatacaaaagcctgcgggcggcccgcgttatgtgcaagtccaaaggcccggcttctattcttagcgtgatcaccgccatcctgattctcacatttgtcacccccatcaactccatggtggttggggaaagcaaggaggtgttcgagctggaacaacttcctgatgacatgctggacatggctctcagaattaatttttattacttcgtctgtatcatgaactatgccgtgacatggggactgattatcattggcctgctcatcggcctgcttttcaagaaataccagcaccggttttctaatctgtatgccatgtactgcgaggaatgtgatatgtaccacgaccgctccgggctcaagagaaacggagatttcaccaataaatgccggcagtgtacgtgcggccagtatgaggacgctacagggctgatgacccatcgcaagacctacaactgccttgtcagatataaagcgaagtgggtgatgaactttctgatcgcctacatgctcctgacactgattaaggatagcgctatcgttgtgcaagccgccggaaccgacttcacaacgtgtctcgaaaccgagaatattaactggaattgcacaggcccctttctgaaccttgggaattgtcagaaacagcaaaagaaagagccttatgctaacatcgccacccagctgaagggactccaggcgatttctgtcctggatatgcccatgatcgctagcatcccggaagacattgccggcgccctgcggtacatcgaggaaaaagagacattccacgtgcagcttaccgctgaatatgccatgctctccagatactgcgattactatgctcaattttctgacaatagcggctactcccagacgacctggcgcgtttatctgcggagccatgatttcgacgcctgtattctgtaccctaaccagcacttttgcagatgtgtgaagcatggggacaagtgcagctccagcaatcgcgatttcgcgaacgagatgaaaaattattactctggaaagcagaacaaatttgacaaggatctcaatctggcccttatggctctgcaccacgccttccggggcacatccagcgcttatatcgccaccatgctctccaaaaagtctaacgacgatctgattgcgtacacaaataagatcaaagagaagtttcccgggaacgccctgcttaaagctatcgtcgactacattgcctatatgaagtctctctccgaaatgtctagcttcaaatacgatgagttctgggacgatctgctgtataagtccgctcctaccaaagcccccagcctctctagaggatccgaacccagctacaactttaagctggtggtgtcttcccgcagcatcaagtcttgtaaaaatgttaagagcgtcgtgtgcctttcccctcggagcggcgtgtcttatgactccattatcgcctgtggggatccgaacggccccagcgtctacagaaaaccttccgacggagtgttccaatctaatgctgatcagagcacgtattgcctggcggactcccattgcctcgaggactttgaagttgtgtctcaggaggagctggatgccattaagaaaagcaagtgttgggaagctgagtaccccgacgtcaagctgtccaaacttacagatggcgtgaagtcttgccgcatgaaagacagcgggaactgtaatgttgccgccaaccggtggcctatcatccagtgcgaaaatgataagttctactattccgagctccaaaaagactacgataagacccaggacattggacacttttgtctgagccccggctgctctacagtgagattcccgatcaaccctaagcatatttccaattgtaactggcaggtcagccggtcttccatcgctaaaattgatgtgcacaatatcgaggacattgatcagtatcgcaaggccatcacccaaaaactgcagaccagcctctctctgtttaagtacgcgaaaacaaagaaccttccccacatcaagcctatttataaatacatcacgattgaagggaccgagacagctgaaggaatcgagtccgcctatattgaaagcgagatccccgccctggctggcacctccatcgggttcaagattacaagcaaagagggcaagcatctcctggacgttatcggatacgtgaaatctgccagctactcctctatttataccaagctgtacacgacaggccctaccagcgggatcaataccaaacacgatgaactttgcacaggaccctgtccggcgaagattaaccatcagaccggctggctcacatttgctaaggagagaacgtcctcttgggggtgcgaagagttcggatgtctggccatcagcgacggctgcgtctttgggtcctgccaagacatcattcgggatgaactgaccgtgtatcgcaaagagacagacgaggtgaccgatgtcgaactctgtctgacattctctgacaagacctactgcacgaatcttaaccctatcacccccattatcacagatctgtttgaggttcagttcaaaaccgtggaaacatatagcctccccagaattgtggccatccagaaccacgagattaagatcggccaggtcaatgacctgggagtgtactccaaaggctgtgggaacgttcaaaaggtgaatggaaccgtctatggcaacggggtgcctaagttcgattacctgtgccatcttgctagccggaaagaagttatcgtgagaaagtgttttgacaatgattaccaggcctgcaaattcctgcagtctccggcttcctatcgcctcgaggaggacagcggaacagtcaccgtgattgattacaagaaaatcctgggcacgattaagatgaaggccatcctcggggacgttaaatataagacatttgcggacaacgtggatatgaccgccgaaggctcttgtaccggatgcattaattgtttcgagaacatccactgcgaactgacacttcacaccacgatcgaggcttcctgtcccattgtcagcacatgcaccgtgtttcatgaccggatcctggtgacacctaatgagcacaaatacgccctcaaggtcgtttgcaccgaaaaacccggcaacacactgaccattagaatctgtaatacgaaggtggaggcttccctggcccttgtggatgccaagcctattctggaactcgctcccgtcgaccagaccgcgtatatccgcgagaaagatgaaagatgcaagacatggatgtgtcgggtgcgcgacgaggggctgcaagttatcctcgagcctttcaaaaacctgtttggatcttacattggcatcttctatacctttattatcagcattatcgcccttctgattatcatctacattgtgctccccatctgcttcaagctgagagatacactgcggaaacatgaagacgcttacaagcgcgagatgaagattagatga

SEQ ID NO: 14252 - RNA, 4326 nt, synthetic construct
  misc_feature 1..4326: note = derived and/or modified CDS sequence (opt5) from SSHV__K02539.1__GP
  source 1..4326: mol_type = other RNA
atgatctgcattctgatcctcttcgccgtgaccgctgccagccccgtctaccagagatgttttcaagacggcgcgattgttaagcagaacccttccaaagaggctgtgacagaagtgtgcctgaaggatgacgtctctatgatcaaaacggaggcccggtatattaagaatgccaccggggtgttcagcaacaatgttgctatccgcaaatggcttgtgtccgattggcacgactgtagaccgaagaagatcacaggaggccatattaacgtcatcgaagtgggggatgacctgtctctccacaccgagagctacgtttgctccgccgattgtacaattggagtggacaaagaaaccgctcaggtccggctgcagacagataccacgaatcattttgagatcgccggcaccattgtgaagtctgggtggttcaaaagcacaacctatatcacacttgaccaaacctgcgagcacctgaaggtgtcctgtggacccaaaagcattcagtttcatgcgtgcttcaaccagcacatgtcttgtgtccgctttctccacagaacgatcctgcctggctccatcgccaatagcatttgccagaacatcgaaattatcattctggttacactcaccctgcttatcttcatcctgctctctgtgctgtccaagacatacatttgttatcttctgatgcccgtgtttatccctattgcttacgcctatggcatcatttacaataagagctgcaaaaagtgcaaactctgtgggctggtctaccatcccttcaccgagtgcggaacccactgtgtgtgcggcgctcggtatgatacatctgaccgcatgaagctgcatagagcctccgggctctgtcctggatacaaaagcctgcgggcggcccgcgttatgtgcaagtccaaaggcccggcttctatccttagcgtgatcacggccattctgatcctcacctttgtcacacccattaactccatggtggttggggaaagcaaggaggtgttcgagctggaacaacttcctgatgacatgctggacatggctctcagaatcaatttttattacttcgtctgtattatgaactatgccgtgacctggggactgatcattatcggcctgctcatcggcctgcttttcaagaaataccagcaccggttttctaatctgtatgccatgtactgcgaggaatgtgatatgtaccacgaccgctccgggctcaagagaaacggagatttcacaaataaatgccggcagtgtacctgcggccagtatgaggacgctacggggctgatgacacatcgcaagacctacaactgccttgtcagatataaagcgaagtgggtgatgaactttctgattgcctacatgctcctgaccctgatcaaggatagcgctattgttgtgcaagccgccggaacagacttcaccacatgtctcgaaacggagaatatcaactggaattgcaccggcccctttctgaaccttgggaattgtcagaaacagcaaaagaaagagccttatgctaacattgccacacagctgaagggactccaggcgatctctgtcctggatatgcccatgatcgctagcattccggaagacatcgccggcgccctgcggtacattgaggaaaaagagaccttccacgtgcagcttacagctgaatatgccatgctctccagatactgcgattactatgctcaattttctgacaatagcggctactcccagaccacgtggcgcgtttatctgcggagccatgatttcgacgcctgtatcctgtaccctaaccagcacttttgcagatgtgtgaagcgcggggacaagtgcagctccagcaatggagatttcgcgaacgagatgaaaaattattactctggcaagcagaacaaatttgacaaggatctcaatctggcccttatggctctgcatcacgccttccgggggacctccagcgcttatattgccacaatgctctccaaaaagtctaacgacgatctgatcgcgtacaccaataagatcaaagagaagtttcccggaaacgccctgcttaaagctattgtcgactacatcgcctatatgaagtctctctccgaaatgtctagcttcaaatacgatgagttctgggacgatctgctgtataagtccgctcctacaaaagcccccagcctctctagaggctccgaacccagctacaactttaagctggtggtgtcttcccgcagcattaagtcttgtaaaaatgttaagagcgtcgtgtgcctttcccctcggagcggggtgtcttatgactccatcattgcctgtggcgatccgaacggacccagcgtctacagaaaaccttccgacggcgtgttccaatctaatgctgatcagagcacctattgcctggcggactcccactgcctcgaggactttgaagttgtgtctcaggaggagctggatgccatcaagaaaagcaagtgttgggaagctgagtaccccgacgtcaagctgtccaaacttacggatggggtgaagtcttgccgcatgaaagacagcggaaactgtaatgttgccgccaaccggtggcctatcattcagtgcgaaaatgataagttctactattccgagctccaaaaagactacgataagacacaggacatcggccatttttgtctgagccccgggtgctctaccgtgagattcccgattaaccctaagcacatctccaattgtaactggcaggtcagccggtcttccattgctaaaatcgatgtgcataatattgaggacatcgatcagtatcgcaaggccatcacacaaaaactgcagaccagcctctctctgtttaagtacgcgaaaaccaagaaccttccccacattaagcctatctataaatacattacaatcgaaggaacggagaccgctgaaggcattgagtccgcctatatcgaaagcgagatccccgccctggctgggacatccattggcttcaagatcaccagcaaagagggaaagcacctcctggacgttattggctacgtgaaatctgccagctgctcctctatctacacaaagctgtataccacggggcctacaagcggaattaataccaaacatgatgaactttgtaccggcccctgcccggcgaagatcaaccaccagacagggtggctcacctttgctaaggagagaacatcctcttggggatgtgaagagttcggctgcctggccatcagcgacgggtgcgtctttggctcctgtcaagacattatccgggatgaactgacggtgtaccgcaaagagaccgacgaggtgacagatgtcgaactctgcctgaccttctctgacaagacatattgtaccaatcttaaccctattacgcccatcattaccgatctgtttgaggttcagttcaaaacagtggaaacctacagcctccccagaatcgtggccattcagaaccatgagatcaagatcggacaggtcaatgacctgggcgtgtattccaaagggtgcggaaacgttcaaaaggtgaatggcacagtctacgggaacggagtgcctaagttcgattatctgtgtcaccttgctagccggaaagaagttattgtgagaaagtgctttgacaatgattaccaggcctgtaaattcctgcagtctccggcttcctaccgcctcgaggaggacagcggcaccgtcacagtgatcgattataagaaaattctggggaccatcaagatgaaggccattctcggcgacgttaaatacaagacgtttgcggacaacgtggatatgacagccgaaggatcttgcaccggctgtatcaattgcttcgagaacatccattgtgaactgacccttcacacaaccattgaggcttcctgccccatcgtcagcacgtgcacagtgtttcacgaccggattctggtgacccctaatgagcataaatatgccctcaaggtcgtttgtacagaaaaacccgggaacaccctgacaatcagaatttgcaataccaaggtggaggcttccctggcccttgtggatgccaagcctatcctggaactcgctcccgtcgaccagacggcgtacatccgcgagaaagatgaaagatgtaagacctggatgtgccgggtgcgcgacgagggactgcaagttattctcgagcctttcaaaaacctgtttggctcttatatcgggattttctacacatttatcattagcatcattgcccttctgatcatcatttatatcgtgctccccatttgtttcaagctgagagataccctgcggaaacacgaagacgcttacaagcgcgagatgaagatcagatga

SEQ ID NO: 14253 - RNA, 4335 nt, synthetic construct
  misc_feature 1..4335: note = derived and/or modified CDS sequence (opt5) from SORV__AF123488.1__GP
  source 1..4335: mol_type = other RNA
atggaggtgctgagcctcatctggctgcttaccctgtgctccgcctctcccgtcttccagagatgttttcaagacggcgctattgttaagcagaaccctagcaaagaagccgtgacagaggtgtgcctcaaggatgacgtctccatgatcaaaacggaaaccaagtacgtgaaaaatacaaccgggacattcgcgaacaatattgctatgcggaagtggctggttgccgattggcacgactgtcgcccgcagaagtctagcggaggccatatcaacgtgattgaggtcggggatgacctttccctgcacaccgaatcttatatctgcagcgccgattgtgtgatcacagttgacaaagagaccgctcagattagactccaaacggataataccaaccattttgaggtggccggaacaaccgtcaagtccggctggttcaaaagcacaacctacatcacgctggaccagacatgcgaacacctgaaggtgtcttgtgggcccaaatccattcagtttcatgcttgcttcaatcagcacatgagctgtgtgcggtttctccaccgcaccatcctgcctggatctattgccaactccatctgccaaaatattgagatcatcattcttgtcacactgagcctcgttatcttcatttttctgaccatcgtgtctaagacctatatttgttaccttctgatgcccatcttcatccctattgcgtttatctatggctggatttacaacaagtcctgcaaaaagtgcaaactctgtggcctggtgtatcatcccttcacagaatgcgggacgcactgtgtctgcggagccagatacgagaccagcgatcggatgaagctgcatcgcgcttccggcctctgtcctgggtacaaatctctgagagccgctcgggtgatgtgcaagagcaaaggaccggcctccatccttagcattctgacagcgatcctcatcctgacctttgttacacccatttctgccatggtggtcggcgagtccaatgaaatctatacccttgacgatctgcctgacgacatggtgcagatggctgagcgcattaacatctactatcagattctcatcattaattacggggttacgtgggccttcctgctgctcggactggtgcttgcttatttctttaagaagtaccagcacaaattcctggattattacgccatgtactgtgaagagtgcgacatgtatcacgaaaagagcggcatgacatactggggcgattttaccaacaaatgtagacaatgcacctgtgggcagttcgaggacgccacaggactcatggtccataagaaatcttataattgcctggtgaagtacaaggctaaatggatccggaacatccttattgcgtatctgatgatcatgctcgtcaaggatagcctgctgtttgtgggcgccacccgcgctgacttcgcctcctgcgttgatgagaaaacagtgacgtggaactgtaccgggccctttctcaatctgggaagatgcgacaagacacagaaaaagaccggctacaaggatattgccaaccaacttaaagggctgggagtcatctctattctcgacatccctatgatcgaaaagatgcccgatgagattagcggctccctgaaatatatcgacagcctggaaacataccacgagcagcttaccgctgaatacgccttcctcacgcggtattgtgactactatacccagtacacagataattctggctattcccagaccgtgtggcgcacatacctgagaagccatgactttggggcgtgcgttgtgtatccgaaccaacacttctgtcggtgcgtcaagtacgatgacaaatgtaattctgctaagtgggattttgccaacgagatgaagaccttctacacgggaagaaaagtgaagtttaataaagacctgaacctcgccctgcttgtgctgcataaggctttccgcggcacagggaccgcctatattgctgaggccatggcgcggaaagataatggatccatggcccacttcgctctcgaaatcagaaagaaatttcctacaaacgccctgctggctgcccttattgactacatcgtttatctccagagcctggcggagatctccaccttcgaactggaggaagattgggaggactttaagtacaagcccgagcctaccgaatctacactccagccccgcagccaccggtccgatcagtataatttcaaaaacgccgactctaatagcaacgtcaaggtgtgcaaaaatgtgaagaaagtcctgtgtgtgtcccccagaagccgcgctaagtttgagaacattatcgcctgcggcgaacatgctaacccttctgtttacatgatgccgaatatttccatctatcaaagcaactctgagcggtcccactactgtattgccgatagccattgccttgaggaatacgagatcgtgaatacggaactgctcaccgccctgaagaaatctagatgctgggctaaggagatggacgacgtcgtgctgcacaaacagagcgatgggcttcgctcctgtcggatcaaggacacaggcagctgcaacgttctcggaaatgattggaccattgtgctgtgtgaaaacggcaattattactattctgagatccacaaagactacgataaggaccaggatgtcgggcatttctgcctgtcccccagatgtagcacaattcgctatcctatcaaccggagacacattcggaagtgcgactggcagatctcccattctaccattgataaaatcagcgtgcaagagctcgcggacatcgaacagtacaagaaagccatttcccagaagctgcagacgtctcttagcatctttaaatatgttaagacaaagaatctgccccacattaaacctgcttacaagtacatcaccgtggagggaaccgaaacaattgagggcatcgaaaacgccttcatcgagtccgagattcccgccctcgctgggaccgccatcggatttaaaattaattctcgcgaaggcaactatctgatggatgtcatcgggtacgtcaagagcgcgtcctatagcgctacatacacgaaactgtataccacaggcccgaccattggaatcaatacaagacatgacgagaagtgtaccggcccttgccccgtgacgatcgatcacaaagacgggtggcttaccttctctaaggaacggacatccacctggggatgtgaggaatttggctgcctcgccgtgagcgacgggtgtgttttcggatcttgccaagatattatcaaggacgagctggccgtgtacagaaaaacaaccgaggaactgacaaccgtggagctctgcctgacgttttccgataagacatattgtaccaaccttaatgctattacccctatcattacagacaaattcgaagtccagttcaagaccgtggagagctacacgctgccccgcatcattgccgttaaaaaccacgagatcaaggtgggccagatcaacgatctcggggtctactctaagggctgcggaaatgtgcaaaaagttaacggcacaaattatgggaacggagtgcctaagtttgactacctgtgtcatctggcgtcccggaaagaagtcattcttagaaagtgcttcgataatgactatcaggcttgtaaatttctgcagagccccgcctcctaccgcctcgaggaacaccagggcaccgtgacagttatcgattataagaagattctggggagcatcaaaatgaaggccattctcggagacgtgaaatacaagaactatcaatctaatatcgagatcaacgctgaagggacctgcgccggctgtgtcaattgcttcgagaacattcattgtgagtttacaatccacaccacggtggaaaccagctgcccgattgtgacagattgtgtctccttccatgacagaatcctgattacccctgacgagcacaaatacgctcttaagatcgtttgccaggataagcccaaagtgtctctgaagtttaaaatctgcaatacaaacattgacgccagcatgaccatcgtggattccaagcccattctcgaactggcgcctgtcgaccagacggcctacatcaaagagaaggatgaacggtgtaagacatggatgtgccgcgtgagagacgagggcttccaggttattctggagccgtttaaaaatcttttcggatcttatatcggcatcttttacaccgggattctgagcgtgatctgtctcctgattgtcatctatattgtgctccccatctgcttcaagctgcgggatacacttaaacaacacgaagacgcttacaagaaagagatgaagattcgctga

SEQ ID NO: 14254 - RNA, 4335 nt, synthetic construct
  misc_feature 1..4335: note = derived and/or modified CDS sequence (opt5) from SORV(SORV-252)__JN815081.1__GP
  source 1..4335: mol_type = other RNA
atggaggtgctgagcctcatctggctgcttgccgtctgctccgctaaccccgttttccagagatgttttcaagacggcgccattgtgaagcagaatccttctaaagaagcggtgaccgaggtctgcctgaaggatgacgtgagcatgatcaaaacagaagctaagtacgttaaaaacacgaccgggacattctccaataacgtggccatgcggaagtggctcgtcgccgattggcacgactgtcgcccgcagaagtctagcggaggccatattaatgtgatcgaggttggggatgacctgtcccttcacaccgaatcttatatttgcagcgctgattgtgtgatcacagtcgacaaagagaccgcccagatcagactgcaaacagattccaccaaccattttgaggtggctggaacgaccgtcaagagcggctggttcaaatctacaacctacattacactcgaccagacctgcgaacacctgaaggtgtcctgtgggcccaaaagcatccagtttcatgcctgcttcaatcagcacatgtcttgtgttcggtttctgcaccgcacgattctccctggatccatcgcgaacagcatttgccaaaatatcgagattatcatcctggtgacactttctctgattatcttcatttttctcaccatcgtgtccaagacatatatttgttacctgcttatgcccatcttcatccctattgcctttatctatggctggatttacaacaagagctgcaaaaagtgcaaactgtgtggcctcgtctatcatcccttcaccgaatgcgggacccactgtgtgtgcggagctagatacgagacatccgatcggatgaagctgcatcgcgcctctggcctgtgtcctgggtacaaaagcctcagagctgcccgggttatgtgcaagtccaaaggaccggcgagcatcctgtctattcttacggccgtgctgatcctcacctttgtcacacccatctccgctattatcattgacgagagcaaggaaatctataccctggatgaccttcctgacgatatggtgcagatggccgagcgcattaatatctactatcagattctgctcatcaactacggcgttacatgggctttcctgctgctcgggctgatccttgcctatttctttaagaaataccagcacaagttcctggactattacgccatgtactgtgaagagtgcgatatgtatcacgaaaaatctggaatgacctactggggcgactttacgaataagtgtagacaatgcacatgtggccagtatgaggatgctgcggggctcatggtgcataaaaagagctacaactgcctgattaagtataaagccaagtggatcaaaaatattcttatcctgtacctcattatgatcctggtcaaggactccctgctctttgtgggagctaccggcaccgattttgccgcctgcatcgacgagaaatctgtcacatggaactgtaccgggcccttcctgaaccttggacggtgcgataagcctcagaagaaagctagctttaaggacattgccaatcaactgaaaggcctcggggtgatctccgttctggatattcccatgatcgaaaagatgccggacgacattagcggatctctgaaatatatcgattcccttcgcacataccacgagcagctcacggcggaatacgctttcctgaccagatattgtgactactatgcccagtacacagataacagcggctattctcagaccgtgtggcggacatacctgcgctcccatgactttggcgcctgcgtcgtgtatcctaatcaacacttctgtagatgcgttaagtacggggataagtgtaacagcgctaaatgggactttgccaatgagatgaagtccttctacaccggacagaaagctaagtttaacaaagatctcaatctggcccttctggtgctccataaggcgttccggggcacggggaccgcctatatcgctgaaacactggccagaaaagacaacggatctatggtccacttcgctctggagattcgcaagaagtttcccaccaatgcccttctcgcggccctgatcgattacattgtgtatctgcagagcctcgctgagatctccacattcgaacctgaggaagactgggaggattctaaataccagcccgaacccaccgagagcgtgctgcaacctcgggcccacagatccgaccagtataactttaagaatgctgatagcaactctaatgttaaagtctgcaagaacattaaaaaggtgctttgtatctccccgcgcagccgggccaagttcgagaatatcattgcctgcggcgaacatgctaacccctctgtgtacatgatgcctaacacgtccatctatcagagcaattctgagagaagccactactgtattgcggactcccattgcctggaagagtacgagatcgtcaacacagaactcctgaccgcctttaaaaagagccgctgctgggctaaagagattgacgatatcgtgctgcacaagcagtctgacgggcttcggtcctgtagaattaaagatacaggcagctgcaatgttctcggaaacgactggaccatcgtgctgtgtgaaaatggcaactattactattccgaggtccacaaggattacgacaaggatcaagacgtggggcatttctgcctgtctccccgctgtaataccatccggtatcctattagcagacgccacatcggagaatgcaactggcagattacacattccacgatcgataaaatttctgttcaggagctcgccgacatcgagcagtacaagaaagccatcagccaaaagctgcagacctccctttctatttttaaatatgtgaagacaaagaatctgccccacatcaaaccggcttaccggtacattaccgtcggcgggacagaaaccatcgagggagtggaaaacgccttcattgagagcgaaatccctgcgctcgctggcacggccatcgggtttaagattaattccagagagggcaactatctgatggatgttatcggatacgtgaaaagcgcctcttattccgctacatacaccaagctgtataccacaggccccaccattgggatcaatacaaaacatgacgagaagtgtacgggaagctgccctgtcaccattaaccacaaagatggctggcttacattctctaaggaacggacctccacatgggggtgtgaggaatttggatgcctcgccgtgagcgacggctgtgtgttcgggtcttgccaggacatcattaaggatgagctggcggtctaccgcaaaaccacggaggaactgaccacagttgagctctgcctgaccttttccgacaagacatattgtaccgatcttaatgctatcacacccatcattaccgacaaattcgaagtgcaattcaagacggtggagagctacacactgcctagaatcattgccgtcaaaaaccacgaaatccggaccggccagattaacgatctcggagtgtactccaagggctgcgggaatgttcagaaggtgaacggaaccagctatggcaatggggtccccaaatttgactacctgtgtcatctggcctctagaaaggaggtgatccttcgcaaatgcttcgataacgactatcaggcttgtaagtttctgcaaagcccggcctcctaccggctcgaggaacaccagggaacagttaccgtgatcgattataaaaagattctgggctctatcaagatgaaagctatgctcggggacgtcaagtacaaaaattatcagagcaacattgagatcaatgccgaaggcacgtgcgcgggatgtattgattgcttcgagaacatccattgtgaatttacaatccacaccacagtggaggcctcctgccctattaccacagactgtgtttctttccatgacagaatcctgattacccccgaggaacacaagtacgctcttaaaatcgtgtgccaggataagcccaaggtcagcctgaaatttaagatttgcaatacgaacgtggaggcctccatgaccatcattgactctaaacctatcctcgaactggctccggtggatcaaacaacctacatcaaggagaaagacgaacgctgtaagacatggatgtgcagagtccgggatgagggcttccaggttattctggagccctttaagaatcttttcgggagctatatcggaattttctacaccggcgtgctgtccatcatttgtctcctgatcgtgatctatattatcctccctatttgctacaaactgcgcgacacgcttaagcagcacgaagatgcctataaaaaggagatgaaaatcagatga

SEQ ID NO: 14255 - RNA, 4335 nt, synthetic construct
  misc_feature 1..4335: note = derived and/or modified CDS sequence (opt5) from SORV(NJO-94F)__KX817337.1__GP
  source 1..4335: mol_type = other RNA
atggaggtgctgagcctcatctggctgcttaccctgtgctccgcctctcccgtcttccagagatgttttcaagacggcgctattgttaagcagaaccctagcaaagaagccgtgacagaggtgtgcctcaaggatgacgtctccatgatcaaaacggaaaccaagtacgtgaaaaatacaaccgggacattcgcgaacaatattgctatgcggaagtggctggttgccgattggcacgactgtcgcccgcagaagtctagcggaggccatatcaacgtgattgaggtcggggatgacctttccctgcacaccgaatcttatatctgcagcgccgattgtgtgatcacagttgacaaagagaccgctcagattagactccaaacggataataccaaccattttgaggtggccggaacaaccgtcaagtccggctggttcaaaagcacaacctacatcacgctggaccagacatgcgaacacctgaaggtgtcttgtgggcccaaatccattcagtttcatgcttgcttcaatcagcacatgagctgtgtgcggtttctccaccgcaccatcctgcctggatctattgccaactccatctgccaaaatattgagatcatcattcttgtcacactgagcctcgttatcttcatttttctgaccatcgtgtctaagacctatatttgttaccttctgatgcccatcttcatccctattgcgtttatctatggctggatttacaacaagtcctgcaaaaagtgcaaactctgtggcctggtgtatcatcccttcacagaatgcgggacgcactgtgtctgcggagccagatacgagaccagcgatcggatgaagctgcatcgcgcttccggcctctgtcctgggtacaaatctctgagagccgctcgggtgatgtgcaagagcaaaggaccggcctccatccttagcattctgacagcgatcctcatcctgacctttgttacacccatttctgccatggtggtcggcgagtccaatgaaatctatacccttgacgatctgcctgacgacatggtgcagatggctgagcgcattaacatctactatcagattctcatcattaattacggggttacgtgggccttcctgctgctcggactggtgcttgcttatttctttaagaagtaccagcacaaattcctggattattacgccatgtactgtgaagagtgcgacatgtatcacgaaaagagcggcatgacatactggggcgattttaccaacaaatgtagacaatgcacctgtgggcagttcgaggacgccacaggactcatggtccataagaaatcttataattgcctggtgaagtacaaggctaaatggatccggaacatccttattgcgtatctgatgatcatgctcgtcaaggatagcctgctgtttgtgggcgccacccgcgctgacttcgcctcctgcgttgatgagaaaacagtgacgtggaactgtaccgggccctttctcaatctgggaagatgcgacaagacacagaaaaagaccggctacaaggatattgccaaccaacttaaagggctgggagtcatctctattctcgacatccctatgatcgaaaagatgcccgatgagattagcggctccctgaaatatatcgacagcctggaaacataccacgagcagcttaccgctgaatacgccttcctcacgcggtattgtgactactatacccagtacacagataattctggctattcccagaccgtgtggcgcacatacctgagaagccatgactttggggcgtgcgttgtgtatccgaaccaacacttctgtcggtgcgtcaagtacggagataaatgtaattctgctaagtgggactttgccaacgagatgaagaccttctacacgggcagaaaagtgaagtttaataaagatctgaacctcgccctgcttgtgctgcataaggctttccgcgggacaggaaccgcctatattgctgaggccatggcgcggaaagacaatggctccatggcccacttcgctctcgaaatcagaaagaaatttcctacaaacgccctgctggctgcccttattgattacatcgtttatctccagagcctggcggagatctccaccttcgaactggaggaagactgggaggattttaagtacaagcccgagcctaccgaatctacactccagccccgcagccaccggtccgaccagtataatttcaaaaacgccgattctaatagcaacgtcaaggtgtgcaaaaatgtgaagaaagtcctgtgtgtgtcccccagaagccgcgctaagtttgagaacattatcgcctgcggggaacatgctaacccttctgtttacatgatgccgaatatttccatctatcaaagcaactctgagcggtcccactactgtattgccgacagccattgccttgaggaatacgagatcgtgaatacggaactgctcaccgccctgaagaaatctagatgctgggctaaggagatggatgacgtcgtgctgcacaaacagagcgacggccttcgctcctgtcggatcaaggatacaggaagctgcaacgttctcggcaatgactggaccattgtgctgtgtgaaaacgggaattattactattctgagatccacaaagattacgacaaggatcaggacgtcggacatttctgcctgtcccccagatgtagcacaattcgctatcctatcaaccggagacacattcggaagtgcgattggcagatctcccattctaccattgacaaaatcagcgtgcaagagctcgcggatatcgaacagtacaagaaagccatttcccagaagctgcagacgtctcttagcatctttaaatatgttaagacaaagaatctgccccacattaaacctgcttacaagtacatcaccgtggagggcaccgaaacaattgaggggatcgaaaacgccttcatcgagtccgagattcccgccctcgctggaaccgccatcggctttaaaattaattctcgcgaagggaactatctgatggacgtcatcggctacgtcaagagcgcgtcctatagcgctacatacacgaaactgtataccacaggaccgaccattggcatcaatacaagacatgatgagaagtgtaccgggccttgccccgtgacgatcgaccacaaagatggatggcttaccttctctaaggaacggacatccacctggggctgtgaggaatttgggtgcctcgccgtgagcgacggatgtgttttcggctcttgccaagacattatcaaggatgagctggccgtgtacagaaaaacaaccgaggaactgacaaccgtggagctctgcctgacgttttccgacaagacatattgtaccaaccttaatgctattacccctatcattacagataaattcgaagtccagttcaagaccgtggagagctacacgctgccccgcatcattgccgttaaaaaccacgagatcaaggtggggcagatcaacgacctcggcgtctactctaagggatgcggcaatgtgcaaaaagttaacgggacaaattatggaaacggcgtgcctaagtttgattacctgtgtcatctggcgtcccggaaagaagtcattcttagaaagtgcttcgacaatgattatcaggcttgtaaatttctgcagagccccgcctcctaccgcctcgaggaacaccaggggaccgtgacagttatcgactataagaagattctgggaagcatcaaaatgaaggccattctcggcgatgtgaaatacaagaactatcaatctaatatcgagatcaacgctgaagggacctgcgccggctgtgtcaattgcttcgagaacattcattgtgagtttacaatccacaccacggtggaaaccagctgcccgattgtgacagactgtgtctccttccatgatagaatcctgattacccctgacgagcacaaatacgctcttaagatcgtttgccaggacaagcccaaagtgtctctgaagtttaaaatctgcaatacaaacattgatgccagcatgaccatcgtggactccaagcccattctcgaactggcgcctgtcgatcagacggcctacatcaaagagaaggacgaacggtgtaagacatggatgtgccgcgtgagagatgagggattccaggttattctggagccgtttaaaaatcttttcggctcttatatcgggattttctacaccggaatcctgagcgtgatctgtctcctgattgtcatctatattgtgctccccatctgctttaagctgcgggacacacttaaacaacacgaagatgcttacaagaaagagatgaagattcgctga

SEQ ID NO: 14256 - RNA, 4323 nt, synthetic construct
  misc_feature 1..4323: note = derived and/or modified CDS sequence (opt5) from TAHV__AF123485.1__GP
  source 1..4323: mol_type = other RNA
atgatgttcgtgctgtttttcatcgccctcagcgctgcctcccccgtctaccagagatgctttcaagacggcgcgattgttaagcagaacccttctaaacaggctgtgaccgaggtgtgtctgaaggatgacgtcagcatgatcaaaacagaagcccggtatttccgcaatgccacggggacctacgctaacaatgtggccattagaaagtggcttgtttccgattggcacgactgccggccgaaaaaggtgtctggaggccatatcaacgtcattgaggtgggggatgacctgacactccacaccgaggcttatgtttgtaatgccgattgcacaatcggagtggacaaggagaccgcgcaggtccgcctgcaaacagataccacgaaccattttgaaatcgccggcaccacagtgaaaagcgggtggttcaagtccaccacatacattacccttgaccagacgtgtgagcacctgaaagtgtcttgcggacccaagagcatccagtttcatgcttgtttcaatcagcacatgtcctgcgtcagatttctccaccggacaattctgcctggcagcatcgcctcttccatttgtcaaaacgttgagatcattatcctgaccgtgctcacactgcttatcttcattctgctcagcatcctgtctaaaacctatatttgctacatccttatgcccatttttatccctctggcttatatctacggcgtgatttacaataagtcctgtaagaaatgcaagctctgcgggctggtctatcatcccttcaccgaatgtggaacacactgcgtgtgtggcgcccgctacgagacgagcgatagaatgaaactgcatcgggcgtctgggctctgccctggatataagtccctgcgcgccgctagagttatgtgtaaaagcaagggcccggcctccatcctttctattatcaccgctgtgctgattctcacatttgtcacccccatcaacgccatggtggccggggacacacaggaaaccttcaaactggaggatcttcctgacgacatgctgagcatggctatgaaggttaatatgtactatatcatgtgcatgattaactacgcggtgacgtggtccttcatcctctgtgccctgctgattgctctcctgtttaagaaatatcagcaccggttccttaatttttacgccatgtactgccacgagtgtgatatgtatcatgaccgcagcggactgaagtacaacggcgatttcacaaataaatgcagacagtgtacctgcggccaatatgaagacgccgctgggctcctgacccaccggaagacatacaactgccttgtccagtataaatctaagtggctgaccaactttctcatcgtgtacattatcctgatgctgattaaggattccgtcctcatcgtgcatgccgacggaacagatttcgagaaatgtagcggcgaagttgacatcacgtggaattgcaccgggccctttctgaaccttggaaattgtgagaagaaacagaagaaagaatcttataacaatattgcgacacaactgaagggcctcgatgctatcagcgtgctggacattcctatgatctccaagattcccgaggatatcgccggggccctgcgcttcatcgaggaacagagatcttaccacgtccagcttaccgctgagtacgccatgctcacacggtattgcgactactatacccagtttacggacaacagcggatactcccaaaccacatggagagtgtatctgcgcagccatgatttcaaggcttgtattctgtacccgaatcagcacttttgccggtgtgttaagcacggcgacaaatgttcttccagcaactgggatttcgccaatgaaatgaagaactattactctggcaaacagtccaagtttgacaaggatctcaatctggcgcttatgagcctgcatcacgccttcagagggacctcctctttctacatcgctaaactcctgaaggagaaaaagaacgaagacctggtgacatatgccgagaaaattaagggaaaataccctggcaatgcccttctcaaggctatcattgattatatcaagtacatggaggacctgaccgaaatgaacaattttaaacatgatgagatgtgggacgatttcatctttgaagtgccccctacgaaaagcccctccattcgccggctggagtctagctatgacttcaaaacaaacgtcaactccaatcccagccacatctgcaagaacattaaaaccgtggtttgcctctctcctaagtccggggtcagctacgattctatcattgcgtgtggagaaccgtcccagcccagcatctatagaaagcctgactctcaagtgtttcagagcaatgccgaccagacacacttctgcctgtccgatacccattgccttgagaactacgagaccgtgggcgaagagatcattgacgctatcaaaaagagcaaatgttgggaaacagagtttacggagtacattcagttcaagcaatctgatggggtccgctcctgccggatgaaagacagcggcgaatgtaccgtgacaaccaatagatggcccatcattctgtgcgataacgacaagttttattactccgagctccagaaggattatgacaaagatcaggacatcggacacttctgtctgtctcctcgctgcaatacaattcggcatcccatcaacagaaagcacatcagcaattgtacctggcaggtttcccataacaatattgataaaatcgaagtgcacgagctggaagaccttgagcaatacaagaaagccattacgcagaagctccagacatctctgaccctgtttaagtatagcaaaaccaagaacctcccgcacatcaaacctatgtacaagtatattacaatcgagggcaccgaaacagctgaggggctggaatccgcctacatcgagtctgaaattcccgcccttgctggaacgagcatcggcttcaaaattacctccaagagcgggaaacatctgctcgatgtcatcggatacgtgaagtctgcgtcctatagcgccgtttacacaaagctgtataccacaggccctaccattggggtgaatacgaaacacgacgagctgtgcaccggcccctgtcctgtcaacgtgccccatggaacaggctggcttacctttgctaaggagcgcacatcttcctgggggtgcgaagagttcggatgtctcgccatcagcgacggctgcgttttcgggtcttgccaagatatcattaaagacgaaatcaccgtgtaccggaaggagacagaagagaccacggatgtcgagctgtgtctgacatttgccgacaaaacctattgcaccaatctcaacgctattacaccgatcattaccgatcagttcgaagtgcagtttaagacggtggaggcctactccctgcctagaatcattgcggtccggaaccacgaaatcatggttggacagatcaatgacattggcgtgtatagcaaggggtgtggcaacgtgcaaaaagtcaataacacaaattacggaaacggcgtgcccaagttcgattacctttgccatctggcttcccgcaaagaggttatcgtgagaaagtgttttgacaatgattatcaggcctgcaaattcctccagacccccgccagctaccggctggaggaagaagggggatctgtcacagtgattgactataagaagatcctgggcaccattaaaatgaaggctatccttggggatgttaaatacaagacatttgccgacaacgtggacctgaccgtcgaaggagtgtgtacgggctgcatcaattgtttcgagaacattcactgcgaactcaccatccacagcacagttgaggcgtcctgtcctgtggtctctagctgcaccgtgtttcatgatcgcattctgatcacaccgaatgagcacaaatatgctattaaggtgatctgcaacgaaaagcccgggcctaccctccccttcaaaatctgttccgccaagacggacgccgctatgacactggccgatgctaaacctattcttgagctggcccccgtcgaccagaccacatacatcaaggaaaaagatgagagatgcaagacctggatgtgtcgggttagagacgaaggctttcaagtgattttcgagcctttcaagaatctctttggatcttatatcggcattttctacacctttatcattagcctgatggcgatcttcatcgtgatttacatcgtcctgcccatttgctttaaacttcgcgatacactgagacagcatgaggacgcctataagcgggaaatgaaaatccgctga

SEQ ID NO: 14257 - RNA, 4323 nt, synthetic construct
  misc_feature 1..4323: note = derived and/or modified CDS sequence (opt5) from TAHV__AF229129.1__GP
  source 1..4323: mol_type = other RNA
atgatgttcgtgctgtttttcatcgccctcagcgctgcctcccccgtctaccagagatgctttcaagacggcgcgattgttaagcagaacccttctaaacaggctgtgaccgaggtgtgtctgaaggatgacgtcagcatgatcaaaacagaagcccggtatttccgcaatgccacggggacctacgctaacaatgtggccattagaaagtggcttgtttccgattggcacgactgccggccgaaaaaggtgtctggaggccatatcaacgtcattgaggtgggggatgacctgacactccacaccgaggcttatgtttgtaatgccgattgcacaatcggagtggacaaggaaaccgcgcaggtccgcctgcaaacagataccacgaaccattttgaaatcgccggcaccacagtgaaaagcgggtggttcaagtccaccacatacattacccttgaccagacgtgtgagcacctgaaagtgtcttgcggacccaagagcatccagtttcatgcttgtttcaatcagcacatgtcctgcgtcagatttctccaccggacaattctgcctggcagcatcgcctcttccatttgtcaaaacgttgagatcattatcctgaccgtgctcacactgcttatcttcattctgctcagcatcctgtctaaaacctatatttgctacatccttatgcccatttttatccctctggcttatatctacggcgtgatttacaataagtcctgtaagaaatgcaagctctgcgggctggtctatcatcccttcaccgaatgtggaacacactgcgtgtgtggcgcccgctacgagacgagcgatagaatgaaactgcatcgggcgtctgggctctgccctggatataagtccctgcgcgccgctagagttatgtgtaaaagcaagggcccggcctccatcctttctattatcaccgctgtgctgattctcacatttgtcacccccatcaacgccatggtggccggggacacacaggaaaccttcaaactggaggatcttcctgacgacatgctgagcatggctatgaaggttaatatgtactatatcatgtgcatgattaactacgcggtgacgtggtccttcatcctctgtgccctgctgattgctctcctgtttaagaaatatcagcaccggttccttaatttttacgccatgtactgccacgagtgtgatatgtatcatgaccgcagcggactgaagtacaacggcgatttcacaaataaatgcagacagtgtacctgcggccaatatggggacgccgctggactcctgacccaccggaagacatacaactgccttgtccagtataaatctaagtggctgaccaactttctcatcggctacattatcctgatgctgattaaggattccgtgctcctggtccatgccgacgggacagatttcgaaaaatgtagcggagaggcggacatcacgtggaattgcaccggcccctttctttctctggggaactgtgaaaagaaacagaagaaagagagctataataacatcgctacacaactcaagggactggatgccatttccgtgctggacatccctatgatttctaagatccccgaagatattgccggcgcccttcgcttcatcgaggagcagagaagctaccacgttcagctcaccgctgaatacgctatgctgacacggtattgcgactactatacccagtttacggacaattccggctacagccaaaccacatggagagtgtatctgcgctctcatgatttcgaggcctgtatcctctacccgaaccggcacttttgcagatgtgtcaaacacggggacaagtgctccagctctaattgggatttcgcgaacgaaatgaaaaattattactccggaaagcagagcaaatttaacaaggacctgaatcttgccctgatgtccctccatcacgctttccgcggcacctctagcttctacattgccaagctgctgaaagagaagaaaaacgaagatcttgtgacatatgctgagaagatcaaagggaagtaccctggaaatgccctcctgaaagcgattatcgactatattaagtacatgaagggcctgaccgagatgaacaattttaaacatgatgaaatgtgggacgatttcatctttgaggttccccctacgaagtccccctctgtgcggagactcgaaagctcctatgacttcaaaacaaacgtcaacagcaatccctctcacatctgtaagaacattaaaaccgtggtgtgcctgtcccctaagagcggggtttcttacgattccatcattgcctgtggcgagccgagccagccctctatctatcgcaagcctgacagccaggtctttcaatccaatgctgatcagacacacttctgccttagcgacacccattgcctggaaaactacgagaccgtgggagaggaaattatcgacgccatcaaaaagtctaaatgttgggagacagaatttacggagtacacccagctcaagcagtccgatggcgtgcggagctgcagaatgaaagactccggggagtgtacagtcaccacaaatcgctggcccattatcctgtgcgataacgacaagttctattactctgaactgcaaaaggattatgacaaagatcaggacattggacacttttgtcttagccctcggtgcaataccatcagacatcccattaaccgcaagcacatctccaattgtacgtggcaagtgaaccataataacattgataaaatcgaggttcacgaactcgaggacctggaacagtacaagaaagctatcacacaaaagctgcagacctctctcaccctgttcaagtatagcaaaacaaagaatcttccgcacattaaacctatgtacaagtatatcaccattgagggcacagagacggccgaagggatcgagtccgcctacattgaatctgagatccccgctctggcgggaaccagcatcggctttaaaattacatccaagagcgggaaacatctcctggatgtgatcggctacgtcaagtctgcctcctatagcgctgtgtacaccaagctgtatacaaccggacctacgattggcgttaacaccaaacacgacgaactttgcacagggccctgtcctgtgaatgtcccccatggaaccggctggctcacattcgccaaggagcggacctcttcctgggggtgcgaggaatttggatgtctggccatcagcgatggctgcgtgttcgggtcttgccaggacattatcaaagacgagatcacagtttacagaaaggaaaccgaggaaacgacagatgtggagctgtgtctcaccttcgctgacaaaacctattgcacaaacctgaacgccattaccccgatcattacggatcaatttgaggtccagttcaagacagtggaagcgtactcccttcctcggatcattgctgtgcgcaatcacgagatcatggtcggccagattaacgacatcggagtttatagcaagggctgtgggaatgtgcagaaagtgaacaataccaactacggaaatggcgcccccaagtttgattacctgtgccatctcgcctccagaaaagaagtcatcgtgcggaagtgtttcgacaacgattatcaggcttgcaaatttctgcagacacccgccagctacagactggaggaggaagggggatctgttaccgtgattgactataagaagatccttggcacaattaaaatgaaggcgatcctgggggatgtcaaatacaagaccttcgctgacaatgtggatctcacggttgagggcgtgtgtaccggatgcgtcaactgttttgaaaatattcactgcgagagcacaatccactccaccgtggaagcctcttgtcctgttatcagctcctgcacagtgttccatgaccgcattctgatcaccccgaacgagcacaaatatgccattaaggtcatctgcaatgagaagcccggccctacgctcccctttaaaatttgttctgctaagacagacgccgctatgaccctggccgatgcgaaacctatccttgaactggcccccgtggaccagacaacctacatcaaggagaaagtggaacggtgcaagacctggatgtgtagagtccgcgatgaggggttccaggttatttttgaacctttcaagaacctcttcggaagctatatcggcatcttttacacattcattatttccctgatggctatctttattgtgatctacatcgtgctgcccatttgcttcaaacttagagacacgctgcggcaacatgaggatgcctataagcgcgagatgaaaatcagatga

SEQ ID NO: 14258 - RNA, 4323 nt, synthetic construct
  misc_feature 1..4323: note = derived and/or modified CDS sequence (opt5) from TAHV(22595-6)__HM036218.1__GP
  source 1..4323: mol_type = other RNA
atgatgttcgtgctgtttttcatcgccctcagcgctgcctcccccgtctaccagagatgctttcaagacggcgcgattgttaagcagaacccttctaaacaggctgtgaccgaggtgtgtctgaaggatgacgtcagcatgatcaaaacagaagcccggtatttccgcaatgccacggggacctacgctaacaatgtggccattagaaagtggcttgtttccgattggcacgactgccggccgaaaaaggtgtctggaggccatatcaacgtcattgaggtgggggatgacctgacactccacaccgaggcttatgtttgtaatgccgattgcacaatcggagtggacaaggaaaccgcgcaggtccgcctgcaaacagataccacgaaccattttgaaatcgccggcaccacagtgaaaagcgggtggttcaagtccaccacatacattacccttgaccagacgtgtgagcacctgaaagtgtcttgcggacccaagagcatccagtttcatgcttgtttcaatcagcacatgtcctgcgtcagatttctccaccggacaattctgcctggcagcatcgcctcttccatttgtcaaaacgttgagatcattatcctgaccgtgctcacactgcttatcttcattctgctcagcatcctgtctaaaacctatatttgctacatccttatgcccatttttatccctctggcttatatctacggcgtgatttacaataagtcctgtaagaaatgcaagctctgcgggctggtctatcatcccttcaccgaatgtggaacacactgcgtgtgtggcgcccgctacgagacgagcgatagaatgaaactgcatcgggcgtctgggctctgccctggatataagtccctgcgcgccgctagagttatgtgtaaaagcaagggcccggcctccatcctttctattatcaccgctgtgctgattctcacatttgtcacccccatcaacgccatggtggccggggacacacaggaaaccttcaaactggaggatcttcctgacgacatgctgagcatggctatgaaggttaatatgtactatatcatgtgcatgattaactacgcggtgacgtggtccttcatcctctgtgccctgctgattgctctcctgtttaagaaatatcagcaccggttccttaatttttacgccatgtactgccacgagtgtgatatgtatcatgaccgcagcggactgaagtacaacggcgatttcacaaataaatgcagacagtgtacctgcggccaatatgaagacgccgctgggctcctgacccaccggaagacatacaactgccttgtccagtataaatctaagtggctgaccaactttctcatcgtgtacattatcctgatgctgattaaggattccgtcctcatcgtgcatgccgacggaacagatttcgagaaatgtagcggcgaagcggacatcacgtggaattgcaccgggccctttctgaaccttggaaattgtgagaagaaacagaagaaagaatcttataacaatattgctacacaactgaagggcctcgatgccatcagcgttctggacattcctatgatctccaagattcccgaggatatcgccggggctctgcgcttcatcgaggaacagagatcttaccacgtgcagcttaccgccgagtacgctatgctcacacggtattgcgactactatacccagtttacggacaacagcggatactcccaaaccacactgagagtctatctgcgcagccatgatttcaaagcctgtattctctacccgaatcagcacttttgccggtgtgtgaagcacggcgacaaatgcagctccagcaactgggatttcgcgaatgaaatgaagaactattactctggcaaacagtccaagtttgacaaggatctgaatcttgccctgatgagcctccatcacgctttcagagggacctcctctttctacatcgccaaactgctgaaggagaaaaagaacgaagaccttgttacatatgctgagaaaattaagggaaaataccctggcaatgccctcctgaaggcgatcattgattatatcaagtacatggaggacctgaccgaaatgaacaattttaaacatgatgagatgtgggacgatttcatctttgaagtgccccctacgaagtctccctccattcgccggctcgagtctagctatgacttcaaaacaaacgtcaactccaatcccagccacatctgtaagaacattaaaaccgtggtgtgcctgtctcctaagtccggggttagctacgattctatcattgcctgtggagaaccgtcccagcccagcatctatagaaagcctgactctcaagtctttcagagcaatgctgaccagacacacttctgcctttccgatacccattgcctggagaactacgagaccgtgggcgaagagatcattgacgccatcaaaaagagcgaatgttgggagacagagtttacggaatacattcagttcaaacaatctgatggggtgcgctcctgccggatgaaggacagcggcgagtgtaccgtcacaaccaatagatggcccatcattctctgcgataacgacaaattttattactccgaactgcagaaggattatgacaaggatcaggacatcggacacttctgtctgtctcctcgctgcaatacaattcggcatcccatcaacagaaaacacatcagcaattgtacctggcaagtgtcccataacaatattgataagatcgaggttcacgaacttgaggacctcgagcagtacaaaaaggctattacgcagaaactgcagacatctctgaccctctttaagtatagcaagaccaaaaacctgccgcacatcaagcctatgtacaaatatattacaatcgaaggcaccgagacagccgaagggatcgagtccgcctacattgaatctgagatccccgctcttgcgggaacgagcattggcttcaagatcacctccaaaagcgggaagcatctgctcgatgtgattggatacgtcaaatctgcctcctatagcgctgtgtacacaaagctgtataccacaggccctaccatcggggttaatacgaagcacgacgagctgtgcaccggcccctgtcctgtgaacgtcccccatggaacaggctggcttacctttgccaaagaacgcacatcttcctgggggtgcgaggagttcggatgtctcgccatcagcgacggctgcgtgttcgggtcttgccaagatattatcaaggacgaaattaccgtttaccggaaagaaacagaggagaccacggatgtggaactgtgtctgacatttgctgacaagacctattgcaccaatctcaacgccatcacaccgattatcaccgatcagttcgaggtccagtttaaaacggtggaagcgtactccctgcctagaattatcgctgtgcggaaccacgagatcatggtcggacagattaatgacatcggcgtttatagcaaggggtgtggcaacgtgcaaaaggtgaataacacaaattacggaaacggcgtccccaaattcgattacctttgccatctggcctcccgcaaggaggtgattgttagaaaatgttttgacaatgattatcaggcctgcaagttcctccagacccccgctagctaccggctggaagaggaagggggatctgtgacagtcatcgactataaaaagattctgggcaccatcaagatgaaagccatccttggggatgtgaagtacaaaacatttgcggacaacgttgacctgaccgtggagggagtctgtacgggctgcattaattgtttcgaaaacatccactgcgagctcaccattcacagcacagtggaggcttcctgtcctgttgtgtctagctgcaccgtctttcatgatagaatcctgattacaccgaatgaacacaagtatgccatcaaagtgatctgcaacgagaagcccgggcctaccctccccttcaagatttgttccgccaaaacggacgctgccatgacactggctgatgccaagcctatccttgaactggcgcccgtggaccagaccacatacattaaagagaaggatgaacgctgcaaaacctggatgtgtcgggtcagagacgagggctttcaagttatcttcgagcctttcaagaatctctttggatcttatattggcatcttctacacctttattatcagcctgatggccatcttcattgtgatctacattgtgctgcccatctgctttaaacttcgcgatacactgagacagcatgaagacgcttataagcgggagatgaagattcgctga

SEQ ID NO: 14259 - RNA, 4323 nt, synthetic construct
  misc_feature 1..4323: note = derived and/or modified CDS sequence (opt5) from TAHV(92' Bardos)__HM036209.1__GP
  source 1..4323: mol_type = other RNA
atgatgttcgtgctgtttttcatcgccctcagcgctgcctcccccgtctaccagagatgctttcaagacggcgcgattgttaagcagaacccttctaaacaggctgtgaccgaggtgtgtctgaaggatgacgtcagcatgatcaaaacagaagcccggtatttccgcaatgccacggggacctacgctaacaatgtggccattagaaagtggcttgtttccgattggcacgactgccggccgaaaaaggtgtctggaggccatatcaacgtcattgaggtgggggatgacctgacactccacaccgaggcttatgtttgtaatgccgattgcacaatcggagtggacaaggagaccgcgcaggtccgcctgcaaacagataccacgaaccattttgaaatcgccggcaccacagtgaaaagcgggtggttcaagtccaccacatacattacccttgaccagacgtgtgagcacctgaaagtgtcttgcggacccaagagcatccagtttcatgcttgtttcaatcagcacatgtcctgcgtcagatttctccaccggacaattctgcctggcagcatcgcctcttccatttgtcaaaacgttgagatcattatcctgaccgtgctcacactgcttatcttcattctgctcagcatcctgtctaaaacctatatttgctacatccttatgcccatttttatccctctggcttatatctacggcgtgatttacaataagtcctgtaagaaatgcaagctctgcgggctggtctatcatcccttcaccgaatgtggaacacactgcgtgtgtggcgcccgctacgagacgagcgatagaatgaaactgcatcgggcgtctgggctctgccctggatataagtccctgcgcgccgctagagttatgtgtaaaagcaagggcccggcctccatcctttctattatcaccgctgtgctgattctcacatttgtcacccccatcaacgccatggtggccggggacacacaggaaaccttcaaactggaggatcttcctgacaatatgctgagcatggctatgaaggttaacatgtactatatcatgtgcatgattaattacgcggtgacgtggtccttcatcctctgtgccctgctgattgctctcctgtttaagaaatatcagcaccggttccttaacttttacgccatgtactgccacgagtgtgacatgtatcatgatcgcagcggactgaagtacaatgaagacttcacaaacaaatgcagacagtgtacctgcggccaatatgaggatgccgctggcctcctgacccaccggaagacatacaactgccttgtccagtataaatctaagtggctgaccaattttctcatcgtgtacattatcctgatgctgattaaggactccgtcctcatcgtgcatgccgatgggacagacttcgaaaaatgtagcggagaggcggatatcacgtggaactgcaccggcccctttctgaatcttgggaactgtgaaaagaaacagaagaaagagtcttataataacattgctacacaactgaagggactcgacgccatcagcgttctggatatttccatgatctctaagattcctgaggacatcgccggcgctctgcgcttcatcgaagaacagagaagctaccacgtgcagcttaccgccgaatacgctatgctcacacggtattgcgattactatacccagtttacggacaattccgggtacagccaaaccacatggagagtctatctgcgctctcatgacttcgaggcctgtattctgtaccccaaccagcacttttgccggtgtgtgaaacacggagataagtgctccagctctaattgggacttcgcgaacgaaatgaaaaatttttattccggcaagcagagcaaattcgataaggacctcaacctggcccttatgtccctgcatcacgctttcagaggcacctctagcttttacatcgccaagctcctgaaagagaagaaaaatgaggatctggttacatacgctgaaaagattaaagggaagtatccgggaaacgcccttctcaaagcgatcattgactacatcaagtatatggaggatctgaccgaaatgaataacttcaagtacgacgagatgtgggatgactttatcttcgaagtgcctcccacgaaatccccttctattcgccggctggagagctcctatgattttaagacaaacgtcaatagcaacccctctcatatctgtaaaaatattaagaccgtggtgtgcctctcccccaaaagcggcgtttcttacgactccatcattgcctgtggggagcctagccagccgtctatctatagaaagcccgatagccaagtcttccagtccaacgctgaccagacacacttttgcctgagcgacacccactgccttgaaaattacgagaccgtgggagaagagatcattgatgccatcaagaaatctaagtgttgggagacagagttcacggaatacattcagtttaaacaatccgacggcgtgcgcagctgccggatgaaggattccggggaatgtaccgtcacaaccaacagatggcctatcattctgtgcgacaatgataaattctattactctgagctccagaaggactatgataaggaccaggatatcggccatttttgtctgagcccccgctgcaacacaattcggcaccctatcaatagaaaacatatctccaactgtacctggcaagtgtctcacaataacattgacaagatcgaagttcatgagctggaggatcttgaacagtacaaaaaggctattacgcagaaactccagacaagcctgaccctgttcaagtattccaagaccaaaaatctcccccacatcaagccgatgtacaaatatattacaatcgagggaaccgaaacagccgagggcatcgaatctgcctacattgagagcgagatccctgctctggcggggacgtccattggatttaagatcaccagcaaatctggcaagcaccttctggacgtgattgggtacgtcaaatccgccagctattctgctgtgtacacaaagctctataccacaggacccaccatcggcgttaacacgaagcatgatgaactgtgcaccgggccttgtcccgtgaatgtccctcacggcacaggatggctgaccttcgccaaagagcgcacatccagctggggctgcgaagagttcgggtgtcttgccatctctgacggatgcgtgtttggctcctgccaagacattatcaaggatgaaattaccgtttaccggaaagagacagaggaaaccacggacgtggagctctgtctgacattcgctgataagacctattgcaccaacctgaacgccatcacacccattatcaccgaccagtttgaagtccagttcaaaacggtggaggcgtacagcctcccgagaattatcgctgtgcggaatcatgagatcatggtcgggcagattaacgatatcggagtttattccaagggctgtgggaatgtgcaaaaggtgaacaatacaaactacggcaatggagtccctaaatttgactacctgtgccaccttgccagccgcaaggaagtgattgttagaaaatgtttcgataacgactatcaggcctgcaagtttctgcagacccccgcttcttaccggctcgaggaagagggcgggagcgtgacagtcatcgattataaaaagattctgggaaccatcaagatgaaagccatcctgggcgacgtgaagtacaaaacattcgcggataatgttgaccttaccgtggaaggggtctgtacgggatgcattaactgttttgagaatatccattgcgagctgaccattcactccacagtggaggcttcttgtcccgttgtgagctcctgcaccgtcttccacgacagaatcctcattacacctaacgaacataagtatgccatcaaagtgatctgcaatgaaaagccgggccccaccctgccttttaagatttgttctgccaaaacggatgctgccatgacactcgctgacgccaagcccatcctggagcttgcgcctgtggatcagaccacatacattaaagaaaaggacgagcgctgcaaaacctggatgtgtcgggtcagagatgaggggttccaagttatcttcgaaccctttaagaacctgttcggcagctatattggaatcttttacaccttcattatctccctcatggccatctttattgtgatctacattgtgctgcctatctgcttcaagctgcgcgacacacttagacagcacgaggatgcttataaacgggaaatgaagattcgctga

SEQ ID NO: 14260 - RNA, 4323 nt, synthetic construct
  misc_feature 1..4323: note = derived and/or modified CDS sequence (opt5) from TAHV(92' Bardos)__HM036212.1__GP
  source 1..4323: mol_type = other RNA
atgatgttcgtgctgtttttcatcgccctcagcgctgcctcccccgtctaccagagatgctttcaagacggcgcgattgttaagcagaacccttctaaacaggctgtgaccgaggtgtgtctgaaggatgacgtcagcatgatcaaaacagaagcccggtatttccgcaatgccacggggacctacgctaacaatgtggccattagaaagtggcttgtttccgattggcacgactgccggccgaaaaaggtgtctggaggccatatcaacgtcattgaggtgggggatgacctgacactccacaccgaggcttatgtttgtaatgccgattgcacaatcggagtggacaaggagaccgcgcaggtccgcctgcaaacagataccacgaaccattttgaaatcgccggcaccacagtgaaaagcgggtggttcaagtccaccacatacattacccttgaccagacgtgtgagcacctgaaagtgtcttgcggacccaagagcatccagtttcatgcttgtttcaatcagcacatgtcctgcgtcagatttctccaccggacaattctgcctggcagcatcgcctcttccatttgtcaaaacgttgagatcattatcctgaccgtgctcacactgcttatcttcattctgctcagcatcctgtctaaaacctatatttgctacatccttatgcccatttttatccctctggcttatatctacggcgtgatttacaataagtcctgtaagaaatgcaagctctgcgggctggtctatcatcccttcaccgaatgtggaacacactgcgtgtgtggcgcccgctacgagacgagcgatagaatgaaactgcatcgggcgtctgggctctgccctggatataagtccctgcgcgccgctagagttatgtgtaaaagcaagggcccggcctccatcctttctattatcaccgctgtgctgattctcacatttgtcacccccatcaacgccatggtggccggggacacacaggaaaccatcaaactggaggatcttcctgacgacatgctgagcacggctatgaaggttaatatgtactatattatgtgcatgatcaactacgcggtgacatggtccttcattctctgtgccctgctgatcgctctcctgttcaagaaatatcagcaccggtttcttaatttctacgccatgtactgccacgagtgtgatatgtatcatgaccgcagcggactgaagtacaacgaagattttaccaataaatgcagacagtgtacctgcggccaatatgaggacgccgctggcctcctgacacaccggaagacctacaactgccttgtccagtataaatctaagtggctgacaaacttcctcattgtgtacatcattctgatgctgatcaaggattccgtcctcatcgtgcatgccgacgggacggattttgaaaaatgtagcggagaggcggacattacctggaattgcacaggccccttcctgaaccttgggaattgtgaaaagaaacagaagaaagagtcttataacaatatcgctacccaactgaagggactcgatgccattagcgttctggacatctccatgatttctaagatccctgaggatatcgccggcgctctgcgctttattgaagaacagagaagctaccacgtgcagcttacagccgaatacgctatgctcacccggtattgcgactactatacgcagttcaccgacaactccgggtacagccaaacaacctggagagtctatctgcgctctcatgattttaaagcctgtatcctgtaccccaatcagcacttctgccggtgtgtgaagcacggagacaaatgctccagctctaactgggattccgcgaatgagatgaagaacttttatagcggcaatcagtccaaattcgacaaggatctcaacctggcccttatgtctctgcatcacgcttttagaggcacaagctccttctacattgccaagctcctgaaagaaaagaaaaatgaggacctggttacctacgctgagaagatcaaagggaagtatccgggaaacgcccttctcaaagcgattatcgattacatcaagtatatggaagacctgacggagatgaataacttcaagtacgatgaaatgtgggacgattttattttcgaggtgcctcccacaaaatctcctagcatccgccggctggaatccagctatgactttaagaccaacgtcaattctaacccctcccatatttgtaaaaatatcaagacagtggtgtgcctcagccccaaatctggcgtttcctacgatagcattatcgcctgtggggagccttctcagccgagcatctatagaaagcccgactcccaagtcttccagagcaacgctgaccagacccacttttgcctgtctgatacccactgccttgagaattacgaaacagtgggagaggaaattatcgacgccattaagaaatccaagtgttgggagacggagttcaccgaatacatccagtttaaacaaagcgatggcgtgcgctcctgccggatgaaggactctggggagtgtacagtcaccacaaacagatggcctattatcctgtgcgataatgacaaattctattacagcgaactccagaaggattatgacaaggatcaggacattggccatttttgtctgtcccccagatgcaacaccatccggcaccctatcaatagaaaacatatttctaactgtacgtggcaagtgagccacaataacatcgataagattgaggttcatgaactggaggaccttgagcagtacaaaaaggctatcacacagaaactccagacctccctgaccctgttcaagtattctaagaccaaaaatctcccccacattaagccgatgtacaaatatatcacaatcgaaggaacagagacggccgaaggcattgagagcgcctacatcgaatccgagattcctgctctggcggggaccagcatcggatttaagattacatctaaatccggcaagcaccttctggatgtgatcgggtacgtcaaaagcgcctcttattccgctgtgtacaccaagctctatacaaccggacccacgatcggcgttaacaccaagcatgacgagctgtgcacagggccttgtcccgtgaatgtccctcacggcaccggatggctgacattcgccaaagaacgcaccagctcttggggctgcgaggaatttgggtgtcttgccatttccgacggatgcgtgttcggcagctgccaagatatcattaaggacgagatcacagtttaccggaaagaaaccgaggagacgacagatgtggaactctgtctgaccttcgctgacaagacctattgcacaaacctgaacgccattacccccatcattacggatcagtttgaggtccagttcaaaacagtggaagcgtactccctcccgagaatcatcgctgtgcggaatcatgagattatggtcgggcagatcaacgacattggagtttatagcaagggctgtgggaatgtgcaaaaggtgaacaataccaactacggcaatggagtccctaaatttgattacctgtgccaccttgcctctcgcaaggaggtgatcgttagaaaatgtttcgacaacgattatcaggcctgcaagtttctgcagacacccgctagctaccggctcgaagaggaaggcgggtccgtgaccgtcattgactataaaaagatcctgggaacaatcaagatgaaagccattctgggcgatgtgaagtacaaaaccttcgcggacaatgttgaccttacggtggagggggtctgtaccggatgcatcaactgttttgaaaatattcattgcgagctgacaatccactctaccgtggaggctagctgtcccgttgtgtcctcttgcacagtcttccacgatcgcattctcatcacccctaacgaacataagtatgccatcaaagtgatttgcaatgagaagccgggccccacgctgccttttaagatctgtagcgccaaaacagacgctgccatgaccctcgctgatgccaagcccattctggaacttgcgcctgtggaccagacaacctacatcaaagagaaggatgaacgctgcaaaacctggatgtgtcgggtcagagacgaggggttccaagttatttttgagcccttcaagaacctgttcggctcctatatcggaatcttttacacattcattatctctctcatggccatttttatcgtgatttacatcgtgctgcctatttgcttcaagctgcgcgatacgcttagacagcacgaagacgcttataaacgggagatgaagatccgctga

SEQ ID NO: 14261 - RNA, 4323 nt, synthetic construct
  misc_feature 1..4323: note = derived and/or modified CDS sequence (opt5) from TAHV(Souche D C14019-29)__HM036215.1__GP
  source 1..4323: mol_type = other RNA
atgatgttcgtgctgtttttcatcgccctcagcgctgcctcccccgtctaccagagatgctttcaagacggcgcgattgttaagcagaacccttctaaacaggctgtgaccgaggtgtgtctgaaggatgacgtcagcatgatcaaaacagaagcccggtatttcaagaatgccacggggacctacgctaacaatgtggccattcgcaaatggcttgtttccgattggcacgactgcagaccgaagaaggtgtctggaggccatatcaacgtcattgaggtgggggatgacctgacactccacaccgaggcttatgtttgtaatgccgattgcacaatcggagtggacaaagaaaccgcgcaggtccggctgcaaacagataccacgaaccattttgaaatcgccggcaccacagtcaagagcgggtggttcaaatccaccacatacattacccttgaccagacgtgtgagcacctgaaggtgtcttgcggacccaaaagcatccagtttcatgcttgtttcaatcagcacatgtcctgcgtgcgctttctccacagaacaattctgcctggcagcatcgcctcttccatttgtcaaaacgttgagatcattatcctgaccgtgctcacactgcttatcttcattctgctcagcatcctgtctaagacctatatttgctacatccttatgcccatttttatccctctggcttatatctacggcgtgatttacaataagtcctgtaaaaagtgcaaactctgcgggctggtctatcatcccttcaccgaatgtggaacacactgcgtgtgtggcgcccggtacgagacgagcgatcgcatgaagctgcatagagcgtctgggctctgccctggatataaatccctgcgggccgctcgcgttatgtgtaagagcaaaggcccggcctccatcctttctattatcaccgctgtgctgattctcacatttgtcacccccatcaacgccatggtggccggggacacacaggaaaccttcaagctggaggatcttcctgacgacatgctgagcatggctatgaaggttaatatgtactatatcatgtgcatgattaactacgcggtgacgtggtccttcatcctctgtgccctgctgattgctctcctgtttaaaaagtatcagcacagattccttaatttttacgccatgtactgccacgagtgtgatatgtatcatgaccggagcggactgaaatacaacggcgatttcacaaataagtgccgccagtgtacctgcggccaatatgaagacgccgctgggctcctgacccacagaaaaacatacaactgccttgtccagtataagtctaagtggctgaccaactttctcatcgtgtacattatcctgatgctgattgaggattccgtcctcatcgtgcatgccgacggaacagatttcgaaaaatgtagcggcgaggcggacatcacgtggaattgcaccgggccctttctgaaccttggaaattgtgaaaagaaacagaagaaagagtcttataacaatattgctacacaactgaagggcctcgatgccatcagcgttctggacattcctatgatctccaagattcccgaggatatcgccggggctctgcggttcatcgaggaacagcgctcttaccacgtgcagcttaccgccgaatacgctatgctcacaagatattgcgactactatacccagtttacggacaacagcggatactcccaaaccacatggcgggtctatctgagaagccatgatttcgaggcctgtattctgtacccgaatcgccacttttgccggtgtgtgaaacacggcgacaagtgttcttccagcaactgggatttcgcgaatgaaatgaaaaactattactctggcaagcagtccaaatttaataaggacctcaacctggcccttatgagcctgcatcacgctttcagagggacctcctctttctacatcgccaagctcctgaaagagaagaaaaatgaggatctggttacatatgctgaaaagattaaaggaaagtaccctggcaacgcccttctcaaagcgatcattgactatatcaagtacatgaaggatctgaccgagatgaataactttaaacatgacgaaatgtgggaggatttcatctttgaagtgccccctacaaagagcccctccgtccgccggctggagtctagctatgacttcaaaacgaacgttaattccaaccccagccacatttgcaagaatatcaaaaccgtggtgtgcctctctcctaagtccggggtcagctacgattctattatcgcctgtggagagccgtcccagcccagcatttatagaaagcctgactctcaggtgtttcaaagcaacgctgatcagacacacttctgcctgtccgacacccattgccttgaaaattacgagaccgtgggcgaagagatcatcgacgccattaaaaagagcaaatgttgggagacagaatttacggagtacatccagttcaagcagtctgatggggtccgctcctgccggatgaaagacagcggcgaatgtaccgtggctacaaacagatggcccattatcctgtgcgataataacaagttttattactccgagctccaagaagactatgataaggaccaggatattggacacttctgtctgtctcctcgctgcaataccatccggcatcccattaacagaaaacacatcagcaattgtacatggcaggtttcccataacaatatcgacaagattgaggtgcacgagctggaagatcttgagcagtacaaaaaggccatcacccaaaaactccagacgtctctgacactgtttaagtatagcaagaccaaaaacctcccgcacattaagcctatgtacaaatatatcaccattgaaggcacagagaccgccgaagggatcgagtccgcttacatcgagtctgaaattcccgcgctggccggaacaagcatcggcttcaagattacgtccaaaagcgggaagcatcttctggacgtcatcggatacgtgaaatctgcttcctatagcgccgtttacaccaagctctatacaaccggccctacaattggggtgaataccaagcacgatgagctgtgcacgggcccctgtcctgtcaacgtgccccatggaaccggctggctgacatttgccaaagaacgcacctcttcctgggggtgcgaggagttcggatgtcttgctatcagcgacggctgcgttttcgggtcttgccaggatatcattaaggacgaaatcacagtgtaccggaaagagaccgaagagacaaccgacgtcgaactctgtctgacgtttgccgataagacatattgcaccaacctgaatgcgattaccccgatcattacagaccaattcgaggtgcagtttaaaaccgtggaggcttactccctccctagaatcattgccgtccggaaccacgaaatcatggttggacagatcaatgatattggcgtgtatagcaaggggtgtggcaacgtgcagaaggtcaataacacgaattacggaaacggcgtgcccaaattcgactacctgtgccatcttgcctcccgcaaggaggttatcgtgagaaaatgttttgataatgactatcaggcttgcaagttcctgcaaacacccgccagctaccggctcgaagaggaagggggatctgtcaccgtgattgattataaaaagatcctgggcacaattaagatgaaagcgatcctgggggacgttaagtacaaaacctttgctgataacgtggaccttacagtcgagggagtgtgtaccggctgcatcaattgtttcgagaacattcactgcgaactgacgatccacagcaccgttgaggcctcctgtcctgtggtctctagctgcacagtgtttcatgatcgcattctcatcaccccgaatgaacacaagtatgccattaaagtgatctgcaacgagaagcccgggcctatcctgcccttcaagatttgttccgctaaaacagacgccgctatgaccctcgccgacgcgaagcctatcctggaacttgcccccgtcgatcagacgacatacattaaagagaaggacgagagatgcaaaacctggatgtgtcgggttagagatgaaggctttcaggtgatcttcgagcctttcaagaatctgtttggatcttatattggcatcttctacacatttattatcagcctcatggctatcttcattgtgatctacattgtcctgcccatctgctttaagattcgcgacaccctgagacaacatgaagatgcctataaacgggagatgaagatccgctga

SEQ ID NO: 14262 - RNA, 4323 nt, synthetic construct
  misc_feature 1..4323: note = derived and/or modified CDS sequence (opt5) from TAHV(1014)__GQ386833.1__GP
  source 1..4323: mol_type = other RNA
atgatgttcgtgctgtttttcatcgccctcagcgctgcctcccccgtctaccagagatgctttcaagacggcgcgattgttaagcagaacccttctaaacaggctgtgaccgaggtgtgtctgaaggatgacgtcagcatgatcaaaacagaagcccggtatttccgcaatgccacggggacctacgctaacaatgtggccattagaaagtggcttgtttccgattggcacgactgccggccgaaaaaggtgtctggaggccatatcaacgtcattgaggtgggggatgacctgacactccacaccgaggcttatgtttgtaatgccgattgcacaatcggagtggacaaggaaaccgcgcaggtccgcctgcaaacagataccacgaaccattttgaaatcgccggcaccacagtgaaaagcgggtggttcaagtccaccacatacattacccttgaccagacgtgtgagcacctgaaagtgtcttgcggacccaagagcatccagtttcatgcttgtttcaatcagcacatgtcctgcgtcagatttctccaccggacaattctgcctggcagcatcgcctcttccatttgtcaaaacgttgagatcattatcctgaccgtgctcacactgcttatcttcattctgctcagcatcctgtctaaaacctatatttgctacatccttatgcccatttttatccctctggcttatatctacggcgtgatttacaataagtcctgtaagaaatgcaagctctgcgggctggtctatcatcccttcaccgaatgtggaacacactgcgtgtgtggcgcccgctacgagacgagcgatagaatgaaactgcatcgggcgtctgggctctgccctggatataagtccctgcgcgccgctagagttatgtgtaaaagcaagggcccggcctccatcctttctattatcaccgctgtgctgattctcacatttgtcacccccatcaacgccatggtggccggggacacacaggaaaccttcaaactggaggatcttcctgacgacatgctgagcatggctatgaaggttaatatgtactatatcatgtgcatgattaactacgcggtgacgtggtccttcatcctctgtgccctgctgattgctctcctgtttaagaaatatcagcaccggttccttaatttttacgccatgtactgccacgagtgtgatatgtatcatgaccgcagcggactgaagtacaacggcgatttcacaaataaatgcagacagtgtacctgcggcaagtatgaagacgccgctgggctcctgacccaccggaaaacatacaactgccttgtccaatataagtctaagtggctgaccaactttctcatcgtgtacattatcctgatgctgattaaagattccgtcctcatcgtgcatgccgacggaacagatttcgagaagtgtagcggcgaagcggacatcacgtggaattgcaccgggccctttctgaaccttggaaattgtgagaaaaagcagaaaaaggaatcttataacaatattgctacacagctgaagggcctcgatgccatcagcgttctggacattcctatgatctccaaaattcccgaggatatcgccggggctctgcgcttcatcgaggaacaaagatcttaccacgtgcagcttaccgccgagtacgctatgctcacacggtattgcgactactatacccagtttacggacaacagcggatactcccagaccacatggagagtctatctgcgcagccatgatttcgaagcctgtattctgtacccgaatcaacacttttgccggtgtgtgaagcacggcgacaaatgttcttccagcaactgggatttcgcgaatgagatgaagaactattactctggcaaacagtccaagtttgacaaggatctcaatctggcccttatgagcctgcatcacgctttcagagggacctcctctttctacatcgccaaactcctgcgcgaaaagaaaaacgaggacctggttacatatgtggagaagattaaaggaaagtaccctggcaatgcccttctcaaagctatcattgattatatcaagtacatgaaggggctgaccgaaatgaacaatagcaaacatgacgagatgtgggatgactttatcttcgaagtgccccctacgaagtccccctctgtgcggagactggagagctcctatgattttaaaacaaacgtgaacagcaatccctctcacatttgcaagaacatcaaaaccgttgtctgcctctcccctaagagcggagtgtcttacgactccattatcgcgtgtggcgaaccgagccagccctctatttatcgcaagcctgatagccaggtgttccaatccaatgccgaccagacacacttttgcctgagcgacacccattgccttgagaacttcgagaccgtcggggaagagatcatcgatgctattaaaaagtctaaatgttgggaaacagagtttacggagtacatccagttcaagcagtccgacggcgtgcggagctgcagaatgaaagattccggagaatgtaccgttacaaccaatcgctggcccattatcctgtgcgacaacgataagttttactattctgagctccaaaaggactacgataaaggccaggacattgggcacttctgtctgagccctcggtgcaatacaatcagacatcccattaaccgcaagcacatctccaattgtacctggcaggtcaaccataataacatcgataaaattgaagtccacgagctggaagaccttgagcagtataagaaagccatcacgcaaaagctccagacatctctgaccctgtttaagtacagcaaaaccaagaatctcccgcacattaaacctatgtataagtacatcacaattgagggaaccgaaacagctgagggcatcgaatccgcctatatcgagtctgaaattcccgccctggctgggacgagcatcggattcaaaattacctccaagagcggcaaacatcttctggatgtgatcgggtacgttaagtctgcgtcctacagcgccgtgtatacaaagctctacaccacaggccctaccattggagtcaacacgaaacacgacgagctgtgcaccggcccctgtcctgtgaatgttccccatgggacaggatggctgacctttgctaaggagcggacatcttcctggggctgcgaagagttcgggtgtcttgccatcagcgatggatgcgtgttcggctcttgccaggacatcattaaagacgaaatcaccgtctatagaaaggagacagaagagaccacggatgtggagctctgtctgacatttgccgacaaaacctactgcaccaacctgaacgctattacaccgatcattaccgatcaattcgaagtgcagtttaagacggtcgaggcctattccctccctcggatcattgcggttcgcaatcacgaaatcatggtggggcagatcaacgacattggcgtgtacagcaagggatgtggcaatgtccagaaagtgaacaatacaaactatgggaatggagttcccaagttcgattacctgtgccatcttgcttccagaaaagaggtgatcgtccggaagtgtattgacaacgattaccaagcctgcaaatttctgcagacccccgccagctatagactcgaggaagagggcgggtctgtgacagttatcgactacaagaagattctgggaaccatcaaaatgaaggctatcctgggcgatgtgaaatataagacattcgccgacaatgtcgatcttaccgtggaaggggtttgtacgggctgcattaactgttttgagaatatccactgcgaactgaccattcacagcacagtggaggcgtcctgtcctgtcgtgtctagctgcaccgtgttccatgaccgcatcctcattacaccgaacgagcacaaatacgctatcaaggtcatctgcaatgaaaagcccggacctaccctgccctttaaaatttgttccgccaagacggacgccgctatgacactcgccgatgctaaacctatcctggagcttgcccccgttgaccagaccacatatattaaggaaaaagatgagcggtgcaagacctggatgtgtagagtgcgcgacgaaggcttccaggtgatctttgagcctttcaagaacctgttcgggtcttacattggaatcttttataccttcattatcagcctcatggcgatctttattgtcatctacattgtgctgcccatctgcttcaaactgagagatacacttcggcaacatgaggacgcctacaagcgcgaaatgaaaattagatga

SEQ ID NO: 14263 - RNA, 4323 nt, synthetic construct
  misc_feature 1..4323: note = derived and/or modified CDS sequence (opt5) from TAHV(105)__GQ386829.1__GP
  source 1..4323: mol_type = other RNA
atgatgttcgtgctgtttttcatcgccctcagcgctgcctcccccgtctaccagagatgctttcaagacggcgcgattgttaagcagaacccttctaaacaggctgtgaccgaggtgtgtctgaaggatgacgtcagcatgatcaaaacagaagcccggtatttccgcaatgccacggggacctacgctaacaatgtggccattagaaagtggcttgtttccgattggcacgactgccggccgaaaaaggtgtctggaggccatatcaacgtcattgaggtgggggatgacctgacactccacaccgaggcttatgtttgtaatgccgattgcacaatcggagtggacaaggagaccgcgcaggtccgcctgcaaacagataccacgaaccattttgaaatcgccggcaccacagtgaaaagcgggtggttcaagtccaccacatacattacccttgaccagacgtgtgagcacctgaaagtgtcttgcggacccaagagcatccagtttcatgcttgtttcaatcagcacatgtcctgcgtcagatttctccaccggacaattctgcctggcagcatcgcctcttccatttgtcaaaacgttgagatcattatcctgaccgtgctcacactgcttatcttcattctgctcagcatcctgtctaaaacctatatttgctacatccttatgcccatttttatccctctggcttatatctacggcgtgatttacaataagtcctgtaagaaatgcaagctctgcgggctggtctatcatcccttcaccgaatgtggaacacactgcgtgtgtggcgcccgctacgagacgagcgatagaatgaaactgcatcgggcgtctgggctctgccctggatataagtccctgcgcgccgctagagttatgtgtaaaagcaagggcccggcctccatcctttctattatcaccgctgtgctgattctcacatttgtcacccccatcaacgccatggtggccggggacacacaggaaaccttcaaactggaggatcttcctgacgacatgctgagcatggctatgaaggttaatatgtactatatcatgtgcatgattaactacgcggtgacgtggtccttcatcctctgtgccctgctgattgctctcctgtttaagaaatatcagcaccggttccttaatttttacgccatgtactgccacgagtgtgatatgtatcatgaccgcagcggactgaagtacaacggcgatttcacaaataaatgcagacagtgtacctgcggccaatatgaagacgccgctgggctcctgacccaccggaagacatacaactgccttgtccagtataaatctaagtggctgaccaactttctcatcgtgtacattatcctgatgctgattaaggattccgtcctcatcgtgcatgccgacggaacagatttcgagaaatgtagcggcgaagcggacatcacgtggaattgcaccgggccctttctgaaccttggaaattgtgagaagaaacagaagaaagaatcttataacaatattgctacacaactgaagggcctcgatgccatcagcgttctggacattcctatgatctccaagattcccgaggatatcgccggggctctgcgcttcatcgaggaacagagatcttaccacgtgcagcttaccgccgagtacgctatgctcacacggtattgcgactactatacccagtttacggacaacagcggatactcccaaaccacatggagagtctatctgcgcagccatgatttcgaagcctgtattctgtacccgaatcagcacttttgccggtgtgtgaaacacggcgacaagtgcagctccagcaactgggatttcgcgaatgagatgaaaaactattactctggcaagcagtccaaatttgacaaggatctcaatctggcccttatgagcctgcatcacgctttcagagggacctcctctttctacatcgccaagctcctgaaagaaaagaaaaacgaggacctggttacatatgctgagaagattaaaggaaagtaccctggcaatgcccttctcaaagcgatcattgattatatcaagtacatgaaggacctgaccgaaatgaacaattttaaacatgatgagatgtgggacgatttcatctttgaagtgccccctacgaagtctccctccgtccgccggctggagtctagctatgacttcaaaacaaacgtgaactccaatcccagccacatttgtaagaacatcaaaaccgtggtttgcctctctcctaagtccggggtcagctacgattctattatcgcctgtggagaaccgtcccagcccagcatttatagaaagcctgactctcaagtgtttcagagcaatgctgaccagacacacttctgcctgtccgatacccattgccttgagaactacgagaccgtgggcgaagagatcatcgacgccattaaaaagagcaaatgttgggaaacagagtttacggagtacatccagttcaagcaatctgatggggtccgctcctgccggatgaaagacagcggcgaatgtaccgtgacaaccaatagatggcccattatcctgtgcgataacgacaagttttattactccgagctccagaaggattatgacaaagatcaggacattggacacttctgtctgtctcctcgctgcaatacaatccggcatcccattaacagaaagcacatcagcaattgtacctggcaggtttcccataacaatatcgataaaattgaagtgcacgagctggaagaccttgagcaatacaagaaagctatcacgcagaagctccagacatctctgaccctgtttaagtatagcaaaaccaagaacctcccgcacattaaacctatgtacaagtatatcacaattgagggcaccgaaacagccgaggggatcgaatccgcctacatcgagtctgaaattcccgctctggcgggaacgagcatcggcttcaaaattacctccaagagcgggaaacatcttctggatgtcatcggatacgtgaagtctgcctcctatagcgctgtttacacaaagctctataccacaggccctaccattggggtgaatacgaaacacgacgagctgtgcaccggcccctgtcctgtcaacgtgccccatggaacaggctggctgacctttgccaaggagcgcacatcttcctgggggtgcgaagagttcggatgtcttgccatcagcgacggctgcgttttcgggtcttgccaagatatcattaaagacgaaatcaccgtgtaccggaaggagacagaagagaccacggatgtcgagctctgtctgacatttgctgacaaaacctattgcaccaatctgaacgccattacaccgatcattaccgatcagttcgaagtgcagtttaagacggtggaggcgtactccctccctagaatcattgctgtccggaaccacgaaatcatggttggacagatcaatgacattggcgtgtatagcaaggggtgtggcaacgtgcaaaaagtcaataacacaaattacggaaacggcgtgcccaagttcgattacctgtgccatcttgcctcccgcaaagaggttatcgtgagaaagtgttttgacaatgattatcaggcctgcaaattcctgcagacccccgctagctaccggctcgaggaagaagggggatctgtcacagtgattgactataagaagatcctgggcaccattaaaatgaaggccatcctgggggatgttaaatacaagacatttgcggacaacgtggaccttaccgtcgaaggagtgtgtacgggctgcatcaattgtttcgagaacattcactgcgaactgaccatccacagcacagttgaggcttcctgtcctgtggtctctagctgcaccgtgtttcatgatcgcattctcatcacaccgaatgagcacaaatatgccattaaggtgatctgcaacgaaaagcccgggcctaccctgcccttcaaaatctgttccgccaagacggacgctgccatgacactcgctgatgccaaacctattctggagcttgcgcccgtcgaccagaccacatacatcaaggaaaaagatgagagatgcaagacctggatgtgtcgggttagagacgaaggctttcaagtgattttcgagcctttcaagaatctgtttggatcttatatcggcattttctacacctttatcattagcctcatggccatcttcatcgtgatttacatcgtcctgcccatttgctttaaactgcgcgatacacttagacagcatgaggacgcttataagcgggaaatgaaaatccgctga

SEQ ID NO: 14264 - RNA, 4323 nt, synthetic construct
  misc_feature 1..4323: note = derived and/or modified CDS sequence (opt5) from TAHV(106)__GQ386830.1__GP
  source 1..4323: mol_type = other RNA
atgatgttcgtgctgtttttcatcgccctcagcgctgcctcccccgtctaccagagatgctttcaagacggcgcgattgttaagcagaacccttctaaacaggctgtgaccgaggtgtgtctgaaggatgacgtcagcatgatcaaaacagaagcccggtatttccgcaatgccacggggacctacgctaacaatgtggccattagaaagtggcttgtttccgattggcacgactgccggccgaaaaaggtgtctggaggccatatcaacgtcattgaggtgggggatgacctgacactccacaccgaggcttatgtttgtaatgccgattgcacaatcggagtggacaaggagaccgcgcaggtccgcctgcaaacagataccacgaaccattttgaaatcgccggcaccacagtgaaaagcgggtggttcaagtccaccacatacattacccttgaccagacgtgtgagcacctgaaagtgtcttgcggacccaagagcatccagtttcatgcttgtttcaatcagcacatgtcctgcgtcagatttctccaccggacaattctgcctggcagcatcgcctcttccatttgtcaaaacgttgagatcattatcctgaccgtgctcacactgcttatcttcattctgctcagcatcctgtctaaaacctatatttgctacatccttatgcccatttttatccctctggcttatatctacggcgtgatttacaataagtcctgtaagaaatgcaagctctgcgggctggtctatcatcccttcaccgaatgtggaacacactgcgtgtgtggcgcccgctacgagacgagcgatagaatgaaactgcatcgggcgtctgggctctgccctggatataagtccctgcgcgccgctagagttatgtgtaaaagcaagggcccggcctccatcctttctattatcaccgctgtgctgattctcacatttgtcacccccatcaacgccatggtggccggggacacacaggaaaccttcaaactggaggatcttcctgacgacatgctgagcatggctatgaaggttaatatgtactatatcatgtgcatgattaactacgcggtgacgtggtccttcatcctctgtgccctgctgattgctctcctgtttaagaaatatcagcaccggttccttaatttttacgccatgtactgccacgagtgtgatatgtatcatgaccgcagcggactgaagtacaacggcgatttcacaaataaatgcagacagtgtacctgcggccaatatgaagacgccgctgggctcctgacccaccggaagacatacaactgccttgtccagtataaatctaagtggctgaccaactttctcatcgtgtacattatcctgatgctgattaaggattccgtcctcatcgtgcatgccgacggaacagatttcgagaaatgtagcggcgaagcggacatcacgtggaattgcaccgggccctttctgaaccttggaaattgtgagaagaaacagaagaaagaatcttataacaatattgctacacaactgaagggcctcgatgccatcagcgttctggacattcctatgatctccaagattcccgaggatatcgccggggctctgcgcttcatcgaggaacagagatcttaccacgtgcagcttaccgccgagtacgctatgctcacacggtattgcgactactatacccagtttacggacaacagcggatactcccaaaccacatggagagtctatctgcgcagccatgatttcgaagcctgtattctgtacccgaatcagcacttttgccggtgtgtgaaacacggcgacaagtgttcttccagcaactgggatttcgcgaatgagatgaaaaactattactctggcaagcagtccaaatttgacaaggatctcaatctggcccttatgagcctgcatcacgctttcagagggacctcctctttctacatcgccaagctcctgaaagaaaagaaaaacgaggacctggttacatatgctgagaagattaaaggaaagtaccctggcaatgcccttctcaaagcgatcattgattatatcaagtacatgaaggggctgaccgaaatgaacaattttaaacatgacgagatgtgggatgacttcatcagcgaagtgccccctacgaagtccccctctgtccgccggctggagagctcctatgattttaaaacaaacgtgaacagcaatccctctcacatttgcaagaacatcaaaaccgtggtttgcctctcccctaagagcggagtctcttacgactccattatcgcctgtggcgaaccgagccagccctctatttatagaaagcctgatagccaagtgttccagtccaatgctgaccagacacacttttgcctgagcgacacccattgccttgagaactacgagaccgtgggggaagagatcatcgatgccattaaaaagtctaaatgttgggaaacagagttcacggagtacatccagtttaagcaatccgacggcgtccgcagctgccggatgaaagattccggagaatgtaccgtgacaaccaatagatggcccattatcctgtgcgacaacgataagttctattactctgagctccagaaggactatgataaagaccaggatattggccacttttgtctgagccctcgctgcaatacaatccggcatcccattaacagaaagcacatctccaattgtacctggcaggtttctcataacaatatcgacaaaattgaagtgcacgagctggaagatcttgagcaatacaagaaagctatcacgcagaagctccagacaagcctgaccctgttcaagtattccaaaaccaagaacctcccgcacattaaacctatgtacaagtatatcacaattgaggggaccgaaacagccgagggaatcgaatctgcctacatcgagagcgaaattcccgctctggcgggcacgtccatcgggtttaaaattaccagcaagtctggaaaacatcttctggacgtcatcggctacgtgaagtccgccagctattctgctgtttacacaaagctctataccacagggcctaccattgatgtgaatacgaaacacgacgagctgtgcaccggcccctgtcctgtcaacgtgccccatggaacaggctggctgaccttcgccaaggagcgcacatccagctgggggtgcgaagagtttggatgtcttgccatctctgacggctgcgttttcgggtcctgccaagatatcattaaagacgaaatcaccgtgtaccggaaggagacagaagagaccacggatgtcgagctctgtctgacattcgctgacaaaacctattgcaccaatctgaacgccattacaccgatcattaccgatcagtttgaagtgcagttcaagacggtggaggcgtacagcctccctagaatcattgctgtccggaaccacgaaatcatggttggacagatcaatgacattggcgtgtattccaaggggtgtggcaacgtgcaaaaagtcaataacacaaattacggaaacggcgtgcccaagtttgattacctgtgccatcttgccagccgcaaagaggttatcgtgagaaagtgtttcgacaatgattatcaggcctgcaaatttctgcagacccccgcttcttaccggctcgaggaagaagggggaagcgtcacagtgattgactataagaagatcctgggcaccattaaaatgaaggccatcctgggggatgttaaatacaagacattcgcggacaacgtggaccttaccgtcgaaggagtgtgtacgggctgcatcaattgttttgagaacattcactgcgaactgaccatccactccacagttgaggcttcttgtcctgtggtcagctcctgcaccgtgttccatgatcgcattctcatcacaccgaatgagcacaaatatgccattaaggtgatctgcaacgaaaagcccgggcctaccctgccctttaaaatctgttctgccaagacggacgctgccatgacactcgctgatgccaaacctattctggagcttgcgcccgtcgaccagaccacatacatcaaggaaaaagatgagagatgcaagacctggatgtgtcgggttagagacgaaggcttccaagtgatttttgagcctttcaagaatctgttcggaagctatatcggcatcttttacaccttcattatttccctcatggccatctttatcgtgatttacatcgtcctgcccatttgcttcaaactgcgcgatacacttagacagcatgaggacgcttataagcgggaaatgaaaatccgctga

SEQ ID NO: 14265 - RNA, 4323 nt, synthetic construct
  misc_feature 1..4323: note = derived and/or modified CDS sequence (opt5) from TAHV(181)__GQ386831.1__GP
  source 1..4323: mol_type = other RNA
atgatgttcgtgctgtttttcatcgccctcagcgctgcctcccccgtctaccagagatgctttcaagacggcgcgattgttaagcagaacccttctaaacaggctgtgaccgaggtgtgtctgaaggatgacgtcagcatgatcaaaacagaagcccggtatttccgcaatgccacggggacctacgctaacaatgtggccattagaaagtggcttgtttccgattggcacgactgccggccgaaaaaggtgtctggaggccatatcaacgtcattgaggtgggggatgacctgacactccacaccgaggcttatgtttgtaatgccgattgcacaatcggagtggacaaggaaaccgcgcaggtccgcctgcaaacagataccacgaaccattttgaaatcgccggcaccacagtgaaaagcgggtggttcaagtccaccacatacattacccttgaccagacgtgtgagcacctgaaagtgtcttgcggacccaagagcatccagtttcatgcttgtttcaatcagcacatgtcctgcgtcagatttctccaccggacaattctgcctggcagcatcgcctcttccatttgtcaaaacgttgagatcattatcctgaccgtgctcacactgcttatcttcattctgctcagcatcctgtctaaaacctatatttgctacatccttatgcccatttttatccctctggcttatatctacggcgtgatttacaataagtcctgtaagaaatgcaagctctgcgggctggtctatcatcccttcaccgaatgtggaacacactgcgtgtgtggcgcccgctacgagacgagcgatagaatgaaactgcatcgggcgtctgggctctgccctggatataagtccctgcgcgccgctagagttatgtgtaaaagcaagggcccggcctccatcctttctattatcaccgctgtgctgattctcacatttgtcacccccatcaacgccatggtggccggggacacacaggaaaccttcaaactggaggatcttcctgacgacatgctgagcatggctatgaaggttaatatgtactatatcatgtgcatgattaactacgcggtgacgtggtccttcatcctctgtgccctgctgattgctctcctgtttaagaaatatcagcaccggttccttaatttttacgccatgtactgccacgagtgtgatatgtatcatgaccgcagcggactgaagtacaacggcgatttcacaaataaatgcagacagtgtacctgcggccaatatggggacgccgctggactcctgacccaccggaagacatacaactgccttgtccagtataaatctaagtggctgaccaactttctcatcggctacattatcctgatgctgattaaggattccgtgctcatcgtccatgccgacgggacagatttcgaaaaatgtagcggagaggcggacatcacgtggaattgcaccggcccctttctgaaccttgggaattgtgaaaagaaacagaagaaagagtcttataacaatattgctacacaactgaagggactcgatgccatcagcgtgctggacattcctatgatctccaagattcccgaagatatcgccggcgctctgcgcttcatcgaggagcagagatcttaccacgttcagcttaccgccgaatacgctatgctcacacggtattgcgactactatacccagtttacggacaacagcggctactcccaaaccacatggagagtgtatctgcgcagccatgatttcgaggcctgtattctgtacccgaatcggcacttttgcagatgtgtcaaacacggggacaagtgcagctccagcaactgggatttcgcgaatgaaatgaaaaactattactctggaaagcagtccaaatttgacaaggatctcaatctggcccttatgagcctgcatcacgctttccgcggcacctcctctttctacatcgccaagctcctgaaagagaagaaaaacgaagacctggtgacatatgctgagaagattaaagggaagtaccctggaaatgcccttctcaaagcgatcattgattatatcaagtacatgaagggcctgaccgagatgaacaattttaaacatgacgaaatgtgggatgacttcatctttgaggttccccctacgaagtctccctccgtgcggagactggaatctagctatgatttcaaaacaaacgtcaactccaatcccagccacatttgtaagaacatcaaaaccgtggtgtgcctctctcctaagtccggggttagctacgactctattatcgcctgtggcgagccgtcccagcccagcatttatcgcaagcctgattctcaggtctttcaaagcaatgctgaccagacacacttctgcctgtccgacacccattgccttgaaaactacgagaccgtgggagaggaaatcatcgatgccattaaaaagagcaaatgttgggagacagaatttacggagtacatccagttcaagcagtctgacggcgtgcggtcctgcagaatgaaagatagcggggagtgtaccgtcacaaccaatcgctggcccattatcctgtgcgacaacgataagttttattactccgaactccaaaaggactatgataaagaccaggatattggacacttctgtctgtctcctcggtgcaatacaatcagacatcccattaaccgcaagcacatcagcaattgtacctggcaagtgaaccataataacatcgacaaaattgaggttcacgaactggaggatcttgaacagtacaagaaagctatcacgcagaagctccagacatccctgaccctgtttaagtattctaaaaccaagaatctcccgcacattaaacctatgtacaagtatatcacaattgagggcaccgagacagccgaagggatcgagagcgcctacatcgaatccgagattcccgctctggcgggaacgtctatcggcttcaaaattaccagcaagtccgggaaacatcttctggacgtgatcggctacgtcaagagcgcctcttattccgctgtgtacacaaagctctataccacaggacctaccattggcgttaacacgaaacacgatgaactgtgcaccgggccctgtcctgtgaatgtcccccatggaacaggctggctgacctttgccaaggagcggacaagctcttgggggtgcgaggagttcggatgtcttgccatctccgacggctgcgtgttcgggagctgccaggacatcattaaagatgaaatcaccgtttacagaaaggaaacagaggaaaccacggacgtggagctctgtctgacatttgctgataaaacctattgcaccaacctgaacgccattacaccgatcattaccgaccaattcgaggtccagtttaagacggtggaagcgtactctctccctcggatcattgctgtgcgcaatcacgagatcatggtcggccagatcaacgatattggagtttattccaagggctgtgggaatgtgcagaaagtgaacaatacaaactacggaaatggcgtccccaagttcgactacctgtgccatcttgccagcagaaaagaagtgatcgttcggaagtgttttgataacgactatcaagcctgcaaattcctgcagacccccgcttcctacagactcgaggaggaagggggaagcgtgacagtcattgattataagaagatcctgggcaccattaaaatgaaggccatcctgggggacgtgaaatacaagacatttgcggataatgttgaccttaccgtggagggcgtctgtacgggatgcatcaactgtttcgaaaatattcactgcgagctgaccatccactctacagtggaagctagctgtcctgttgtgtcctcttgcaccgtctttcatgaccgcattctcatcacaccgaacgagcacaaatatgccattaaggtgatctgcaatgagaagcccggccctaccctgcccttcaaaatctgtagcgccaagacggatgctgccatgacactcgctgacgccaaacctattctggaacttgcgcccgtggatcagaccacatacatcaaggagaaagacgaacggtgcaagacctggatgtgtagagtccgcgatgaggggtttcaggttattttcgaacctttcaagaacctgtttggatcctatatcggcattttctacacctttatcatttctctcatggccatcttcatcgtgatttacatcgtgctgcccatttgctttaaactgagagacacacttcggcaacatgaggatgcttataagcgcgagatgaaaatcagatga

SEQ ID NO: 14266 - RNA, 4323 nt, synthetic construct
  misc_feature 1..4323: note = derived and/or modified CDS sequence (opt5) from TAHV(236)__GQ386832.1__GP
  source 1..4323: mol_type = other RNA
atgatgttcgtgctgtttttcatcgccctcagcgctgcctcccccgtctaccagagatgctttcaagacggcgcgattgttaagcagaacccttctaaacaggctgtgaccgaggtgtgtctgaaggatgacgtcagcatgatcaaaacagaagcccggtatttccgcaatgccacggggacctacgctaacaatgtggccattagaaagtggcttgtttccgattggcacgactgccggccgaaaaaggtgtctggaggccatatcaacgtcattgaggtgggggatgacctgacactccacaccgaggcttatgtttgtaatgccgattgcacaatcggagtggacaaggaaaccgcgcaggtccgcctgcaaacagataccacgaaccattttgaaatcgccggcaccacagtgaaaagcgggtggttcaagtccaccacatacattacccttgaccagacgtgtgagcacctgaaagtgtcttgcggacccaagagcatccagtttcatgcttgtttcaatcagcacatgtcctgcgtcagatttctccaccggacaattctgcctggcagcatcgcctcttccatttgtcaaaacgttgagatcattatcctgaccgtgctcacactgcttatcttcattctgctcagcatcctgtctaaaacctatatttgctacatccttatgcccatttttatccctctggcttatatctacggcgtgatttacaataagtcctgtaagaaatgcaagctctgcgggctggtctatcatcccttcaccgaatgtggaacacactgcgtgtgtggcgcccgctacgagacgagcgatagaatgaaactgcatcgggcgtctgggctctgccctggatataagtccctgcgcgccgctagagttatgtgtaaaagcaagggcccggcctccatcctttctattatcaccgctgtgctgattctcacatttgtcacccccatcaacgccatggtggccggggacacacaggaaaccttcaaactggaggatcttcctgacgacatgctgagcatggctatgaaggttaatatgtactatatcatgtgcatgattaactacgcgatcacgtggtccttcattctctgtgccctgctgatcgctctcctgtttaagaaatatcagcaccggttccttaatttttacgccatgtactgccacgagtgtgatatgtatcatgaccgcagcggactgaagtacaacggcgatttcacaaataaatgcagacagtgtacctgcggccaatatgaagacgccgctgggctcctgacccaccggaagacatacaactgccttgtgcagtataaatctaagtggctgaccaactttctcattgtctacatcattctgatgctgatcaaggattccgtgctcatcgtccatgccgacggaacagatttcgagaaatgtagcggcgaagcggacattacgtggaattgcaccgggccctttctgaaccttggaaattgtgagaagaaacagaagaaagaatcttataacaatatcgctacacaactgaagggcctcgatgccattagcgtgctggacatgcctatgatctccaagattcccgaggatatcgccggggctctgcgcttcatcgaggaacagagatcttaccacgttcagcttaccgccgagtacgctatgctcacacggtattgcgactactatacccagtttacggacaacagcggatactcccaaaccacatggagagtgtatctgcgcagccatgatttcgaagcctgtattctgtacccgaatcagcacttttgccggtgtgtcaaacacggcgacaagtgcagctccagcaactgggatttcgcgaatgagatgaaaaactattactctggcaagcagtccaaatttgacaaggatctcaatctggcccttatgagcctgcatcacgctttcagagggacctcctctttctacatcgccaagctcctgaaagaaaagaaaaacgaggacctggtgacatatgctgagaagattaaaggaaagtaccctggcaatgcccttctcaaagcgatcattgattatatcaagtacatgaaggacctgaccgaaatgaacaattttaaacatgatgagatgtgggacgatttcatctttgaagttccccctacgaagtctccctccgtgcgccggctggagtctagctatgacttcaaaacaaacgtcaactccaatcccagccacatttgtaagaacatcaaaaccgtgatttgcctctctcctaagtccggggtgagctacgattctatcattgcctgtggagaaccgtcccagcccagcatctatagaaagcctgactctcaagtttttcagagcaatgctgaccagacacacttctgcctgtccgatacccattgccttgagaactacgagaccgtcggcgaagagatcattgacgccatcaaaaagagcaaatgttgggaaacagagctgacggagtacattcagtttaagcaatctgatggggtgcgctcctgccggatgaaagacagcggcgaatgtaccgtgacaaccaatagatggcccatcattctctgcgataacgacaagttctattactccgagctgcagaaggattatgacaaagatcaggacatcggacacttttgtctgtctcctcgctgcaatacaattcggcatcccatcaacagaaagcacatcagcaattgtacctggcaggtctcccataacaatattgataaaatcgaagtgcacgagcttgaagacctcgagcaatacaagaaagctattacgcagaagctgcagacatctctgaccctcttcaagtatagcaaaaccaagaacctgccgcacatcaaacctatgtacaagtatattacaatcgagggcaccgaaacagccgaggggatcgaatccgcctacattgagtctgaaatccccgctcttgcgggaacgagcattggctttaaaatcacctccaagagcgggaaacatctgctcgatgttattggatacgtgaagtctgcctcctatagcgctgtctacacaaagctgtataccacaggccctaccatcggggtgaatacgaaacacgacgagctgtgcaccggcccctgtcctgttaacgtgccccatggaacaggctggcttaccttcgccaaggagcgcacatcttcctgggggtgcgaagagtttggatgtctcgccatcagcgacggctgcgtcttcgggtcttgccaagatattatcaaagacgaaattaccgtgtaccggaaggagacagaagagaccacggatgttgagctgtgtctgacattcgctgacaaaacctattgcaccaatctcaacgccatcacaccgattatcaccgatcagtttgaagtgcagttcaagacggtcgaggcgtactccctgcctagaattatcgctgtgcggaaccacgaaatcatggtgggacagattaatgacatcggcgtctatagcaaggggtgtggcaacgttcaaaaagtgaataacacaaattacggaaacggcgtgcccaagtttgattacctttgccatctggcctcccgcaaagaggtcattgtgagaaagtgtttcgacaatgattatcaggcctgcaaatttctccagacccccgctagctaccggctggaggaagaggggtctagcgttacagtgatcgactataagaagattctgggaaccatcaaaatgaaggccatccttggcgatgtcaaatacaagacattcgcggacaacgtggacctgaccgttgaaggggtgtgtacgggatgcattaattgttttgagaacatccactgcgaactcaccattcactccacagtcgaggcttcttgtcctgtggttagctcctgcaccgtgttccatgatagaatcctgattacaccgaatgagcacaaatatgccatcaaggtcatctgcaacgaaaagcccggccctaccctcccctttaaaatttgttctgccaagacggacgctgccatgacactggctgatgccaaacctatccttgagctggcgcccgtggaccagaccacatacattaaggaaaaagatgagcgctgcaagacctggatgtgtcgggtgagagacgaagggttccaagtcatctttgagcctttcaagaatctcttcggcagctatattggaatcttttacaccttcattatctccctgatggccatctttattgttatctacattgtgctgcccatctgcttcaaacttcgcgatgctctgagacagcatgaggacgcctataagcgggaaatgaaaattcgctga

SEQ ID NO: 14267 - RNA, 4323 nt, synthetic construct
  misc_feature 1..4323: note = derived and/or modified CDS sequence (opt5) from TAHV(29)__GQ386823.1__GP
  source 1..4323: mol_type = other RNA
atgatgttcgtgctgtttttcatcgccctcagcgctgcctcccccgtctaccagagatgctttcaagacggcgcgattgttaagcagaacccttctaaacaggctgtgaccgaggtgtgtctgaaggatgacgtcagcatgatcaaaacagaagcccggtatttccgcaatgccacggggacctacgctaacaatgtggccattagaaagtggcttgtttccgattggcacgactgccggccgaaaaaggtgtctggaggccatatcaacgtcattgaggtgggggatgacctgacactccacaccgaggcttatgtttgtaatgccgattgcacaatcggagtggacaaggagaccgcgcaggtccgcctgcaaacagataccacgaaccattttgaaatcgccggcaccacagtgaaaagcgggtggttcaagtccaccacatacattacccttgaccagacgtgtgagcacctgaaagtgtcttgcggacccaagagcatccagtttcatgcttgtttcaatcagcacatgtcctgcgtcagatttctccaccggacaattctgcctggcagcatcgcctcttccatttgtcaaaacgttgagatcattatcctgaccgtgctcacactgcttatcttcattctgctcagcatcctgtctaaaacctatatttgctacatccttatgcccatttttatccctctggcttatatctacggcgtgatttacaataagtcctgtaagaaatgcaagctctgcgggctggtctatcatcccttcaccgaatgtggaacacactgcgtgtgtggcgcccgctacgagacgagcgatagaatgaaactgcatcgggcgtctgggctctgccctggatataagtccctgcgcgccgctagagttatgtgtaaaagcaagggcccggcctccatcctttctattatcaccgctgtgctgattctcacatttgtcacccccatcaacgccatggtggccggggacacacaggaaaccttcaaactggaggatcttcctgacgacatgctgagcatggctatgaaggttaatatgtactatatcatgtgcatgattaactacgcggtgacgtggtccttcatcctctgtgccctgctgattgctctcctgtttaagaaatatcagcaccggttccttaatttttacgccatgtactgccacgagtgtgatatgtatcatgaccgcagcggactgaagtacaacggcgatttcacaaataaatgcagacagtgtacctgcggccaatatgaagacgccgctgggctcctgacccaccggaagacatacaactgccttgtccagtataaatctaagtggctgaccaactttctcatcgtgtacattatcctgatgctgattaaggattccgtcctcatcgtgcatgccgacggaacagatttcgagaaatgtagcggcgaagcggacatcacgtggaattgcaccgggccctttctgaaccttggaaattgtgagaagaaacagaagaaagaatcttatgataacattgctacacaactgaagggcctcgacgccatcagcgttctggatattcctatgatctccaagattcccgaggacatcgccggggctctgcgcttcatcgaggaacagagatcttaccacgtgcagcttaccgccgagtacgctatgctcacacggtattgcgactactatacccagtttacggataatagcggatactcccaaaccacatggagagtctatctgcgcagccatgacttcgaagcctgtattctgtacccgaaccagcacttttgccggtgtgtgaaacacggcgataagtgcagctccagcaattgggacttcgcgaacgagatgaaaaattattactctggcaagcagtccaaatttgataaggacctcaacctggcccttatgagcctgcatcacgctttcagagggacctcctctttctacatcgccaagctcctgaaagaaaagaaaaatgaggatctggttacatatgctgagaagattaaaggaaagtaccctggcaacgcccttctcaaagcgatcattgactatatcaagtacatgaaggatctgaccgaaatgaataactttaaacatgacgagatgtgggatgacttcatctttgaagtgccccctacgaagtctccctccgtccgccggctggagtctagctatgatttcaaaacaaatgtgaactccaaccccagccacatttgtaagaatatcaaaaccgtggtttgcctctctcctaagtccggggtcagctacgactctattatcgcctgtggagaaccgtcccagcccagcatttatagaaagcctgactctcaagtgtttcagagcaacgctgatcagacacacttctgcctgtccgacacccattgccttgagaattacgagaccgtgggcgaagagatcatcgatgccattaaaaagagcaaatgttgggaaacagagtttacggagtacatccagttcaagcaatctgacggggtccgctcctgccggatgaaagatagcggcgaatgtaccgtgacaaccaacagatggcccattatcctgtgcgacaatgataagttttattactccgagctccagaaggactatgataaagaccaggatattggacacttctgtctgtctcctcgctgcaacacaatccggcatcccattaatagaaagcacatcagcaactgtacctggcaggtttcccataataacatcgacaaaattgaagtgcacgagctggaagatcttgagcaatacaagaaagctatcacgcagaagctccagacatctctgaccctgtttaagtatagcaaaaccaagaatctcccgcacattaaacctatgtacaagtatatcacaattgagggcaccgaaacagccgaggggatcgaatccgcctacatcgagtctgaaattcccgctctggcgggaacgagcatcggcttcaaaattacctccaagagcgggaaacatcttctggacgtcatcggatacgtgaagtctgcctcctatagcgctgtttacacaaagctctataccacaggccctaccattggggtgaacacgaaacacgacgagctgtgcaccggcccctgtcctgtcaatatgccccatggaacaggctggctgacctttgccaaggagcgcacatcttcctgggggtgcgaagagttcggatgtcttgccatcagcgatggctgcgtgttcgggtcttgccaagacatcattaaagatgaaatcaccgtttaccggaaggagacagaagagaccacggacgtggagctctgtctgacatttgctgataaaacctattgcaccaacctgaatgccattacaccgatcattaccgaccagttcgaagtccagtttaagacggtggaggcgtactccctccctagaatcattgctgtgcggaaccacgaaatcatggtcggacagatcaacgatattggcgtttatagcaaggggtgtggcaatgtgcaaaaagtgaacaatacaaactacggaaatggcgtccccaagttcgactacctgtgccatcttgcctcccgcaaagaggtgatcgttagaaagtgttttgataacgactatcaggcctgcaaattcctgcagacccccgctagctaccggctcgaggaagaagggggatctgtgacagtcattgattataagaagatcctgggcaccattaaaatgaaggccatcctgggggacgtgaaatacaagacatttgcggacaatgttgatcttaccgtggaaggagtctgtacgggctgcatcaactgtttcgagaatattcactgcgaactgaccatccacagcacagtggaggcttcctgtcctgttgtgtctagctgcaccgtctttcatgaccgcattctcatcacaccgaacgagcacaaatatgccattaaggtgatctgcaatgaaaagcccgggcctaccctgcccttcaaaatctgttccgccaagacggatgtggctatgacactcgccgacgctaaacctattctggagcttgcccccgtcgatcagaccacatacatcaaggaaaaagacgagagatgcaagacctggatgtgtcgggttaaggatgaaggctttcaagtgattttcgagcctttcaaaaacctgtttggatcttatatcggcattttctacacctttatcattagcctcatggcgatcttcatcgtgatttacatcgtcctgcccatttgctttaagctgagagacacacttcgccagcatgaggatgcctataaaagagaaatgaagatccggtga

SEQ ID NO: 14268 - RNA, 4323 nt, synthetic construct
  misc_feature 1..4323: note = derived and/or modified CDS sequence (opt5) from TAHV(4019)__GQ386834.1__GP
  source 1..4323: mol_type = other RNA
atgatgttcgtgctgtttttcatcgccctcagcgctgcctcccccgtctaccagagatgctttcaagacggcgcgattgttaagcagaacccttctaaacaggctgtgaccgaggtgtgtctgaaggatgacgtcagcatgatcaaaacagaagcccggtatttccgcaatgccacggggacctacgctaacaatgtggccattagaaagtggcttgtttccgattggcacgactgccggccgaaaaaggtgtctggaggccatatcaacgtcattgaggtgggggatgacctgacactccacaccgaggcttatgtttgtaatgccgattgcacaatcggagtggacaaggaaaccgcgcaggtccgcctgcaaacagataccacgaaccattttgaaatcgccggcaccacagtgaaaagcgggtggttcaagtccaccacatacattacccttgaccagacgtgtgagcacctgaaagtgtcttgcggacccaagagcatccagtttcatgcttgtttcaatcagcacatgtcctgcgtcagatttctccaccggacaattctgcctggcagcatcgcctcttccatttgtcaaaacgttgagatcattatcctgaccgtgctcacactgcttatcttcattctgctcagcatcctgtctaaaacctatatttgctacatccttatgcccatttttatccctctggcttatatctacggcgtgatttacaataagtcctgtaagaaatgcaagctctgcgggctggtctatcatcccttcaccgaatgtggaacacactgcgtgtgtggcgcccgctacgagacgagcgatagaatgaaactgcatcgggcgtctgggctctgccctggatataagtccctgcgcgccgctagagttatgtgtaaaagcaagggcccggcctccatcctttctattatcaccgctgtgctgattctcacatttgtcacccccatcaacgccatggtggccggggacacacaggaaaccttcaaactggaggatcttcctgacgacatgctgagcatggctatgaaggttaatatgtactatatcatgtgcatgattaactacgcggtgacgtggtccttcatcctctgtgccctgctgattgctctcctgtttaagaaatatcagcaccggttccttaatttttacgccatgtactgccacgagtgtgatatgtatcatgaccgcagcggactgaagtacaacggcgatttcacaaataaatgcagacagtgtacctgcggccaatatgaagacgccgctgggctcctgacccaccggaagacatacaactgccttgtccagtataaatctaagtggctgaccaactttctcatcgtgtacattatcctgatgctgattaaggattccgtcctcatcgtgcatgccgacggaacagatttcgagaaatgtagcggcgaagcggacatcacgtggaattgcaccgggccctttctgaaccttggaaattgtgagaagaaacagaagaaagaatcttataacaatattgctacacaactgaagggcctcgatgccatcagcgttctggacattcctatgatctccaagattcccgaggatatcgccggggctctgcgcttcatcgaggaacagagatcttaccacgtgcagcttaccgccgagtacgctatgctcacacggtattgcgactactatacccagtttacggacaacagcggatactcccaaaccacatggagagtctatctgcgcagccatgatttcgaagcctgtattctgtacccgaatcggcacttttgcagatgtgtgaaacacggcgacaagtgcagctccagcaactgggatttcgcgaatgagatgaaaaactattactctggcaagcagtccaaatttgacaaggatctcaatctggcccttatgagcctgcatcacgctttccgcgggacctcctctttctacatcgccaagctcctgaaagaaaagaaaaacgaggacctggttacatatgctgagaagattaaaggaaagtaccctggcaatgcccttctcaaagcgatcattgattatatcaagtacatgaaggacctgaccgaaatgaacaattttaaacatgatgagatgtgggacgatagcatcttcgaagtgccccctacgaagtccccctctgtccggagactggagagctcctatgactttaaaacaaacgtgaacagcaatccctctcacatttgtaagaacatcaaaaccgtggtttgcctctcccctaagagcggggtctcttacgattccattatcgcctgtggagaaccgagccagccctctatttatcgcaagcctgacagccaggtgttccaatccaatgctgaccagacacacttttgcctgagcgatacccattgccttgagaactacgaggccgtgggcgaagagatcatcgacgctattaaaaagtctaaatgttgggaaaccgagttcacagagtacatccagtttaagcagtccgatggggtccggagctgcagaatgaaagactccggcgaatgtacggtgaccacaaatcgctggcccattatcctgtgcgataacgacaagttctattactctgagctccaaaaggattatgacaaagatcaggacattggacacttttgtctgagccctcggtgcaataccatcagacatcccattaaccgcaagcacatctccaattgtacatggcaggtttctcataacaatatcgataaaattgaagtgcacgagctggaagaccttgagcagtacaagaaagccatcacccaaaagctccagacgagcctgacactgttcaagtattccaaaaccaagaacctcccgcacattaaacctatgtacaagtatatcaccattgagggcacagaaaccgccgaggggatcgaatctgcttacatcgagagcgaaattcccgcgctggccggaacatccatcggctttaaaattacgagcaagtctgggaaacatcttctggatgtcatctcctacgtgaagtctgcttcttattccgccgtttacaccaagctctatacaaccggacctacaattggcgtgaataccaaacacgacgagctgtgcacggggccctgtcctgtcaacgtgccccatggcaccggatggatcacattcgccaaggagcggaccagctcttggggctgcgaagagtttgggtgtctggctatctccgacggatgcgttttcggcagctgccaggatattatcaaagacgaaattacagtgtacagaaaggagaccgaagagacaaccgatgtcgagctttgtctcacgttcgccgacaaaacatattgcaccaatctgaacgcgatcaccccgattatcacagatcaatttgaagtgcagttcaagaccgtggaggcttactccctgcctcggattatcgccgtccgcaaccacgaaatcatggttgggcagattaatgacatcggagtgtatagcaagggctgtgggaacgtgcagaaagtcaataacacgaattacggcaacggagtgcccaagtttgattacctctgccatctggcctctagaaaagaggttattgtgcggaagtgtttcgacaatgattatcaggcttgcaaatttcttcaaacacccgccagctacagactggaggaagagggcgggtccgtcaccgtgatcgactataagaagattctcggaacaatcaaaatgaaggcgatcctgggcgatgttaaatacaagaccttcgctgacaacgtggacctgacagtcgaaggggtgtgtaccggatgcattaattgttttgagaacatccactgcgaacttacgattcactctaccgttgaggccagctgtcctgtggtctcctcttgcacagtgttccatgatcgcatcctgattaccccgaatgagcacaaatatgccatcaaggtgatctgcaacgaaaagcccggccctacactcccctttaaaatttgtagcgctaagaccgacgccgctatgacgctggccgatgcgaaacctatcctcgagctggcccccgtcgaccagacaacctacattaaggaaaaagatgagcggtgcaagacatggatgtgtagagttcgcgacgaagggttccaggtgatctttgagcctttcaagaatcttttcggctcctatattggaatcttttacaccttcattatctctctgatggctatctttattgtgatctacattgtcctccccatctgcttcaaactgagagataccctgcggcaacatgaggacgcctataagcgcgaaatgaaaattagatga

SEQ ID NO: 14269 - RNA, 4323 nt, synthetic construct
  misc_feature 1..4323: note = derived and/or modified CDS sequence (opt5) from TAHV(4020)__GQ386835.1__GP
  source 1..4323: mol_type = other RNA
atgatgttcgtgctgtttttcatcgccctcagcgctgcctcccccgtctaccagagatgctttcaagacggcgcgattgttaagcagaacccttctaaacaggctgtgaccgaggtgtgtctgaaggatgacgtcagcatgatcaaaacagaagcccggtatttccgcaatgccacggggacctacgctaacaatgtggccattagaaagtggcttgtttccgattggcacgactgccggccgaaaaaggtgtctggaggccatatcaacgtcattgaggtgggggatgacctgacactccacaccgaggcttatgtttgtaatgccgattgcacaatcggagtggacaaggaaaccgcgcaggtccgcctgcaaacagataccacgaaccattttgaaatcgccggcaccacagtgaaaagcgggtggttcaagtccaccacatacattacccttgaccagacgtgtgagcacctgaaagtgtcttgcggacccaagagcatccagtttcatgcttgtttcaatcagcacatgtcctgcgtcagatttctccaccggacaattctgcctggcagcatcgcctcttccatttgtcaaaacgttgagatcattatcctgaccgtgctcacactgcttatcttcattctgctcagcatcctgtctaaaacctatatttgctacatccttatgcccatttttatccctctggcttatatctacggcgtgatttacaataagtcctgtaagaaatgcaagctctgcgggctggtctatcatcccttcaccgaatgtggaacacactgcgtgtgtggcgcccgctacgagacgagcgatagaatgaaactgcatcgggcgtctgggctctgccctggatataagtccctgcgcgccgctagagttatgtgtaaaagcaagggcccggcctccatcctttctattatcaccgctgtgctgattctcacatttgtcacccccatcaacgccatggtggccggggacacacaggaaaccttcaaactggaggatcttcctgacgacatgctgagcatggctatgaaggttaatatgtactatatcatgtgcatgattaactacgcggtgacgtggtccttcatcctctgtgccctgctgattgctctcctgtttaagaaatatcagcaccggttccttaatttttacgccatgtactgccacgagtgtgatatgtatcatgaccgcagcggactgaagtacaacggcgatttcacaaataaatgcagacagtgtacctgcggccaatatgaagacgccgctgggctcctgacccaccggaagacatacaactgccttgtccagtataaatctaagtggctgaccaactttctcatcgtgtacattatcctgatgctgattaaggattccgtcctcatcgtgcatgccgacggaacagatttcgagaaatgtagcggcgaagcggacatcacgtggaattgcaccgggccctttctgaaccttggaaattgtgagaagaaacagaagaaagaatcttataacaatattgctacacaactgaagggcctcgatgccatcagcgttctggacattcctatgatctccaagattcccgaggatatcgccggggctctgcgcttcatcgaggaacagagatcttaccacgtgcagcttaccgccgagtacgctatgctcacacggtattgcgactactatacccagtttacggacaacagcggatactcccaaaccacatggagagtctatctgcgcagccatgatttcgaagcctgtattctgtacccgaatcagcacttttgccggtgtgtgaaacacggcgacaagtgttcttccagcaactgggatttcgcgaatgagatgaaaaactattactctggcaagcagtccaaatttgacaaggatctcaatctggcccttatgagcctgcatcacgctttcagagggacctcctctttctacatcgccaagctcctgaaagaaaagaaaaacgaggacctggttacatatgctgagaagattaaaggaaagtacagcggcaatgcccttctcaaagcgatcattgattatatcaagtacatgaaggggctgaccgaaatgaacaattttaaacatgacgagatgtgggatgacttcatctttgaagtgcctccccctaagtccccctctgtccgccggctggagagctcctatgatttcaaaacgaacgtgaacagcaatccctctcacatttgcaagaacatcaaaacagtggtttgcctctcccctaagagcggagtctcttacgactccattatcgcctgtggcgaaccgagccagccctctatttatagaaagcctgatagccaagtgtttcagtccaatgctgaccagacccacttctgcctgagcgacacacattgccttgagaactacgagaccgtgggggaagagatcatcgatgccattaaaaagtctaaatgttgggaaaccgagtttacagagtacatccagttcaagcaatccgacggcgtccgcagctgccggatgaaagattccggagaatgtacggtgaccacaaatagatggcccattatcctgtgcgacaacgataagttttattactctgagctccagaaggactatgataaagaccaggatattggccacttctgtctgagccctcgctgcaataccatccggcatcccattaacagaaagcacatctccaattgtacatggcaggtttctcataacaatatcgacaaaattgaagtgcacgagctggaagatcttgagcaatacaagaaagctatcacccagaagctccagacgagcctgacactgtttaagtattccaaaaccaagaacctcccgcacattaaacctatgtacaagtatatcaccattgaggggacagaaaccgccgagggaatcgaatctgcctacatcgagagcgaaattcccgctctggcgggcacatccatcgggttcaaaattacgagcaagtctggaaaacatcttctggacgtcatcggctacgtgaagtccgccagctattctgctgtttacaccaagctctatacaaccgggcctacaattggcgtgaataccaaacacgatgagctgtgcacgggaccctgtcctgtcaacgtgccccatggcaccgggtggctgacatttgccaaggagcgcacctccagctggggatgcgaagagttcggctgtcttgccatctctgacgggtgcgttttcggatcctgccaagacatcattaaagatgaaatcacagtgtaccggaaggagaccgaagagacaaccgacgtcgagctctgtctgacgtttgctgataaaacatattgcaccaatctgaacgccattaccccgatcattacagaccagttcgaagtgcagtttaagaccgtggaggcgtacagcctccctagaatcattgctgtccggaaccacgaaatcatggttggccagatcaatgatattggggtgtattccaagggctgtggaaacgtgcaaaaagtcaataacacgaattacggcaacggggtgcccaagttcgactacctgtgccatcttgccagccgcaaagaggttatcgtgagaaagtgttttgataatgactatcaggcctgcaaattcctgcagacacccgcttcttaccggctcgaggaagagggaggcagcgtcaccgtgattgattataagaagatcctggggacaattaaaatgaaggccatcctgggagacgttaaatacaagacctttgcggataacgtggaccttacagtcgaaggcgtgtgtaccgggtgcatcaattgtttcgagaacattcactgcgaactgacgatccactccaccgttgaggcttcttgtcctgtggtcagctcctgcacagtgtttcatgaccgcattctcatcaccccgaatgagcacaaatatgccattaaggtgatctgcaacgaaaagcccggccctacactgcccttcaaaatctgttctgccaagaccgatgctgccatgacgctcgctgacgccaaacctattctggagcttgcgcccgtcgatcagacaacctacatcaaggaaaaagacgagagatgcaagacatggatgtgtcgggttagagatgaaggatttcaagtgattttcgagcctttcaagaatctgtttggcagctatatcgggattttctacacctttatcatttccctcatggccatcttcatcgtgatttacatcgtcctgcccatttgctttaaactgcgcgacacccttagacagcatgaggatgcttataagcgggaaatgaaaatccgctga

SEQ ID NO: 14270 - RNA, 4323 nt, synthetic construct
  misc_feature 1..4323: note = derived and/or modified CDS sequence (opt5) from TAHV(4030)__GQ386836.1__GP
  source 1..4323: mol_type = other RNA
atgatgttcgtgctgtttttcatcgccctcagcgctgcctcccccgtctaccagagatgctttcaagacggcgcgattgttaagcagaacccttctaaacaggctgtgaccgaggtgtgtctgaaggatgacgtcagcatgatcaaaacagaagcccggtatttccgcaatgccacggggacctacgctaacaatgtggccattagaaagtggcttgtttccgattggcacgactgccggccgaaaaaggtgtctggaggccatatcaacgtcattgaggtgggggatgacctgacactccacaccgaggcttatgtttgtaatgccgattgcacaatcggagtggacaaggagaccgcgcaggtccgcctgcaaacagataccacgaaccattttgaaatcgccggcaccacagtgaaaagcgggtggttcaagtccaccacatacattacccttgaccagacgtgtgagcacctgaaagtgtcttgcggacccaagagcatccagtttcatgcttgtttcaatcagcacatgtcctgcgtcagatttctccaccggacaattctgcctggcagcatcgcctcttccatttgtcaaaacgttgagatcattatcctgaccgtgctcacactgcttatcttcattctgctcagcatcctgtctaaaacctatatttgctacatccttatgcccatttttatccctctggcttatatctacggcgtgatttacaataagtcctgtaagaaatgcaagctctgcgggctggtctatcatcccttcaccgaatgtggaacacactgcgtgtgtggcgcccgctacgagacgagcgatagaatgaaactgcatcgggcgtctgggctctgccctggatataagtccctgcgcgccgctagagttatgtgtaaaagcaagggcccggcctccatcctttctattatcaccgctgtgctgattctcacatttgtcacccccatcaacgccatggtggccggggacacacaggaaaccttcaaactggaggatcttcctgacgacatgctgagcatggctatgaaggttaatatgtactatatcatgtgcatgattaactacgcggtgacgtggtccttcatcctctgtgccctgctgattgctctcctgtttaagaaatatcagcaccggttccttaatttttacgccatgtactgcaacgagtgtgatatgtatcacgaccgcagcggactgaagtacaatggcgatttcacaaacaaatgcagacagtgtacctgcggccaatatgaagacgccgctgggctcctgacccatcggaagacatacaactgccttgtccagtataaatctaagtggctgaccaattttctcatcgtgtacattatcctgatgctgattaaggattccgtcctcatcgtgcacgccgacggaacagatttcgagaaatgtagcggcgaagcggacatcacgtggaactgcaccgggccctttctgaatcttggaaactgtgagaagaaacagaagaaagaatcttataataacattgctacacaactgaagggcctcgatgccatcagcgttctggacattcctatgatctccaagattcccgaggatatcgccggggctctgcgcttcatcgaggaacagagatcttaccatgtgcagcttaccgccgagtacgctatgctcacacggtattgcgactactatacccagtttacggacaatagcggatactcccaaaccacatggagagtctatctgcgcagccacgatttcgaagcctgtattctgtacccgaaccagcatttttgccggtgtgtgaaacacggcgacaagtgcagctccagcaattgggatttcgcgaacgagatgaaaaattattactctggcaagcagtccaaatttgacaaggatctcaacctggcccttatgagcctgcaccatgctttcagagggacctcctctttctacatcgccaagctcctgaaagaaaagaaaaatgaggacctgattacatatgctgagaagatcaaaggaaagtaccctggcaacgcccttctcaaagcgattatcgattatatcaagtacatgaaggacctgaccgaaatgaataactttaaacacgatgagatgtgggacgatttcatttttgaagttccccctacgaagtctccctccgtgcgccggctggagtctagctatgacttcaaaacaaacgtcaattccaaccccagccatatctgtaagaatattaaaaccgtggtgtgcctctctcctaagtccggggttagctacgattctatcattgcctgtggagaaccgtcccagcccagcatctatagaaagcctgactctcaagtctttcagagcaacgctgaccagacacacttctgcctgtccgatacccactgccttgagaattacgagaccgtgggcgaagagatcattgacgccatcaaaaagagcaaatgttgggaaacagagtttacggagtacattcagttcaagcaatctgatggggtgcgctcctgccggatgaaagacagcggcgaatgtaccgtcacaaccaacagatggcccatcattctgtgcgataatgacaagttttattactccgagctccagaaggattatgacaaagatcaggacatcggacatttctgtctgtctcctcgctgcaacacaattcggcaccccatcaatagaaagcatatcagcaactgtacctggcaagtgtcccacaataacattgataaaatcgaagttcatgagctggaagaccttgagcagtacaagaaagctattacgcagaagctccagacatctctgaccctgtttaagtatagcaaaaccaagaatctcccgcacatcaaacctatgtacaagtatattacaatcgagggcaccgaaacagccgaggggatcgaatccgcctacattgagtctgaaatccccgctctggcgggaacgagcattggcttcaaaatcacctccaagagcgggaaacaccttctggatgtgattggatacgtcaagtctgcctcctatagcgctgtgtacacaaagctctataccacaggccctaccatcggggttaacacgaaacatgacgagctgtgcaccggcccctgtcctgtgaatgtcccccacggaacaggctggctgacctttgccaaggagcgcacatcttcctgggggtgcgaagagttcggatgtcttgccatcagcgacggctgcgtgttcgggtcttgccaagatattatcaaagacgaaattatcgtttaccggaaggagaccgaagagacaaccgatgtggagctctgtctgacgtttgctgacaaaacatattgcaccaacctgaacgccattaccccgatcattacagatcagttcgaagtccagtttaagaccgtggaggcgtactccctccctagaatcatcgctgtgcggaatcatgaaattatggtcggacagatcaacgacattggcgtttatagcaaggggtgtggcaatgtgcaaaaagtgaacaatacgaactacggaaatggcgtccccaagttcgattacctgtgccaccttgcctcccgcaaagaggtgatcgttagaaagtgttttgacaacgattatcaggcctgcaaattcctgcagacacccgctagctaccggctcgaggaagaagggggatctgtgaccgtcattgactataagaagatcctgggcacaatcaaaatgaaggccattctgggggatgtgaaatacaagacctttgcggacaatgttgaccttacagtggaaggagtctgtaccggctgcgtgaactgtttcgagaatatccattgcgaactgacgattcacagcaccgttgaggcttcctgttctgtggtcagctcctgcacagtgtttcacgatagaatcctcattacccctaacgagcataaatatgccatcaaggtgatctgcaatgaaaagccggggcccacactgcctttcaaaatttgttctgccaagaccgacgctgccatgacgctcgctgatgccaaacccatcctggagcttgcgcctgtcgaccagacaacctacattaaggaaaaagatgagcgctgcaagacatggatgtgtcgggttagagacgaaggctttcaagtgatcttcgagcccttcaagaacctgtttggaagctatattggcatcttctacacctttattatctccctcatggccatcttcattgtgatctacattgtcctgcctatctgctttaaactgcgcgatacccttagacagcacgaggacgcttataagcgggaaatgaaaattcgctga

SEQ ID NO: 14271 - RNA, 4323 nt, synthetic construct
  misc_feature 1..4323: note = derived and/or modified CDS sequence (opt5) from TAHV(4033)__GQ386837.1__GP
  source 1..4323: mol_type = other RNA
atgatgttcgtgctgtttttcatcgccctcagcgctgcctcccccgtctaccagagatgctttcaagacggcgcgattgttaagcagaacccttctaaacaggctgtgaccgaggtgtgtctgaaggatgacgtcagcatgatcaaaacagaagcccggtatttccgcaatgccacggggacctacgctaacaatgtggccattagaaagtggcttgtttccgattggcacgactgccggccgaaaaaggtgtctggaggccatatcaacgtcattgaggtgggggatgacctgacactccacaccgaggcttatgtttgtaatgccgattgcacaatcggagtggacaaggaaaccgcgcaggtccgcctgcaaacagataccacgaaccattttgaaatcgccggcaccacagtgaaaagcgggtggttcaagtccaccacatacattacccttgaccagacgtgtgagcacctgaaagtgtcttgcggacccaagagcatccagtttcatgcttgtttcaatcagcacatgtcctgcgtcagatttctccaccggacaattctgcctggcagcatcgcctcttccatttgtcaaaacgttgagatcattatcctgaccgtgctcacactgcttatcttcattctgctcagcatcctgtctaaaacctatatttgctacatccttatgcccatttttatccctctggcttatatctacggcgtgatttacaataagtcctgtaagaaatgcaagctctgcgggctggtctatcatcccttcaccgaatgtggaacacactgcgtgtgtggcgcccgctacgagacgagcgatagaatgaaactgcatcgggcgtctgggctctgccctggatataagtccctgcgcgccgctagagttatgtgtaaaagcaagggcccggcctccatcctttctattatcaccgctgtgctgattctcacatttgtcacccccatcaacgccatggtggccggggacacacaggaaaccttcaaactggaggatcttcctgacgacatgctgagcatggctatgaaggttaatatgtactatatcatgtgcatgattaactacgcggtgacgtggtccttcatcctctgtgccctgctgattgctctcctgtttaagaaatatcagcacggattccttaatttttacgccatgtactgccacgagtgtgatatgtatcatgaccggagcggcctgaagtacaacggcgatttcacaaataaatgccgccagtgtacctgcgggcaatatgaagacgccgctggactcctgacccacagaaagacatacaactgccttgtccagtataaatctaagtggctgaccaactttctcatcgtgtacattatcctgatgctgattaaggattccgtcctcatcgtgcatgccgacggcacagatttcgagaaatgtagcggggaagcggacatcacgtggaattgcaccggaccctttctgtctcttggcaactgtgagaagaaacagaagaaagaaagctataataacattgctacacaactgaaggggctcgatgccatctccgttctggacattcctatgatctctaagattcccgaggatatcgccggagctctgcggttcatcgaggaacagcgcagctaccacgtgcagcttaccgccgagtacgctatgctcacaagatattgcgactactatacccagtttacggacaattccggctacagccaaaccacatggcgggtctatctgagatctcatgatttcgaagcctgtattctgtacccgaaccagcacttttgccgctgtgtgaaacacggcgacaagtgctccagctctaattgggatttcgcgaacgagatgaaaaattattactccgggaagcagagcaaatttgacaaggatctcaacctggcccttatgtccctgcatcacgctttccggggaacctctagcttctacatcgccaagctcctgaaagaaaagaaaaatgaggacctggttacatatgctgagaagattaaaggcaagtaccctgggaacgcccttctcaaagcgatcattgattatatcaagtacatgaaggacctgaccgaaatgaataactttaaacatgatgagatgtgggacgatttcatctttgaagtgccccctacgaagtccccctctgtcagacgcctggagagctcctatgacttcaaaacaaatgtgaacagcaacccctctcacatttgtaagaatatcaaaaccgtggtttgcctctcccctaagagcggagtctcttacgattccattatcgcctgtggcgaaccgagccagccctctatttatcggaagcctgacagccaagtgtttcagtccaacgctgaccagacacacttctgcctgagcgatacccattgccttgagaattacgagaccgtgggggaagagatcatcgacgccattaaaaagtctaaatgttgggaaacagagtttacggagtacatccagttcaagcaatccgatggcgtcagaagctgccgcatgaaagactccggagaatgtaccgtgacaaccaaccggtggcccattatcctgtgcgataatgacaagttttattactctgagctccagaaggattatgacaaagatcaggacattggccacttctgtctgagccctagatgcaacacaatccgccatcccattaatcggaagcacatctccaactgtacctggcaggtttctcataataacatcgataaaattgaagtgcacgagctggaagaccttgagcaatacaagaaagctatcacgcagaagctccagacaagcctgaccctgtttaagtattccaaaaccaagaatctcccgcacattaaacctatgtacaagtatatcacaattgaggggaccgaaacagccgagggaatcgaatctgcctacatcgagagcgaaattcccgctctggcgggcacgtccatcgggttcaaaattaccagcaagtctggaaaacatcttctggatgtcatcggctacgtgaagtccgccagctattctgctgtttacacaaagctctataccacagggcctaccattggcgtgaacacgaaacacgacgagctgtgcaccggaccctgtcctgtcaatgtgccccatggcacagggtggctgacctttgccaaggagagaacatccagctggggatgcgaagagttcggctgtcttgccatctctgacgggtgcgttttcggatcctgccaagatatcattaaagacgaaatcaccgtgtaccgcaaggagacagaagagaccacggatgtcgagctctgtctgacatttgctgacaaaacctattgcaccaacctgaatgccattacaccgatcattaccgatcagttcgaagtgcagtttaagacggtggaggcgtacagcctccctcggatcattgctgtcagaaaccacgaaatcatggttggccagatcaacgacattggggtgtattccaagggctgtggaaatgtgcaaaaagtcaacaatacaaactacggcaatggggtgcccaagttcgattacctgtgccatcttgccagccggaaagaggttatcgtgcgcaagtgttttgacaacgattatcaggcctgcaaattcctgcagacccccgcttcttacagactcgaggaagagggaggcagcgtcacagtgattgactataagaagatcctggggaccattaaaatgaaggccatcctgggagatgttaaatacaagacatttgcggacaatgtggaccttaccgtcgaaggcgtgtgtacggggtgcatcaactgtttcgagaatattcactgcgaactgaccatccactccacagttgaggcttcttgtcctgtggtcagctcctgcaccgtgtttcatgatcggattctcatcacaccgaacgagcacaaatatgccattaaggtgatctgcaatgaaaagcccggccctaccctgcccttcaaaatctgttctgccaagacggacgctgccatgacactcgctgatgccaaacctattctggagcttgcgcccgtcgaccagaccacatacatcaaggaaaaagatgagagatgcaagacctggatgtgtcgcgttcgggacgaaggatttcaagtgattttcgagcctttcaagaacctgtttggcagctatatcgggattttctacacctttatcatttccctcatggccatcttcatcgtgatttacatcgtcctgcccatttgctttaaactgagagatacacttcgccagcatgaggacgcttataagagagaaatgaaaatccggtga

SEQ ID NO: 14272 - RNA, 4323 nt, synthetic construct
  misc_feature 1..4323: note = derived and/or modified CDS sequence (opt5) from TAHV(4034)__GQ386838.1__GP
  source 1..4323: mol_type = other RNA
atgatgttcgtgctgtttttcatcgccctcagcgctgcctcccccgtctaccagagatgctttcaagacggcgcgattgttaagcagaacccttctaaacaggctgtgaccgaggtgtgtctgaaggatgacgtcagcatgatcaaaacagaagcccggtatttccgcaatgccacggggacctacgctaacaatgtggccattagaaagtggcttgtttccgattggcacgactgccggccgaaaaaggtgtctggaggccatatcaacgtcattgaggtgggggatgacctgacactccacaccgaggcttatgtttgtaatgccgattgcacaatcggagtggacaaggagaccgcgcaggtccgcctgcaaacagataccacgaaccattttgaaatcgccggcaccacagtgaaaagcgggtggttcaagtccaccacatacattacccttgaccagacgtgtgagcacctgaaagtgtcttgcggacccaagagcatccagtttcatgcttgtttcaatcagcacatgtcctgcgtcagatttctccaccggacaattctgcctggcagcatcgcctcttccatttgtcaaaacgttgagatcattatcctgaccgtgctcacactgcttatcttcattctgctcagcatcctgtctaaaacctatatttgctacacccttatgcccatctttattcctctggcttatatctacggcgtgatctacaataagtcctgtaagaaatgcaagctctgcgggctggtctatcatcccttcacagaatgtggaacgcactgcgtgtgtggcgcccgctacgagaccagcgatagaatgaaactgcatcgggcgtctgggctctgccctggatataagtccctgcgcgccgctagagttatgtgtaaaagcaagggcccggcctccattctttctatcattacagctgtgctgatcctcacctttgtcacacccattaacgccatggtggccggggacacccaggaaacgttcaaactggaggatcttcctgacgacatgctgagcatggctatgaaggttaatatgtactatatcatgtgcatgatcaactacgcggtgacatggtccttcattctctgtgccctgctgatcgctctcctgtttaagaaatatcagcaccggttccttaatttttacgccatgtactgccacgagtgtgatatgtatcatgaccgcagcggactgaagtacaacggcgatttcaccaataaatgcagacagtgtacctgcggccaatatgaagacgccgctgggctcctgacacaccggaagacctacaactgccttgtccagtataaatctaagtggctgacaaactttctcattgtgtacatcattctgatgctgatcaaggattccattctcatcgtccatgccgacggaacggatttcgagaaatgtagcggcgaagcggacatcacctggaattgcacagggccctttctgaaccttggaaattgtgagaagaaacagaagaaagaatcttataacaatattgctacccaactgaagggcctcgatgccatcagcgtgctggacattcctatgatctccaagattcccgaggatatcgccggggctctgcgcttcatcgaggaacagagatcttaccacgttcagcttacagccgagtacgctatgctcacccggtgctgtgactattacacgcagtttaccgacaacagcggatattcccaaacaacctggagagtgtacctgcgcagccatgatttcgaagcctgcattctgtatccgaatcagcacttttgtcggtgcgtcaaacacggcaacaagtgttcttccagcaattgggacttcgcgaacgagatgaaaaattactattctggcaagcagtccaaatttgataaggacctcaacctggcccttatgagcctgcatcacgctttcagagggacatcctctttctacatcgccaagctcctgaaagaaaagaaaaatgaggatctggtgacctacgctgagaagattaaaggaaagtatcctggcaacgcccttctcaaagcgatcattgactacatcaagtatatgaaggatctgacggaaatgaataactttaaacatgacgagatgtgggatgacttcatctttgaagttccccctacaaagagcccctccgtgcgccggctggagtctagctacgatttcaaaaccaacgtcaattccaaccccagccacatttgcaagaatatcaaaacagtggtgtgtctctctcctaagtccggggttagctatgactctattatcgcctgcggagaaccgtcccagcccagcatttacagaaagcctgattctcaagtctttcagagcaacaccgaccagacccacttctgcctgtccgacacacattgtcttgagaattatgaggctgtgggcgaagagatcatcgatgccattaaaaagagcaaatgctgggaaacggagtttaccgagtacatccagttcaagcaatctgacggggtgcgctcctgtcggatgaaagatagcggcgaatgcacagtcaccacaaacagatggcccattatcctgtgtgacaatgataagttttactattccgagctccagaaggactacgataaagaccaggatattggacacttctgcctgtctcctcgctgtaacaccatccggcatcccattaatagaaagcacatcagcaactgcacgtggcaagtgaatcataacaatatcgacaaaattgaagttcacgagctggaagatcttgagcagtataagaaagctatcacacagaagctccagacctccctgaccctgtttaagtactctaaaacaaagaacctcccgcacattaaacctatgtataagtacatcaccattgagggcacagaaacggccgaggggatcgaaagcgcctatatcgagtccgaaattcccgctctggcgggaacctctatcggcttcaaaattacaagcaagtccgggaaacatcttctggacgtgatcggatacgtcaagagcgcctcttactccgctgtgtataccaagctctacacaaccggccctacgattggggttaataccaaacacgatgagctgtgtacaggcccctgccctgtgaacgtcccccatggaaccggctggctgacatttgccaaggagcgcaccagctcttgggggtgtgaagagttcggatgccttgccatctccgacggctgcgtgttcgggagctgtcaagacatcattaaagatgaaatcacagtttatcggaaggagaccgaagagacgacagacgtggagctctgcctgacctttgctgataaaacctactgtacaaacctgaatgccattaccccgatcattacggaccagttcgaagtccagtttaagacagtggaggcgtattctctccctagaatcattgctgtgcggaaccacgaaatcatggtcggacagatcaatgatattggcgtttactccaaggggtgcggcaacgtgcaaaaagtgaataacaccaattatggaaacggcgtccccaagttcgactacctgtgtcatcttgccagccgcaaagaggtgatcgttagaaagtgctttgataatgactaccaggcctgtaaattcctgcagattcccgcttcctatcggctcgaggaagaagggggaagcgtgacagtcatcgattacaagaagattctgggcaccatcaaaatgaaggccatcctgggggacgtgaaatataagacatttgcggataacgttgaccttaccgtggaaggagtctgcacgggctgtattaattgcttcgagaacatccactgtgaactgaccattcactctacagtggaggctagctgccctgttgtgtcctcttgcaccgtctttcatgacagaatcctcattacaccgaatgagcacaaatacgccatcaaggtgatctgtaacgaaaagcccgggcctaccctgcccttcaaaatttgcagcgccaagacggatgctgccatgacactcgctgacgccaaacctatcctggagcttgcgcccgtggatcagaccacatatattaaggaaaaagacgagcgctgtaagacctggatgtgccgggtcagagatgaaggctttcaagttatcttcgagcctttcaagaatctgtttggatcctacattggcatcttctatacctttattatctctctcatggccatcttcattgtgatctacattgtgctgcccatctgttttaaactgcgcgacacacttagacagcatgaggatgcttacaagcgggaaatgaaaattcgctga
